(12) United States Patent
Bentwich

(10) Patent No.: US 7,759,478 B1
(45) Date of Patent: Jul. 20, 2010

(54) BIOINFORMATICALLY DETECTABLE VIRAL REGULATORY GENES

(75) Inventor: Itzhak Bentwich, Kfar Daniel (IL)

(73) Assignee: Rosetta Genomics Ltd., Rehovot (IL)

( * ) Notice: Subject to any disclaimer, the term of this patent is extended or adjusted under 35 U.S.C. 154(b) by 484 days.

(21) Appl. No.: 10/604,984

(22) Filed: Aug. 29, 2003

Related U.S. Application Data

(60) Provisional application No. 60/457,788, filed on Mar. 27, 2003.

(51) Int. Cl.
*C07H 21/04* (2006.01)
*A61K 31/70* (2006.01)

(52) U.S. Cl. .......... 536/24.5; 536/23.1; 514/44

(58) Field of Classification Search ............ None
See application file for complete search history.

(56) References Cited

U.S. PATENT DOCUMENTS

| | | | | |
|---|---|---|---|---|
| 5,624,803 | A * | 4/1997 | Noonberg et al. | 435/6 |
| 6,136,603 | A * | 10/2000 | Dean et al. | 435/375 |
| 6,703,491 | B1 * | 3/2004 | Homburger et al. | 536/23.1 |
| 6,849,431 | B2 * | 2/2005 | Okamoto et al. | 435/91.2 |
| 2002/0086356 | A1 | 7/2002 | Tuschl et al. | |

FOREIGN PATENT DOCUMENTS

| | | |
|---|---|---|
| WO | WO 01/68836 | 9/2001 |
| WO | WO 02/44321 | 6/2002 |
| WO | WO 02/094185 | 11/2002 |
| WO | WO 01/75164 | 2/2003 |

OTHER PUBLICATIONS

Krutzfeldt et al. Nature Genetics 2006 vol. 38, pp. S14-S19.*
John et al. PLoS Biology 2004, vol. 2, pp. 1862-1879.*
Lee, R. C., R. L. Feinbaum and V. Ambros. The C. elegans heterochronic gene lin-4 encodes small RNAs with antisense complementarity to lin-14 Cell Dec. 3, 1993 843-854 75.
Wightman, B., I. Ha and G. Ruvkun. Posttranscriptional regulation of the heterochronic gene lin-14 by lin-4 mediates temporal pattern formation in C. elegans Cell Dec. 3, 1993 855-862 75.
Gallinaro, H., L. Domenjoud and M. Jacob. Structural study of the 5' end of a synthetic premessenger RNA from adenovirus. Evidence for a long-range exon-intron interaction J Mol Biol Jul. 15, 1994 205-225 240.
Lu, C. and R. Bablanian. Characterization of small nontranslated polyadenylylated RNAs in vaccinia virus infected cells Proc Natl Acad Sci U S A Mar. 5, 1996 2037-2042 93.
Crawford, E. D., E. P. Deantoni, R. Etzioni, V. C. Schaefer, R. M. Olson and C. A. Ross. Serum prostate-specific antigen and digital rectal examination for early detection of prostate cancer in a national community-based program. The Prostate Cancer Education Council Urology Jun. 1996 863-869 47.
Engdahl HM, Hjalt TA, Wagner EG. A two unit antisense RNA cassette test system for silencing of target genes. Nucleic Acids Res. Aug. 15, 1997 3218-27 25.

Smith, D. S., P. A. Humphrey and W. J. Catalona. The early detection of prostate carcinoma with prostate specific antigen: the Washington University experience Cancer Nov. 1, 1997 1852-1856 80.
Dsouza, M., N. Larsen and R. Overbeek. Searching for patterns in genomic data Trends Genet Dec. 1997 497-498 13.
Moss, E. G., R. C. Lee and V. Ambros. The cold shock domain protein LIN-28 controls developmental timing in C. elegans and is regulated by the lin-4 RNA Cell 1997 637 88.
Fire, A., S. Xu, M. K. Montgomery, S. A. Kostas, S. E. Driver and C. C. Mello. Potent and specific genetic interference by double-stranded RNA in Caenorhabditis elegans Nature Feb. 19, 1998 806-811 391.
Waterhouse, P. M., M. W. Graham and M. B. Wang. Virus resistance and gene silencing in plants can be induced by simultaneous expression of sense and antisense RNA Proc Natl Acad Sci U S A Nov. 10, 1998 13959-13964 95.
Ngo, H., C. Tschudi, K. Gull and E. Ullu. Double-stranded RNA induces mRNA degradation in *Trypanosoma brucei* Proc Natl Acad Sci U S A Dec. 8, 1998 14687-14692 95.
Verma, S. And F. Eckstein. Modified oligonucleotides: synthesis and strategy for users Annu Rev Biochem 1998 99-134 67.
Wuchty, S., W. Fontana, I. L. Hofacker and P. Schuster. Complete suboptimal folding of RNA and the stability of secondary structures Biopolymers Feb. 1999 145-165 49.
Mathews, D. H., J. Sabina, M. Zuker and D. H. Turner. Expanded sequence dependence of thermodynamic parameters improves prediction of RNA secondary structure J Mol Biol May 21, 1999 911-940 288.
Chang, P. L. Encapsulation for somatic gene therapy Ann N Y Acad Sci Jun. 18, 1999 146-158 875.
Zhang, M. Q. Large-scale gene expression data analysis: a new challenge to computational biologists Genome Res Aug. 1999 681-688. 9.
Grisaru, D., M. Sternfeld, A. Eldor, D. Glick and H. Soreq. Structural roles of acetylcholinesterase variants in biology and pathology Eur J Biochem Sep. 1999 672-686 264.
Fire, A. RNA-triggered gene silencing Trends Genet Sep. 1999 358-363 15.
Tabara, H., M. Sarkissian, W. G. Kelly, J. Fleenor, A. Grishok, L. Timmons, A. Fire and C. C. Mello. The rde-1 gene, RNA interference, and transposon silencing in C. elegans Cell Oct. 15, 1999 123-132 99.

(Continued)

*Primary Examiner*—Tracy Vivlemore
(74) *Attorney, Agent, or Firm*—Polsinelli Shughart PC; Teddy C. Scott, Jr.

(57) ABSTRACT

The present invention relates to a group of novel viral RNA regulatory genes, here identified as "viral genomic address messenger genes" or "VGAM genes", and as "genomic record" or "GR" genes. VGAM genes selectively inhibit translation of known host target genes, and are believed to represent a novel pervasive viral attack mechanism. GR genes encode an operon-like cluster of VGAM genes. VGAM and viral GR genes may therefore be useful in diagnosing, preventing and treating viral disease. Several nucleic acid molecules are provided respectively encoding several VGAM genes, as are vectors and probes, both comprising the nucleic acid molecules, and methods and systems for detecting VGAM genes, and for counteracting their activity.

6 Claims, 20 Drawing Sheets

OTHER PUBLICATIONS

Ryo, A., Y. Suzuki, K. Ichiyama, T. Wakatsuki, N. Kondoh, A. Hada, M. Yamamoto and N. Yamamoto. Serial analysis of gene expression in HIV-1-infected T cell lines FEBS Lett Nov. 26, 1999 182-186 462.

Olsen, P. H. and V. Ambros. The lin-4 regulatory RNA controls developmental timing in Caenorhabditis elegans by blocking LIN-14 protein synthesis after the initiation of translation Dev Biol Dec. 15, 1999 671-680 216.

Tuschl, T., P. D. Zamore, R. Lehmann, D. P. Bartel and P. A. Sharp. Targeted mRNA degradation by double-stranded RNA in vitro Genes Dev Dec. 15, 1999 3191-3197 13.

Reinhart, B. J., F. J. Slack, M. Basson, A. E. Pasquinelli, J. C. Bettinger, A. E. Rougvie, H. R. Horvitz and G. Ruvkun. The 21-nucleotide let-7 RNA regulates developmental timing in *Caenorhabditis elegans* Nature Feb. 24, 2000 901-906 403.

Pitt, J. N. J. A. Schisa and J. R. Priess. P granules in the germ cells of *Caenorhabditis elegans* adults are associated with clusters of nuclear pores and contain RNA Dev Biol Mar. 15, 2000 315-333 219.

Hammond, S. M., E. Bernstein, D. Beach and G. J. Hannon. An RNA-directed nuclease mediates post-transcriptional gene silencing in Drosophila cells Nature Mar. 16, 2000 293-296 404.

Slack, F. J., M. Basson, Z. Liu, V. Ambros, H. R. Horvitz and G. Ruvkun. The lin-41 RBCC gene acts in the C. elegans heterochronic pathway between the let-7 regulatory RNA and the LIN-29 transcription factor Mol Cell Apr. 2000 659-669 5.

Fortier, E. and J. M. Belote. Temperature-dependent gene silencing by an expressed inverted repeat in Drosophila Genesis Apr. 2000 240-244 26.

Mourrain, P., C. Beclin, T. Elmayan, F. Feuerbach, C. Godon, J. B. Morel, D. Jouette, A. M. Lacombe, S. Nikic, N. Picault, K. Remoue, M. Sanial, T. A. Vo and H. Vaucheret. Arabidopsis SGS2 and SGS3 genes are required for posttranscriptional gene silencing and natural virus resistance Cell May 26, 2000 533-542 101.

Sijen, T. and J. M. Kooter. Post-transcriptional gene-silencing: RNAs on the attack or on the defense? Bioessays Jun. 2000 520-531 22.

Brenner, S., M. Johnson, J. Bridgham, G. Golda, D. H. Lloyd, D. Johnson, S. Luo, S. McCurdy, M. Foy, M. Ewan, R. Roth, D. George, S. Eletr, G. Albrecht, E. Vermaas, S. R. Williams, K. Moon, T. Burcham, M. Pallas, R. B. Dubridge, J. Kirchner, K. Fearon, J. Mao and K. Corcoran. Gene expression analysis by massively parallel signature sequencing (MPSS) on microbead arrays Nat Biotechnol Jun. 2000 630-634 18.

Ryo, A., Y. Suzuki, M. Arai, N. Kondoh, T. Wakatsuki, A. Hada, M. Shuda, K. Tanaka, C. Sato, M. Yamamoto and N. Yamamoto. Identification and characterization of differentially expressed mRNAs in HIV type 1-infected human T cells AIDS Res Hum Retroviruses Jul. 1, 2000 995-1005 16.

Nilsson, M., G. Barbany, D. O. Antson, K. Gertow and U. Landegren. Enhanced detection and distinction of RNA by enzymatic probe ligation Nat Biotechnol Jul. 2000 791-793 18.

Kent, W. J. and A. M. Zahler. Conservation, regulation, synteny, and introns in a large-scale C. briggsae-C. elegans genomic alignment Genome Res Aug. 2000 1115-1125 10.

Kennerdell, J. R. and R. W. Carthew. Heritable gene silencing in Drosophila using double-stranded RNA Nat Biotechnol Aug. 2000 896-898 18.

Smith, N. A., S. P. Singh, M. B. Wang, P. A. Stoutjesdijk, A. G. Green and P. M. Waterhouse. Total silencing by intron-spliced hairpin RNAs Nature Sep. 21, 2000 319-320 407.

Voinnet, O., C. Lederer and D. C. Baulcombe. A viral movement protein prevents spread of the gene silencing signal in Nicotiana benthamiana Cell Sep. 29, 2000 157-167 103.

Mette MF, Aufsatz W, van der Winden J, Matzke MA, Matzke AJ. Transcriptional silencing and promoter methylation triggered by double-stranded RNA. EMBO J. Oct. 2, 2000 5194-201 19.

Yang, D., H. Lu and J. W. Erickson. Evidence that processed small dsRNAs may mediate sequence-specific mRNA degradation during RNAi in Drosophila embryos Curr Biol Oct. 5, 2000 1191-1200 10.

Anandalakshmi, R., R. Marathe, X. Ge, J. M. Herr, Jr., C. Mau, A. Mallory, G. Pruss, L. Bowman and V. B. Vance. A calmodulin-related protein that suppresses posttranscriptional gene silencing in plants Science Oct. 6, 2000 142-144 290.

Fagard, M., S. Boutet, J. B. Morel, C. Bellini and H. Vaucheret. AGO1, QDE-2, and RDE-1 are related proteins required for post-transcriptional gene silencing in plants, quelling in fungi, and RNA interference in animals Proc Natl Acad Sci U S A Oct. 10, 2000 11650-11654 97.

Pasquinelli, A. E., B. J. Reinhart, F. Slack, M. Q. Martindale, M. I. Kuroda, B. Maller, D. C. Hayward, E. E. Ball, B. Degnan, P. Muller, J. Spring, A. Srinivasan, M. Fishman, J. Finnerty, J. Corbo, M. Levine, P. Leahy, E. Davidson and G. Ruvkun. Conservation of the sequence and temporal expression of let-7 heterochronic regulatory RNA Nature Nov. 2, 2000 86-89 408.

Llave, C., K. D. Kasschau and J. C. Carrington. Virus-encoded suppressor of posttranscriptional gene silencing targets a maintenance step in the silencing pathway Proc Natl Acad Sci U S A Nov. 21, 2000 13401-13406 9.

Cogoni, C. and G. Macino. Post-transcriptional gene silencing across kingdoms Curr Opin Genet Dev Dec. 2000 638-643 10.

Elbashir, S. M., W. Lendeckel and T. Tuschl. RNA interference is mediated by 21- and 22-nucleotide RNAs Genes Dev Jan. 15, 2001 188-200 15.

Bernstein, E., A. A. Caudy, S. M. Hammond and G. J. Hannon. Role for a bidentate ribonuclease in the initiation step of RNA interference Nature Jan. 18, 2001 363-366 409.

Vaucheret, H. and M. Fagard. Transcriptional gene silencing in plants: targets, inducers and regulators Trends Genet Jan. 2001 29-35 17.

Thomas, C. L., L. Jones, D. C. Baulcombe and A. J. Maule. Size constraints for targeting post-transcriptional gene silencing and for RNA-directed methylation in *Nicotiana benthamiana* using a potato virus X vector Plant J Feb. 2001 417-425 25.

Galyam, N., D. Grisaru, M. Grifman, N. Melamed-Book, F. Eckstein, S. Seidman, A. Eldor and H. Soreq. Complex host cell responses to antisense suppression of ACHE gene expression Antisense Nucleic Acid Drug Dev Feb. 2001 51-57 11.

Sharp, P. A. RNA interference—2001 Genes Dev Mar. 1, 2001 485-490 15.

Mallory, A. C., L. Ely, T. H. Smith, R. Marathe, R. Anandalakshmi, M. Fagard, H. Vaucheret, G. Pruss, L. Bowman and V. B. Vance. HC-Pro suppression of transgene silencing eliminates the small RNAs but not transgene methylation or the mobile signal Plant Cell Mar. 2001 571-583 13.

Matzke, M. A., A. J. Matzke, G. J. Pruss and V. B. Vance. RNA-based silencing strategies in plants Curr Opin Genet Dev Apr. 2001 221-227 11.

Schisa, J. A., J. N. Pitt and J. R. Priess. Analysis of RNA associated with P granules in germ cells of C. elegans adults Development Apr. 2001 1287-1298 128.

Di Serio, F., H. Schob, A. Iglesias, C. Tarina, E. Bouldoires and F. Meins, Jr. Sense- and antisense-mediated gene silencing in tobacco is inhibited by the same viral suppressors and is associated with accumulation of small RNAs Proc Natl Acad Sci U S A May 22, 2001 6506-6510 98.

Elbashir, S. M., J. Harborth, W. Lendeckel, A. Yalcin, K. Weber and T. Tuschl. Duplexes of 21-nucleotide RNAs mediate RNA interference in cultured mammalian cells Nature May 24, 2001 494-498 411.

Piccin, A., A. Salameh, C. Benna, F. Sandrelli, G. Mazzotta, M. Zordan, E. Rosato, C. P. Kyriacou and R. Costa. Efficient and heritable functional knock-out of an adult phenotype in Drosophila using a GAL4-driven hairpin RNA incorporating a heterologous spacer Nucleic Acids Res Jun. 15, 2001 E55-55 29.

Vance, V. and H. Vaucheret. RNA silencing in plants—defense and counterdefense Science Jun. 22, 2001 2277-2280 292.

Argaman, L., R. Hershberg, J. Vogel, G. Bejerano, E. G. Wagner, H. Margalit and S. Altuvia. Novel small RNA-encoding genes in the intergenic regions of *Escherichia coli* Curr Biol Jun. 26, 2001 941-950 11.

Grishok, A., A. E. Pasquinelli, D. Conte, N. Li, S. Parrish, I. Ha, D. L. Baillie, A. Fire, G. Ruvkun and C. C. Mello. Genes and mechanisms related to RNA interference regulate expression of the small temporal RNAs that control C. elegans developmental timing Cell Jul. 13, 2001 23-34.

Hutvagner, G., J. McLachlan, A. E. Pasquinelli, E. Balint, T. Tuschl and P. D. Zamore. A cellular function for the RNA-interference enzyme Dicer in the maturation of the let-7 small temporal RNA Science Aug. 3, 2001 834-838 293.

Hammond, S. M., S. Boettcher, A. A. Gaudy, R. Kobayashi and G. J. Hannon. Argonaute2, a link between genetic and biochemical analyses of RNAi Science Aug. 10, 2001 1146-1150 293.

Vaucheret, H., C. Beclin and M. Fagard. Post-transcriptional gene silencing in plants J Cell Sci Sep. 2001 3083-3091 114.
Wesley, S. V., C. A. Helliwell, N. A. Smith, M. B. Wang, D. T. Rouse, Q. Liu, P. S. Gooding, S. P. Singh, D. Abbott, P. A. Stoutjesdijk, S. P. Robinson, A. P. Gleave, A. G. Green and P. M. Waterhouse. Construct design for efficient, effective and high-throughput gene silencing in plants Plant J Sep. 2001 581-590 27.
Mattick, J. S. and M. J. Gagen. The evolution of controlled multitasked gene networks: the role of introns and other noncoding RNAs in the development of complex organisms Mol Biol Evol Sep. 2001 1611-1630 18.
Carter, R. J., I. Dubchak and S. R. Holbrook. A computational approach to identify genes for functional RNAs in genomic sequences Nucleic Acids Res Oct. 1, 2001 3928-3938 29.
Moss, E. G. RNA interference: it's a small RNA world Curr Biol Oct. 2, 2001 R772-775 11.
Ketting, R. F., S. E. Fischer, E. Bernstein, T. Sijen, G. J. Hannon and R. H. Plasterk. Dicer functions in RNA interference and in synthesis of small RNA involved in developmental timing in C. elegans Genes Dev Oct. 15, 2001 2654-2659 15.
Ruvkun, G. Molecular biology. Glimpses of a tiny RNA world Science Oct. 26, 2001 797-799 294.
LEE, R. C. and V. Ambros. An extensive class of small RNAs in Caenorhabditis elegans Science Oct. 26, 2001 862-864 294.
Lau, N. C., L. P. Lim, E. G. Weinstein and D. P. Bartel. An abundant class of tiny RNAs with probable regulatory roles in Caenorhabditis elegans Science Oct. 26, 2001 858-862 294.
Lagos-Quintana, M., R. Rauhut, W. Lendeckel and T. Tuschl. Identification of novel genes coding for small expressed RNAs Science Oct. 26, 2001 853-858 294.
Itaya, A., A. Folimonov, Y. Matsuda, R. S. Nelson and B. Ding. Potato spindle tuber viroid as inducer of RNA silencing in infected tomato Mol Plant Microbe Interact Nov. 2001 1332-1334 14.
Mattick, J. S. Non-coding RNAs: the architects of eukaryotic complexity EMBO Rep Nov. 2001 986-991 2.
Elbashir, S. M., J. Martinez, A. Patkaniowska, W. Lendeckel and T. Tuschl. Functional anatomy of siRNAs for mediating efficient RNAi in Drosophila melanogaster embryo lysate Embo J Dec. 3, 2001 6877-6888 20.
Ambros, V. microRNAs: tiny regulators with great potential Cell Dec. 28, 2001 823-826 107.
Blaszczyk, J., J. E. Tropea, M. Bubunenko, K. M. Routzahn, D. S. Waugh, D. L. Court and X. Ji. Crystallographic and modeling studies of RNase III suggest a mechanism for double-stranded RNA cleavage Structure Dec. 2001 1225-1236 9.
Crete, P., S. Leuenberger, V. A. Iglesias, V. Suarez, H. Schob, H. Holtorf, S. Van Eeden and F. Meins. Graft transmission of induced and spontaneous post-transcriptional silencing of chitinase genes Plant J Dec. 2001 493-501 28.
Smallridge, R. A small fortune Nat Rev Mol Cell Biol Dec. 2001 867 2.
Eddy, S. R. Non-coding RNA genes and the modern RNA world Nat Rev Genet Dec. 2001 919-929 2.
Lu, C. M. miRNA bead detection Genaco Biomedical Products PHS 398 2001 1.
Matzke, M., A. J. Matzke and J. M. Kooter. RNA: guiding gene silencing 2001 1080 293.
Grosshans, H. and F. J. Slack. Micro-RNAs: small is plentiful J Cell Biol Jan. 7, 2002 17-21 156.
Meshorer, E., C. Erb, R. Gazit, L. Pavlovsky, D. Kaufer, A. Friedman, D. Glick, N. Benarie and H. Soreq. Alternative splicing and neuritic mRNA translocation under long-term neuronal hypersensitivity Science Jan. 18, 2002 508-512 295.
Paddison, P. J., A. A. Gaudy and G. J. Hannon. Stable suppression of gene expression by RNAi in mammalian cells Proc Natl Acad Sci U S A Feb. 5, 2002 1443-1448 99.
Moss, E. G. MicroRNAs: hidden in the genome Curr Biol Feb. 19, 2002 R138-140 12.
Banerjee, D. and F. Slack. Control of developmental timing by small temporal RNAs: a paradigm for RNA-mediated regulation of gene expression Bioessays Feb. 2002 119-129 24.
Elbashir, S. M., J. Harborth, K. Weber and T. Tuschl. Analysis of gene function in somatic mammalian cells using small interfering RNAs Methods Feb. 2002 199-213 26.
Han, Y. and D. Grierson. Relationship between small antisense RNAs and aberrant RNAs associated with sense transgene mediated gene silencing in tomato Plant J Feb. 2002 509-519 29.

Nicholson, R. H. and A. W. Nicholson. Molecular characterization of a mouse cDNA encoding Dicer, a ribonuclease III ortholog involved in RNA interference Mamm Genome Feb. 2002 67-73 13.
Puerta-Fernandez, E., A. Barroso-Deljesus and A. Berzal-Herranz. Anchoring hairpin ribozymes to long target RNAs by loop-loop RNA interactions Antisense Nucleic Acid Drug Dev Feb. 2002 1-9 12.
Giordano, E., R. Rendina, I. Peluso and M. Furia. RNAi triggered by symmetrically transcribed transgenes in Drosophila melanogaster Genetics Feb. 2002 637-648 160.
Martens, H., J. Novotny, J. Oberstrass, T. L. Steck, P. Postlethwait and W. Nellen. RNAi in Dictyostelium: the role of RNA-directed RNA polymerases and double-stranded RNase Mol Biol Cell Feb. 2002 445-453 13.
Mourelatos, Z., J. Dostie, S. Paushkin, A. Sharma, B. Charroux, L. Abel, J. Rappsilber M. Mann and G. Dreyfuss. miRNPs: a novel class of ribonucleoproteins containing numerous microRNAs Genes Dev Mar. 15, 2002 720-728 16.
Seggerson, K., L. Tang and E. G. Moss. Two genetic circuits repress the Caenorhabditis elegans heterochronic gene lin-28 after translation initiation Dev Biol Mar. 15, 2002 215-225 243.
Morel, J. B., C. Godon, P. Mourrain, C. Beclin, S. Boutet, F. Feuerbach, F. Proux and H. Vaucheret. Fertile hypomorphic Argonaute (ago1) mutants impaired in post-transcriptional gene silencing and virus resistance Plant Cell Mar. 2002 629-639 14.
Catalanotto, C., G. Azzalin, G. Macino and C. Cogoni. Involvement of small RNAs and role of the qde genes in the gene silencing pathway in Neurospora Genes Dev Apr. 1, 2002 790-795 16.
Boutla, A., K. Kalantidis, N. Tavernarakis, M. Tsagris and M. Tabler. Induction of RNA interference in Caenorhabditis elegans by RNAs derived from plants exhibiting post-transcriptional gene silencing Nucleic Acids Res Apr. 1, 2002 1688-1694 30.
Pasquinelli, A. E. And G. Ruvkun. Control of developmental timing by micrornas and their targets Annu Rev Cell Dev Biol Epub 2002 Apr. 2, 2002 495-513 18.
Paddison, P. J., A. A. Caudy, E. Bernstein, G. J. Hannon and D. S. Conklin. Short hairpin RNAs (shRNAs) induce sequence-specific silencing in mammalian cells Genes Dev Apr. 15, 2002 948-958 16.
Beclin, C., S. Boutet, P. Waterhouse and H. Vaucheret. A branched pathway for transgene-induced RNA silencing in plants Curr Biol Apr. 16, 2002 684-688 12.
Eddy, S. R. Computational genomics of noncoding RNA genes Cell Apr. 19, 2002 137-140 109.
Lagos-Quintana, M., R. Rauhut, A. Yalcin, J. Meyer, W. Lendeckel and T. Tuschl. Identification of tissue-specific microRNAs from mouse Curr Biol Apr. 30, 2002 735-739 12.
Kent, W. J. Blat—the Blast-like alignment tool Genome Res Apr. 2002 656-664 12.
Hutvagner, G. and P. D. Zamore. RNAi: nature abhors a double-strand Curr Opin Genet Dev Apr. 2002 225-232 12.
Nilsson, M., J. Baner, M. Mendel-Hartvig, F. Dahl, D. O. Antson, M. Gullberg and U. Landegren. Making ends meet in genetic analysis using padlock probes Hum Mutat Apr. 2002 410-415 19.
Pasquinelli, A. E. MicroRNAs: deviants no longer Trends Genet Apr. 2002 171-173 18.
Lai, E. C. Micro RNAs are complementary to 3' UTR sequence motifs that mediate negative post-transcriptional regulation Nat Genet Apr. 2002 363-364 30.
Schwarz, D. S. and P. D. Zamore. Why do miRNAs live in the miRNP? Genes Dev May 1, 2002 1025-1031 16.
Brantl, S. Antisense-RNA regulation and RNA interference Biochim Biophys Acta May 3, 2002 15-25 1575.
Li, H., W. X. Li and S. W. Ding. Induction and suppression of RNA silencing by an animal virus Science May 17, 2002 1319-1321 296.
Zamore, P. D. Ancient pathways programmed by small RNAs Science May 17, 2002 1265-1269 296.
Chen, S., E. A. Lesnik, T. A. Hall, R. Sampath, R. H. Griffey, D. J. Ecker and L. B. Blyn. A bioinformatics based approach to discover small RNA genes in the Escherichia coli genome Biosystems Mar.-May 2002 157-177 65.
Lee, N. S., T. Dohjima, G. Bauer, H. Li, M. J. Li, A. Ehsani, P. Salvaterra and J. Rossi. Expression of small interfering RNAs targeted against HIV-1 rev transcripts in human cells Nat Biotechnol May 2002 500-505 20.
Draghici, S. Statistical intelligence: effective analysis of high-density microarray data Drug Discov Today Jun. 1, 2002 S55-63 7.

Silhavy, D., A. Molnar, A. Lucioli, G. Szittya, C. Hornyik, M. Tavazza and J. Burgyan. A viral protein suppresses RNA silencing and binds silencing-generated, 21- to 25-nucleotide double-stranded RNAs Embo J Jun. 17, 2002 3070-3080 21.

Ayash-Rashkovsky, M., Z. Weisman, J. Diveley, R. B. Moss, Z. Bentwich and G. Borkow. Generation of Th1 immune responses to inactivated, gp120-depleted HIV-1 in mice with a dominant Th2 biased immune profile via immunostimulatory [correction of imunostimulatory] oligonucleotides—relevance to AIDS vaccines in developing countries Vaccine. Jun. 21, 2002 2684-2692 20.

Tabara, H., E. Yigit, H. Siomi and C. C. Mello. The dsRNA binding protein RDE-4 interacts with RDE-1, DCR-1, and a DExH-box helicase to direct RNAi in *C. elegans* Cell Jun. 28, 2002 861-871 109.

Bettencourt, R., O. Terenius and I. Faye. Hemolin gene silencing by ds-RNA injected into Cecropia pupae is lethal to next generation embryos Insect Mol Biol Jun. 2002 267-271 11.

Hooper, N. M. And A. J. Turner. The search for alpha-secretase and its potential as a therapeutic approach to Alzheimer s disease Curr Med Chem Jun. 2002 1107-1119 9.

Liu, Q., S. Singh and A. Green. High-oleic and high-stearic cotton-seed oils: nutritionally improved cooking oils developed using gene silencing J Am Coll Nutr Jun. 2002 205S-211S 21.

Zeng, Y., E. J. Wagner and B. R. Cullen. Both natural and designed micro RNAs can inhibit the expression of cognate mRNAs when expressed in human cells Mol Cell Jun. 2002 1327-1333 9.

McManus, M. T., C. P. Petersen, B. B. Haines, J. Chen and P. A. Sharp. Gene silencing using micro-RNA designed hairpins Rna Jun. 2002 842-850 8.

Reinhart, B. J., E. G. Weinstein, M. W. Rhoades, B. Bartel and D. P. Bartel. MicroRNAs in plants Genes Dev Jul. 1, 2002 1616-1626 16.

McCaffrey, A. P., L. Meuse, T. T. Pham, D. S. Conklin, G. J. Hannon and M. A. Kay. RNA interference in adult mice Nature Jul. 4, 2002 38-39 418.

Hannon, G. J. RNA interference Nature Jul. 11, 2002 244-251 418.

Dennis, C. The brave new world of RNA Nature Jul. 11, 2002 122-124 418.

Jacque, J. M., K. Triques and M. Stevenson. Modulation of HIV-1 replication by RNA interference Nature Jul. 25, 2002 435-438 418.

Cullen, B. R. RNA interference: antiviral defense and genetic tool Nat Immunol Jul. 2002 597-599 3.

Ma, C. and A. Mitra. Intrinsic direct repeats generate consistent post-transcriptional gene silencing in tobacco Plant J Jul. 2002 37-49 31.

Novina, C. D., M. F. Murray, D. M. Dykxhoorn, P. J. Beresford, J. Riess, S. K. Lee, R. G. Collman, J. Lieberman, P. Shankar and P. A. Sharp. siRNA-directed inhibition of HIV-1 infection Nat Med Jul. 2002 681-686 8.

Pomerantz, R. J. RNA interference meets HIV-1: will silence be golden? Nat Med Jul. 2002 659-660 8.

Zeng, Y. and B. R. Cullen. RNA interference in human cells is restricted to the cytoplasm Rna Jul. 2002 855-860 8.

Xiang, C. C., O. A. Kozhich, M. Chen, J. M. Inman, Q. N. Phan, Y. Chen and M. J. Brownstein. Amine-modified random primers to label probes for DNA microarrays Nat Biotechnol Jul. 2002 738-742 20.

Llave, C., K. D. Kasschau, M. A. Rector and J. C. Carrington. Endogenous and silencing-associated small RNAs in plants Plant Cell Jul. 2002 1605-1619 14.

RHOADES, M. W., B. J. Reinhart, L. P. Lim, C. B. Burge, B. Bartel and D. P. Bartel. Prediction of plant microRNA targets Cell Aug. 23, 2002 513-520 110.

Hipfner, D. R., K. Weigmann and S. M. Cohen. The bantam gene regulates Drosophila growth Genetics Aug. 2002 1527-1537 161.

Liu, Q., S. P. Singh and A. G. Green. High-stearic and High-oleic cottonseed oils produced by hairpin RNA-mediated post-transcriptional gene silencing Plant Physiol Aug. 2002 1732-1743 129.

Stoutjesdijk, P. A., S. P. Singh, Q. Liu, C. J. Hurlstone, P. A. Waterhouse and A. G. Green. hpRNA-mediated targeting of the Arabidopsis FAD2 gene gives highly efficient and stable silencing Plant Physiol Aug. 2002 1723-1731 129.

Suzuma, S., S. Asari, K. Bunai, K. Yoshino; Y. Ando, H. Kakeshita, M. Fujita, K. Nakamura and K. Yamane. Identification and characterization of novel small RNAs in the aspS-yrvM intergenic region of the *Bacillus subtilis* genome Microbiology Aug. 2002 2591-2598 148.

Milligan, L., T. Forne, E. Antoine, M. Weber, B. Hemonnot, L. Dandolo, C. Brunel and G. Cathala. Turnover of primary transcripts is a major step in the regulation of mouse H19 gene expression EMBO Rep Aug. 2002 774-779 3.

Hamilton, A., O. Voinnet, L. Chappell and D. Baulcombe. Two classes of short interfering RNA in RNA silencing Embo J Sep. 2, 2002 4671-4679 21.

Lee, Y., K. Jeon, J. T. Lee, S. Kim and V. N. Kim. MicroRNA maturation: stepwise processing and subcellular localization Embo J Sep. 2, 2002 4663-4670 21.

Klahre, U., P. Crete, S. A. Leuenberger, V. A. Iglesias and F. Meins, Jr. High molecular weight RNAs and small interfering RNAs induce systemic posttranscriptional gene silencing in plants Proc Natl Acad Sci U S A Sep. 3, 2002 11981-11986 99.

Park, W., J. Li, R. Song, J. Messing and X. Chen. Carpel Factory, a Dicer homolog, and HEN1, a novel protein, act in microRNA metabolism in Arabidopsis thaliana Curr Biol Sep. 3, 2002 1484-1495 12.

Jiang, M. and J. Milner. Selective silencing of viral gene expression in HPV-positive human cervical carcinoma cells treated with siRNA, a primer of RNA interference Oncogene Sep. 5, 2002 6041-6048 21.

Martinez, J., A. Patkaniowska, H. Urlaub, R. Luhrmann and T. Tuschl. Single-stranded antisense siRNAs guide target RNA cleavage in RNAi Cell Sep. 6, 2002 563-574 110.

Allshire, R. Molecular biology. RNAi and heterochromatin—a hushed-up affair Science Sep. 13, 2002 1818-1819 297.

Reinhart, B. J. and D. P. Bartel. Small RNAs correspond to centromere heterochromatic repeats Science Sep. 13, 2002 1831 297.

Volpe, T. A., C. Kidner, I. M. Hall, G. Teng, S. I. Grewal and R. A. Martienssen. Regulation of heterochromatic silencing and histone H3 lysine-9 methylation by RNAi Science Sep. 13, 2002 1833-1837 297.

Baulcombe, D. DNA events. An RNA microcosm Science Sep. 20, 2002 2002-2003 297.

Llave, C., Z. Xie, K. D. Kasschau and J. C. Carrington. Cleavage of Scarecrow-like mRNA targets directed by a class of Arabidopsis miRNA Science Sep. 20, 2002 2053-2056 297.

Mochizuki, K., N. A. Fine, T. Fujisawa and M. A. Gorovsky. Analysis of a piwi-related gene implicates small RNAs in genome rearrangement in tetrahymena Cell Sep. 20, 2002 689-699 110.

Hutvagner, G. and P. D. Zamore. A microRNA in a multiple-turnover RNAi enzyme complex Science Sep. 20, 2002 2056-2060 297.

Coburn, G. A. and B. R. Cullen. Potent and specific inhibition of human immunodeficiency virus type 1 replication by RNA interference J Virol Sep. 2002 9225-9231 76.

Caudy, A. A., M. Myers, G. J. Hannon and S. M. Hammond. Fragile X-related protein and VIG associate with the RNA interference machinery Genes Dev Oct. 1, 2002 2491-2496 16.

Ishizuka, A., M. C. Siomi and H. Siomi. A Drosophila fragile X protein interacts with components of RNAi and ribosomal proteins Genes Dev Oct. 1, 2002 2497-2508 16.

Voinnet, O. RNA silencing: small RNAs as ubiquitous regulators of gene expression Curr Opin Plant Biol Oct. 2002 444-451 5.

Golden, T. A., S. E. Schauer, J. D. Lang, S. Pien, A. R. Mushegian, U. Grossniklaus, D. W. Meinke and A. Ray. Short Integuments1/suspensor1/Carpel Factory, a Dicer homolog, is a maternal effect gene required for embryo development in Arabidopsis Plant Physiol Oct. 2002 808-822 130.

Merkle, I., M. J. Van Ooij, F. J. Van Kuppeveld, D. H. Glaudemans, J. M. Galama, A. Henke, R. Zell and W. J. Melchers. Biological significance of a human enterovirus B-specific RNA element in the 3' nontranslated region J Virol Oct. 2002 9900-9909 76.

Froeyen, M. and P. Herdewijn. RNA as a target for drug design, the example of Tat-TAR interaction Curr Top Med Chem Oct. 2002 1123-1145 2.

Carmell, M. A., Z. Xuan, M. Q. Zhang and G. J. Hannon. The Argonaute family: tentacles that reach into RNAi, developmental control, stem cell maintenance, and tumorigenesis Genes Dev Nov. 1, 2002 2733-2742 16.

Provost, P., D. Dishart, J. Doucet, D. Frendewey, B. Samuelsson and O. Radmark. Ribonuclease activity and RNA binding of recombinant human Dicer Embo J Nov. 1, 2002 5864-5874 21.

Zhang, H., F. A. Kolb, V. Brondani, E. Billy and W. Filipowicz. Human Dicer preferentially cleaves dsRNAs at their termini without a requirement for ATP Embo J Nov. 1, 2002 5875-5885 21.

Mallory, A. C., B. J. Reinhart, D. Bartel, V. B. Vance and L. H. Bowman. A viral suppressor of RNA silencing differentially regulates the accumulation of short interfering RNAs and micro-RNAs in tobacco Proc Natl Acad Sci U S A Nov. 12, 2002 15228-15233 99.

Gottesman, S. Stealth regulation: biological circuits with small RNA switches Genes Dev Nov. 15, 2002 2829-2842 16.

Calin, G. A., C. D. Dumitru, M. Shimizu, R. Bichi, S. Zupo, E. Noch, H. Aldler, S. Rattan, M. Keating, K. Rai, L. Rassenti, T. Kipps, M. Negrini, F. Bullrich and C. M. Croce. Frequent deletions and down-regulation of micro- RNA genes miR15 and miR16 at 13q14 in chronic lymphocytic leukemia Proc Natl Acad Sci U S A Nov. 26, 2002 15524-15529 99.

Gaudilliere, B., Y. Shi and A. Bonni. RNA interference reveals a requirement for myocyte enhancer factor 2A in activity-dependent neuronal survival J Biol Chem Nov. 29, 2002 46442-46446 277.

Jones, L. Revealing micro-RNAs in plants Trends Plant Sci Nov. 2002 473-475 7.

Schauer, S. E., S. E. Jacobsen, D. W. Meinke and A. Ray. Dicer-Like1: blind men and elephants in Arabidopsis development Trends Plant Sci Nov. 2002 487-491 7.

Okazaki, Y., M. Furuno, T. Kasukawa, J. Adachi, H. Bono, S. Kondo, et al. Analysis of the mouse transcriptome based on functional annotation of 60,770 full-length cDNAs Nature Dec. 5, 2002 563-573 420.

Dennis, C. Small RNAs: the genome's guiding hand? Nature Dec. 19-26, 2002 732 420.

Uchida, N., S. Hoshino, H. Imataka, N. Sonenberg and T. Katada. A novel role of the mammalian GSPT/eRF3 associating with poly(A)-binding protein in Cap/Poly(A)-dependent translation J Biol Chem Dec. 27, 2002 50286-50292 277.

Huttenhofer, A., J. Brosius and J. P. Bachellerie. RNomics: identification and function of small, non-messenger RNAs Curr Opin Chem Biol Dec. 2002 835-843 6.

Wood, N. T. Unravelling the molecular basis of viral suppression of PTGS Trends Plant Sci 2002 384 7.

Cohen, O., C. Erb, D. Ginzberg, Y. Pollak, S. Seidman, S. Shoham, R. Yirmiya and H. Soreq. Neuronal overexpression of "readthrough" acetylcholinesterase is associated with antisense-suppressible behavioral impairments Mol Psychiatry *No date in pubmed* 2002 874-885 7.

Mlotshwa, S., O. Voinnet, M. F. Mette, M. Matzke, H. Vaucheret, S. W. Ding, G. Pruss and V. B. Vance. RNA silencing and the mobile silencing signal Plant Cell *No date in pubmed* 2002 S289-301 14 Suppl.

Tang, G., B. J. Reinhart, D. P. Bartel and P. D. Zamore. A biochemical framework for RNA silencing in plants Genes Dev Jan. 1, 2003 49-63 17.

Kawasaki, H. and K. Taira. Short hairpin type of dsRNAs that are controlled by tRNA(Val) promoter significantly induce RNAi-mediated gene silencing in the cytoplasm of human cells Nucleic Acids Res Jan. 15, 2003 700-707 31.

Ashrafi, K., F. Y. Chang, J. L. Watts, A. G. Fraser, R. S. Kamath, J. Ahringer and G. Ruvkun. Genome-wide RNAi analysis of Caenorhabditis elegans fat regulatory genes Nature Jan. 16, 2003 268-272 421.

Kamath, R. S., A. G. Fraser, Y. Dong, G. Poulin, R. Durbin, M. Gotta, A. Kanapin, N. Le Bot, S. Moreno, M. Sohrmann, D. P. Welchman, P. Zipperlen and J. Ahringer. Systematic functional analysis of the Caenorhabditis elegans genome using RNAi Nature Jan. 16, 2003 231-237 421.

Tuschl, T. Functional genomics: RNA sets the standard Nature Jan. 16, 2003 220-221 421.

Iyer, L. M., E. V. Koonin and L. Aravind. Evolutionary connection between the catalytic subunits of DNA-dependent RNA polymerases and eukaryotic RNA-dependent RNA polymerases and the origin of RNA polymerases BMC Struct Biol Jan. 28, 2003 1 3.

Shi, Y. Mammalian RNAi for the masses Trends Genet Jan. 2003 9-12 19.

Cerutti, H. RNA interference: traveling in the cell and gaining functions? Trends Genet Jan. 2003 39-46 19.

Zeng, Y. and B. R. Cullen. Sequence requirements for micro RNA processing and function in human cells Rna Jan. 2003 112-123 9.

Kawasaki, H., E. Suyama, M. Iyo and K. Taira. siRNAs generated by recombinant human Dicer induce specific and significant but target site-independent gene silencing in human cells Nucleic Acids Res Feb. 1, 2003 981-987 31.

Reiner, A., D. Yekutieli and Y. Benjamini. Identifying differentially expressed genes using false discovery rate controlling procedures Bioinformatics Feb. 12, 2003 368-375 19.

Doench, J. G., C. P. Petersen and P. A. Sharp: siRNAs can function as miRNAs Genes Dev Feb. 15, 2003 438-442 17.

Gupta, V., A. Cherkassky, P. Chatis, R. Joseph, A. L. Johnson, J. Broadbent, T. Erickson and J. Dimeo. Directly labeled mRNA produces highly precise and unbiased differential gene expression data Nucleic Acids Res Feb. 15, 2003 e13 31.

Boffelli, D., J. McAuliffe, D. Ovcharenko, K. D. Lewis, I. Ovcharenko, L. Pachter and E. M. Rubin. Phylogenetic shadowing of primate sequences to find functional regions of the human genome Science Feb. 28, 2003 1391-1394 299.

Kasschau, K. D., Z. Xie, E. Allen, C. Llave, E. J. Chapman, K. A. Krizan and J. C. Carrington P1/HC-Pro, a viral suppressor of RNA silencing, interferes with Arabidopsis development and miRNA unction Dev Cell Feb. 2003 205-217 4.

Carmell, M. A., L. Zhang, D. S. Conklin, G. J. Hannon and T. A. Rosenquist. Germline transmission of RNAi in mice Nat Struct Biol Feb. 2003 91-92 10.

Dostie, J., Z. Mourelatos, M. Yang, A. Sharma and G. Dreyfuss. Numerous microRNPs in neuronal cells containing novel microRNAs Rna Feb. 2003 180-186 9.

Lagos-Quintana, M., R. Rauhut, J. Meyer, A. Borkhardt and T. Tuschl. New microRNAs from mouse and human Rna Feb. 2003 175-179 9.

Wilson, J. A., S. Jayasena, A. Khvorova, S. Sabatinos, I. G. Rodrigue-Gervais, S. Arya, F. Sarangi, M. Harris-Brandts, S. Beaulieu and C. D. Richardson. RNA interference blocks gene expression and RNA synthesis from hepatitis C replicons propagated in human liver cells Proc Natl Acad Sci U S A Mar. 4, 2003 2783-2788 100.

Lim, L. P., M. E. Glasner, S. Yekta, C. B. Burge and D. P. Bartel. Vertebrate microRNA genes Science Mar. 7, 2003 1540 299.

Maniataki, E., A. E. Martinez De Alba, R. Sagesser, M. Tabler and M. Tsagris. Viroid RNA systemic spread may depend on the interaction of a 71-nucleotide bulged hairpin with the host protein VirP1 Rna Mar. 2003 346-354 9.

Ambros, V., B. Bartel, D. P. Bartel, C. B. Burge, J. C. Carrington, X. Chen, G. Dreyfuss, S. R. Eddy, S. Griffiths-Jones, M. Marshall, M. Matzke, G. Ruvkun and T. Tuschl. A uniform system for microRNA annotation Rna Mar. 2003 277-279 9.

Findley, S. D., M. Tamanaha, N. J. Clegg and H. Ruohola-Baker. Maelstrom, a Drosophila spindle-class gene, encodes a protein that colocalizes with Vasa and RDE1/AGO1 homolog, Aubergine, in nuage Development Mar. 2003 859-871 130.

Konforti, B. The news and you Nat Struct Biol 2003 147 10.

Stein, T. D. and J. A. Johnson. Genetic programming by the proteolytic fragments of the amyloid precursor protein: somewhere between confusion and clarity Rev Neurosci 2003 317-341 14.

Szymanski, M., M. Z. Barciszewska, M. Zywicki and J. Barciszewski. Noncoding RNA transcripts J Appl Genet 2003 1-19 44.

Lamande Sr, et al. Bethlem myopathy and engineered collagen VI triple helical deletions prevent intracellular multimer assembly and protein secretion. J Biol Chem. Jul. 30, 1999;274(31):21817-22.

* cited by examiner

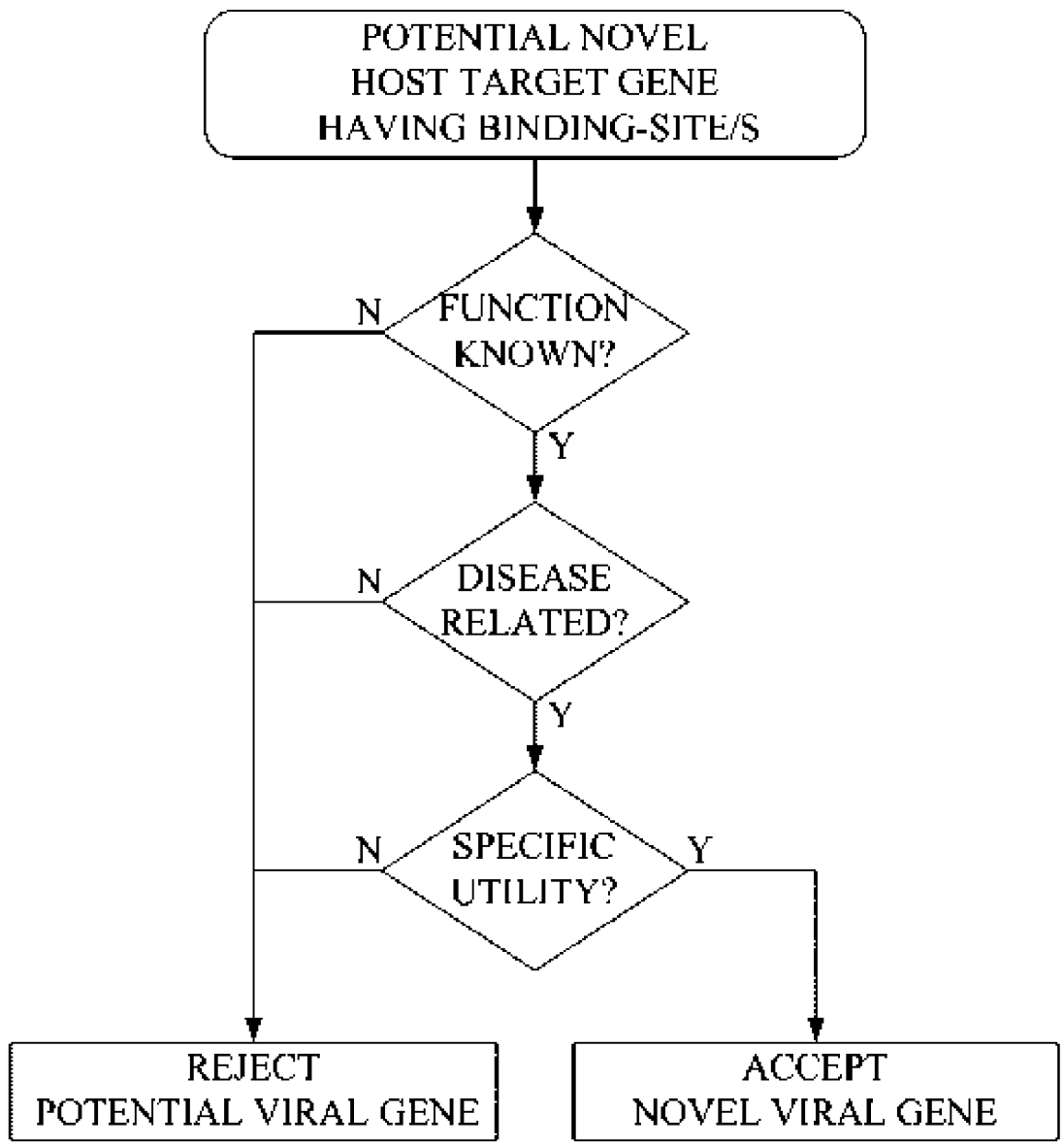

FIG. 12A

EST72223 sequence:

CCCTTATTAGAGGATTCTGCTCATGCCAGGGTGAGGTAGTAAGTTGT
ATTGTTGTGGGGTAGGGATATTAGGCCCCAATTAGAAGATAACTAT
ACAACTTACTACTTTCCCTGGTGTGTGGCATATTCACACTTAGTCTTA  MIR98
GCAGTGTTGCCTCCATCAGACAAAGTTGTAGATGTTCCTTGGATAATT
TGGACTGGAAGAAAAGAGACATGGAAGGGGACAGATGGTGTTTAGG
GTGAGGCAGATGTCATTATAAAGTGACTTGTCTTTCATTAATTGGAGC
ATATAATTATTTTACCTTTGGGCATGAACTCATTTTGCTATTCTTCAAC
TGTGTAATGATTGCATTTTATTAGTAATAGAACAGGAATGTGTGCAAG
GGAATGGAAAGCATACTTTAAGAATTTTGGGCCAGGCGCGGTGGTTC
ATGCCTGTAATCCCAGCATTTTTGGGAGGCCGAGGCGGGTGGATCA
CCTGAGGTCAGGAGTTCGAGACCAACCTGGCCAACACGGCGAAACC
CCGCCTCTACTCAAATACAAAAATTAGCCAGGCTTGGTGACACTCGC
CTGTGGTCCCAGCTACTCAGGAGGCTGAGGCAGGAGAAATTGCTTGA
ACCCAGGAAGTGGAGGCTTCAGTGAGCTGAGAACACGCCACTGCA  GAM24
CTCCAGTCCTGGGCAACAGAGCAAGACTCTGTCTCAGGAAAAAAAA
AG

FIG. 12B 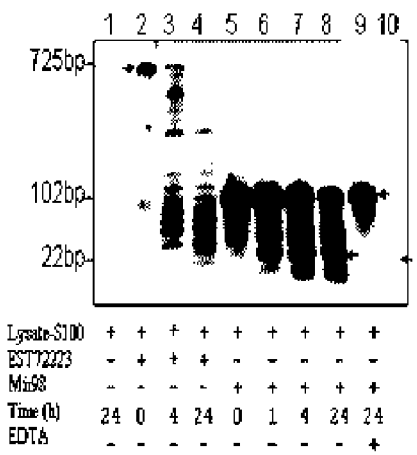 FIG. 12C 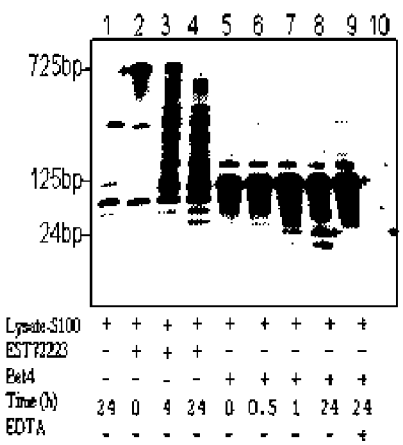

MIR98            GAM24

FIG. 12D

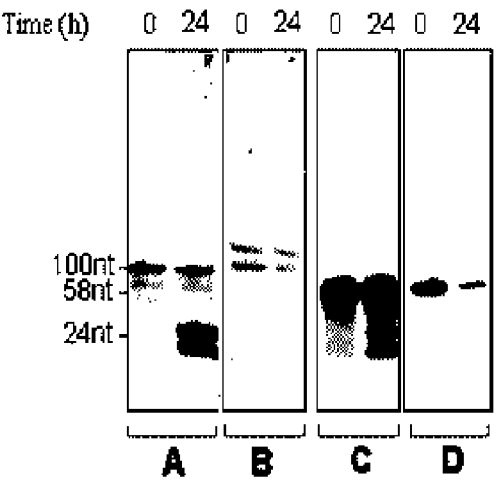

FIG. 13A

```
dbEST Id.7929020(Image4514344) sequence:
GCAAAAACTGGAAGCATTCCCTTTGAAAACTGGCACAAGACAGGGATGCCCTCT
CTCACCGCTCCTATTCAACATAGTGTTGGAAGTTCTGGCCAGGGCAATTAGGCA
GGAGAAGGAAATAAAGGGTATTCAATTAGGAAAAGAGCAAGTCAAATTGTTCCT
GTTTGCAGATGACATGATTGTATATCTAGAAAACCCCATTGTCTCAGCCCCAAA
TCTCCTTAAGCTGATAAGCAACTTCAGCAAAGTCTCAGGATACAAAATAAATGT
ACAAAAATCACAAGCATTCTTACACACCCAACAACAGAAAAACAGAGCCAAATCA
TGAGTGAACTCCCATTCACAATTGCTTCAAAGAGAATAAAATACCTAGGAATCC
AACTTACAAGGGATGTGAAGGACCTCTTCAAGGAGAACTACAAACCACTGCTCA
AGGAAATAAAAGAGGATACAAACAAATGGAAGAACATTCCATGCTCATGGGTAG
GAAGAATCAATATTGTGAAAATGGCCATACTGCCCAAGGTAATTTACAGATTCA
ATCCCATCCCCATCAAGCTACCAATGACTTTCTTCACAGAATTGGAAAAAACTA
CTTTAAAGTTCATATGGAACCAAAAAAGAGCCCGCATCGCCAAGTCAATCCTAA
GCCAAAAGAACAAAGCTGGAGGCATCACACTACCTGACTTCAAACTTTACTACA     GAM23
AGGCTACACTAACCAAAACACCATGGTACTGGTACCAAAACACAGATATACATC
AATGGAACAGAACAGAGCCCTCAGAAATAACGCCGAATACCTACAACTATCTGA
TCTTTGACAAACCTGAGAAAAACAAGCAATGGGGAAAGGATTCCCTATTTAATA
AATGGTGCTGGCAAAACTGACTAGCCATATGTAGAAAGCTGAAACTGGATCCCT
TCCTTACACCTTATACAAAAATCAATTCAAGATGGATTAAAGATTTAAACGTTA
GACCTAAACCATAAAACCCTAGAAGAAAACCTAGGCATTACCATTCAGGACA
TAGGCATGGGCAAGGACTTCATGTCCAAAACACCAAAAGCAATGGCAACAAAG
ACAAAATTGACAAATGGGATCTAATTAAACTAAAGAGCTTCTGCACAGCAAAAG
AAACTACCATCAGAGTGAACAGGCAACCTACAAAATGGGAGAAAATTTTCGCAA     GAM2
CCTACTCATCTGACAAAGGGCTAATATCCAGAATCTACAATCAACTCAAACAAA      5
TTTACAAAAAAAAAAAAAA
```

FIG. 13B

GAM25

FIG. 14A dbEST Id.1388749 (Image1020185) Sequence:

ACTCCTATCAACAGTGTAAAAGCATTCCTGTTTCTCCATAATCTTGCCAGCATCTT
TTCATTTTTTGAATTATAGCCATTCTGACTGTTGTGAGATGGTGTCTCATTCTGG
TTTTGATTTGCATTTCTCAGATGATCAGTGATGTTGAAGTTTTTTTGTTTGTTGGC
TGCATGTATGCCTTCTTTTGAAAAGTGTCTGTTTGTGTCCTTTGACCACTTTCTAA
TGGGGTTGAGTTTTTTTTCTTGTAAATTTGTTTAAGTTCCTTGTAGATGCTGGAT
ATTAGACCTTTGTCAGATGGATAGAGTGCAAAAATTTTCTCCCATTCTGTAGGTTG
TCGGTTTACTCTGTTGATAGGTTCTTAATGCTGTGCAGAAGCTCTTTAGTTTAATT
AGATCCCATTTGTCAATTTTGCCTTTTGTTCCAATTGCTTTTGCCATCTTCCTCAT
GAAATCTTTGCCCTTGCCTGTGTCCTGAATGGCATTGCCTAGGTTTTCTTCCAGGA
TTTTTATAGTTTTGGGTTGTAGATTTAAGTCTTTAATCCATCTTGAGTTAACTTTT
GTATATGGGTTAAGGAAGCGGCCCGTTTCAATTTGCTGCAAATGCCTAGCCACTTC
TCCCAGCACCATTTATTAAATAGGGAATCTTTTCCCCATTGCTTCCTTTTGTCAGG
TTTGTCAAAGATCACATGGTTGTAGGTGTGTGGTCTTATTTCTGGGTTCTCTATTC
TGTTCCATTGGGCTATGGCCCGGTTCTGTACCACCACTATGCTGTTTGGGTACCA
TAGTCTTGTAGAATGTTTGAAGCTGGGTAGCATGATGCCTCTAGCTTTGCTCTTCT
TGCTAAGAAATGTCTTGGCTATTTGGGCTCTTTTTGGTTCCATATGAATTTTAAA
ATAGCTTTTCTAGGTCTCTAAAGAATGTGAATAGTAGTTTAATGGGCCTAGCATT
TAATTTACAGATTGCCTTGGGCAGTGTGGTCATTTTCACGATATTGATCCTTCCTG
<u>TCTGTGAGCATATGTTTTTCCATTTGTTTGTGTCATCTCTGATTTCTTTGAATAAT</u>
<u>GGTTTATAGTTATCCTTGAAAAGGTCCTTCACTTTTCTTGTTAGCTGTATTCCTAG</u>
<u>ATATTATACTCTTCTTGTGGCAATTGTGAATGGGA</u>GTTAATTCATGAGTTTTCTCT GAM
CGGCTTGCCTGTTGTTGGTGTATAGGAATGCTAGTGACTTTTGCACATTGATTTTG  26
TATCCTGAGACTTTGTTCAAGTTGCTTATCAGCTAAGAAGTTTTTGAGCTGACATC
ATGGAGTTTTCTAGATATAGGATCATATCATCTGCAAACAAGATAGTTTGACTTC
CTGTCTTCCTATTTGAATAGCTTTTCTTTCTTCTTGCCTGATTGCCTTGGTGA
GAATTTCTAATACTGTGTTGAATAGGAGTGGTGAGCTCGTGCCAA

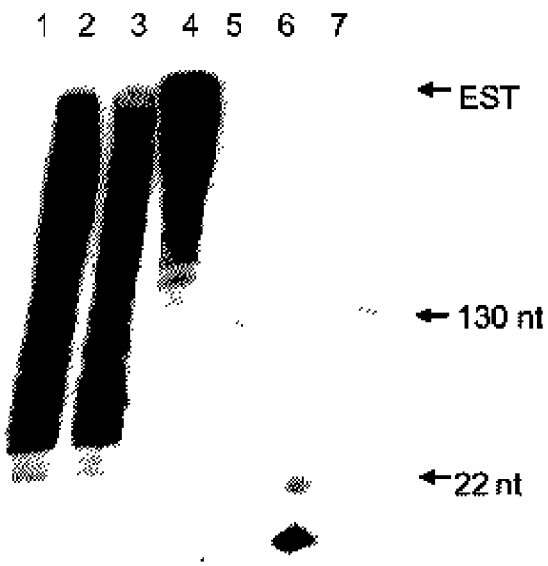

FIG. 14B

GAM26

CCCGTGGGGGGTCTTAGTGGAAGTGACGTGCTGTGAATA   SEQ ID:1917
CAGGTCCATAGCACCGCTATCCACTATGTCTCGCCCGGG

TAGCACCGCTATCCACTATGTCTC   SEQ ID: 4642

```
        T   G    TCT           -    AC            A   A
CCCG   GG  GGG       TAGTGGA  AGTG    GTGCTGTG   AT   C
||||   ||  |||       |||||||  ||||    ||||||||   ||
GGGC   CC  CTC       ATCACCT  TCGC    CACGATAC   TG   A
        -   G    TGT           A     --            C   G
```

Figure 15D/1

```
                      CT-    CACTAT
              5' TAGCACCG   ATC       GTCT  3'      SEQ ID:4642
COL6A1           ||||||||   |||       ||||
BINDING SITE1 3' ATCGTGGC   TAG       CAGA  5'      SEQ ID:7584
                      AAT    AGCTCC

CC         AT-
              5' GCA   GCTATCCACT   GTC  3'         SEQ ID:4642
SFRS1            |||   ||||||||||   |||
BINDING SITE1 3' CGT   CGATGGGTGG   CAG  5'         SEQ ID:13801
                     AA         ATT

A-   CTAT  A
              5' TAGC  CCG    CC CTATGTCTC  3'      SEQ ID:4642
HIP12            ||||  |||    || |||||||||
BINDING SITE1 3' GTCG  GGC    GG GATACAGAG  5'      SEQ ID:32922
                    CG   CC--  C

CTA    ACTA  -
              5' TAGCACCG   TCC    TG TCTC  3'      SEQ ID:4642
ZNF212           ||||||||   |||    || ||||
BINDING SITE1 3' ATCGTGGC   AGG    AC AGAG  5'      SEQ ID:14557
                         AC-    GG--  G

A   C--         A
              5' GC CCG    TATCCACT TGTCT  3'       SEQ ID:4642
FLJ20436         || |||    |||||||| |||||
BINDING SITE1 3' CG GGT    ATAGGTGA ACAGA  5'       SEQ ID:19472
                  -   TTT          C

C - A  CAC
              5' TAGCA C GCT TC    TATGTCTC  3'     SEQ ID:4642
KIAA1622         ||||| | ||| ||    |||||||||
BINDING SITE1 3' ATTGT G CGA AG    ATACAGAG  5'     SEQ ID:27766
                    A T C  TA-

ACC         C  G
              5' GC   GCTATCCA TAT TC  3'           SEQ ID:4642
LOC51312         ||   |||||||| ||| ||
BINDING SITE1 3' CG   CGATAGGT ATA AG  5'           SEQ ID:20659
                   A--         -   A

AC  C  TCCA
              5' TAGC  CG TA    CTATGTCTC  3'       SEQ ID:4642
LOC57105         ||||  || ||    |||||||||
BINDING SITE1 3' ATCG  GC AT    GATATAGAG  5'       SEQ ID:21639
                    CA  A  CAAC

CC   A
              5' GCA   GCT TCCACTATGT  3'           SEQ ID:4642
LOC146603        |||   ||| ||||||||||
BINDING SITE1 3' TGT   CGA AGGTGATACA  5'           SEQ ID:38215
                     TA   C
```

Figure 15D/2

```
              G   ATC      A
           5' ACC CT   CACT TGTCTC   3'          SEQ ID:4642
LOC145761     ||| ||   |||| ||||||
BINDING SITE1 3' TGG GA   GTGA ACAGAG  5'        SEQ ID:40584
              G   AAA     C

--  CT    CAC
           5' TAGCA  CCG ATC    TATGTCTC  3'     SEQ ID:4642
LOC202986     |||||  ||| |||    ||||||||
BINDING SITE1 3' ATCGT  GGT TAG    ATACAGAG  5'  SEQ ID:43470
                  TA   T-    CA-
```

US 7,759,478 B1

BIOINFORMATICALLY DETECTABLE VIRAL REGULATORY GENES

BACKGROUND OF INVENTION

1. Field of the Invention

The present invention relates to a group of bioinformatically detectable novel viral RNA regulatory genes, here identified as "viral genomic address messenger" or "VGAM" genes.

2. Description of Prior Art

Small RNAs are known to perform diverse cellular functions, including post-transcriptional gene expression regulation. The first two such RNA genes, Lin-4 and Let-7, were identified by genetic analysis of Caenorhabditis Elegans (Elegans) developmental timing, and were termed short temporal RNA (stRNA) (Wightman, B., Ha, I., Ruvkun, G., Cell 75, 855 (1993); Erdmann, V. A. et al., Nucleic Acids Res. 29, 189 (2001); Lee, R. C., Feinbaum, R. L., Ambros, V., Cell 75, 843 (1993); Reinhart, B. et al., Nature 403, 901 (2000)).

Lin-4 and Let-7 each transcribe a ~22 nucleotide (nt) RNA, which acts a post transcriptional repressor of target mRNAs, by binding to elements in the 3"-untranslated region (UTR) of these target mRNAs, which are complementary to the 22 nt sequence of Lin-4 and Let-7 respectively. While Lin-4 and Let-7 are expressed at different developmental stage, first larval stage and fourth larval stage respectively, both specify the temporal progression of cell fates, by triggering post-transcriptional control over other genes (Wightman, B., Ha, I., Ruvkun, G., Cell 75, 855 (1993); Slack et al., Mol. Cell 5, 659 (2000)). Let-7 as well as its temporal regulation have been demonstrated to be conserved in all major groups of bilaterally symmetrical animals, from nematodes, through flies to humans (Pasquinelli, A., et al. Nature 408, 86 (2000)).

The initial transcription product of Lin-4 and Let-7 is a ~60-80 nt RNA, the nucleotide sequence of the first half of which is partially complementary to that of its second half, therefore allowing this RNA to fold onto itself, forming a "hairpin structure". The final gene product is a ~22 nt RNA, which is "diced" from the above mentioned "hairpin structure", by an enzyme called Dicer, which also apparently also mediates the complementary binding of this ~22 nt segment to a binding site in the 3" UTR of its target gene.

Recent studies have uncovered 93 new genes in this class, now referred to as micro RNA or miRNA genes, in genomes of Elegans, Drosophilea, and Human (Lagos-Quintana, M., Rauhut, R., Lendeckel, W., Tuschl, T., Science 294, 853 (2001); Lau, N. C., Lim, L. P., Weinstein, E. G., Bartel, D. P., Science 294, 858 (2001); Lee, R. C., Ambros, V., Science 294, 862 (2001). Like the well studied Lin-4 and Let-7, all newly found MIR genes produce a ~60-80 nt RNA having a nucleotide sequence capable of forming a "hairpin structure". Expressions of the precursor ~60-80 nt RNA and of the resulting diced ~22 nt RNA of most of these newly discovered MIR genes have been detected.

Based on the striking homology of the newly discovered MIR genes to their well-studied predecessors Lin-4 and Let-7, the new MIR genes are believed to have a similar basic function as that of Lin-4 and Let-7: modulation of target genes by complementary binding to the UTR of these target genes, with special emphasis on modulation of developmental control processes. This is despite the fact that the above mentioned recent studies did not find target genes to which the newly discovered MIR genes complementarily bind. While existing evidence suggests that the number of regulatory RNA genes "may turn out to be very large, numbering in the hundreds or even thousands in each genome", detecting such genes is challenging (Ruvkun G., "Perspective: Glimpses of a tiny RNA world", Science 294, 779 (2001)).

The ability to detect novel RNA genes is limited by the methodologies used to detect such genes. All RNA genes identified so far either present a visibly discernable whole body phenotype, as do Lin-4 and Let-7 (Wightman et. al., Cell 75, 855 (1993); Reinhart et al., Nature 403, 901 (2000)), or produce significant enough quantities of RNA so as to be detected by the standard biochemical genomic techniques, as do the 93 recently detected miRNA genes. Since a limited number clones were sequenced by the researchers discovering these genes, 300 by Bartel and 100 by Tuschl (Bartel et. al., Science 294, 858 (2001); Tuschl et. al., Science 294, 853 (2001)), the RNA genes found can not be much rarer than 1% of all RNA genes. The recently detected miRNA genes therefore represent the more prevalent among the miRNA gene family.

Current methodology has therefore been unable to detect RNA genes which either do not present a visually discernable whole body phenotype, or are rare (e.g. rarer than 0.1% of all RNA genes), and therefore do not produce significant enough quantities of RNA so as to be detected by standard biochemical technique. To date, miRNA have not been detected in viruses.

SUMMARY OF INVENTION

The present invention is directed to an isolated nucleic acid wherein the sequence of the nucleic acid consists of the sequence of SEQ ID NO: 1917, or the complement of SEQ ID NO: 1917 or the RNA equivalent of SEQ ID NO: 1917, wherein the complement is identical in length to the nucleic acid of (a) or (b). SEQ ID NO: 1917 is the viral hairpin sequence of the Viral Genomic Address Messenger 1931.

The present invention is also directed to an isolated nucleic acid wherein the sequence of the nucleic acid consists of the sequence of SEQ ID NO: 4642, an RNA equivalent of SEQ ID NO: 4642, or the complement of SEQ ID NO: 4642 or the RNA equivalent of SEQ ID NO: 4642, wherein the complement is identical in length to the nucleic acid of (a) or (b). SEQ ID NO: 4642 is the viral miR of the viral hairpin sequence as set forth in SEQ ID NO: 1917 of the Viral Genomic Address Messenger 1931 (VGAM1931) and modulates expression of host target genes thereof wherein the function and utility of the host genes is known in the art.

The present invention is also directed to a vector comprising the nucleic acid wherein the sequence of the nucleic acid consists of the sequence of SEQ ID NO: 4642, an RNA equivalent of SEQ ID NO: 4642, or the complement of SEQ ID NO: 4642 or the RNA equivalent of SEQ ID NO: 4642, wherein the complement is identical in length to the nucleic acid of (a) or (b). The present invention is also directed to a vector comprising the nucleic acid wherein the sequence of the nucleic acid consists of the sequence of SEQ ID NO: 1917, an RNA equivalent of SEQ ID NO: 1917, or the complement of SEQ ID NO: 1917 or the RNA equivalent of SEQ ID NO: 1917, wherein the complement is identical in length to the nucleic acid of (a) or (b).

The present invention is also directed to an isolated nucleic acid wherein the sequence of the nucleic acid consists of the sequence of SEQ ID NO: 4642, an RNA equivalent of SEQ ID NO: 4642, or the complement of SEQ ID NO: 4642 or the RNA equivalent of SEQ ID NO: 4642, wherein the complement is identical in length to the nucleic acid of (a) or (b). SEQ ID NO: 4642 is the viral miR of the viral hairpin sequence as set forth in SEQ ID NO: 1917 of the Viral Genomic Address Messenger 1931 (VGAM1931) and modulates expression of host target genes thereof wherein the function and utility of the host genes is known in the art.

The present invention is also directed to a probe comprising the nucleic acid wherein the sequence of the nucleic acid consists of the sequence of SEQ ID NO: 4642, an RNA equivalent of SEQ ID NO: 4642, or the complement of SEQ ID NO: 4642 or the RNA equivalent of SEQ ID NO: 4642, wherein the complement is identical in length to the nucleic acid of (a) or (b). The present invention is also directed to a probe comprising the nucleic acid wherein the sequence of the nucleic acid consists of the sequence of SEQ ID NO: 1917, an RNA equivalent of SEQ ID NO: 1917, or the complement of SEQ ID NO: 1917 or the RNA equivalent of SEQ ID NO: 1917, wherein the complement is identical in length to the nucleic acid of (a) or (b).

BRIEF DESCRIPTION OF DRAWINGS

Reference is now made to FIG. 1, which is a simplified diagram describing each of a plurality of novel bioinformatically detected viral genes of the present invention, referred to here as Viral Genomic Address Messenger (VGAM) viral genes, which modulates expression of respective host target genes thereof, the function and utility of which host target genes is known in the art. VGAM is a novel bioinformatically detected regulatory, non protein coding, viral micro RNA (miRNA) gene. The method by which VGAM was detected is described hereinabove with reference to FIGS. 2-8. VGAM GENE is a viral gene contained in the genome of a virus. VGAM HOST TARGET GENE is a human gene contained in the human genome. VGAM GENE encodes a VGAM PRECURSOR RNA. Similar to other miRNA genes, and unlike most ordinary genes, VGAM PRECURSOR RNA does not encode a protein. VGAM PRECURSOR RNA folds onto itself, forming VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof. By "inversed-reversed" is meant a sequence which is reversed and wherein each nucleotide is replaced by a complementary nucleotide, as is well known in the art (e.g. ATGGC is the inversed-reversed sequence of GCCAT). An enzyme complex designated DICER COMPLEX, 'dices' the VGAM FOLDED PRECURSOR RNA into VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. VGAM HOST TARGET GENE encodes a corresponding messenger RNA, VGAM HOST TARGET RNA. VGAM HOST TARGET RNA comprises three regions, as is typical of mRNA of a protein coding gene: a 5' untranslated region, a protein coding region and a 3' untranslated region, designated 5'UTR, PROTEIN CODING and 3'UTR respectively. VGAM RNA binds complementarily to one or more host target binding sites located in untranslated regions of VGAM HOST TARGET RNA. This complementary binding is due to the fact that the nucleotide sequence of VGAM RNA is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting—VGAM RNA may have a different number of host target binding sites in untranslated regions of a VGAM HOST TARGET RNA. It is further appreciated that while FIG. 1 depicts host target binding sites in the 3'UTR region, this is meant as an example only—these host target binding sites may be located in the 3'UTR region, the 5'UTR region, or in both 3'UTR and 5'UTR regions. The complementary binding of VGAM RNA to host target binding sites on VGAM HOST TARGET RNA, such as BINDING SITE I, BINDING SITE II and BINDING SITE III, inhibits translation of VGAM HOST TARGET RNA into VGAM HOST TARGET PROTEIN. VGAM HOST TARGET PROTEIN is therefore outlined by a broken line. It is appreciated that VGAM HOST TARGET GENE in fact represents a plurality of VGAM host target genes. The mRNA of each one of this plurality of VGAM host target genes comprises one or more host target binding sites, each having a nucleotide sequence which is at least partly complementary to VGAM RNA, and which when bound by VGAM RNA causes inhibition of translation of respective one or more VGAM host target proteins. It is further appreciated by one skilled in the art that the mode of translational inhibition illustrated by FIG. 1 with specific reference to translational inhibition exerted by VGAM GENE on one or more VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)). It is yet further appreciated that a function of VGAM is inhibition of expression of host target genes, as part of a novel viral mechanism of attacking a host. Accordingly, utilities of VGAM include diagnosis, prevention and treatment of viral infection by a virus. Specific functions, and accordingly utilities, of VGAM correlate with, and may be deduced from, the identity of the host target genes which VGAM binds and inhibits, and the function of these host target genes, as elaborated hereinbelow. Nucleotide sequences of the VGAM PRECURSOR RNA, and of the 'diced' VGAM RNA, and a schematic representation of the secondary folding of VGAM FOLDED PRECURSOR RNA of each of the plurality of VGAM GENEs described by FIG. 1 are further described hereinbelow with reference to Table 1. Nucleotide sequences of host target binding sites, such as BINDING SITE-I, BINDING SITE-II and BINDING SITE-III of FIG. 1, found on, and schematic representation of the complementarity of each of these host target binding sites to VGAM RNA are described hereinbelow with reference to Table 2.;

FIG. 8 is a simplified flowchart illustrating operation of a function & utility analyzer constructed and operative in accordance with a preferred embodiment of the present invention;

Figure 9:
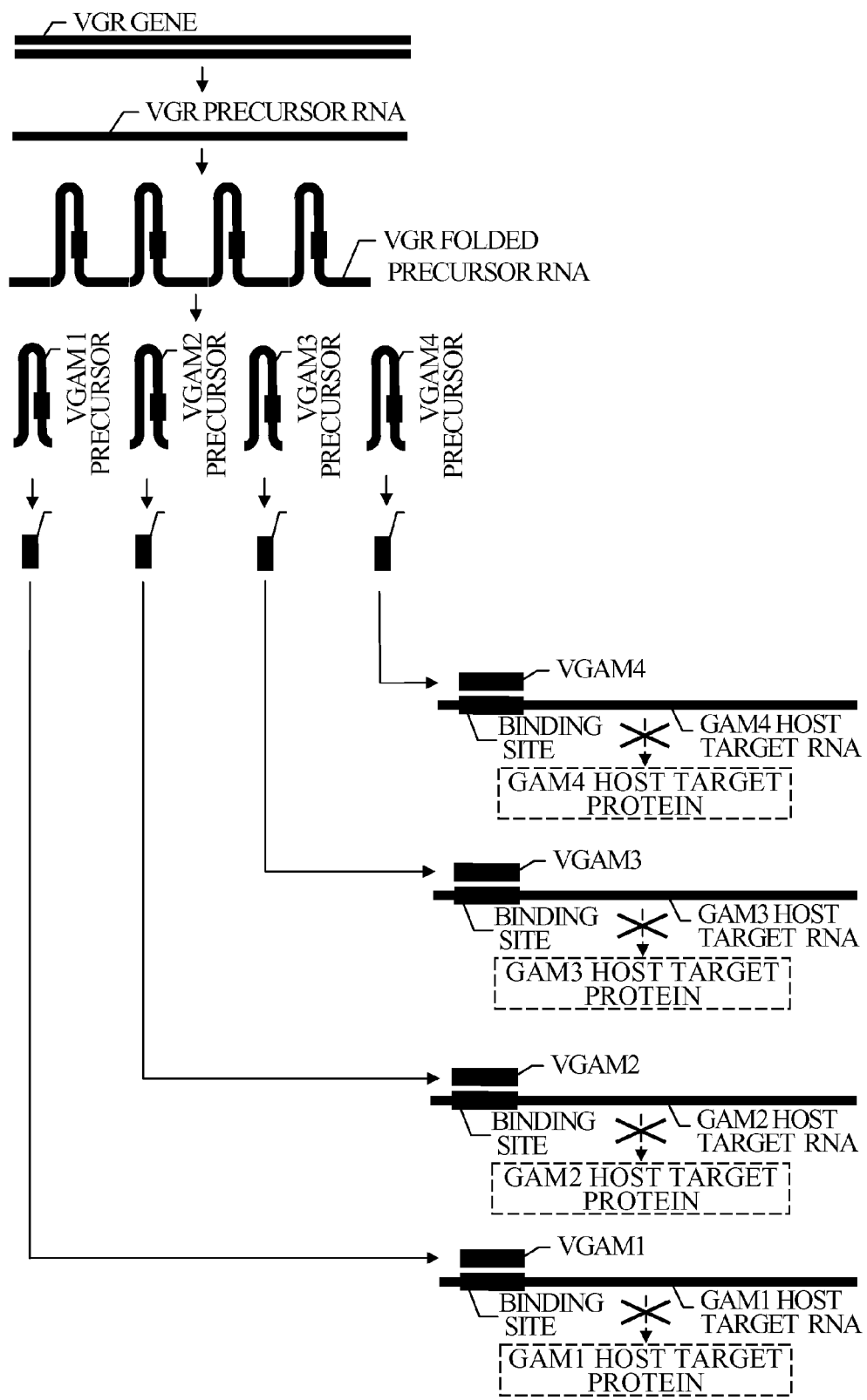

Reference is now made to FIG. 9, which is a simplified diagram describing each of a plurality of novel bioinformatically detected regulatory viral genes, referred to here as Viral Genomic Record(VGR) viral genes, which encodes an 'operon-like' cluster of novel viral micro RNA-like genes, each of which in turn modulates expression of at least one host target gene, the function and utility of which at least one host target gene is known in the art. VGR GENE is a novel bioinformatically detected regulatory, non protein coding, RNA viral gene. The method by which VGR GENE was detected is described hereinabove with reference to FIGS. 6-15. VGR GENE encodes VGR PRECURSOR RNA, an RNA molecule, typically several hundred nucleotides long. VGR PRECURSOR RNA folds spatially, forming VGR FOLDED PRECURSOR RNA. It is appreciated that VGR FOLDED PRECURSOR RNA comprises a plurality of what is known in the art as 'hairpin' structures. These 'hairpin' structures are due to the fact that the nucleotide sequence of VGR PRECURSOR RNA comprises a plurality of segments, the first half of each such segment having a nucleotide sequence which is at least a partial inversed-reversed sequence of the second half thereof, as is well known in the art. VGR FOLDED PRECURSOR RNA is naturally processed by cellular enzymatic activity into a plurality of separate VGAM precursor RNAs, schematically represented by VGAM1 PRECURSOR, VGAM2 PRECURSOR, VGAM3 PRECURSOR, VGAM4 PRECURSOR, VGAM5 PRECURSOR, VGAM6 PRECURSOR, VGAM7 PRECURSOR and VGAM8 PRECURSOR, each of which VGAM precursor RNAs being a hairpin shaped RNA segment, corresponding to VGAM PRECURSOR RNA of FIG. 8. The above mentioned VGAM precursor RNAs are diced by DICER COMPLEX of FIG. 8, yielding respective short RNA segments of about 22 nucleotides in length, schematically represented as VGAM1 RNA, VGAM2 RNA, VGAM3 RNA, VGAM4 RNA, VGAM5 RNA, VGAM6 RNA, VGAM7 RNA and VGAM8 RNA respectively, each of which VGAM RNAs corresponding to VGAM RNA of FIG. 8. VGAM1 RNA binds complimentarily to a host target binding site located in an untranslated region of VGAM1 HOST TARGET RNA, which host target binding site corresponds to a host target binding site such as BINDING SITE I, BINDING SITE II or BINDING SITE III of FIG. 10, thereby inhibiting translation of VGAM1 HOST TARGET RNA into VGAM1 HOST TARGET PROTEIN, both of FIG. 10. VGAM2 RNA binds complimentarily to a host target binding site located in an untranslated region of VGAM2 HOST TARGET RNA, which host target binding site corresponds to a host target binding site such as BINDING SITE I, BINDING SITE II or BINDING SITE III of FIG. 10, thereby inhibiting translation of VGAM2 HOST TARGET RNA into VGAM2 HOST TARGET PROTEIN, both of FIG. 10. VGAM3 RNA binds complimentarily to a host target binding site located in an untranslated region of VGAM3 HOST TARGET RNA, which host target binding site corresponds to a host target binding site such as BINDING SITE I, BINDING SITE II or BINDING SITE III of FIG. 10, thereby inhibiting translation of VGAM3 HOST TARGET RNA into VGAM3 HOST TARGET PROTEIN, both of FIG. 10. VGAM4 RNA binds complimentarily to a host target binding site located in an untranslated region of VGAM4 HOST TARGET RNA, which host target binding site corresponds to a host target binding site such as BINDING SITE I, BINDING SITE II or BINDING SITE III of FIG. 10, thereby inhibiting translation of VGAM4 HOST TARGET RNA into VGAM4 HOST TARGET PROTEIN, both of FIG. 10. VGAM5 RNA binds complimentarily to a host target binding site located in an untranslated region of VGAM5 HOST TARGET RNA, which host target binding site corresponds to a host target binding site such as BINDING SITE I, BINDING SITE II or BINDING SITE III of FIG. 10, thereby inhibiting translation of VGAM5 HOST TARGET RNA into VGAM5 HOST TARGET PROTEIN, both of FIG. 10. VGAM6 RNA binds complimentarily to a host target binding site located in an untranslated region of VGAM6 HOST TARGET RNA, which host target binding site corresponds to a host target binding site such as BINDING SITE I, BINDING SITE II or BINDING SITE III of FIG. 10, thereby inhibiting translation of VGAM6 HOST TARGET RNA into VGAM6 HOST TARGET PROTEIN, both of FIG. 10. VGAM7 RNA binds complimentarily to a host target binding site located in an untranslated region of VGAM7 HOST TARGET RNA, which host target binding site corresponds to a host target binding site such as BINDING SITE I, BINDING SITE II or BINDING SITE III of FIG. 10, thereby inhibiting translation of VGAM7 HOST TARGET RNA into VGAM7 HOST TARGET PROTEIN, both of FIG. 10. VGAM8 RNA binds complimentarily to a host target binding site located in an untranslated region of VGAM8 HOST TARGET RNA, which host target binding site corresponds to a host target binding site such as BINDING SITE I, BINDING SITE II or BINDING SITE III of FIG. 10, thereby inhibiting translation of VGAM8 HOST TARGET RNA into VGAM8 HOST TARGET PROTEIN, both of FIG. 10. It is appreciated that a function of VGR GENE is inhibition of expression of host target genes, as part of a novel viral mechanism of attacking a host. Accordingly, utilities of VGR GENE include diagnosis, prevention and treatment of viral infection by a virus. Specific functions, and accordingly utilities, of VGR GENE correlate with, and may be deduced from, the identity of the host target genes, which are inhibited by VGAM RNAs comprised in the 'operon-like' cluster of VGR GENE, schematically represented by VGAM1 HOST TARGET PROTEIN through VGAM8 HOST TARGET PROTEIN.

Figure 10:
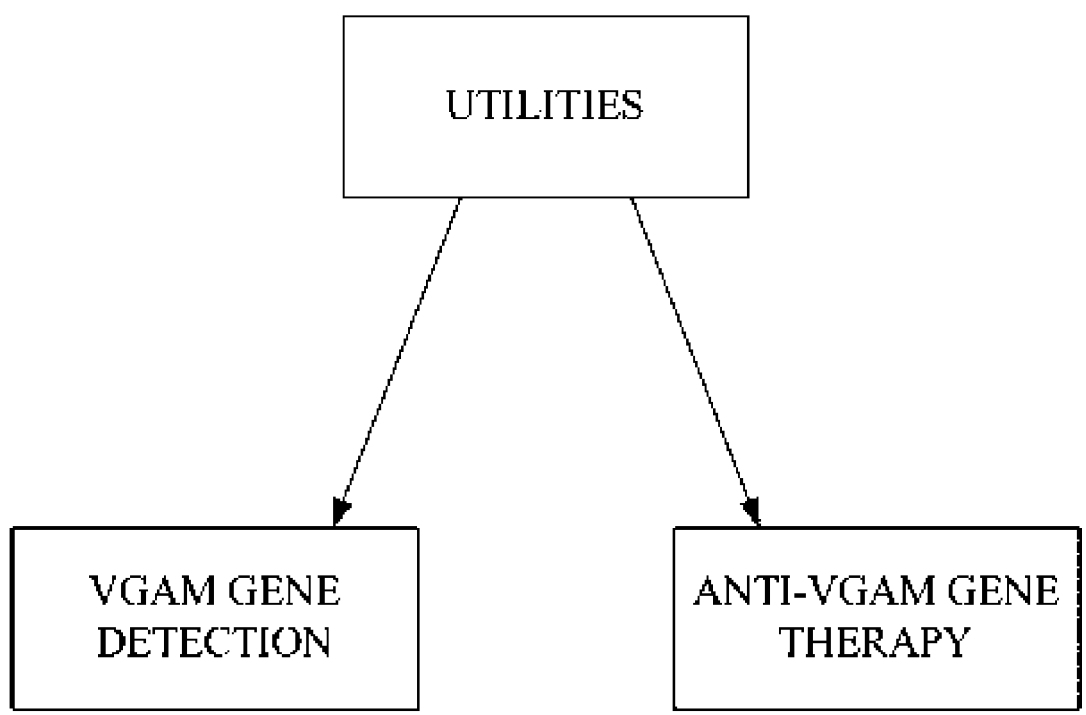
Figure 11A:
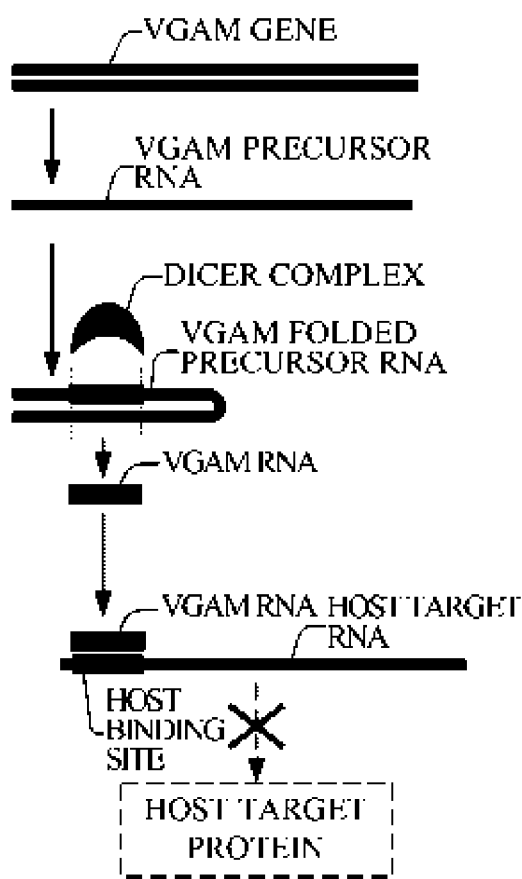
Figure 11B:
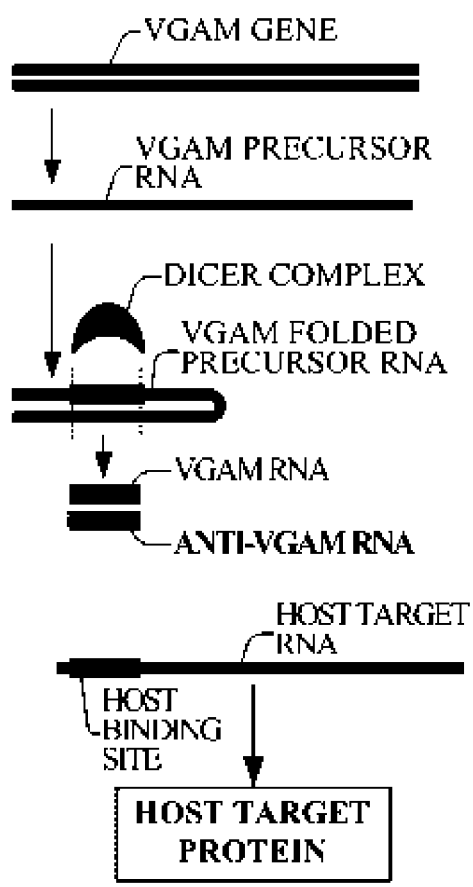
Figure 13C:
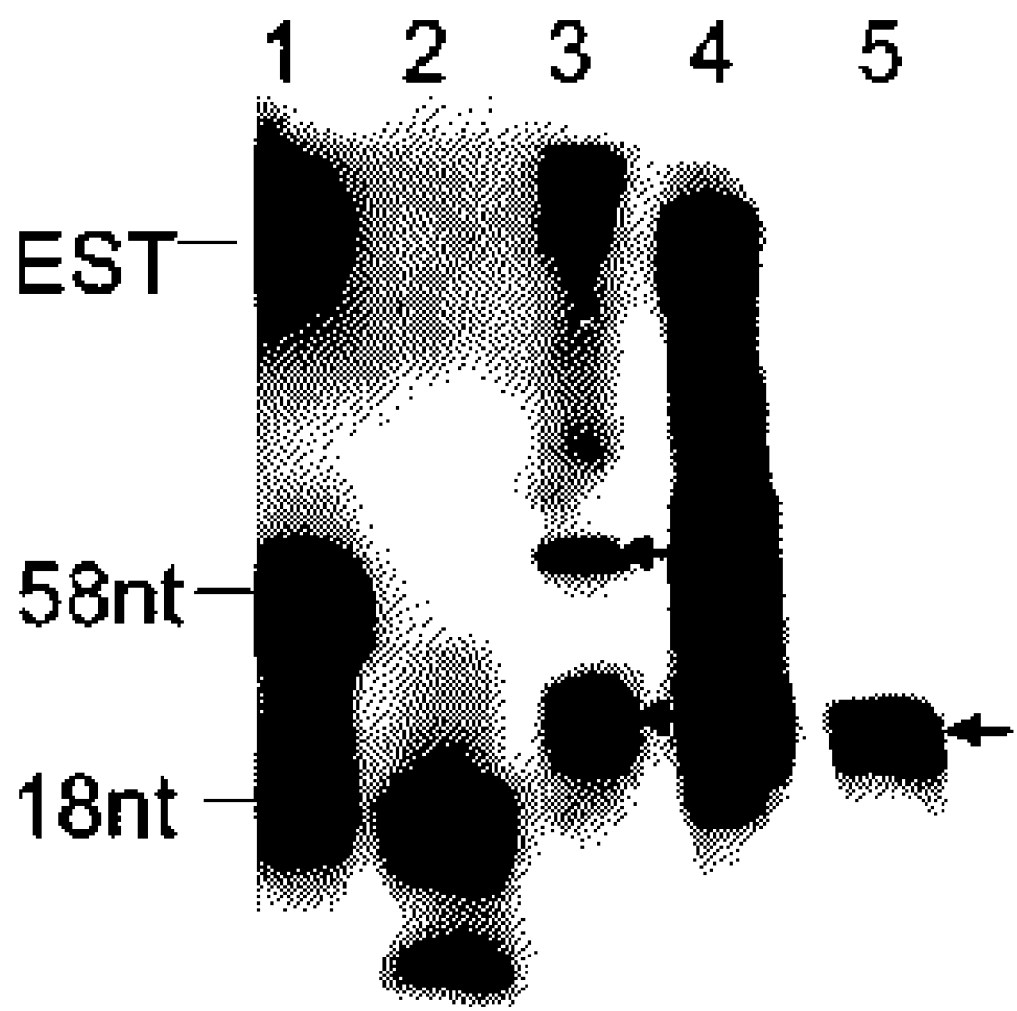

FIG. 10 is a block diagram illustrating different utilities of genes of a novel group of genes, and operons of a novel group of operons, both of the present invention;

FIGS. 11A and 11B are simplified diagrams, which when taken together illustrate a mode of gene therapy applicable to genes of the novel group of genes of the present invention;

FIG. 12A is an annotated sequence of EST72223 comprising novel gene GAM24 detected by the gene detection system of the present invention;

FIGS. 12B and 12C are pictures of laboratory results, which when taken together demonstrate laboratory confirmation of expression of the bioinformatically detected novel gene GAM24 of FIG. 12A;

FIG. 12D provides pictures of laboratory results, which when taken together demonstrate further laboratory confirmation of expression of the bioinformatically detected novel gene GAM24 of FIG. 12A;

FIG. 13A is an annotated sequence of an EST7929020 comprising novel genes GAM23 and GAM25 detected by the gene detection system of the present invention;

FIG. 13B is a picture of laboratory results, which confirm expression of bioinformatically detected novel genes GAM23 and GAM25 of FIG. 13A;

FIG. 13C is a picture of laboratory results, which confirm endogenous-expression of bioinformatically detected novel gene GAM25 of FIG. 13A;

FIG. 14A is an annotated sequence of an EST1388749 comprising novel gene GAM26 detected by the gene detection system of the present invention;

FIG. 14B is a picture of laboratory results, which confirm expression of the bioinformatically detected novel gene GAM26 of FIG. 14A;

FIGS. 15A-D are schematic diagrams illustrating sequences, functions and utilities of the VGAM1931 gene expressing the hairpin as set forth in SEQ ID NO: 191.7 and the miRNAs set forth in SEQ ID NO: 4642, which were detected using the bioinformatic gene detection system described hereinabove with reference to FIGS. 1 through 8; and

BRIEF DESCRIPTION OF SEQUENCES

A Sequence Listing of genomic sequences of the present invention designated SEQ ID:1 through SEQ ID:46755 is attached to this application, enclosed in computer readable form on CD-ROM. The genomic listing comprises the following nucleotide sequences:Genomic sequences designated SEQ ID:1 through SEQ ID:2725 are nucleotide sequences of 2725 gene precursors of respective novel genes of the present invention; Genomic sequences designated SEQ ID:2726 through SEQ ID:5450 are nucleotide sequences of 2725 genes of the present invention; and Genomic sequences designated SEQ ID:5451 through SEQ ID:46755 are nucleotide sequences of 41305 gene precursors of respective novel genes of the present invention.

DETAILED DESCRIPTION

The present invention relates to a novel group of bioinformatically detectable, viral regulatory RNA genes, which repress expression of host target host genes, by means of complementary hybridization to binding sites in untranslated regions of these host target host genes. It is believed that this novel group of viral genes represent a pervasive viral mechanism of attacking hosts, and that therefore knowledge of this novel group of viral genes may be useful in preventing and treating viral diseases.

In various preferred embodiments, the present invention seeks to provide improved method and system for detection and prevention of viral disease, which is mediated by this group of novel viral genes.

Accordingly, the invention provides several substantially pure nucleic acids (e.g., genomic nucleic acid, cDNA or synthetic nucleic acid) each encoding a novel viral gene of the VGAM group of gene, vectors comprising the nucleic acids, probes comprising the nucleic acids, a method and system for selectively modulating translation of known "target" genes utilizing the vectors, and a method and system for detecting expression of known "target" genes utilizing the probe.

By "substantially pure nucleic acid" is meant nucleic acid that is free of the genes which, in the naturally-occurring genome of the organism from which the nucleic acid of the invention is derived, flank the genes discovered and isolated by the present invention. The term therefore includes, for example, a recombinant nucleic acid which is incorporated into a vector, into an autonomously replicating plasmid or virus, or into the genomic nucleic acid of a prokaryote or eukaryote at a site other than its natural site; or which exists as a separate molecule (e.g., a cDNA or a genomic or cDNA fragment produced by PCR or restriction endonuclease digestion) independent of other sequences. It also includes a recombinant nucleic acid which is part of a hybrid gene encoding additional polypeptide sequence.

"Inhibiting translation" is defined as the ability to prevent synthesis of a specific protein encoded by a respective gene, by means of inhibiting the translation of the mRNA of this gene. "Translation inhibiter site" is defined as the minimal nucleic acid sequence sufficient to inhibit translation.

There is thus provided in accordance with a preferred embodiment of the present invention a bioinformatically detectable novel viral gene encoding substantially pure nucleic acid wherein: RNA encoded by the bioinformatically detectable novel viral gene is about 18 to about 24 nucleotides in length, and originates from an RNA precursor, which RNA precursor is about 50 to about 120 nucleotides in length, a nucleotide sequence of a first half of the RNA precursor is a partial inversed-reversed sequence of a nucleotide sequence of a second half thereof, a nucleotide sequence of the RNA encoded by the novel viral gene is a partial inversed-reversed sequence of a nucleotide sequence of a binding site associated with at least one host target gene, and a function of the novel viral gene is bioinformatically deducible.

There is further provided in accordance with another preferred embodiment of the present invention a method for anti-viral treatment comprising neutralizing said RNA.

Further in accordance with a preferred embodiment of the present invention the neutralizing comprises: synthesizing a complementary nucleic acid molecule, a nucleic sequence of which complementary nucleic acid molecule is a partial inversed-reversed sequence of said RNA, and transfecting host cells with the complementary nucleic acid molecule, thereby complementarily binding said RNA.

Further in accordance with a preferred embodiment of the present invention the neutralizing comprises immunologically neutralizing.

There is still further provided in accordance with another preferred embodiment of the present invention a bioinformatically detectable novel viral gene encoding substantially pure nucleic acid wherein: RNA encoded by the bioinformatically detectable novel viral gene includes a plurality of RNA sections, each of the RNA sections being about 50 to about 120 nucleotides in length, and including an RNA segment, which RNA segment is about 18 to about 24 nucleotides in length, a nucleotide sequence of a first half of each of the RNA sections encoded by the novel viral gene is a partial inversed-reversed sequence of nucleotide sequence of a second half thereof, a nucleotide sequence of each of the RNA segments encoded by the novel viral gene is a partial inversed-reversed sequence of the nucleotide sequence of a binding site associated with at least one target host gene, and a function of the novel viral gene is bioinformatically deducible from the following data elements: the nucleotide sequence of the RNA encoded by the novel viral gene, a nucleotide sequence of the at least one target host gene, and function of the at least one target host gene.

Further in accordance with a preferred embodiment of the present invention the function of the novel viral gene is bioinformatically deducible from the following data elements: the nucleotide sequence of the RNA encoded by the bioinformatically detectable novel viral gene, a nucleotide sequence of the at least one target host gene, and a function of the at least one target host gene.

Still further in accordance with a preferred embodiment of the present invention the RNA encoded by the novel viral gene complementarily binds the binding site associated with the at least one target host gene, thereby modulating expression of the at least one target host gene.

Additionally in accordance with a preferred embodiment of the present invention the binding site associated with at least one target host gene is located in an untranslated region of RNA encoded by the at least one target host gene.

Moreover in accordance with a preferred embodiment of the present invention the function of the novel viral gene is selective inhibition of translation of the at least one target host gene, which selective inhibition includes complementary hybridization of the RNA encoded by the novel viral gene to the binding site.

Further in accordance with a preferred embodiment of the present invention the invention includes a vector including the DNA.

Still further in accordance with a preferred embodiment of the present invention the invention includes a method of selectively inhibiting translation of at least one gene, including introducing the vector.

Moreover in accordance with a preferred embodiment of the present invention the introducing includes utilizing RNAi pathway.

Additionally in accordance with a preferred embodiment of the present invention the invention includes a gene expression inhibition system including: the vector, and a vector inserter, functional to insert the vector into a cell, thereby selectively inhibiting translation of at least one gene.

Further in accordance with a preferred embodiment of the present invention the invention includes a probe including the DNA.

Still further in accordance with a preferred embodiment of the present invention the invention includes a method of selectively detecting expression of at least one gene, including using the probe.

Additionally in accordance with a preferred embodiment of the present invention the invention includes a gene expression detection system including: the probe, and a gene expression detector functional to selectively detect expression of at least one gene.

Further in accordance with a preferred embodiment of the present invention the invention includes an anti-viral substance capable of neutralizing the RNA.

Still further in accordance with a preferred embodiment of the present invention the neutralizing includes complementarily binding the RNA.

Additionally in accordance with a preferred embodiment of the present invention the neutralizing includes immunologically neutralizing. Moreover in accordance with a preferred embodiment of the present invention the invention includes a method for anti-viral treatment including neutralizing the RNA.

Further in accordance with a preferred embodiment of the present invention the neutralizing includes: synthesizing a complementary nucleic acid molecule, a nucleic sequence of which complementary nucleic acid molecule is a partial inversed-reversed sequence of the RNA, and transfecting host cells with the complementary nucleic acid molecule, thereby complementarily binding the RNA.

Still further in accordance with a preferred embodiment of the present invention the neutralizing includes immunologically neutralizing.

Figure 1:
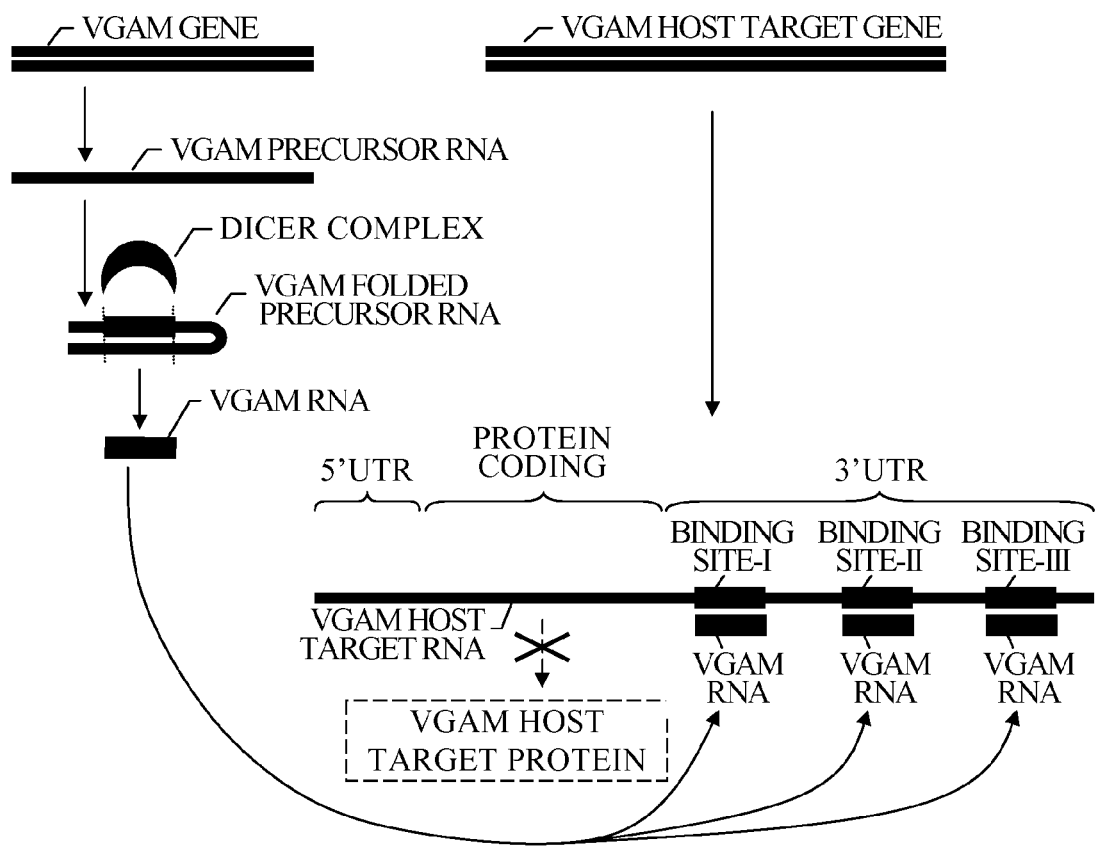

Reference is now made to FIG. 1 which is a simplified diagram illustrating a mode by which genes of a novel group of genes of the present invention, modulate expression of known host target.

The novel genes of the present invention are micro RNA (miRNA)-like, regulatory RNA genes, modulating expression of known host target. This mode of modulation is common to other known miRNA genes, as described hereinabove with reference to the background of the invention section.

VGAM GENE and TARGET GENE are two human genes contained in the DNA of the human genome.

VGAM GENE encodes a VGAM PRECURSOR RNA. However, similar to other miRNA genes, and unlike most ordinary genes, its RNA, VGAM PRECURSOR RNA, does not encode a protein.

VGAM PRECURSOR RNA folds onto itself, forming VGAM FOLDED PRECURSOR RNA. As FIG. 8 illustrates, VGAM FOLDED PRECURSOR RNA forms a "hairpin structure", folding onto itself. As is well known in the art, this "hairpin structure", is typical genes of the miRNA genes, and is due to the fact that nucleotide sequence of the first half of the RNA of a gene in this group is an accurate or partial inversed-reversed sequence of the nucleotide sequence of its second half. By "inversed-reversed" is meant a sequence which is reversed and wherein each nucleotide is replaced by a complementary nucleotide, as is well known in the art (e.g. ATGGC is the inversed-reversed sequence of GCCAT).

An enzyme complex, designated DICER COMPLEX, "dices" the VGAM FOLDED PRECURSOR RNA into a single stranded RNA segment, about 22 nucleotides long, designated VGAM RNA. As is known in the art, "dicing" of the hairpin structured RNA precursor into shorter RNA segments about 22 nucleotides long by a Dicer type enzyme is catalyzed by an enzyme complex comprising an enzyme called Dicer together with other necessary proteins.

TARGET GENE encodes a corresponding messenger RNA, designated TARGET RNA. This TARGET RNA comprises 3 regions: a 5" untranslated region, a protein coding region and a 3" untranslated region, designated 5"UTR, PROTEIN CODING and 3"UTR respectively.

VGAM RNA binds complementary a BINDING SITE, located on the 3"UTR segment of TARGET RNA. This complementarily binding is due to the fact that the nucleotide sequence of VGAM RNA is an accurate or partial inversed-reversed sequence of the nucleotide sequence of BINDING SITE.

The complementary binding of VGAM RNA to BINDING SITE inhibits translation of TARGET RNA into TARGET PROTEIN. TARGET PROTEIN is therefore outlined by a broken line.

It is appreciated by one skilled in the art that the mode of transcriptional inhibition illustrated by FIG. 1 with specific reference to VGAM genes of the present invention, is in fact common to all other miRNA genes. A specific complementary binding site has been demonstrated only for Lin-4 and Let-7. All the other 93 newly discovered miRNA genes are also believed by those skilled in the art to modulate expression of other genes by complimentary complementary binding, although specific complimentary complementary binding sites for these genes have not yet been found (Ruvkun G., "Perspective: Glimpses of a tiny RNA world", Science 294, 779 (2001)). The present invention discloses a novel group of genes, the VGAM genes, belonging to the miRNA genes group, and for which a specific an complementary binding has been determined.

Figure 2:
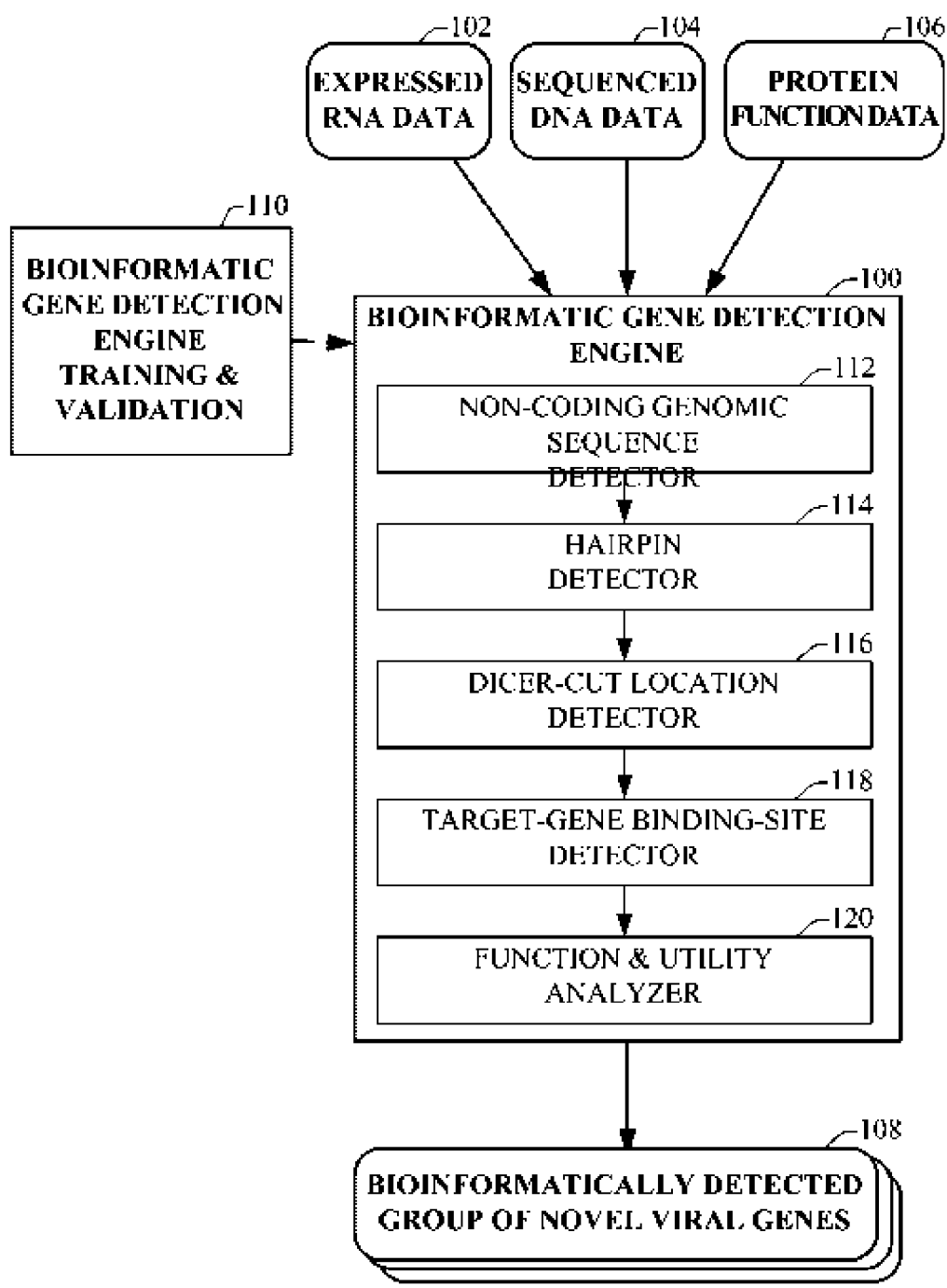
FIG. 2 is a simplified block diagram illustrating a bioinformatic gene detection system capable of detecting genes of the novel group of genes of the present invention, which system is constructed and operative in accordance with a preferred embodiment of the present invention.

Reference is now made to FIG. 2 which is a simplified block diagram illustrating a bioinformatic gene detection system capable of detecting genes of the novel group of genes of the present invention, which system is constructed and operative in accordance with a preferred embodiment of the present invention.

A centerpiece of the present invention is a bioinformatic gene detection engine 100, which is a preferred implementation of a mechanism capable of bioinformatically detecting genes of the novel group of genes of the present invention.

The function of the bioinformatic gene detection engine 100 is as follows: it receives three types of input, expressed RNA data 102, sequenced DNA data 104, and protein function data 106, performs a complex process of analysis of this data as elaborated below, and based on this analysis produces output of a bioinformatically detected group of novel genes designated 108.

Expressed RNA data 102 comprises published expressed sequence tags (EST) data, published mRNA data, as well as other sources of published RNA data. Sequenced DNA data 104 comprises alphanumeric data describing sequenced genomic data, which preferably includes annotation data such as location of known protein coding regions relative to the sequenced data. Protein function data 106 comprises scientific publications reporting studies which elucidated physiological function known proteins, and their connection, involvement and possible utility in treatment and diagnosis of various diseases. Expressed RNA data 102, sequenced DNA data 104 may preferably be obtained from data published by the National Center for Bioinformatics (NCBI) at the National Institute of Health (NIH), as well as from various other published data sources. Protein function data 106 may preferably be obtained from any one of numerous relevant published data sources, such as the Online Mendelian Inherited Disease In Man (OMIM) database developed by John Hopkins University, and also published by NCBI.

Prior to actual detection of bioinformatically detected novel genes 108 by the bioinformatic gene detection engine 100, a process of bioinformatic gene detection engine training & validation designated 110 takes place. This process uses the known miRNA genes as a training set (some 200 such genes have been found to date using biological laboratory means), to train the bioinformatic gene detection engine 100 to bioinformatically recognize miRNA-like genes, and their respective potential target binding sites. Bioinformatic gene detection engine training & validation 110 is further describe hereinbelow with reference to FIG. 3.

The bioinformatic gene detection engine 100 comprises several modules which are preferably activated sequentially, and are described as follows:

A non-coding genomic sequence detector 112 operative to bioinformatically detect non-protein coding genomic sequences. The non-coding genomic sequence detector 112 is further described hereinbelow with reference to FIGS. 4A and 4B.

A hairpin detector 114 operative to bioinformatically detect genomic "hairpin-shaped" sequences, similar to VGAM FOLDED PRECURSOR of FIG. 1. The hairpin detector 114 is further described hereinbelow with reference to FIGS. 5A and 5B.

A dicer-cut location detector 116 operative to bioinformatically detect the location on a hairpin shaped sequence which is enzymatically cut by DICER COMPLEX of FIG. 1. The dicer-cut location detector 116 is further described hereinbelow with reference to FIG. 6A.

A target-gene binding-site detector 118 operative to bioinformatically detect host target having binding sites, the nucleotide sequence of which is partially complementary to that of a given genomic sequence, such as a sequence cut by DICER COMPLEX of FIG. 1. The target-gene binding-site detector 118 is further described hereinbelow with reference to FIGS. 7A and 7B.

A function & utility analyzer 120 operative to analyze function and utility of host target, in order to identify host target which have a significant clinical function and utility. The function & utility analyzer 120 is further described hereinbelow with reference to FIG. 8.

Hardware implementation of the bioinformatic gene detection engine 100 is important, since significant computing power is preferably required in order to perform the computation of bioinformatic gene detection engine 100 in reasonable time and cost. As an example, it is estimated that using one powerful 8-processor PC Server, over 30 months of computing time (at 24 hours per day) would be required in order to detect all miRNA genes in human EST data, and their respective binding sites.

For example, in order to address this challenge at reasonable time and cost, a preferred embodiment of the present invention may comprise a cluster of a large number of personal computers (PCs), such as 100 PCs (Pentium IV, 1.7 GHz, with 40 GB storage each), connected by Ethernet to several strong servers, such as 4 servers (2-CPU, Xeon 2.2 GHz, with 200 GB storage each), combined with an 8-processor server (8-CPU, Xeon 550 Mhz w/8 GB RAM) connected via 2 HBA fiber-channels to an EMC Clariion 100-disks, 3.6 Terabyte storage device. Additionally, preferably an efficient database computer program, such as Microsoft (™) SQL-Server database computer program is used and is optimized to the specific requirements of bioinformatic gene detection engine 100. Furthermore, the PCs are preferably optimized to operate close to 100% CPU usage continuously, as is known in the art. Using suitable hardware and software may preferably reduce the required calculation time in the abovementioned example from 30 months to 20 days.

It is appreciated that the abovementioned hardware configuration is not meant to be limiting, and is given as an illustration only. The present invention may be implemented in a wide variety of hardware and software configurations.

The present invention discloses 2725 novel viral genes of the VGAM group of genes, which have been detected bioinformatically, as described hereinbelow with reference to Tables 1 and 2. Laboratory confirmation of 4 genes of the GAM group of genes is described hereinbelow with reference to FIGS. 12 through 14.

Figure 3:
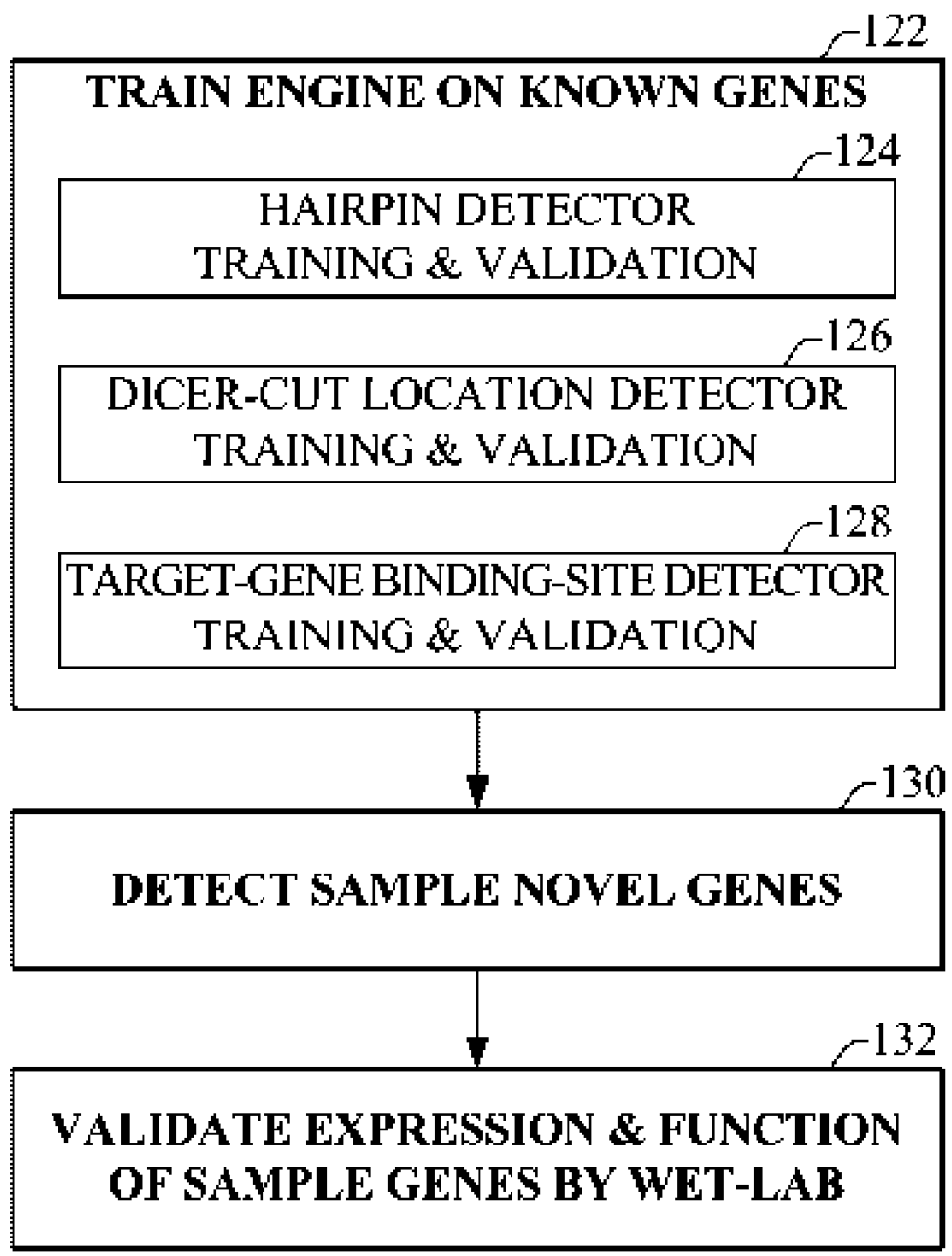
FIG. 3 is a simplified flowchart illustrating operation of a mechanism for training of a computer system to recognize the novel genes of the present invention, which mechanism is constructed and operative in accordance with a preferred embodiment of the present invention.

Reference is now made to FIG. 3 which is a simplified flowchart illustrating operation of a mechanism for training of a computer system to recognize the novel genes of the present invention. This mechanism is a preferred implementation of the bioinformatic gene detection engine training & validation 110 described hereinabove with reference to FIG. 2.

Bioinformatic gene detection engine training & validation 110 of FIG. 2 begins by training the bioinformatic gene detection engine to recognize known miRNA genes, as designated by numeral 122. This training step comprises hairpin detector training & validation 124, further described hereinbelow with reference to FIG. 12A, dicer-cut location detector training & validation 126, further described hereinbelow with reference to FIGS. 6A and 6B, and target-gene binding-site detector training & validation 128, further described hereinbelow with reference to FIG. 7A.

Next, the bioinformatic gene detection engine 100 is used to bioinformatically detect sample novel genes, as designated by numeral 130. An example of a sample novel gene thus detected is described hereinbelow with reference to FIG. 12.

Finally, wet lab experiments are preferably conducted in order to validate expression and preferably function the sample novel genes detected by the bioinformatic gene detection engine 100 in the previous step. An example of wet-lab validation of the abovementioned sample novel gene bioinformatically detected by the system is described hereinbelow with reference to FIGS. 13A and 13B.

Figure 4A:
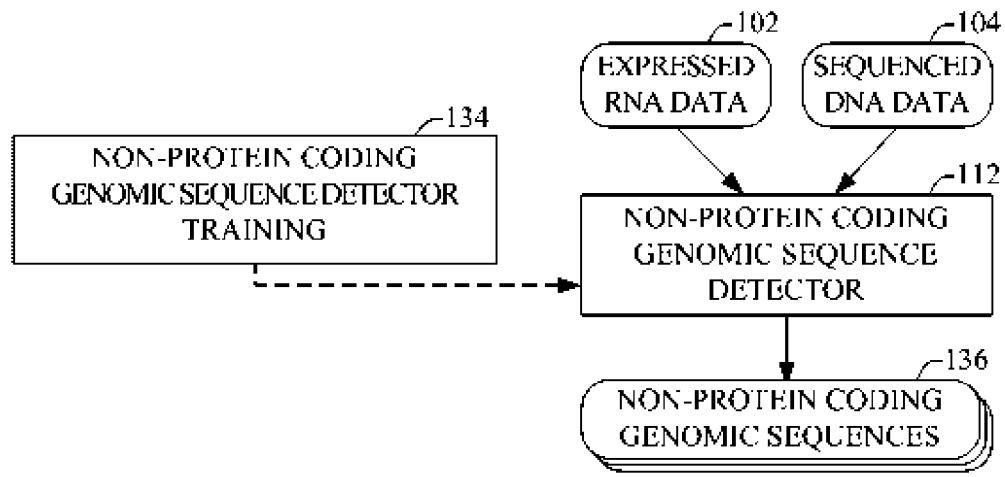
FIG. 4A is a simplified block diagram of a non-coding genomic sequence detector constructed and operative in accordance with a preferred embodiment of the present invention.

Reference is now made to FIG. 4A which is a simplified block diagram of a preferred implementation of the non-coding genomic sequence detector 112 described hereinabove with reference to FIG. 2. Non-protein coding genomic sequence detector 112 of FIG. 2 preferably receives as input at least two types of published genomic data: expressed RNA data 102, including EST data and mRNA data, and sequenced DNA data 104. After its initial training, indicated by numeral 134, and based on the above-mentioned input data, the non-protein coding genomic sequence detector 112 produces as output a plurality of non-protein coding genomic sequences 136. Preferred operation of the non-protein coding genomic sequence detector 112 is described hereinbelow with reference to FIG. 4B.

Figure 4B:
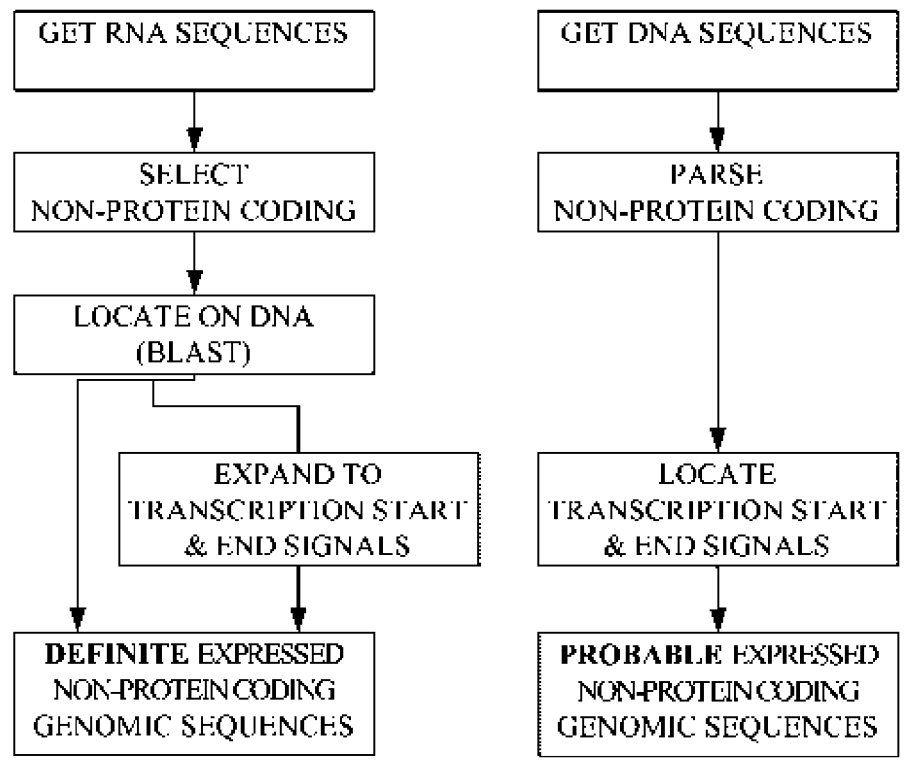
FIG. 4B is a simplified flowchart illustrating operation of a non-coding genomic sequence detector constructed and operative in accordance with a preferred embodiment of the present invention.

Reference is now made to FIG. 4B which is a simplified flowchart illustrating a preferred operation of the non-coding genomic sequence detector 112 of FIG. 2. Detection of non-protein coding genomic sequences to be further analyzed by the system generally preferably progresses in one of the following two paths.

A first path for detecting non-protein coding genomic sequences begins by receiving a plurality of known RNA sequences, such as EST data. Each RNA sequence is first compared to all known protein-coding sequences, in order to select only those RNA sequences which are non-protein coding. This can preferably be performed by BLAST comparison of the RNA sequence to known protein coding sequences. The abovementioned BLAST comparison to the DNA preferably also provides the localization of the RNA on the DNA.

Optionally, an attempt may be made to "expand" the non-protein RNA sequences thus found, by searching for transcription start and end signals, upstream and downstream of location of the RNA on the DNA respectively, as is well known in the art.

A second path for detecting non-protein coding genomic sequences starts by receiving DNA sequences. The DNA sequences are parsed into non protein coding sequences, based on published DNA annotation data: extracting those DNA sequences which are between known protein coding sequences. Next, transcription start and end signals are sought. If such signals are found, and depending on their "strength", probable expressed non-protein coding genomic sequences are yielded.

Figure 5A:
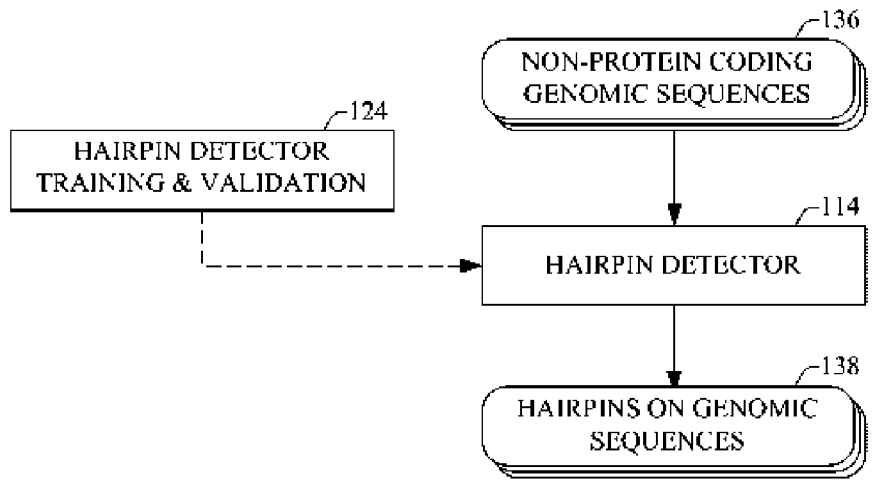
FIG. 5A is a simplified block diagram of a hairpin detector constructed and operative in accordance with a preferred embodiment of the present invention.

Reference is now made to FIG. 5A which is a simplified block diagram of a preferred implementation of the hairpin detector 114 described hereinabove with reference to FIG. 2.

The goal of the hairpin detector 114 is to detect "hairpin" shaped genomic sequences, similar to those of known miRNA genes. As mentioned hereinabove with reference to FIG. 1, a "hairpin" genomic sequence refers to a genomic sequence which "folds onto itself" forming a hairpin like shape, due to the fact that nucleotide sequence of the first half of the nucleotide sequence is an accurate or The hairpin detector 114 of FIG. 2 receives as input a plurality of non-protein coding genomic sequences 136 of FIG. 4A, and after a phase of hairpin detector training & validation 124 of FIG. 3, is operative to detect and output "hairpin shaped" sequences found in the input expressed non-protein coding sequences, designated by numeral 138.

The phase of hairpin detector training & validation 124 is an iterative process of applying the hairpin detector 114 to known hairpin shaped miRNA genes, calibrating the hairpin detector 114 such that it identifies the training set of known hairpins, as well as sequences which are similar thereto. Preferred operation of the hairpin detector 114 is described hereinbelow with reference to FIG. 5B.

Figure 5B:
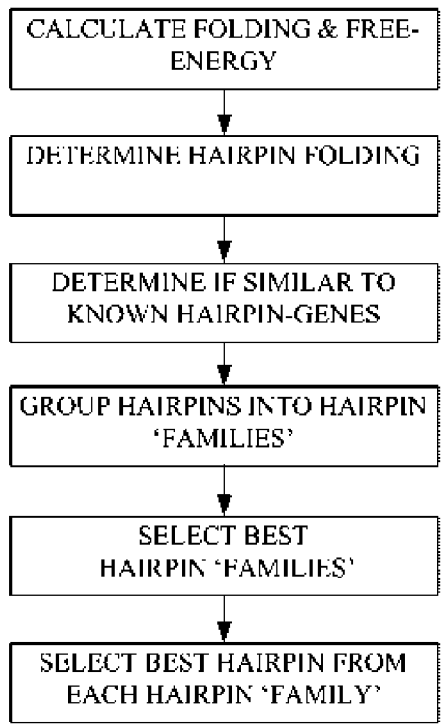
FIG. 5B is a simplified flowchart illustrating operation of a hairpin detector constructed and operative in accordance with a preferred embodiment of the present invention.

Reference is now made to FIG. 5B which is a simplified flowchart illustrating a preferred operation of the hairpin detector 114 of FIG. 2.

A hairpin structure is a two dimensional folding structure, resulting from the nucleotide sequence pattern: the nucleotide sequence of the first half of the hairpin sequence is an inversed-reversed sequence of the second half thereof. Different methodologies are known in the art for detection of various two dimensional and three dimensional hairpin structures.

In a preferred embodiment of the present invention, the hairpin detector 114 initially calculates possible 2-dimensional (2D) folding patterns of a given one of the non-protein coding genomic sequences 136, preferably using a 2D folding algorithm based on free-energy calculation, such as the Zucker algorithm, as is well known in the art.

Next, the hairpin detector 114 analyzes the results of the 2D folding, in order to determine the presence, and location of hairpin structures. A 2D folding algorithm typically provides as output a listing of the base-pairing of the 2D folded shape, i.e. a listing of which all two pairs of nucleotides in the sequence which will bond. The goal of this second step, is to assess this base-pairing listing, in order to determine if it describes a hairpin type bonding pattern.

The hairpin detector 114 then assess those hairpin structures found by the previous step, comparing them to hairpins of known miRNA genes, using various parameters such as length, free-energy, amount and type of mismatches, etc. Only hairpins that bear statistically significant resemblance of the population of hairpins of known miRNAs, according to the abovementioned parameters are accepted.

Lastly, the hairpin detector 114 attempts to select those hairpin structures which are as stable as the hairpins of know miRNA genes. This may be achieved in various manners. A preferred embodiment of the present invention utilizes the following methodology comprising three steps:

First, the hairpin detector 114 attempts to group potential hairpins into "families" of closely related hairpins. As is known in the art, a free-energy calculation algorithm, typically provides multiple "versions" each describing a different possible 2D folding pattern for the given genomic sequence, and the free energy of such possible folding. The hairpin detector 114 therefore preferably assesses all hairpins found on all "versions", grouping hairpins which appear in different versions, but which share near identical locations into a common "family" of hairpins. For example, all hairpins in different versions, the center of which is within 7 nucleotides of each other may preferably be grouped to a single "family".

Next, hairpin "families" are assessed, in order to select only those families which represent hairpins that are as stable as those of known miRNA hairpins. For example, preferably only families which are represented in at least 65% of the free-energy calculation 2D folding versions, are considered stable.

Finally, an attempt is made to select the most suitable hairpin from each selected family. For example, preferably the hairpin which appears in more versions than other hairpins, and in versions the free-energy of which is lower, may be selected.

Figure 6A:
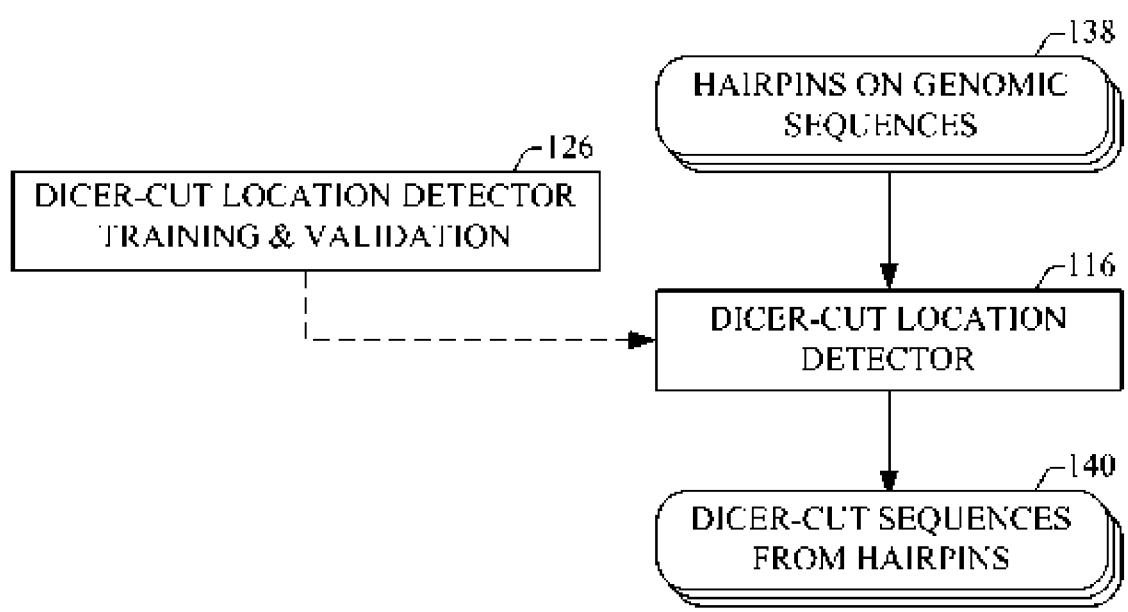
FIG. 6A is a simplified block diagram of a dicer-cut location detector constructed and operative in accordance with a preferred embodiment of the present invention.

Reference is now made to FIG. 6A which is a simplified block diagram of a preferred implementation of the dicer-cut location detector 116 described hereinabove with reference to FIG. 2.

The goal of the dicer-cut location detector 116 is to detect the location in which DICER COMPLEX of FIG. 1, comprising the enzyme Dicer, would "dice" the given hairpin sequence, similar to VGAM FOLDED PRECURSOR RNA, yielding VGAM RNA both of FIG. 1.

The dicer-cut location detector 116 of FIG. 2 therefore receives as input a plurality of hairpins on genomic sequences 138 of FIG. 5A, which were calculated by the previous step, and after a phase of dicer-cut location detector training & validation 126 of FIG. 3, is operative to detect a respective plurality of dicer-cut sequences from hairpins 140, one for each hairpin.

In a preferred embodiment of the present invention, the dicer-cut location detector 116 preferably uses a combination of neural networks, Bayesian networks, Markovian modeling, and Support Vector Machines (SVMs) trained on the known dicer-cut locations of known miRNA genes, in order to detect dicer-cut locations. Dicer-cut location detector training & validation 126, which is further described hereinbelow with reference to FIG. 6B.

Figure 6B:
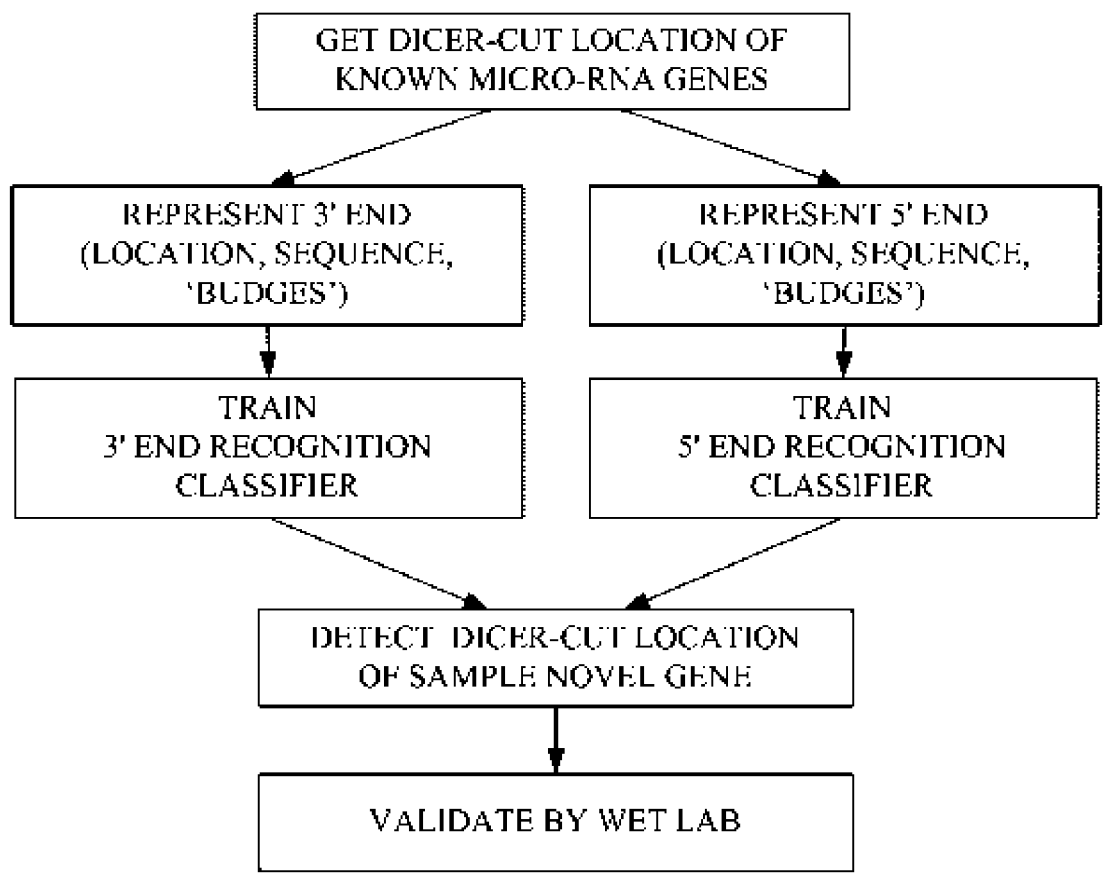
FIG. 6B is a simplified flowchart illustrating training of a dicer-cut location detector constructed and operative in accordance with a preferred embodiment of the present invention.
Figure 6C:
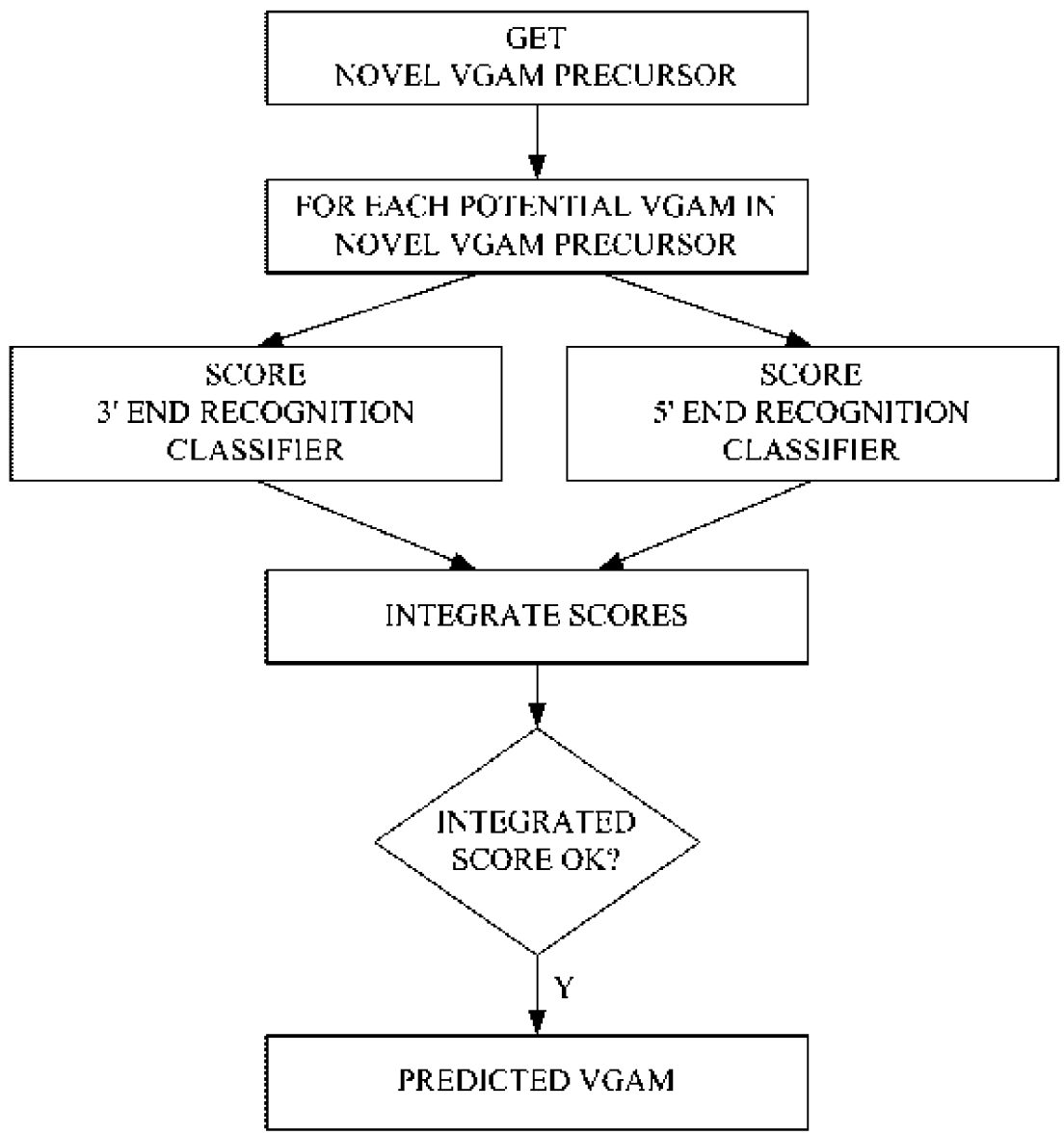
FIG. 6C is a simplified flowchart illustrating prediction of a viral genomic address messenger.

Reference is now made to FIG. 6B which is a simplified flowchart illustrating a preferred implementation of dicer-cut location detector training & validation 126 of FIG. 3. Dicer-cut location detector 116 first preprocesses known miRNA hairpins and their respective dicer-cut locations, so as to be able to properly analyze them and train the detection system accordingly:

The folding pattern is calculated for each known miRNA, preferably based on free-energy calculation, and the size of the hairpin, the size of the loop at the center of the hairpin, and "bulges" (i.e. mismatched base-pairs) in the folded hairpin are noted.

The dicer-cut location, which is known for known miRNA genes, is noted relative to the above, as well as to the nucleotides in each location along the hairpin. Frequency of identity of nucleotides, and nucleotide-pairing, relative to their location in the hairpin, and relative to the known dicer-cut location in the known miRNA genes is analyzed and modeled.

Different techniques are well known in the art for analysis of existing pattern from a given "training set" of species belonging to a genus, which techniques are then capable, to a certain degree, to detect similar patterns in other species not belonging to the training-set genus. Such techniques include, but are not limited to neural networks, Bayesian networks, Support Vector Machines (SVM), Genetic Algorithms, Markovian modeling, and others, as is well known in the art.

Using such techniques, preferably a combination of several of the above techniques, the known hairpins are represented as a several different networks (such as neural, Bayesian, or SVM) input and output layers. Both nucleotide, and "bulge" (i.e. nucleotide pairing or mismatch) are represented for each position in the hairpin, at the input layer, and a corresponding true/false flag at each position, indicating whether it was diced by dicer at the output layer. Multiple networks are preferably used concurrently, and the results therefrom are integrated and further optimized. Markovian modeling may also be used to validate the results and enhance their accuracy. Finally, the bioinformatic detection of dicer-cut location of a sample novel is confirmed by wet-lab experimentation.

Figure 7A:
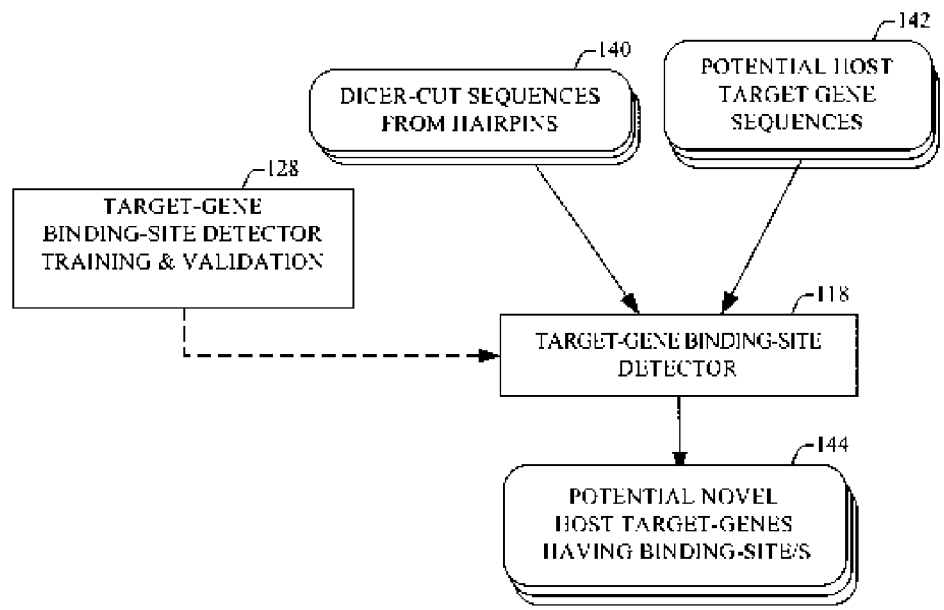
FIG. 7A is a simplified block diagram of a target-gene binding-site detector constructed and operative in accordance with a preferred embodiment of the present invention.

Reference is now made to FIG. 7A which is a simplified block diagram of a preferred implementation of the target-gene binding-site detector 118 described hereinabove with reference to FIG. 2. The goal of the target-gene binding-site detector 118 is to detect a BINDING SITE of FIG. 1, located in an untranslated region of the RNA of a known gene, the nucleotide sequence of which BINDING SITE is at least partially complementary to that of a VGAM RNA of FIG. 1, thereby determining that the abovementioned known gene is a target gene of VGAM of FIG. 1.

The target-gene binding-site detector 118 of FIG. 2 therefore receives as input a plurality of dicer-cut sequences from hairpins 140 of FIG. 6A which were calculated by the previous step, and a plurality of potential target gene sequences 142 which derive sequence DNA data 104 of FIG. 2, and after a phase of target-gene binding-site detector training & validation 128 of FIG. 3, is operative to detect target-genes having binding site/s 144 the nucleotide sequence of which is at least partially complementary to that of each of the plurality of dicer-cut sequences from hairpins 140. Preferred operation of the target-gene binding-site detector is further described hereinbelow with reference to FIG. 7B.

Figure 7B:
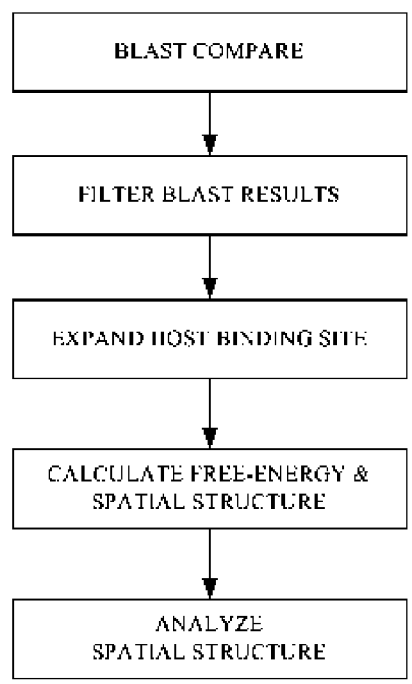
FIG. 7B is a simplified flowchart illustrating operation of a target-gene binding-site detector constructed and operative in accordance with a preferred embodiment of the present invention.

Reference is now made to FIG. 7B which is a simplified flowchart illustrating a preferred operation of the target-gene binding-site detector 118 of FIG. 2. In a preferred embodiment of the present invention, the target-gene binding-site detector 118 first performs a BLAST comparison of the nucleotide sequence of each of the plurality of dicer-cut sequences from hairpins 140, to the potential target gene sequences 142, in order to find crude potential matches. Blast results are then filtered to results which are similar to those of known binding sites (e.g. binding sites of miRNA genes Lin-4 and Let-7 to target genes Lin-14, Lin-41, Lin 28 etc.). Next the binding site is expanded, checking if nucleotide sequenced immediately adjacent to the binding site found by BLAST, may improve the match. Suitable binding sites, then are computed for free-energy and spatial structure. The results are analyzed, selecting only those binding sites, which have free-energy and spatial structure similar to that of known binding sites.

Reference is now made to FIG. 8 which is a simplified flowchart illustrating a preferred operation of the function & utility analyzer 120 described hereinabove with reference to FIG. 2. The goal of the function & utility analyzer 120 is to determine if a potential target gene is in fact a valid clinically useful target gene. Since a potential novel VGAM gene binding a binding site in the UTR of a target gene is understood to inhibit expression of that target gene, and if that target gene is shown to have a valid clinical utility, then in such a case it follows that the potential novel gene itself also has a valid useful function which is the opposite of that of the target gene.

The function & utility analyzer 120 preferably receives as input a plurality of potential novel target genes having binding-site/s 144, generated by the target-gene binding-site detector 118, both of FIG. 7A. Each potential gene, is evaluated as follows:

First the system first checks to see if the function of the potential target gene is scientifically well established. Preferably, this can be achieved bioinformatically by searching various published data sources presenting information on known function of proteins. Many such data sources exist and are published as is well known in the art.

Next, for those target genes the function of which is scientifically known and is well documented, the system then checks if scientific research data exists which links them to known diseases. For example, a preferred embodiment of the present invention utilizes the OMIM(™) database published by NCBI, which summarizes research publications relating to genes which have been shown to be associated with diseases.

Finally, the specific possible utility of the target gene is evaluated. While this process too may be facilitated by bioinformatic means, it might require human evaluation of published scientific research regarding the target gene, in order to determine the utility of the target gene to the diagnosis and or treatment of specific disease. Only potential novel genes, the target-genes of which have passed all three examinations, are accepted as novel genes.

Reference is now made to FIG. 9, which is a simplified diagram describing a novel bioinformatically detected group of regulatory genes, referred to here as Genomic Record (GR) genes, that encode an "operon-like" cluster of novel miRNA-like genes, each modulating expression of a plurality of host target, the function and utility of which target genes is known.

GR GENE (Genomic Record Gene) is gene of a novel, bioinformatically detected group of regulatory, non protein coding, RNA genes. The method by which GR is detected is described hereinabove with reference to FIGS. 6-15.

GR GENE encodes an RNA molecule, typically several hundred nucleotides long, designated GR PRECURSOR RNA.

GR PRECURSOR RNA folds spatially, as illustrated by GR FOLDED PRECURSOR RNA, into a plurality of what is known in the art as "hair-pin" structures. The nucleotide sequence of GR PRECURSOR RNA comprises a plurality of segments, the first half of each such segment having a nucleotide sequence which is at least a partial inversed-reversed sequence of the second half thereof, thereby causing formation of a plurality of "hairpin" structures, as is well known in the art.

GR FOLDED PRECURSOR RNA is naturally processed by cellular enzymatic activity, into 3 separate hairpin shaped RNA segments, each corresponding to VGAM PRECURSOR RNA of FIG. 1, designated VGAM1 PRECURSOR, VGAM2 PRECURSOR and VGAM3 PRECURSOR respectively.

The above mentioned VGAM precursors, are diced by Dicer of FIG. 1, yielding short RNA segments of about 22 nucleotides in length, each corresponding to VGAM RNA of FIG. 1, designated VGAM1, VGAM2 and VGAM3 respectively.

VGAM1, VGAM2 and VGAM3 each bind complementarily to binding sites located in untranslated regions of respective host target, designated VGAM1-TARGET RNA, VGAM2-TARGET RNA and VGAM3-TARGET RNA respectively. This binding inhibits translation of the respective target proteins designated VGAM1-TARGET PROTEIN, VGAM2-TARGET PROTEIN and VGAM3-TARGET PROTEIN respectively.

The structure of VGAM genes comprised in a GR GENE, and their mode of modulation of expression of their respective target genes is described hereinabove with reference to FIG. 1. The bioinformatic approach to detection of VGAM genes comprised in a GR GENE is described hereinabove with reference to FIGS. 9 through 14.

The present invention discloses 3283 novel viral genes of the GR group of genes, which have been detected bioinformatically, as described hereinbelow with reference to Tables 1 and 2. Laboratory confirmation of 3 genes of the GR group of genes is described hereinbelow with reference to FIGS. 9A through 14.

In summary, the current invention discloses a very large number of novel viral GR genes, each of which encodes a plurality of VGAM genes, which in turn may modulate expression of a plurality of host target proteins.

Reference is now made to FIG. 10 which is a block diagram illustrating different utilities of genes of the novel group of genes of the present invention referred to here as VGAM genes and GR genes.

The present invention discloses a first plurality of novel genes referred to here as VGAM genes, and a second plurality of operon-like genes referred to here as GR genes, each of the GR genes encoding a plurality of VGAM genes. The present invention further discloses a very large number of known target-genes, which are bound by, and the expression of which is modulated by each of the novel genes of the present invention. Published scientific data referenced by the present invention provides specific, substantial, and credible evidence that the abovementioned target genes modulated by novel genes of the present invention, are associated with various diseases. Specific novel genes of the present invention, target genes thereof and diseases associated therewith, are described hereinbelow with reference to Tables 1 and 2. It is therefore appreciated that a function of VGAM genes and GR genes of the present invention is modulation of expression of target genes related to known diseases, and that therefore utilities of novel genes of the present invention include diagnosis and treatment of the abovementioned diseases. FIG. 10 describes various types of diagnostic and therapeutic utilities of novel genes of the present invention.

A utility of novel genes of the present invention is detection of VGAM genes and of GR genes. It is appreciated that since VGAM genes and GR genes modulate expression of disease related target genes, that detection of expression of VGAM genes in clinical scenarios associated with said diseases is a specific, substantial and credible utility. Diagnosis of novel genes of the present invention may preferably be implemented by RNA expression detection techniques, including but not limited to biochips, as is well known in the art. Diagnosis of expression of genes of the present invention may be useful for research purposes, in order to further understand the connection between the novel genes of the present invention and the abovementioned related diseases, for disease diagnosis and prevention purposes, and for monitoring disease progress.

Another utility of novel genes of the present invention is anti-VGAM gene therapy, a mode of therapy which allows up regulation of a disease related target-gene of a novel VGAM gene of the present invention, by lowering levels of the novel VGAM gene which naturally inhibits expression of that target gene. This mode of therapy is particularly useful with respect to target genes which have been shown to be under-expressed in association with a specific disease. Anti-VGAM gene therapy is further discussed hereinbelow with reference to FIGS. 11A and 11B.

A further utility of novel genes of the present invention is VGAM replacement therapy, a mode of therapy which achieves down regulation of a disease related target-gene of a novel VGAM gene of the present invention, by raising levels of the VGAM gene which naturally inhibits expression of that target gene. This mode of therapy is particularly useful with respect to target genes which have been shown to be over-expressed in association with a specific disease. VGAM replacement therapy involves introduction of supplementary VGAM gene products into a cell, or stimulation of a cell to produce excess VGAM gene products. VGAM replacement therapy may preferably be achieved by transfecting cells with an artificial DNA molecule encoding a VGAM gene, which causes the cells to produce the VGAM gene product, as is well known in the art.

Yet a further utility of novel genes of the present invention is modified VGAM therapy. Disease conditions are likely to exist, in which a mutation in a binding site of a VGAM gene prevents natural VGAM gene to effectively bind inhibit a disease related target-gene, causing up regulation of that target gene, and thereby contributing to the disease pathology. In such conditions, a modified VGAM gene is designed which effectively binds the mutated VGAM binding site, i.e. is an effective anti-sense of the mutated VGAM binding site, and is introduced in disease effected cells. Modified VGAM therapy is preferably achieved by transfecting cells with an artificial DNA molecule encoding the modified VGAM gene, which causes the cells to produce the modified VGAM gene product, as is well known in the art.

An additional utility of novel genes of the present invention is induced cellular differentiation therapy. As aspect of the present invention is finding genes which determine cellular differentiation, as described hereinabove with reference to FIG. 11. Induced cellular differentiation therapy comprises transfection of cell with such VGAM genes thereby determining their differentiation as desired. It is appreciated that this approach may be widely applicable, inter alia as a means for auto transplantation harvesting cells of one cell-type from a patient, modifying their differentiation as desired, and then transplanting them back into the patient. It is further appreciated that this approach may also be utilized to modify cell differentiation in vivo, by transfecting cells in a genetically diseased tissue with a cell-differentiation determining VGAM gene, thus stimulating these cells to differentiate appropriately.

Reference is now made to FIGS. 11A and 11B, simplified diagrams which when taken together illustrate anti-VGAM gene therapy mentioned hereinabove with reference to FIG. 10. A utility of novel genes of the present invention is anti-VGAM gene therapy, a mode of therapy which allows up regulation of a disease related target-gene of a novel VGAM gene of the present invention, by lowering levels of the novel VGAM gene which naturally inhibits expression of that target gene. FIG. 11A shows a normal VGAM gene, inhibiting translation of a target gene of VGAM gene, by binding to a BINDING SITE found in an untranslated region of TARGET RNA, as described hereinabove with reference to FIG. 1.

FIG. 11B shows an example of anti-VGAM gene therapy. ANTI-VGAM RNA is short artificial RNA molecule the sequence of which is an anti-sense of VGAM RNA. Anti-VGAM treatment comprises transfecting diseased cells with ANTI-VGAM RNA, or with a DNA encoding thereof. The ANTI-VGAM RNA binds the natural VGAM RNA, thereby preventing binding of natural VGAM RNA to its BINDING SITE. This prevents natural translation inhibition of TARGET RNA by VGAM RNA, thereby up regulating expression of TARGET PROTEIN.

It is appreciated that anti-VGAM gene therapy is particularly useful with respect to target genes which have been shown to be under-expressed in association with a specific disease.

Reference is now made to FIG. 12A which is an annotated sequence of an EST comprising a novel gene detected by the gene detection system of the present invention. FIG. 12A shows the nucleotide sequence of a known human non-protein coding EST (Expressed Sequence Tag), identified as EST72223 (SEQ ID NO: 46756). It is appreciated that the sequence of this EST comprises sequences of one known miRNA gene, identified as MIR98, and of one novel GAM gene, referred to here as GAM24, detected by the bioinformatic gene detection system of the present invention, described hereinabove with reference to FIG. 2.

Reference is now made to FIGS. 12B and 12C that are pictures of laboratory results, which when taken together demonstrate laboratory confirmation of expression of the bioinformatically detected novel gene of FIG. 12A. Reference is now made to FIG. 12B which is a Northern blot analysis of MIR-98 and EST72223 transcripts. MIR-98 and EST72223 were reacted with MIR-98 and GAM24 probes as indicated in the figure. It is appreciated that the probes of both MIR-98 and GAM24 reacted with EST72223, indicating that EST72223 contains the sequences of MIR-98 and of GAM24. It is further appreciated that the probe of GAM24 does not cross-react with MIR-98.

Reference is now made to FIG. 12C. A Northern blot analysis of EST72223 and MIR-98 transfections were performed, subsequently marking RNA by the MIR-98 and GAM24 probes. Left, Northern reacted with MIR-98, Right, Northern reacted with GAM24. The molecular Sizes of EST72223, MIR-98 and GAM24 are indicated by arrows. Hela are control cells that have not been introduced to exogenous RNA. EST and MIR-98 Transfections are RNA obtained from Hela transfected with EST72223 and MIR-98, respectively. MIR-98 and EST are the transcripts used for the transfection experiment. The results indicate that EST72223, when transfected into Hela cells, is cut yielding known miRNA gene MIR-98 and novel miRNA gene GAM24.

Reference is now made to FIG. 12D, which is a Northern blot of a lysate experiment with MIR-98 and GAM24. Northern blot analysis of hairpins in EST72223. Left, Northern reacted with predicted Mir-98 hairpin probe, Right, Northern reacted with predicted GAM24 hairpin probe. The molecular size of EST Is indicated by arrow. The molecular sizes of Mir-98 and GAM24 are 80 nt and 100 nt, respectively as indicated by arrows. The 22 nt molecular marker is indicated by arrow. 1-Hela lysate; 2-EST incubated 4 h with Hela lysate; 3-EST without lysate; 4-Mir transcript incubated 4 h with Hela lysate; 5-Mir transcript incubated overnight with Hela lysate; 6-Mir transcript without lysate; 7-RNA extracted from Hela cells following transfection with Mir transcript.

Technical methods used in experiments, the results of which are depicted in FIGS. 12B, 12C and 12D are as follows:

Transcript preparations: Digoxigenin (DIG) labeled transcripts were prepared from EST72223 (TIGER), MIR98 and predicted precursor hairpins by using a DIG RNA labeling kit (Roche Molecular Biochemicals) according to the manufacturer's protocol. Briefly, PCR products with T7 promoter at the 5" end or T3 promoter at the 3" end were prepared from each DNA in order to use it as a template to prepare sense and antisense transcripts, respectively. MIR-98 was amplified using EST72223 as a template with T7miR98 forward primer: 5-"TAATACGACTCACTATAGGGTGAGGTAG-TAAGTTGTA TTGTT-3" (SEQ ID NO: 46760) and T3miR98 reverse primer: 5"-AATTAACCCTCAC- TAAAGGGAAAGTAGTAAG TTGTATAGTT-3" (SEQ ID NO: 46761). EST72223 was amplified with T7-EST 72223 forward primer: 5"-TAATACGACTCACTATAGGCCCT-TATTAGAGGATTCTGCT-3" (SEQ ID NO: 46762) and T3-EST72223 reverse primer: 5"-AATTAACCCTCAC-TAAAGGTTTTTTTTTCCTGAGACAG AGT3" (SEQ ID NO: 46763). Bet-4 was amplified using EST72223 as a template with Bet-4 forward primer: 5"-GAGGCAGGAGAAT-GCTTGA-3" (SEQ ID NO: 46764 and T3-EST72223 reverse primer: 5"-AATTAACCCTCACTAA AGGCCTGAGACA-GAGTCTTGCTC-3" (SEQ ID NO: 46765). The PCR products were cleaned and used for DIG-labeled or unlabeled transcription reactions with the appropriate polymerase. For transfection experiments, CAP reaction was performed by using a mMessage mMachine kit (Ambion).

Transfection procedure: Transfection of Hela cells was performed by using TransMessenger reagent (Qiagen) according to the manufacture's protocol. Briefly, Hela cells were seeded to 1–2×10^6 cells per plate a day before transfection. Two µg RNA transcripts were mixed with 8µl Enhancer in a final volume of 100µl, mixed and incubated at room temperature for 5 min. 16µl TransMessenger reagent was added to the RNA-Enhancer, mixed and incubated for additional 10 min. Cell plates were washed with sterile PBS twice and then incubated with the transfection mix diluted with 2.5 ml DMEM medium without serum. Cells were incubated with transfection mix for three hours under their normal growth condition (370 C and 5% CO2) before the transfection mix was removed and a fresh DMEM medium containing serum was added to the cells. Cells were left to grow 48 hours before harvesting.

Target RNA cleavage assay: Cap-labeled target RNAs were generated using mMessage mMachine™ (Ambion). Caped RNA transcripts were preincubated at 30° C. for 15 min in supplemented Hela S100 obtained from Computer Cell Culture, Mos, Belgium. After addition of all components, final concentrations were 100 mM target RNA, 1 m M ATP, 0.2 mM GTP, 10 U/ml RNasin, 30¼ g/ml creatine kinase, 25 mM creatine phosphate, and 50% S100 extract. Incubation was continued for 4 hours to overnight. Cleavage reaction was stopped by the addition of 8 volumes of proteinase K buffer (200 Mm Tris-Hcl, pH 7.5, 25 m M EDTA, 300 mM NaCI, and 2% SDS). Proteinase K, dissolved in 50 mM Tris-HCI, pH 8, 5 m M CaCl2, and 50% glycerol, was added to a final concentration of 0.6 mg/ml. Sample were subjected to phenol/chloroform extraction and kept frozen until analyzed by urea-TBE PAGE.

Northern analysis: RNAs were extracted from cells by using Tri-reagent according to the manufacture's protocol. The RNAs were dissolved in water and heated to 650 C. to disrupt any association of the 25 nt RNA with larger RNA molecules. RNA were placed on ice and incubated for 30 min with PEG (MW=8000) in a final concentration of 5% and NaCI in a final concentration of 0.5M to precipitate high molecular weight nucleic acid. The RNAs were centrifuged at 10,000×g for 10 min to pellet the high molecular weight nucleic acid. The supernatant containing the low molecular weight RNAs was collected and three volumes of ethanol was added. The RNAs were placed at −200 C for at least two hours and then centrifuged at 10,000×g for 10 min. The pellets were dissolved in Urea-TBE buffer (1Xtbe, 7M urea) for further analysis by a Northern blot.

RNA samples were boiled for 5 min before loading on 15%-8% polyacrylamide (19:1) gels containing 7M urea and 1×TBE. Gels were run in 1×TBE at a constant voltage of 300V and then transferred into a nylon membrane. The membrane was exposed to 3 min ultraviolet light to cross link the RNAs to the membrane. Hybridization was performed overnight with DIG-labeled probes at 420 C. Membranes were washed twice with SSCx2 and 0.2% SDS for 10 min. at 420 C and then washed twice with SSCx0.5 for 5 min at room temperature. The membrane was then developed by using a DIG luminescent detection kit (Roche) using anti DIG and CSPD reaction, according to the manufacture's protocol.

It is appreciated that the data presented in FIGS. 12A, 12B, 12C and 12D, when taken together validate the function of the bioinformatic gene detection engine 100 of FIG. 2. FIG. 12A shows a novel GAM gene bioinformatically detected by the bioinformatic gene detection engine 100, and FIGS. 12B, 12C and 12D show laboratory confirmation of the expression of this novel gene. This is in accord with the engine training and validation methodology described hereinabove with reference to FIG. 3.

Reference is now made to FIG. 13A which is an annotated sequence of an EST comprising a novel gene detected by the gene detection system of the present invention. FIG. 13A shows the nucleotide sequence of a known human non-protein coding EST (Expressed Sequence Tag), identified as EST 7929020 (SEQ ID NO: 46757). It is appreciated that the sequence of this EST comprises sequences of two novel GAM genes, referred to here as GAM23 and GAM25, detected by the bioinformatic gene detection system of the present invention, described hereinabove with reference to FIG. 2.

Reference is now made to FIG. 13B which presents pictures of laboratory results, that demonstrate laboratory confirmation of expression of the bioinformatically detected novel gene of FIG. 13A. Northern blot analysis of hairpins in EST7929020. Left, Northern reacted with predicted GAM25 hairpin probe, Right, Northern reacted with predicted GAM23 hairpin probe. The molecular size of EST is indicated by arrow. The molecular sizes of GAM23 and GAM25 are 60 nt, as indicated by arrow. The 22 nt molecular marker is indicated by arrow. 1-Hela lysate; 2-EST incubated 4 h with Hela lysate; 3-EST incubated overnight with Hela lysate; 4-EST without lysate; 5-GAM transcript; 6-GAM 22 nt marker; 7-GAM PCR probe; 8-RNA from control Hela cells; 9-RNA extracted from Hela cells following transfection with EST.

Reference is now made to FIG. 13C which is a picture of a Northern blot confirming Endogenous expression of bioinformatically detected gene GAM25 of FIG. 13A from in Hela cells. Northern was reacted with a predicted GAM25 hairpin probe. The molecular size of EST7929020 is indicated. The molecular sizes of GAM25 is 58 nt, as indicated. A 19 nt DNA oligo molecular marker is indicated. Endogenous expression of GAM25 in Hela total RNA fraction and in S-100 fraction is indicated by arrows. 1-GAM25 transcript; 2-GAM25 DNA oligo marker; 3-RNA from control Hela cells; 4-RNA extracted from Hela cells following transfection with EST; 5-RNA extracted from S-100 Hela lysate.

Reference is now made to FIG. 14A which is an annotated sequence of an EST comprising a novel gene detected by the gene detection system of the present invention. FIG. 14A shows the nucleotide sequence of a known human non-protein coding EST (Expressed Sequence Tag), identified as EST 1388749 (SEQ ID NO: 46758). It is appreciated that the sequence of this EST comprises sequence of a novel GAM gene, referred to here as GAM26, detected by the bioinformatic gene detection system of the present invention, described hereinabove with reference to FIG. 2.

Reference is now made to FIG. 14B which is a picture of Northern blot analysis, confirming expression of novel bioinformatically detected gene GAM26, and natural processing thereof from EST1388749. Northern reacted with predicted GAM26 hairpin probe. The molecular size of EST is indicated by arrow. The molecular sizes of GAM26 is 130 nt, as indicated by arrow. The 22 nt molecular marker is indicated by arrow. 1-Hela lysate; 2-EST incubated 4 h with Hela lysate; 3-EST incubated overnight with Hela lysate; 4-EST without lysate; 5-GAM transcript; 6-GAM 22 nt marker; 7-GAM PCR probe.

VGAM1931 RNA, herein schematically represented by VGAM2 binds complimentarily to a host target binding site located in an untranslated region of VGAM1931 host target RNA, herein schematically represented by VGAM2 HOST TARGET RNA, which host target binding site corresponds to a host target binding site such as BINDING SITE I, BINDING SITE II, or BINDING SITE III of FIG. 1, thereby inhibiting translation of VGAM1931 host target RNA, herein schematically represented by VGAM2 HOST TARGET RNA into VGAM1931 host target protein, herein schematically represented by VGAM2 HOST TARGET PROTEIN, both of FIG. 1.

Figures 15A, 15B, 15C:
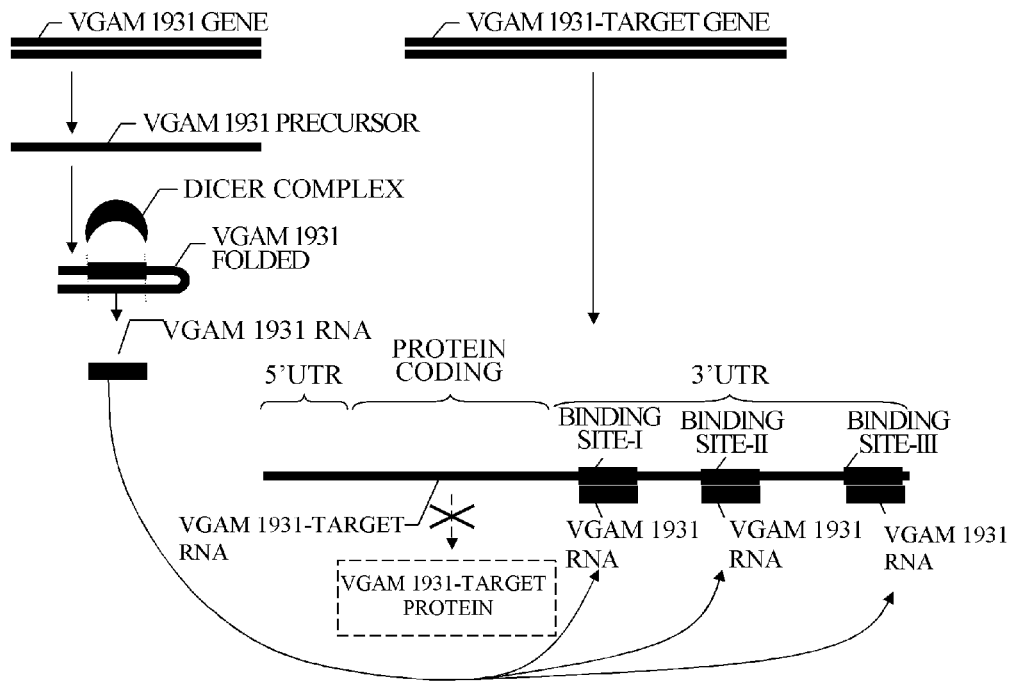

Reference is now made to FIG. 15A, which is a simplified diagram providing a conceptual explanation of the mode by which a novel bioinformatically detected viral gene, referred to here as Viral. Genomic Address Messenger 1931 (VGAM1931) modulates expression of host target genes thereof, the function and utility of which host target genes is known in the art.

VGAM1931 is a novel bioinformatically detected regulatory, non protein coding, viral micro RNA (miRNA) gene. The method by which VGAM1931 was detected is described hereinabove with reference to FIGS. 2-8.

VGAM1931 GENE is a viral gene contained in the genome of Human herpesvirus 4. VGAM1931-HOST TARGET GENE is a human gene contained in the human genome.

VGAM1931 GENE encodes a VGAM1931 PRECURSOR RNA. Similar to other miRNA genes, and unlike most ordinary genes, the RNA transcribed by VGAM1931, VGAM1931 PRECURSOR RNA, does not encode a protein.

VGAM1931 PRECURSOR RNA folds onto itself, forming a 'hairpin structure' designated VGAM1931 FOLDED PRECURSOR RNA. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof. By "inversed-reversed" is meant a sequence which is reversed and wherein each nucleotide is replaced by a complementary nucleotide, as is well known in the art (e.g. ATGGC is the inversed-reversed sequence of GCCAT).

An enzyme complex designated DICER COMPLEX, 'dices' the VGAM1931 FOLDED PRECURSOR RNA into a single stranded ~22 nt long RNA segment, designated VGAM1931 RNA. As is known in the art, 'dicing' of a hairpin structured RNA precursor product into a short ~22 nt RNA segment is catalyzed by an enzyme complex comprising an enzyme called Dicer together with other necessary proteins.

VGAM1931-HOST TARGET GENE encodes a corresponding messenger RNA, designated VGAM1931-HOST-TARGET RNA. VGAM1931-HOST-TARGET RNA comprises three regions, as is typical of mRNA of a protein coding gene: a 5' untranslated region, a protein coding region and a 3' untranslated region, designated 5'UTR, PROTEIN CODING and 3'UTR respectively.

VGAM1931 RNA binds complementarily to one or more host binding sites located in untranslated regions of VGAM1931-HOST-TARGET RNA. This complementary binding is due to the fact that the nucleotide sequence of VGAM1931 RNA is an accurate or a partial inversed-reversed sequence of the nucleotide sequence of each of the host binding sites. As an illustration, FIG. 1931A shows 3 such host binding sites, designated BINDING SITE-I, BINDING SITE-II and BINDING SITE-III respectively. It is appreciated that the number of host binding sites shown in FIG. 1931A is meant as an illustration only, and is not meant to be limiting—VGAM1931 may have a different number of binding sites in untranslated regions of a VGAM1931-HOST-TARGET RNA. It is further appreciated that while FIG. 15A depicts the host binding sites in the 3'UTR region, this is meant as an example only—the binding sites may be located in the 3'UTR region, the 5'UTR region, or in both 3'UTR and 5'UTR regions.

The complementary binding of VGAM1931 RNA to BINDING SITE-I, BINDING SITE-II and BINDING SITE-III inhibits translation of VGAM1931-HOST-TARGET RNA into VGAM1931-HOST-TARGET PROTEIN. VGAM1931-HOST-TARGET PROTEIN is therefore outlined by a broken line.

It is appreciated that VGAM1931-HOST-TARGET GENE in fact represents a plurality of host target genes of VGAM1931. The mRNA of each of this plurality of host target genes of VGAM1931 comprises one or more host binding site, having a nucleotide sequence which is at least partly complementary to VGAM1931 RNA, and which when bound by VGAM1931 RNA causes inhibition of translation of one of a plurality of host target proteins of VGAM1931. Host target genes of VGAM1931 and their respective host binding sites, are described hereinbelow with reference to FIG. 15D.

It is further appreciated by one skilled in the art that the mode of translational inhibition illustrated by FIG. 15A with specific reference to translational inhibition exerted by VGAM1931 on one or more host target genes of VGAM1931, is in fact common to other known non-viral miRNA genes. As mentioned hereinabove with reference to the background section, although a specific complementary binding site has been demonstrated only for miRNA genes Lin-4 and Let-7, all other recently discovered miRNA genes are also believed by those skilled in the art to modulate expression of other genes by complementary binding, although specific complementary binding sites of these genes have not yet been found (Ruvkun G., 'Perspective: Glimpses of a tiny RNA world', Science 294, 779 (2001)).

It is yet further appreciated that a function of VGAM1931 is inhibition of expression of host target genes, as part of a novel viral mechanism of attacking a host. Accordingly, utilities of VGAM1931 include diagnosis, prevention and treatment of viral infection by Human herpesvirus 4. Specific functions, and accordingly utilities, of VGAM1931 correlate with, and may be deduced from, the identity of the target genes which VGAM1931 binds and inhibits, and the function of these target genes, as elaborated hereinbelow with reference to FIG. 15D.

Reference is now made to FIG. 15B, which shows the nucleotide sequence of VGAM1931 PRECURSOR RNA of FIG. 15A, designated SEQ ID:1917, and a probable (over 74%) nucleotide sequence of VGAM1931 RNA of FIG. 15A, designated SEQ ID:4642. The nucleotide sequence of SEQ ID:4642 is marked by an underline within the sequence of VGAM1931 PRECURSOR RNA. Nucleotide sequence SEQ ID:1917 is located at position 151629 relative to the genome of Human herpesvirus 4.

Reference is now made to FIG. 15C, which shows the secondary folding of VGAM1931 PRECURSOR RNA, forming a 'hairpin structure' designated VGAM1931 FOLDED PRECURSOR RNA, both of FIG. 15A. The nucleotide sequence of SEQ ID:4642, which is highly likely (>74%) to be identical or highly similar to the nucleotide sequence of VGAM1931 RNA is marked on VGAM1931 FOLDED PRECURSOR RNA by a solid underline. It is appreciated that the complementary base-paring is not perfect, with 'bulges', as is well known in the art with respect to the RNA folding of all known miRNA genes.

Reference is now made to FIG. 15D, which is a table showing complementarity of host binding sites of VGAM1931, found in untranslated regions of host target genes of VGAM1931, to SEQ ID:4642, which is highly likely (>74%) to be identical or highly similar to the nucleotide sequence of VGAM1931 RNA of FIG. 15A. Each of the host binding sites described hereinbelow corresponds to a host binding site, such as BINDING SITE-I, BINDING SITE-II or BINDING SITE-III, all of FIG. 15A, and each of the host target genes of VGAM1931 described hereinbelow corresponds to VGAM HOST TARGET GENE of FIG. 15A.

As mentioned hereinabove with reference to FIG. 15A a function of VGAM1931 is inhibition of expression of host target genes, as part of a novel viral mechanism of attacking a host. Accordingly, utilities of VGAM1931 include diagnosis, prevention and treatment of viral infection by Human herpesvirus 4. It is appreciated that specific functions, and accordingly utilities, of VGAM1931 correlate with, and may be deduced from, the identity of the host target genes which VGAM1931 binds and inhibits, and the function of these host target genes, as elaborated herein below.

Reference is now made to COL6A1 BINDING SITE. collagen, type VI, alpha 1 (COL6A1, Accession NM_001848) is a host target gene of VGAM1931, corresponding to VGAM1931-HOST TARGET GENE of FIG. 15A. COL6A1 BINDING SITE is a host binding site found in the 3' untranslated region of COL6A1, corresponding to a host binding site such as BINDING SITE-I, BINDING SITE-II or BINDING SITE-III, all of FIG. 15A. FIG. 15D illustrates the complementarity of the nucleotide sequence of COL6A1 BINDING SITE, designated SEQ ID:7584, to the nucleotide sequence of VGAM1931 RNA of FIG. 15A, designated SEQ ID:4642.

A function of VGAM1931 is therefore inhibition of collagen, type VI, alpha 1 (COL6A1), a host gene which encodes a Protein that is associated with BETHLEM MYOPATHY, as part of a novel viral mechanism used by Human herpesvirus 4 for attacking a host. Accordingly, utilities of VGAM1931 include diagnosis, prevention and treatment of viral infection by Human herpesvirus 4. The function and utilities of COL6A1 have been established by previous studies, as described hereinabove with reference to FIG. 1119D.

Reference is now made to SFRS1 BINDING SITE. splicing factor, arginine/serine-rich 1 (splicing factor 2, alternate splicing factor) (SFRS1, Accession NM_006924) is a host target gene of VGAM1931, corresponding to VGAM1931-HOST TARGET GENE of FIG. 15A. SFRS1 BINDING SITE is a host binding site found in the 3' untranslated region of SFRS1, corresponding to a host binding site such as BINDING SITE-I, BINDING SITE-II or BINDING SITE-III, all of FIG. 15A. FIG. 15D illustrates the complementarity of the nucleotide sequence of SFRS1 BINDING SITE, designated SEQ ID:13801, to the nucleotide sequence of VGAM1931 RNA of FIG. 15A, designated SEQ ID:4642.

Yet another function of VGAM1931 is therefore inhibition of splicing factor, arginine/serine-rich I (splicing factor 2, alternate splicing factor) (SFRS1), a host gene which encodes a Protein that plays an essential role in pre-mRNA splicing, as part of a novel viral mechanism used by Human herpesvirus 4 for attacking a host. Accordingly, utilities of VGAM1931 include diagnosis, prevention and treatment of viral infection by Human herpesvirus 4. The function and utilities of SFRS1 have been established by previous studies, as described hereinabove with reference to FIG. 323D.

Reference is now made to HIP12 BINDING SITE. HIP12 (Accession XM_038791) is a host target gene of VGAM1931, corresponding to VGAM1931-HOST TARGET GENE of FIG. 15A. HIP12 BINDING SITE is a host binding site found in the 3' untranslated region of HIP12, corresponding to a host binding site such as BINDING SITE-I, BINDING SITE-II or BINDING SITE-III, all of FIG. 15A. FIG. 15D illustrates the complementarity of the nucleotide sequence of HIP12 BINDING SITE, designated SEQ ID:32922, to the nucleotide sequence of VGAM1931 RNA of FIG. 15A, designated SEQ ID:4642.

An additional function of VGAM1931 is therefore inhibition of (HIP12), a host gene which encodes a Protein that is a component of clathrin-coated pits and vesicles, that may link the endocytic machinery to the actin cytoskeleton., as part of a novel viral mechanism used by Human herpesvirus 4 for attacking a host. Accordingly, utilities of VGAM1931 include diagnosis, prevention and treatment of viral infection by Human herpesvirus 4.

The function of HIP12 has been established by previous studies. Huntingtin-interacting protein-1 (HIP1; 601767) is a membrane-associated protein that interacts with huntingtin (143100), the protein altered in Huntington disease. While attempting to isolate the mouse homolog of HIP1, Chopra et al. (2000) identified a homologous cDNA, which they designated Hip12. By screening a human frontal cortex cDNA library with an EST that showed homology to mouse Hip12, Chopra et al. (2000) cloned a full-length HIP12 cDNA encoding a deduced 1,068-amino acid protein that shares 47% sequence identity with HIP1. The highest degree of similarity occurs in the C-terminal region, which shows considerable homology to the cytoskeletal protein talin (186745). Northern blot analysis detected expression of a 5-kb HIP12 transcript in brain, heart, kidney, pancreas, and liver, but not in lung or placenta. In ES cell-derived neurons, both HIP1 and HIP12 are highly expressed and distributed throughout the cytoplasm and cell processes with enrichment within the cis-Golgi. In contrast to HIP1, which is toxic in cell culture, HIP12 does not confer toxicity in the same assay systems. HIP12 does not interact with huntingtin but can interact with HIP1, suggesting a potential interaction in vivo that may influence the function of each respective protein. By searching EST databases for homologs of yeast Sla2p, Engqvist-Goldstein et al. (1999) identified mouse and human cDNAs encoding HIP1R. The deduced human protein, which is 91% identical to the mouse sequence, is identical to the KIAA0655 protein reported by Ishikawa et al. (1998). It is also identical to the shorter sequence reported by Seki et al. (1998) except that it contains approximately 180 additional amino acids in it N terminus, including a conserved domain implicated in the endocytic function of Sla2p. HIP1R has 3 predicted coiled coils and a C-terminal talin-like domain, which Engqvist-Goldstein et al. (1999) confirmed binds F-actin in vitro. Northern blot analysis revealed that mouse Hip1r is expressed ubiquitously, with reduced expression in skeletal muscle and heart, consistent with RT-PCR analysis of human HIP1R expression (Seki et al., 1998; Ishikawa et al., 1998). Fluorescence microscopy demonstrated that mouse Hip1r is expressed as punctate structures, enriched at the cell cortex and excluded from the nucleus, which colocalize with clathrin (see 118955) and other markers of receptor-mediated endocytosis.

Full details of the abovementioned studies are described in the following publications, the disclosure of which are hereby incorporated by reference:

Chopra, V. S.; Metzler, M.; Rasper, D. M.; Engqvist-Goldstein, A. E. Y.; Singaraja, R.; Gan, L.; Fichter, K. M.; McCutcheon, K.; Drubin, D.; Nicholson, D. W.; Hayden, M. R.: HIP12 is a non-proapoptotic member of a gene family including HIP1, an interacting protein with huntingtin. Mammalian Genome 11: 1006-1015, 2000.; and Engqvist-Goldstein, A. E. Y.; Kessels, M. M.; Chopra, V. S.; Hayden, M. R.; Drubin, D. G.: An actin-binding protein of the Sla2/Huntingtin interacting protein 1 family is a novel compo.

Further studies establishing the function and utilities of HIP12 are found in John Hopkins OMIM database record ID 605613, and in sited publications numbered 10160, 20936 and 20937-20938 listed in the bibliography section hereinbelow, which are also hereby incorporated by reference.

Reference is now made to ZNF212 BINDING SITE. zinc finger protein 212 (ZNF212, Accession NM_012256) is a host target gene of VGAM1931, corresponding to VGAM1931-HOST TARGET GENE of FIG. 15A. ZNF212 BINDING SITE is a binding site found in the 3' untranslated region of ZNF212, corresponding to a host binding site such as BINDING SITE-I, BINDING SITE-II or BINDING SITE-III, all of FIG. 15A. FIG. 15D illustrates the complementarity of the nucleotide sequence of ZNF212 BINDING SITE, designated SEQ ID:14557, to the nucleotide sequence of VGAM1931 RNA of FIG. 15A, designated SEQ ID:4642.

A further function of VGAM1931 is therefore inhibition of zinc finger protein 212 (ZNF212). Accordingly, utilities of VGAM1931 include diagnosis and treatment of diseases and clinical conditions with which ZNF212 is associated.

Reference is now made to FLJ20436 BINDING SITE. FLJ20436 (Accession NM_017822) is a host target gene of VGAM1931, corresponding to VGAM1931-HOST TARGET GENE of FIG. 15A. FLJ20436 BINDING SITE is a binding site found in the 3' untranslated region of FLJ20436, corresponding to a host binding site such as BINDING SITE-I, BINDING SITE-II or BINDING SITE-III, all of FIG. 15A. FIG. 15D illustrates the complementarity of the nucleotide sequence of FLJ20436 BINDING SITE, designated SEQ ID:19472, to the nucleotide sequence of VGAM1931 RNA of FIG. 15A, designated SEQ ID:4642.

Yet a further function of VGAM1931 is therefore inhibition of (FLJ20436). Accordingly, utilities of VGAM1931 include diagnosis and treatment of diseases and clinical conditions with which FLJ20436 is associated.

Reference is now made to KIAA1622 BINDING SITE. KIAA1622 (Accession NM_058237) is a host target gene of VGAM1931, corresponding to VGAM193'-HOST TARGET GENE of FIG. 15A. KIAA1622 BINDING SITE is a binding site found in the 3' untranslated region of KIAA1622, corresponding to a host binding site such as BINDING SITE-I, BINDING SITE-II or BINDING SITE-III, all of FIG. 15A. FIG. 15D illustrates the complementarity of the nucleotide sequence of KIAA1622 BINDING SITE, designated SEQ ID:27766, to the nucleotide sequence of VGAM1931 RNA of FIG. 15A, designated SEQ ID:4642.

Another function of VGAM1931 is therefore inhibition of (KIAA1622). Accordingly, utilities of VGAM1931 include diagnosis and treatment of diseases and clinical conditions with which KIAA1622 is associated.

Reference is now made to LOC51312 BINDING SITE. LOC51312 (Accession NM_018579) is a host target gene of VGAM1931, corresponding to VGAM1931-HOST TARGET GENE of FIG. 15A. LOC51312 BINDING SITE is a binding site found in the 5' untranslated region of LOC51312, corresponding to a host binding site such as BINDING SITE-I, BINDING SITE-II or BINDING SITE-III, all of FIG. 15A. FIG. 15D illustrates the complementarity of the nucleotide sequence of LOC51312 BINDING SITE, designated SEQ ID:20659, to the nucleotide sequence of VGAM1931 RNA of FIG. 15A, designated SEQ ID:4642.

Yet another function of VGAM1931 is therefore inhibition of (LOC51312). Accordingly, utilities of VGAM1931 include diagnosis and treatment of diseases and clinical conditions with which LOC51312 is associated.

Reference is now made to LOC57105 BINDING SITE. LOC57105 (Accession NM_020377) is a host target gene of VGAM1931, corresponding to VGAM1931-HOST TARGET GENE of FIG. 15A. LOC57105 BINDING SITE is a binding site found in the 3' untranslated region of LOC57105, corresponding to a host binding site such as BINDING SITE-I, BINDING SITE-II or BINDING SITE-III, all of FIG. 15A. FIG. 15D illustrates the complementarity of the nucleotide sequence of LOC57105 BINDING SITE, designated SEQ ID:21639, to the nucleotide sequence of VGAM1931 RNA of FIG. 15A, designated SEQ ID:4642.

An additional function of VGAM1931 is therefore inhibition of (LOC57105). Accordingly, utilities of VGAM1931 include diagnosis and treatment of diseases and clinical conditions with which LOC57105 is associated.

Reference is now made to LOC146603 BINDING SITE. LOC146603 (Accession XM_085514) is a host target gene of VGAM1931, corresponding to VGAM1931-HOST TARGET GENE of FIG. 15A. LOC146603 BINDING SITE is a binding site found in the 5' untranslated region of LOC146603, corresponding to a host binding site such as BINDING SITE-I, BINDING SITE-II or BINDING SITE-III, all of FIG. 15A. FIG. 15D illustrates the complementarity of the nucleotide sequence of LOC146603 BINDING SITE, designated SEQ ID:38215, to the nucleotide sequence of VGAM1931 RNA of FIG. 15A, designated SEQ ID:4642.

A further function of VGAM1931 is therefore inhibition of (LOC146603). Accordingly, utilities of VGAM1931 include diagnosis and treatment of diseases and clinical conditions with which LOC146603 is associated.

Reference is now made to LOC145761 BINDING SITE. LOC145761 (Accession XM_096855) is a host target gene of VGAM1931, corresponding to VGAM1931-HOST TARGET GENE of FIG. 15A. LOC145761 BINDING SITE is a binding site found in the 5' untranslated region of LOC145761, corresponding to a host binding site such as BINDING SITE-I, BINDING SITE-II or BINDING SITE-III, all of FIG. 15A. FIG. 15D illustrates the complementarity of the nucleotide sequence of LOC145761 BINDING SITE, designated SEQ ID:40584, to the nucleotide sequence of VGAM1931 RNA of FIG. 15A, designated SEQ ID:4642.

Yet a further function of VGAM1931 is therefore inhibition of (LOC145761). Accordingly, utilities of VGAM1931 include diagnosis and treatment of diseases and clinical conditions with which LOC145761 is associated.

Reference is now made to LOC202986 BINDING SITE. LOC202986 (Accession XM_117489) is a host target gene of VGAM1931, corresponding to VGAM1931-HOST TARGET GENE of FIG. 15A. LOC202986 BINDING SITE is a binding site found in the 3' untranslated region of LOC202986, corresponding to a host binding site such as BINDING SITE-I, BINDING SITE-II or BINDING SITE-III, all of FIG. 15A. FIG. 15D illustrates the complementarity of the nucleotide sequence of LOC202986 BINDING SITE, designated SEQ ID:43470, to the nucleotide sequence of VGAM1931 RNA of FIG. 15A, designated SEQ ID:4642.

Another function of VGAM1931 is therefore inhibition of (LOC202986). Accordingly, utilities of VGAM1931 include diagnosis and treatment of diseases and clinical conditions with which LOC202986 is associated.

TABLE 1

| GENE | PRECURSOR-SEQUENCE | P-SEQ | GENE-SEQ ID | G-SEQ ID | FOLDED PRECURSOR |
|---|---|---|---|---|---|
| GAM 1931 | CCCGTGGGGGGTCTTAGTGG AAGTGACGTGCTGTGAATAC AGGTCCATAGCACCGCTATC CACTATGTCTCGCCCGGG | 1917 | TAGCACCGCT ATCCACTATG TCTC | 4642 | ``` T   G    TCT     -     AC         A   A CCCG GG GGG    TAGTGGA AGTG   GTGCTGTG AT C ||||  || |||    ||||||| ||||   |||||||| || GGGC CC CTC    ATCACCT TCGC   CACGATAC TG A  -  G    TGT     A     --         C   G ``` |

Nucleotide sequence of the VGAM PRECURSOR RNA, and of the 'diced' VGAM RNA, and a Schematic representation of the secondary folding of VGAM FOLDED PRECURSOR RNA of each of the plurality VGAM GENEs described by FIG. 1 are further described hereinbelow with reference to Table 1.

Nucleotide sequences of the VGAM1931 precursor RNA, herein designated VGAM PRECURSOR RNA, and of the diced VGAM1931 RNA, herein designated VGAM RNA, and a schematic representation of the secondary folding of VGAM1931 folded precursor RNA, herein designated VGAM FOLDED PRECURSOR RNA, of VGAM1931 are further described hereinbelow with reference to Table 1.

TABLE 2

| GENE | TARGET | UTR | SEQUENCE | SEQ ID | BINDING-SITE |
|---|---|---|---|---|---|
| GAM 1931 | COL6A1 | 3' | AGACCCTCGAGATTAACGGTGCTA | 7584 | ```       CT_     CACTAT TAGCACCG   ATC        GTCT ||||||||   |||        |||| ATCGTGGC   TAG        CAGA      AAT     AGCTCC``` |
| GAM 1931 | HIP12 | 3' | GAGACATAGCGGCCCGGGCGCTG | 32922 | ```   A_    CTAT    A TAGC  CCG     CC  CTATGTCTC ||||  |||     ||  ||||||||| GTCG  GGC     GG  GATACAGAG   CG    CC__  C``` |
| GAM 1931 | SFRS1 | 3' | GACTTAGGTGGGTAGCAATGC | 13801 | ```    CC             AT_ GCA    GCTATCCACT   GTC |||    ||||||||||   ||| CGT    CGATGGGTGG   CAG    AA             ATT``` |
| GAM 1931 | FLJ20436 | 3' | AGACACAGTGGATATTTTGGC | 19472 | ```  A   C__        A GC CCG   TATCCACT TGTCT || |||   |||||||| ||||| CG GGT   ATAGGTGA ACAGA  _      TTT       C``` |
| GAM 1931 | KIAA1622 | 3' | GAGACATAATGACAGCTGATGTTA | 27766 | ```         C _  A CAC TAGCA C GCT TC      TATGTCTC ||||| | ||| ||      |||||||| ATTGT G CGA AG      ATACAGAG      A T   C  TA_``` |
| GAM 1931 | ZNF212 | 3' | GAGAGCAGGGGACACGGTGCTA | 14557 | ```         CTA     ACTA _ TAGCACCG    TCC     TG TCTC ||||||||    |||     || |||| ATCGTGGC    AGG     AC AGAG AC_     GG__    G``` |
| GAM 1931 | LOC146603 | 5' | GAGACACAGTGAAAAGGGGT | 40584 | ```    G ATC     A ACC CT   CACT TGTCTC ||| ||   ||||  |||||| TGG GA   GTGA  ACAGAG    G AAA     C``` |
| GAM 1931 | LOC146603 | 5' | ACATAGTGGACAGCATTGT | 38215 | ```    CC  A GCA  GCT  TCCACTATGT |||  |||  |||||||||| TGT  CGA  AGGTGATACA  TA    C``` |

TABLE 2-continued

| | | | | | |
|---|---|---|---|---|---|
| GAM 1931 | LOC20 2986 | 3' | GAGACATAACGATTTGGATTGCTA | 43470 | ``` ___CT___CAC____ TAGCA   CCG ATC    TATGTCTC ┆┆┆┆┆   ┆┆┆ ┆┆┆    ┆┆┆┆┆┆┆┆ ATCGT   CCG TAG    ATACAGAG    TA    T_  CA_ ``` |
| GAM 1931 | LOC5 1312 | 5' | GAAATATGGATAGCAGC | 20659 | ``` ACC       C   G GC   GCTATCCA TAT TC ┆┆   ┆┆┆┆┆┆┆┆ ┆┆┆ ┆┆ CG   CGATAGGT ATA AG A__           _   A ``` |
| GAM 1931 | LOC5 7105 | 3' | GAGATATAGCAACTAACGACGCTA | 21639 | ``` AC  C  TCCA TAGC CG TA    CTATGTCTC ┆┆┆┆ ┆┆ ┆┆    ┆┆┆┆┆┆┆┆┆ ATCG GC AT    GATATAGAG CA  A  CAAC ``` |

Nucleotide sequence of host target binding sites, such as BINDING SITE-I, BINDING SITE-II and BINDING SITE-III of FIG. 1, found on, and schematic representation of the complementarity of each of these host target binding sites to VGAM RNA are described hereinbelow with reference to Table 2.

Nucleotide sequences of host target binding sites, such as BINDING SITE-I, BINDING SITE-II and BINDING SITE-III of FIG. 1, found on, and schematic representation of the complementarity of each of these host target binding sites to VGAM1931 RNA, herein designated VGAM RNA, are described hereinbelow with reference to Table 2.

SEQUENCE LISTING (46765 sequences)

SEQ ID NO: 1 - RNA, 131 nt, Human herpesvirus 7
acaguuaaaaguuuagcuucgucauaacuaacaauugaacaaguaucauaaauuagauuuggcguaauaggucgcacauucagcacauguucacuauuguauuuuggaaugaaauguaaauccguuaccgu

SEQ ID NO: 2 - RNA, 78 nt, Human herpesvirus 7
cuauuugaaaaugacuauuaaauuuuuguggaagaugucuauucugaauuuccauguuaguaguaauacaucgaaaag

SEQ ID NO: 3 - RNA, 131 nt, ictalurid herpesvirus 1
gugguucguagugacuauuggugaaaaggaugauguacucgggggggaugccuuccugguuggucgccacuaguuucaccaaucgccccccuauuuuaucccacgacacaacggucaccccgacgccccgc

SEQ ID NO: 4 - RNA, 71 nt, Invertebrate iridescent virus 6
aaagaggugaggaaaaugaagauguauaccuuuuuuuacaauauauuuaucuucgcuuucguuaauucuuu

SEQ ID NO: 5 - RNA, 131 nt, Invertebrate iridescent virus 6
aaauuuuuuaugacauuguugaauuauuacuugaagcuaccaaugauaaaaaagcaucuucuauagauucaagaugcguuguuuguuaugaaaaugaaauuuguauaaaaauucaaccauguaaucauuuu

SEQ ID NO: 6 - RNA, 102 nt, Invertebrate iridescent virus 6
aagauuugguuauagauggaugagaaauauaauuuauaguugugcucauuaauuuuaauaugguaugcacuuguuguuuuuuaucauuuuuaacuuuuucuu

SEQ ID NO: 7 - RNA, 99 nt, Invertebrate iridescent virus 6
aauaacauuuguuuucauauuuuucauuucuucuuguauugauggauauaauuucaauucaggauuagaugaugagaauucuugaauaaugauauuauu

SEQ ID NO: 8 - RNA, 118 nt, Invertebrate iridescent virus 6
aauaugcuagaguuucacuugcauuuacuuuagcuuuucaucaaauaaauaacaauaaggugacaccuuuaauguuggaugaaagaacagcuaauuuagaucaagaucuuaguacauu

SEQ ID NO: 9 - RNA, 130 nt, Invertebrate iridescent virus 6
aaugguaacaguugaaggacuaagaguagcuaaagauguagcguauuuauuuucaagugauuuuaaauaaucaaaagagauauuuuguucugcaaaucuaucccucuuuuuuauucuuucaaaugccauu

SEQ ID NO: 10 - RNA, 90 nt, Invertebrate iridescent virus 6
acaguuuccuaaauuuuuaaauuacuuaaaguauucaaaauacgauuauucuaugcuugaaaguaauaauagaauuuuguuuguagcugu

SEQ ID NO: 11 - RNA, 83 nt, Invertebrate iridescent virus 6
acauucguuguauaaagaaucaauugcauuugaaaaauuugcuaacguugguuuuaaauaacuuuuuucuuuaguaacgaugu

SEQ ID NO: 12 - RNA, 76 nt, Invertebrate iridescent virus 6
accauccauaugaaccucuuagagauguuccaaguauauuauauauuggaauagguuuuggaauuaaauauggggu

SEQ ID NO: 13 - RNA, 70 nt, Invertebrate iridescent virus 6
accgaugaaauaauuaaaacuuguggaacaaauggacuuccuaugacacaaaacgaaauuaaagauuggu

SEQ ID NO: 14 - RNA, 63 nt, Invertebrate iridescent virus 6
agaagaauuuuuuucucuccaauguaaucuccaaaagcauuauaaccagauaaaaauuuuucu

SEQ ID NO: 15 - RNA, 63 nt, Invertebrate iridescent virus 6
agauaacaaugguuugggugaaauuuuuaacuacgaaagucuauuacccauacuaaaagaucu

SEQ ID NO: 16 - RNA, 74 nt, Invertebrate iridescent virus 6
agcuuaccaauauuaguauuguaccaacugcaagcccugcugcuaaaguuggugcugcugguacugguccugcu

SEQ ID NO: 17 - RNA, 130 nt, Invertebrate iridescent virus 6
auaauaugaauuugaauaauaugaauuuacuuaaagaaguauccgaagaaaaucguuuaauguuacuuaaagacuauuuucaaacaucgggucuuguuaaacaucaguuagaaacguuugaucauuuuau

SEQ ID NO: 18 - RNA, 61 nt, Invertebrate iridescent virus 6
auagcgguguuguaauuuguaauguaagcgaaacaccuauauuacaaucuuuaccgguuau

SEQ ID NO: 19 - RNA, 69 nt, Invertebrate iridescent virus 6
augaaggaaugacaggaaaaacuucuaaacaaaaaucuuuuggaugggauauuccuaacauuucuacau

SEQ ID NO: 20 - RNA, 104 nt, Invertebrate iridescent virus 6
augauguuggcaauuuuaaaaccauuacggauaaucuagaaguaacagaugccuuuuguuccuuuaauuguugucuagcauggauucgagauaauaaacaugau

SEQ ID NO: 21 - RNA, 116 nt, Invertebrate iridescent virus 6
auucuuucuccaauaacuucguccucaaccucuucaucucuucuaauuucuucaucucuucuguuggaaauuuccgguggggggcauuuugaauguguugaugguauagaaagaau

SEQ ID NO: 22 - RNA, 99 nt, Invertebrate iridescent virus 6
auugcaagaaacauguguuauucuacuuuuguagacaaugaugauauaccugaugaaaugugucauguuauggaaugggaugaucauguugcuuguagu

SEQ ID NO: 23 - RNA, 125 nt, Invertebrate iridescent virus 6
auuuuguauuacuuguucgaaagugucuuuuauaauaucaguuucuucuuuaauuuguuuugcaaguggagauguagguaaacuuucuguaagagauuuaacuuuaauuugcaaauuagcaagau

SEQ ID NO: 24 - RNA, 122 nt, Invertebrate iridescent virus 6
caaauucuacauuuguaucaguuaugggagauccgucaauacagguuucgcuuuuaaaacauuuugaaauagaaauuucuuguugauuaugauccaaaauuuuugauauuuuauaugguuug

SEQ ID NO: 25 - RNA, 93 nt, Invertebrate iridescent virus 6
caauguugacaauuaaauuuaauauuaacauagauuuagaauggauuagacaugguuuugaaaaauguaauaucaaaugggauugugaaagug

SEQ ID NO: 26 - RNA, 99 nt, Invertebrate iridescent virus 6
cauggcuuccauuggauuuggcaccgaaguuugacguuccuauuaauagcucccuugaaugucgaauggaauggcuugcgggauauuuggaugcagaug

SEQ ID NO: 27 - RNA, 74 nt, Invertebrate iridescent virus 6
cggugauggacuucuucucggugauggacuucuucucggugauggacuucuucucggugauggacuucuucucg

SEQ ID NO: 28 - RNA, 62 nt, Invertebrate iridescent virus 6
cuugguugauauuguuuguaaugggguucugaaaacaagauucugaaugguuuuuaacgaag

SEQ ID NO: 29 - RNA, 92 nt, Invertebrate iridescent virus 6
gaaacuaugauguguggauggaaugguaaaaaacuuagagcagaaaucuucuuuggaccaguauauuaccacagauugacgcacaugguauc

SEQ ID NO: 30 - RNA, 73 nt, Invertebrate iridescent virus 6
gauguugaaauuuuaaauguuauuauuggaaggggacaaucugaccacaucgcuaauuuaaaaauaacaacuc

SEQ ID NO: 31 - RNA, 64 nt, Invertebrate iridescent virus 6
gcaagcauuuuguacacaugaugaagauuguuuagaaggacaguguuguguacaacguauuugu

SEQ ID NO: 32 - RNA, 80 nt, Invertebrate iridescent virus 6
gcuaucaaucuacaagaucuaaguagauauccaacaguguaugauucuauggaaauacaugcaucuuguauguugggagu

SEQ ID NO: 33 - RNA, 62 nt, Invertebrate iridescent virus 6
gcuauuuuuguauuuaauugauuaacuugacuaugaguauaauacaaaauaccuccaauagc

SEQ ID NO: 34 - RNA, 92 nt, Invertebrate iridescent virus 6
ggaggagauuuugauuuagguauuuuaacauuaggaugguuaucuuuuaaccauuuuagacauaauuuguuuaaaucaacaacauuuccucc

SEQ ID NO: 35 - RNA, 83 nt, Invertebrate iridescent virus 6
gguucauuuugaauuguuguaauaauauuuuugaguugaucuauaccaccauauuuauuaucgcacccaauauaauuuucacc

SEQ ID NO: 36 - RNA, 98 nt, Invertebrate iridescent virus 6
guaucaaaauguaccauuccguaauaagauuucauaauaaauagaccauauacauauuggaauaguagauuuauaacggaaaguggauauuuuugugc

SEQ ID NO: 37 - RNA, 66 nt, Invertebrate iridescent virus 6
guaugaaauaaacaagaaggucguuuuaaagcaucggcuuuaugccuucuaaaucuauuuucaagc

SEQ ID NO: 38 - RNA, 65 nt, Invertebrate iridescent virus 6
guucuacgauguucaguagauauuuuuggugguauagauggucucaaugaacguuuaguagacac

SEQ ID NO: 39 - RNA, 75 nt, Invertebrate iridescent virus 6
guuguuaggucaugucagaggcccugaaauugaucaggagcgaccugaaaacucugacaccagaccugagacagc

SEQ ID NO: 40 - RNA, 68 nt, Invertebrate iridescent virus 6
guuuaggaauuuguuuauguuauggggauaugugugcauguauaccaguucaugauuaauuuuuaaac

SEQ ID NO: 41 - RNA, 81 nt, Invertebrate iridescent virus 6
guuuggaacggaaaugaguuuucuucugugacuguugugaaaacaggaacagaaaaagaauuauuggaaguugaacuaagc

SEQ ID NO: 42 - RNA, 85 nt, Invertebrate iridescent virus 6
uaaaccaauaucaaauaccgcuauaccauuauuaccuauuauauuuuuuccaauacguaaugaauguauaccuugauuagguuua

SEQ ID NO: 43 - RNA, 99 nt, Invertebrate iridescent virus 6
uaaaguagaugaaaaagaaagauauagaggugcagaaguuuuugauccagugccaggauuaaaaagaaauguuguuccuuuagauuuugcaucacuuua

SEQ ID NO: 44 - RNA, 78 nt, Invertebrate iridescent virus 6
uaucaggaacuucucguguugcgcauaauucaucaaacauaugucuuaauguuacaacauuaguauccccuucugaua

SEQ ID NO: 45 - RNA, 72 nt, Invertebrate iridescent virus 6
ucacccggaucuguaacuggaggaccaggugguaauauugcggcugguacaguuacgggaggaucgggagga

SEQ ID NO: 46 - RNA, 78 nt, Invertebrate iridescent virus 6
uccauuuuaugugaaguuucccauuguucaauugaaaaagaaauucauuguuuuugggaucgucauaaaauuacuggg

SEQ ID NO: 47 - RNA, 130 nt, Invertebrate iridescent virus 6
ucgauuuuagauucugagacuaaacgagcaauacaagaugcaauagauucauuugaaccauacaacaauacaguaaaaagaagagaauuugaagagcauuuguugaaacaaaguccgaauauaaaauuag

SEQ ID NO: 48 - RNA, 115 nt, Invertebrate iridescent virus 6
ugauggaagagccguuuauauuucugaagguggucuuuacagucuuauuaugucuagcgaagcuccguuugcuaaggacuuuagacgacuuguauguaauguuauuuuaccguca

SEQ ID NO: 49 - RNA, 70 nt, Invertebrate iridescent virus 6
uggaggugcuaucgguggaggcauaagaguuuuuggauuuugagguccuaccaaagcauuauuuuuucca

SEQ ID NO: 50 - RNA, 127 nt, Invertebrate iridescent virus 6
ugguguugauggaucaucuuaugucuggaacgguucuguauauaauaauguuuuuguaaaaucuuauucaaaguuuucaucacaaagcccauugucaguuccuccaggaaguaacauuucaauacca

SEQ ID NO: 51 - RNA, 107 nt, Invertebrate iridescent virus 6
ugguuugaggaugagaaagugugguuucuuuuauagcuuuuucuggacuuauuucauccauaacacaaagaagaguugcagcuauuaaaccacuacguccgugacca

SEQ ID NO: 52 - RNA, 68 nt, Invertebrate iridescent virus 6
uguuggauauaauucaauuucuucuuuacuuguuaguucuuuauaaggaauugaauuucguuuuaaca

SEQ ID NO: 53 - RNA, 72 nt, Invertebrate iridescent virus 6
uugauugugaaauaacaccauuacuuaaauuugccauaucaaccuuaauuucuggguaauuuucacauucaa

SEQ ID NO: 54 - RNA, 122 nt, Invertebrate iridescent virus 6
uuguguuuuagauaguugauauuuuaaugcauuuucuaaauuaagcauaucaacuuuaucaauauuuaauugguugacuugauucauaaaauguuuaaauuuaucaacauuacuagaaccaa

SEQ ID NO: 55 - RNA, 66 nt, Invertebrate iridescent virus 6
uuguugaucuugaacuucuagaacuugaacuugcgcguauagguucaacagguuuuugauuaacaa

SEQ ID NO: 56 - RNA, 71 nt, Invertebrate iridescent virus 6
uuuguaaacggucuuuuuacuaaacauggaggucaacauguagauggguggacaaaaccguuuuuugcaaa

SEQ ID NO: 57 - RNA, 114 nt, Invertebrate iridescent virus 6
uuuuaauuuuaauuguccuguuuguuauuaaauuuaauucuucagaaguuucuucuauauuaacuucagaaguuacuuccgaaggugaugaugaacaugaaacagaaacuagag

SEQ ID NO: 58 - RNA, 73 nt, Invertebrate iridescent virus 6
uuuucauguaacauccccauguuuaauccuucugaaauaauugauggauugaaacaauggauuaauaugagag

SEQ ID NO: 59 - RNA, 114 nt, Invertebrate iridescent virus 6
uuuucgauucauacuucuuuauuuauuguauuuuaauguuacaucaagguaauaaaauugaaccuuaucuucauuauaaauacaauaaauaagaaucuaaaauggaauugaaaa

SEQ ID NO: 60 - RNA, 85 nt, Invertebrate iridescent virus 6
uuugagaauuuccagaaagauuagccauuuuuguuaauguuauugcacccgaugaaaugacaggugagcuugcaguuguuccaga

SEQ ID NO: 61 - RNA, 60 nt, Maize streak virus
cugacuuggcacucugaauauuugggugaaacccauuuauaucaaagaaccuugagucag

SEQ ID NO: 62 - RNA, 61 nt, Murine adenovirus A
ccugcugacguauugcgcaacugugcaacuaauugugauuguuuuguaauaauggagcagg

SEQ ID NO: 63 - RNA, 131 nt, Murine adenovirus A
gggaacuacucuaacgacggaagcggagcaagagagcucagcuugagaguuaaugaggaaguuacugaaccuccuuacaauucuauuacuuaugcggagguguugcgucuuuaucgucagaauggguuuuc

SEQ ID NO: 64 - RNA, 85 nt, Plutella xylostella granulovirus
acaauaucauaauccauugauaaaguaccgauaauagauaacuguuagcauaaugcggacuuuuuaucgauugauuagauauugu

SEQ ID NO: 65 - RNA, 122 nt, Plutella xylostella granulovirus
acuaugaauuuagacgauuucuuuguaauuauacuccguuggaacgaaucucaauaaauaaauuuuuuaauaagagaaaugucguuugaguacaauucagaaccuaucgaaguguuuauagu

SEQ ID NO: 66 - RNA, 63 nt, Plutella xylostella granulovirus
agauagcaagcuguuggcuaaaaacgguuuuuaucagugguacggccagauuauuugcuauuu

SEQ ID NO: 67 - RNA, 122 nt, Plutella xylostella granulovirus
aguaaguuuuuuuugucuaguagcgcugauuguuuuauuaacgucgucgcuaaguuuucuuuuuucggccaucuucauauuaauaucuucgucggcgguacuguaacuacuggaaacuugcu

SEQ ID NO: 68 - RNA, 64 nt, Plutella xylostella granulovirus
aucucgucuccgacguuuaacaucauuaccuggccguugcuguucacgucgagcgacacgagau

SEQ ID NO: 69 - RNA, 82 nt, Plutella xylostella granulovirus
caacucuggaaugguugaauuuguggcgucgaccagcgcguaaaccauaucguuggcuucguaccuaaccauuauauuguug

SEQ ID NO: 70 - RNA, 61 nt, Plutella xylostella granulovirus
ccugagcuaucaguaaguuguaaauucuauuaauuuuauuauuaacaucgucgagcugggg

SEQ ID NO: 71 - RNA, 68 nt, Plutella xylostella granulovirus
cggacucaucacgcaacugugcgaaagucucagaucgcaagauuuuuacacagacgacaugcuguccg

SEQ ID NO: 72 - RNA, 131 nt, Plutella xylostella granulovirus
cgucguacguggaagucgucuuaccggcguccaggagccguuuacgcugauacuuguaaaacacguugucgugcaacagcagcguuuuguuucccaauugggcggcggcggugacggcguugguguacgcg

SEQ ID NO: 73 - RNA, 86 nt, Plutella xylostella granulovirus
cguguccgauagauuggugucaccucaggcggucguaucuauauuuauauuauuaucacucguuugugugacauggagcaugcacg

SEQ ID NO: 74 - RNA, 92 nt, Plutella xylostella granulovirus
cucuugauccuggcaaucuaaacuagccauauuuuuauaguugauuccuaucucgccuauaucuuugcuguacgugaccagauuauugagag

SEQ ID NO: 75 - RNA, 60 nt, Plutella xylostella granulovirus
gagagguuaucgcagcuuaucuugaacacgauauugggacaguugcguuuguaauauuuu

SEQ ID NO: 76 - RNA, 76 nt, Plutella xylostella granulovirus
gagagucaaauugauuuauauaauaacgaguugcgauuuauauuguugcaagauauuaaaauugauucugauuuuc

SEQ ID NO: 77 - RNA, 103 nt, Plutella xylostella granulovirus
gcguccaaauuuuacagcgaaauauucgagagcuuaaacaacaugaacagcuggcuguacauggugagcucggacaccuucgucaacguaagaugcggggagc

SEQ ID NO: 78 - RNA, 83 nt, Plutella xylostella granulovirus
ggaaaaagccaacaagugccuuaggaugggacguuacgugguguggcccaaucuuagcgcuguguuucucggguggcgcaucu

SEQ ID NO: 79 - RNA, 60 nt, Plutella xylostella granulovirus
ggauucuagucuagaacaaauuauauccggguucaacaacaggagcagauaccgaauacc

SEQ ID NO: 80 - RNA, 84 nt, Plutella xylostella granulovirus
ggcugcgauaacaucaauuuucuaguagauauuuucggagaacacaucaccgagaaugacaaucacucguggugucacguggcc

SEQ ID NO: 81 - RNA, 61 nt, Plutella xylostella granulovirus
gggguuggugggguugggguuagauaugauugcuaaaauuugcugcaacagagccaaaacc

SEQ ID NO: 82 - RNA, 76 nt, Plutella xylostella granulovirus
gguacugcagggaaucgggguucgcuguagugucggaagcucuacacacacucuucucccuguccuuguuguaacc

SEQ ID NO: 83 - RNA, 76 nt, Plutella xylostella granulovirus
gguugaggagauuaugauugaggucgcgcuuaucuucaaaaucaaggaauucgcgcccgacguaccccucuucacc

SEQ ID NO: 84 - RNA, 81 nt, Plutella xylostella granulovirus
guaaaaauaucaaacauagcaugaauuggcucguuuugcgcaacacuugggccaccgucaagggacauguuuuauuuuuau

SEQ ID NO: 85 - RNA, 63 nt, Plutella xylostella granulovirus
gugacguggugcggcaaaucuugaguaaaagugacgacgccuuuaccgccgcucaucacgcac

SEQ ID NO: 86 - RNA, 76 nt, Plutella xylostella granulovirus
guucauucuaguucuguaaccguuuucgucuauuaucucaacauacucuucgacaacuugcaaacgcuggucgaac

SEQ ID NO: 87 - RNA, 71 nt, Plutella xylostella granulovirus
uaacuccaggccguuguugcuaucacugauaauaaaacgaucauuguuuagauaacaguuaucuggaauua

SEQ ID NO: 88 - RNA, 70 nt, Plutella xylostella granulovirus
ucguuucaaaauuuuccggcagcgcgugacccgaugacauuugaaucacgggcgccugauaaaaaugcga

SEQ ID NO: 89 - RNA, 60 nt, Plutella xylostella granulovirus
ucuaaagguaucucucugauggacauugaauugcagaacggaugggauauauacuuuaga

SEQ ID NO: 90 - RNA, 75 nt, Plutella xylostella granulovirus
ugucuucggugagggguagcgucguguuggguuccgugcauacggguaucucgacgcacuccucgccgucaaaca

SEQ ID NO: 91 - RNA, 76 nt, Plutella xylostella granulovirus
uuggcggagugaacguugugguguuuggugauuuguuucaauuaccgcccaucagcaacgauaaagaugcugccaa

SEQ ID NO: 92 - RNA, 100 nt, Saimiriine herpesvirus 2
aaaauguuugugggagcaguaaauguacuaugacuuuaucuggucuugacaagaaucuccaguuaucaaaguggacauccauguuucucucaugcguuuu

SEQ ID NO: 93 - RNA, 80 nt, Saimiriine herpesvirus 2
gagaaggcuguucauauccucuuacuuuuccagggucuucuaaagcaaaauggugucuaggggaugauuguggucuacuc

SEQ ID NO: 94 - RNA, 87 nt, Saimiriine herpesvirus 2
ugcucuaguguauuaacaaaucuguguugguguuuaaagagaaaagcuuuuucagcaucuaauacagcaguugggcuuacaugagca

SEQ ID NO: 95 - RNA, 68 nt, Saimiriine herpesvirus 2
uucuauguccuguaauagguacaaugucuuuuuuuaaggcugugcaagaaguuauacaagggcaugaa

SEQ ID NO: 96 - RNA, 66 nt, shrimp white spot syndrome virus (white spot bacilliform virus)
aaaguugcugccauucuugccaacagaacagagucccuauaucuguugccagauucucccaacuuu

SEQ ID NO: 97 - RNA, 130 nt, shrimp white spot syndrome virus (white spot bacilliform virus)
aaggaagauuaggugcacaaucuauugucauaaaaauguccaggucaauuucuucaacaccuuccucaaaguuauagaagaaacuuguuucaucauuuuuauuagcaauaaacaaguacguuuuuuccuu

SEQ ID NO: 98 - RNA, 64 nt, shrimp white spot syndrome virus (white spot bacilliform virus)
aagggauucaaaaagaguuaaauaugaaaauguggucauuucaaaggcuuauugugauuucuuu

SEQ ID NO: 99 - RNA, 108 nt, shrimp white spot syndrome virus (white spot bacilliform virus)
aagggucggcuccuuaacgcugucaaggaaaaaccugcagaguacuuugaguugcuaauaucugcagacacugaagcagcauuaaaaacugccgaagaaacagcccuu

SEQ ID NO: 100 - RNA, 78 nt, shrimp white spot syndrome virus (white spot bacilliform virus)
acaacauguaagcguuggguaagaagaucuggaucuggaugacccaccuuguccuucuuauccuauccuuauccuugu

SEQ ID NO: 101 - RNA, 76 nt, shrimp white spot syndrome virus (white spot bacilliform virus)
acacguccguguuagugaugaguauauggacagauuugguagucuauuacuuggacgagaaaagaaauggacgugu

SEQ ID NO: 102 - RNA, 75 nt, shrimp white spot syndrome virus (white spot bacilliform virus)
accugauuccuucuucuguugcagaauaaaaggaaccauuuccguugguucugcauagcaaggagaaaucucggu

SEQ ID NO: 103 - RNA, 130 nt, shrimp white spot syndrome virus (white spot bacilliform virus)
accugcacucaaaauuacuucuggggguaacaauaguagcaguaguaucaauaacgaagaugauggugaugaugacgaugccguugacgcuacugcauuaugcccccaaacugaagcuacagugaaaaau

SEQ ID NO: 104 - RNA, 80 nt, shrimp white spot syndrome virus (white spot bacilliform virus)
acgauacgaggauagauugucuagaugcaguagcaaaucucaccggaccuguguauguucucauuuuagaucuuguacgu

SEQ ID NO: 105 - RNA, 69 nt, shrimp white spot syndrome virus (white spot bacilliform virus)
acuucuacuguuuacacuucuguaaaguguuaccuuucuuccauaaucaagagugaaaguaguagaagu

SEQ ID NO: 106 - RNA, 64 nt, shrimp white spot syndrome virus (white spot bacilliform virus)
agaaaaagcaauggguaucaauacagauaauggaggauuuguuuggaagaaugguguuuuuucu

SEQ ID NO: 107 - RNA, 61 nt, shrimp white spot syndrome virus (white spot bacilliform virus)
agaaaguacuaccauuuccuguugacaaguauagagcuguggauaaaaaggugguaaaucu

SEQ ID NO: 108 - RNA, 85 nt, shrimp white spot syndrome virus (white spot bacilliform virus)
agaaccguaucuuguuaucaaauuugaaaagaacucagaaucauuacuuguuuuuccauucaaagcuguacgcaugauacauucu

SEQ ID NO: 109 - RNA, 117 nt, shrimp white spot syndrome virus (white spot bacilliform virus)
agagggcuagugucuaaaacggauagguuuuuacuaccaaacccaacaggccaccaagaugaaggggguuguuuaguacgguuguuagaccacaaaaacuuggacgcuuuuuccuuu

SEQ ID NO: 110 - RNA, 64 nt, shrimp white spot syndrome virus (white spot bacilliform virus)
agcuccuuuuacuguaagguuugguaaugacaaugauaauaauguuauauguguaggaggagcu

SEQ ID NO: 111 - RNA, 80 nt, shrimp white spot syndrome virus (white spot bacilliform virus)
agguuuauggaacuccuggcaagguauuuugcccucccuguccucuuuuagaggggcggccuuacagccuccaaaaaccu

SEQ ID NO: 112 - RNA, 126 nt, shrimp white spot syndrome virus (white spot bacilliform virus)
auauaacaagggacagacuuguaauguuguccaggagugguucaagggauccuucucucuugcaaagcguagaggaacaguccccaaauucuguaguaacauuucccacgcuuucuuuuguaauau

SEQ ID NO: 113 - RNA, 109 nt, shrimp white spot syndrome virus (white spot bacilliform virus)
aucguucaauuguguaaaaaguauggauguguugaauuuguuaugauguuaaaaauaauaaaaauauuguacauuuuauuacauuuguuuguuuugacaccugagcggu

SEQ ID NO: 114 - RNA, 67 nt, shrimp white spot syndrome virus (white spot bacilliform virus)
augacgaagaagacgaaaaagaugucaagcaagaagucucgaaccguccccccauuuuuucguacau

SEQ ID NO: 115 - RNA, 86 nt, shrimp white spot syndrome virus (white spot bacilliform virus)
auucacuuuuuguaacccuaucaacagauuugaaugauaauagaauauguucguauuugucaggguuuucaccagaaauagugaau

SEQ ID NO: 116 - RNA, 91 nt, shrimp white spot syndrome virus (white spot bacilliform virus)
auuuuccuccaugacgaaacacuggugauaugucuggagcucugaugaaugucuugccagaugccauccuaguuuuucuccuggggaaggu

SEQ ID NO: 117 - RNA, 76 nt, shrimp white spot syndrome virus (white spot bacilliform virus)
caacaacagugccaauguaauggaagcuguggauaguuucaauacuacuccuuugcucguuaggcacaugauguug

SEQ ID NO: 118 - RNA, 85 nt, shrimp white spot syndrome virus (white spot bacilliform virus)
caagucccaccgugguuccucugguucugcuucuucuucucauuguaugaguagugaugaagaaucagaggaugaaagggauaug

SEQ ID NO: 119 - RNA, 95 nt, shrimp white spot syndrome virus (white spot bacilliform virus)
caauauggauaguuguugccugauaucgaggauaacaccagaacuggcuggcaaguuaaccuggaucuucauaccagaaaacaacuucaagauug

SEQ ID NO: 120 - RNA, 82 nt, shrimp white spot syndrome virus (white spot bacilliform virus)
caauuugcuaaggguuuguuguuugaugagguugucacaucaauuguggcacaucagauggcucaagauauuugcaagucug

SEQ ID NO: 121 - RNA, 117 nt, shrimp white spot syndrome virus (white spot bacilliform virus)
cagacuugucgaaagaggaccagaaacucuuaucauaaucuaccuccaccauugaagauucguauguaguggaacccauagaaaagauaauaagauuguccacaucgacaaguacug

SEQ ID NO: 122 - RNA, 85 nt, shrimp white spot syndrome virus (white spot bacilliform virus)
cagauugcaccagaaccgacuguugcuccagaaaugugcauuaaccuuuguguguuucuggaacagacguuucugggcauagcug

SEQ ID NO: 123 - RNA, 96 nt, shrimp white spot syndrome virus (white spot bacilliform virus)
cauaugauuuuucaguauuguacaagauucuucaacuacaaaaacagaauaucucuuuacuuuuagagaaggguuucaaugcaugggaaucgugug

SEQ ID NO: 124 - RNA, 77 nt, shrimp white spot syndrome virus (white spot bacilliform virus)
cauuucuucccugcaaacguauggcgguauagaagaguugccugaaaauguacuagucgguuuguccggaggauuug

SEQ ID NO: 125 - RNA, 84 nt, shrimp white spot syndrome virus (white spot bacilliform virus)
ccuugccaagugcgcauaucacgaucacugauaaaaccuccucguauauuauuuaucaccaauuccuuugaguaccgggcaagg

SEQ ID NO: 126 - RNA, 61 nt, shrimp white spot syndrome virus (white spot bacilliform virus)
cgucugggcggaagugcaguuuccuccccgggaggggcgaaucucauaaacacgacagaug

SEQ ID NO: 127 - RNA, 91 nt, shrimp white spot syndrome virus (white spot bacilliform virus)
cguuacauuauugcaguugguguccuacaucaacgcucucuuuucccucgagcgccgaaauguuuucaccgacggcuuuuuuaaugcagcg

SEQ ID NO: 128 - RNA, 124 nt, shrimp white spot syndrome virus (white spot bacilliform virus)
cuaaaauuguccaauacuuuaaaggcaaauuuuggaaaauccaugucggcuauuuuugcucaacauuuaguggacaugacaaacgcuaaacacuuuaaggacccaaagacaaagaagauuuuag

SEQ ID NO: 129 - RNA, 67 nt, shrimp white spot syndrome virus (white spot bacilliform virus)
cuaauacuguuauccuuccuacuucugaguuguuuaacugcccaggaguugaaaaugacaaauuuag

SEQ ID NO: 130 - RNA, 72 nt, shrimp white spot syndrome virus (white spot bacilliform virus)
cuccaccugaggaugaagaagaggaugauuucuaccgcaaaaagcgugccgcaccuccaccugaggaugaag

SEQ ID NO: 131 - RNA, 71 nt, shrimp white spot syndrome virus (white spot bacilliform virus)
cucuucauaggaaacauuuauguguuauuagugauaagaagaaugguacaauuuccuauucaccugaagag

SEQ ID NO: 132 - RNA, 67 nt, shrimp white spot syndrome virus (white spot bacilliform virus)
cugggucggucugaugucaaguucggaggguggaccucugggucgacccgaugucagauuacaccag

SEQ ID NO: 133 - RNA, 127 nt, shrimp white spot syndrome virus (white spot bacilliform virus)
cuguuuuuggagucaguacgcguguggauucacauauuguaggccccuuuaguauaccuguugauuuuucaagcgcaggacuagauaaggccucauguggcaaauuguacguuaacaccauagacgg

SEQ ID NO: 134 - RNA, 75 nt, shrimp white spot syndrome virus (white spot bacilliform virus)
cuucaaaugagauccuuauaaaaauguuccaaauggauaggguuuuggauggcauggaugaugaugaugaugaag

SEQ ID NO: 135 - RNA, 65 nt, shrimp white spot syndrome virus (white spot bacilliform virus)
cuucguggagcugcuuuaaagguuguagugcuuggaaucugcagcaaacgcagcucucuacagag

SEQ ID NO: 136 - RNA, 131 nt, shrimp white spot syndrome virus (white spot bacilliform virus)
cuuggacgugaaaagcgcgaagcagcucccccacuuaaaggugcacuuggacguaagaggcgcgaagcagcucccccacuuaaaggugcgcuuggacgugaaaagcgcgaagcagcucccccacuuaaagg

SEQ ID NO: 137 - RNA, 64 nt, shrimp white spot syndrome virus (white spot bacilliform virus)
cuuggauaauguucuugugaauaucaacaacaaggaugaagaucuuacaaaacucguauccgag

SEQ ID NO: 138 - RNA, 72 nt, shrimp white spot syndrome virus (white spot bacilliform virus)
gaagaggugaagaauaaggagaagguacaggacuagcaucauagucccucacaauccuuguucuuccccuuc

SEQ ID NO: 139 - RNA, 74 nt, shrimp white spot syndrome virus (white spot bacilliform virus)
gaagugagugcagcgcuauaaacuucuccggugauuuggcgagugacuggauuacuuagcccugcgucaauuuc

SEQ ID NO: 140 - RNA, 72 nt, shrimp white spot syndrome virus (white spot bacilliform virus)
gaggaggaacaacaacgacaccaacucaaccuucaccugacgguggagauggauacguagaucuuucuccuc

SEQ ID NO: 141 - RNA, 131 nt, shrimp white spot syndrome virus (white spot bacilliform virus)
gaggcuauccagauaucuaggucgggaagaauccagaaacgauucuagccauuucuggaacaaucauuucuggaaaggguuacaauuuauuguaucuggugcauuauuucugguaccauuucuggcaccuc

SEQ ID NO: 142 - RNA, 86 nt, shrimp white spot syndrome virus (white spot bacilliform virus)
gagguugcaacagcugcagcauggaauacguuuucauuauuuucauuaauaaaggaaaaggccaagcuguuuguuguuagaauuuc

SEQ ID NO: 143 - RNA, 106 nt, shrimp white spot syndrome virus (white spot bacilliform virus)
gauagugauuacggcaucugugaaaaaugugcacgaaaaacucccaaauacaagcuccguauuuuuagggaacgaaaaugcugcgauagauguugccgucuuuauc

SEQ ID NO: 144 - RNA, 68 nt, shrimp white spot syndrome virus (white spot bacilliform virus)
gauuagugaugaugaggaugauauugccuuuauugauuccgaagaagagucugaaucaucuacugauu

SEQ ID NO: 145 - RNA, 92 nt, shrimp white spot syndrome virus (white spot bacilliform virus)
gcacuacacugcacuggugacguaguaguagaaguaguagugguaauaguccacuauugucacugcacugcacuaguaguaguaguaguagu

SEQ ID NO: 146 - RNA, 95 nt, shrimp white spot syndrome virus (white spot bacilliform virus)
gcaucaucuccaacacauacuuuggauacgagaauguuguuguucaucccaaacaacucaaaauuauccccagugucgauuuugauagcuggugc

SEQ ID NO: 147 - RNA, 81 nt, shrimp white spot syndrome virus (white spot bacilliform virus)
gccuagagaaguuaugcaaguaauugguacucucuuggacaagaaacuagaaauugacgacgguauagcuucuguaaaggc

SEQ ID NO: 148 - RNA, 87 nt, shrimp white spot syndrome virus (white spot bacilliform virus)
gcgauaguaaggaucccaauuuuaaaaugucugacugguugaggauaaaaacugcauuaacauuuaaaguugggaaaauuacugugc

SEQ ID NO: 149 - RNA, 68 nt, shrimp white spot syndrome virus (white spot bacilliform virus)
gcgccuucauuuauugucgcagaaucggccgauauuguuggcgaaucuaugucuguaaagcaaggcgu

SEQ ID NO: 150 - RNA, 117 nt, shrimp white spot syndrome virus (white spot bacilliform virus)
gcuauaauggguugugguauuauaagguauacuguauuugucaauaaccuugcaagaucaacacucgauaaugaugaugacaaggcagcaaccuauuauaacaccccuauauauggc

SEQ ID NO: 151 - RNA, 128 nt, shrimp white spot syndrome virus (white spot bacilliform virus)
gcucguguaaugaggauccuaaagucacgugaaggugcucguguaugguuggccaaggaugaaaaugccaucaucuuugaaaacguuaaccacgauacggccaucucuacggacgcuauggagcgagc

SEQ ID NO: 152 - RNA, 114 nt, shrimp white spot syndrome virus (white spot bacilliform virus)
gcuucuucuaggaucuguaucugccaucucugcucaaaaaucugccagucacauuaacgauccuacugcuuuguugagcaccaacacgucuauccagaaucuggucaaggaagc

SEQ ID NO: 153 - RNA, 64 nt, shrimp white spot syndrome virus (white spot bacilliform virus)
ggaagaaagucuuuccauuucccauucuucuugauucagaugggauauauugacaaguucuucc

SEQ ID NO: 154 - RNA, 67 nt, shrimp white spot syndrome virus (white spot bacilliform virus)
ggaagauggguaaauagucccuauaauugguguacaugaaguugaggaaagacuguuugcccuuucc

SEQ ID NO: 155 - RNA, 71 nt, shrimp white spot syndrome virus (white spot bacilliform virus)
ggacauacuugcuagacuuaacaauugaccuauggccaauucucaacuguugacagguaucauaauugucc

SEQ ID NO: 156 - RNA, 131 nt, shrimp white spot syndrome virus (white spot bacilliform virus)
ggauaauacuguaguuaaucgccaugaagcauucauucuaacaucaaaacuuuuacccucgaaugaaaauagaggacuuaaaacuguuguagagucauucuuuaaaaauuuaacaauuaguaacaaagucu

SEQ ID NO: 157 - RNA, 75 nt, shrimp white spot syndrome virus (white spot bacilliform virus)
ggaucgccugcucucaugugaaccgucucggggaagauuuuacccugggacgcuauuaugcccacagcaugaucu

SEQ ID NO: 158 - RNA, 72 nt, shrimp white spot syndrome virus (white spot bacilliform virus)
ggcauaagaagcagacaccuuucgucccaaaaguuuagaaauuugaagggagagccagucugccauguagcc

SEQ ID NO: 159 - RNA, 96 nt, shrimp white spot syndrome virus (white spot bacilliform virus)
ggcccuguuccagaaauggcuguccagaaaucugggucggacagauuccagaaacguuucuaaccauuucuggaacagucauuucuggaaaggguu

SEQ ID NO: 160 - RNA, 95 nt, shrimp white spot syndrome virus (white spot bacilliform virus)
ggcuagcgcuagaagaaccuugcccuccggagacucuggguuccauccucgaaucuucuuuucgggaguucuuuuuaguauagaaacagccugcc

SEQ ID NO: 161 - RNA, 94 nt, shrimp white spot syndrome virus (white spot bacilliform virus)
ggggagggauuuguuuaggggcuggaggaggcuuguugauguuguucucgucuccagaaccgccgccagauuucccuccagauccuccuuccuc

SEQ ID NO: 162 - RNA, 82 nt, shrimp white spot syndrome virus (white spot bacilliform virus)
ggguggagaagaagaggaacuuccuucagcaauaucugaaguguuugcuucauuaccagcugauaacgauuccuccucaccc

SEQ ID NO: 163 - RNA, 74 nt, shrimp white spot syndrome virus (white spot bacilliform virus)
gguccgagcuggguuagauggauuucuaagguggguuaucucuguggcguuuagaaucuuguaacccucggauu

SEQ ID NO: 164 - RNA, 131 nt, shrimp white spot syndrome virus (white spot bacilliform virus)
guaaaaagaaggagaaaaagaaggauaaaaagaagggcgguggugguggugacgauucugauucagaaacagauucuuccucaucaucaucaucuucuucuucuucauccuccuccuccucauccgaagac

SEQ ID NO: 165 - RNA, 80 nt, shrimp white spot syndrome virus (white spot bacilliform virus)
guacuccauguacacuggagaaggaaaaagggguaaauuuguauuagagccaccuaaagaaagaaguguacaaagggugc

SEQ ID NO: 166 - RNA, 76 nt, shrimp white spot syndrome virus (white spot bacilliform virus)
gugcagcauuauguauaguaaaaagcaaaccaggauuuucuuuagccaaacucuguauaacauuaguugccgucac

SEQ ID NO: 167 - RNA, 110 nt, shrimp white spot syndrome virus (white spot bacilliform virus)
guucuucauuauacauggaaauugcccuugacguauugaaaaucaugcgucguucucgccgcaaacgcuuccguucgucuucgggcaaguuuucuucccuuuugaguaac

SEQ ID NO: 168 - RNA, 85 nt, shrimp white spot syndrome virus (white spot bacilliform virus)
guucuuccgauuauacuggaaaggguauugaucaauuggccaauauacuaaagacccugagagaaaauccagaugauagaaggau

SEQ ID NO: 169 - RNA, 103 nt, shrimp white spot syndrome virus (white spot bacilliform virus)
guuguucgucguggcuguaguagcuuccgucguuuuuacaacugaaggagcuagugugagagugaaacggugugcuguuagcccgugccccgacguuauugac

SEQ ID NO: 170 - RNA, 109 nt, shrimp white spot syndrome virus (white spot bacilliform virus)
guuguuguuguugaguaguacuuccaaugguauuuaauuuguccaauauugaacguaauucuacaggcacccuucuaccaguuccaagagcaccuccaccgccgauggc

SEQ ID NO: 171 - RNA, 65 nt, shrimp white spot syndrome virus (white spot bacilliform virus)
guuugcgaaauacgggcaauguuuuauuauuuauagauaaugucacauauggcaacuacgcagau

SEQ ID NO: 172 - RNA, 115 nt, shrimp white spot syndrome virus (white spot bacilliform virus)
uaauguuguuguguuguauuuuguauauagagaaaagaauaaaauaaaagguuaauauaauguugucuuuuacauuuuccuaaacuugauauaauaaacuauauagcaaauauua

SEQ ID NO: 173 - RNA, 121 nt, shrimp white spot syndrome virus (white spot bacilliform virus)
uaauuuuugauuacucuuuucuagcguguauacaacugcagcauugaaaaggcaugacauguaauuuccaaugcuuuuagcugacgggugugugcuguuguagaaaaguaauccaaguuua

SEQ ID NO: 174 - RNA, 93 nt, shrimp white spot syndrome virus (white spot bacilliform virus)
uagcuaacccaaaaccuuacaauuuaacuggaaauacauggucugauguaguuucuguauugacagauaacccuauuguagaugcgggugcug

SEQ ID NO: 175 - RNA, 84 nt, shrimp white spot syndrome virus (white spot bacilliform virus)
uaucaugacuaauauauauaggaucauuucucuuuagauaaucaccuauguuaucagaagaaucacuauuucuuagauuugaua

SEQ ID NO: 176 - RNA, 102 nt, shrimp white spot syndrome virus (white spot bacilliform virus)
uauggucaaaugucugauuguaaugcaauuccucuaucuauuaauauuggaguaccucuccauaaaucgaggaugaacaugcaagacauugaaaagaccaua

SEQ ID NO: 177 - RNA, 93 nt, shrimp white spot syndrome virus (white spot bacilliform virus)
uauguuuuguggaugaaauuucuuauaaugaugaagauguagacgaaauuuugucugagaauagaucacuaagaaauguuucuauuagacaua

SEQ ID NO: 178 - RNA, 93 nt, shrimp white spot syndrome virus (white spot bacilliform virus)
ucauggaauaaaugugcagucuuucccauauuacguacuccgcacauggcuaggagaaacagauauauuggaugaagauacuguacauccuga

SEQ ID NO: 179 - RNA, 77 nt, shrimp white spot syndrome virus (white spot bacilliform virus)
uccaagaagcagagucguaugaccauugacgucaaugcgugggcagaggcggagguggugauaaagcguuucugaga

SEQ ID NO: 180 - RNA, 118 nt, shrimp white spot syndrome virus (white spot bacilliform virus)
uccucgacuaccagacgagauaugaugcucuggggcccugcuucguccuuuuauaccgucacuugguuagaaaaaacgauaguguaguucacaguauuugucccuucuggucuuggga

SEQ ID NO: 181 - RNA, 80 nt, shrimp white spot syndrome virus (white spot bacilliform virus)
ucuauaguguaccaagggcaauaucuuauuuacuguuuuaucauuuuuagcagaagguuuuuccuuuauuacucuaugga

SEQ ID NO: 182 - RNA, 100 nt, shrimp white spot syndrome virus (white spot bacilliform virus)
ucuguugacguuuuucuuuaaguuccuucucagaaagcgauugauuaaacacuuuaguugguuuuagaggaucaacaacuguagaacccagcacaacaga

SEQ ID NO: 183 - RNA, 70 nt, shrimp white spot syndrome virus (white spot bacilliform virus)
ucuuggugacgcacacauuuauaauacccacauugagguguuaaagaagcaguugugccgcgucccuaga

SEQ ID NO: 184 - RNA, 78 nt, shrimp white spot syndrome virus (white spot bacilliform virus)
ugaacgauaaacuuaaaucaauuaaauccccuugagcagcuccagggggagugauugauaacauguguuuaucguuua

SEQ ID NO: 185 - RNA, 77 nt, shrimp white spot syndrome virus (white spot bacilliform virus)
ugacccgagccuuccgcaagaugaacaaccuagucaaucgcagcuucauugacguucaccgagugguggccgaguua

SEQ ID NO: 186 - RNA, 74 nt, shrimp white spot syndrome virus (white spot bacilliform virus)
ugcaccagaaacgacuguugcuccagaaacguacauuaaccuuugcguguuucuggaacaggcguuucugggca

SEQ ID NO: 187 - RNA, 70 nt, shrimp white spot syndrome virus (white spot bacilliform virus)
ugcagcagaacggucuauauuuuuacguggaguuuuaacagucaguggagauuacggaugguuuucugua

SEQ ID NO: 188 - RNA, 131 nt, shrimp white spot syndrome virus (white spot bacilliform virus)
uguauagaaauuccucauuugugaaugauguugaagaaauaaugacguuuuuuccaagcagggguugccugcugagaggcguauuuuauucacaauuucauccaccucauguuuuggaguauuuuuaugca

SEQ ID NO: 189 - RNA, 100 nt, shrimp white spot syndrome virus (white spot bacilliform virus)
uguucuccucccauauacuuuucaaucaaagccgagucuuguuccuuggauaauuuauccaugaccagcuuagaauuucuccaguacaugggacgaaaca

SEQ ID NO: 190 - RNA, 70 nt, shrimp white spot syndrome virus (white spot bacilliform virus)
uguuguugucguauccagaaaaauugaucacaucuucuuggcacaauucacucugguuacugccacuaca

SEQ ID NO: 191 - RNA, 100 nt, shrimp white spot syndrome virus (white spot bacilliform virus)
uuauuguuaaaaaauaugauuaaaaugaguagaaacaacccagaauaugcaagacauuuuuccaguucucucaaauuaauuggaguaacuuuggccauaa

SEQ ID NO: 192 - RNA, 73 nt, shrimp white spot syndrome virus (white spot bacilliform virus)
uuccagaaauggcuguccagaaaucagauuccagaaacgucuauaaccauuucuggaacagucauuucuggaa

SEQ ID NO: 193 - RNA, 85 nt, shrimp white spot syndrome virus (white spot bacilliform virus)
uucgguuaaguacauagccaucguacgaaaacaagccacuuucucugucuucuucguuucuggcguccauguguaucuggcugaa

SEQ ID NO: 194 - RNA, 93 nt, shrimp white spot syndrome virus (white spot bacilliform virus)
uugacgcaauuuggagauguaagaagaguugcggaauucuguaugauuccguauuuguuguuucuuuaauacaucauaauagauuggugucga

SEQ ID NO: 195 - RNA, 70 nt, shrimp white spot syndrome virus (white spot bacilliform virus)
uugugugcguaagguugcagaaucaguagcgacaaaauauacugcugacuugacuaccuuauuccaacga

SEQ ID NO: 196 - RNA, 83 nt, shrimp white spot syndrome virus (white spot bacilliform virus)
uuuggcgaaaucgcaaauggacugauugggcguaagaggcgugaagcaguaucucuaacaccaguccaugaagauaugccaga

SEQ ID NO: 197 - RNA, 113 nt, Simian virus 40
gcaggcagaaguaugcaaagcaugcaucucaauuagucagcaaccagguguggaaaguccccaggcuccccagcaggcagaaguaugcaaagcaugcaucucaauuagucagc

SEQ ID NO: 198 - RNA, 73 nt, Simian virus 40
guguugguaaacagcccacaaaugucaacagcagaaacauacaagcugucagcuuugcacaagggcccaacac

SEQ ID NO: 199 - RNA, 73 nt, Simian virus 40
ucuaagguaaauauaaaauuuuuaaguguauaauguguuaaacuacugauucuaauuguuuguguauuuuaga

SEQ ID NO: 200 - RNA, 65 nt, Autographa californica nucleopolyhedrovirus
aguauuuuggcggugaaucguuuguuuggcgccacggaaacgaucgacuuucaucccaaccugcu

SEQ ID NO: 201 - RNA, 108 nt, Autographa californica nucleopolyhedrovirus
ugcccgaugacgacggcgcgugcugucaccauuuuauuuuugaugcccaacguauuauucaauguauuaaagagauugaaagcgcguacggcgugcgugaucgcggca

SEQ ID NO: 202 - RNA, 70 nt, Avian leukosis virus
acugggucggguggucgugcccgagggcucugcuacacuuguggauccccgggacauuaucaggcgcagu

SEQ ID NO: 203 - RNA, 75 nt, Avian leukosis virus
uacagcuuagcaccacugcugccuuggaacgaugggacccugcccugccuuuggagggagcggucgcuaggugug

SEQ ID NO: 204 - RNA, 93 nt, Bovine leukemia virus
acccugagccucucugaguacaugacugaguguagcgcagagagguugucgcuucugcgugucacucagucauuuuuuauagccgauuggggu

SEQ ID NO: 205 - RNA, 82 nt, Bovine leukemia virus
cacuucugcuucaccaucccccugccagcguuggucuaguggaaagaacuaacgcugacgggggcgauuucuugcagcugug

SEQ ID NO: 206 - RNA, 86 nt, Callitrichine herpesvirus 3
aagcguuugcguuugcaaacucuucgcauguuucuuguguuuguuucaauagaaacaugcgagggcuugcuuuacgaauuucgcuu

SEQ ID NO: 207 - RNA, 78 nt, Callitrichine herpesvirus 3
accugucauggcacagacuacuccaucauggguuucaauaaggugacacucagaggagccaucacauacaugauaggu

SEQ ID NO: 208 - RNA, 78 nt, Callitrichine herpesvirus 3
acgcggggagguguaugauaggcuauuaggacguggauaccuguccgcucuucguuacuaugauacauaucuaaaugu

SEQ ID NO: 209 - RNA, 128 nt, Callitrichine herpesvirus 3
acguugccgagaggcggccaacaaauguuggcaccaacaaacguugcccaaaacccaaucacacagucucaaggguccucgucaacaaaugguggugcccacauuuguuggccgccuucuggcaacgu

SEQ ID NO: 210 - RNA, 93 nt, Callitrichine herpesvirus 3
agaguuucgguccucuuaucuauguuuguuacuuuuagaugccuaugcuggaagguaaaguaaucaauaacgguaagauuuuccaaaacgucu

SEQ ID NO: 211 - RNA, 123 nt, Callitrichine herpesvirus 3
aggcccuaacaaaugacaagauauagauuaguuaaagcagaacgauuuauugacuucucucugauaugagcugaguguaguugaugauuuguaaucuuaauucaucgcuccagucuaggcccu

SEQ ID NO: 212 - RNA, 100 nt, Callitrichine herpesvirus 3
agguggcauauauuagagggacccggucgcauaaaucuuaccaagccuugaaguuaaggacuaagaauggcgacucacuggugccucgcuugugccgucu

SEQ ID NO: 213 - RNA, 71 nt, Callitrichine herpesvirus 3
aguuugacacgcuauuugaaauaauaaaucaaaaauauuuauuucaugauccgaccgcgauguuacaagcu

SEQ ID NO: 214 - RNA, 112 nt, Callitrichine herpesvirus 3
aguuuguucacuucugagaauucuacugucuacauacagaagggucacacccauuggcuaaacuucugugcgacuagacagucccgggggaagucuaaaaauaccgaagacu

SEQ ID NO: 215 - RNA, 127 nt, Callitrichine herpesvirus 3
caugguauaagccaaaaaucauuacuuccucuuccaggggcuagucugccaauuaacugucugaucaaguuacuagaaauaggauagccucugugggggacuuuacacaaauggcucaaacaccaug

SEQ ID NO: 216 - RNA, 63 nt, Callitrichine herpesvirus 3
cauguuaaucaccuauaacuguacaucuuauaaucauauaggacaggagguaucaaugacaug

SEQ ID NO: 217 - RNA, 75 nt, Callitrichine herpesvirus 3
ccaaguuuggauaggugaacacccacugacaguaagcuuuaaacuuagacuuuacugcaccauccuuaaacaggg

SEQ ID NO: 218 - RNA, 131 nt, Callitrichine herpesvirus 3
cccggccaccccuuggggguucuggggacacgguggcuggcugccccgacaucuaguuggccacuagagggcugucuaagugucuuggcagccagcaaccguguccccgaaacccccaaggggcggccggg

SEQ ID NO: 219 - RNA, 93 nt, Callitrichine herpesvirus 3
ccguaaauucaucaucguugucauuaucggagaguucauuugugauuucgaucucauuuucaucaucggcgauaagacaagguguuuccacgg

SEQ ID NO: 220 - RNA, 117 nt, Callitrichine herpesvirus 3
cgcccauacagcacacacccaacacaauuacaacugcccgccccucuauaacuccaccuggcacaugcgguguagggcguggugguuucggccuggggguacugugcuguggcggug

SEQ ID NO: 221 - RNA, 72 nt, Callitrichine herpesvirus 3
cggccguugcgucuuuuguacaggguuuagaugguguucuucugacuguuguacucgcgauggcaaugggcg

SEQ ID NO: 222 - RNA, 130 nt, Callitrichine herpesvirus 3
cucgaaucacuaggugugaagcccaucacaugaccugugucauucggcuggucaaaacacuugguguuuugaccagccguauucaugcaucuuguguacauuaguuucaggcaaauuuaccacgauuaag

SEQ ID NO: 223 - RNA, 130 nt, Callitrichine herpesvirus 3
cuugcaggcugaguaaauguaaaggcuggcggauucucuggcugcggcugggauauaggcugcuguugauuuacaguaggcgcauucguaaacuggcugcaguguuccgucggcuguggcacggcugagg

SEQ ID NO: 224 - RNA, 131 nt, Callitrichine herpesvirus 3
cuuuacucgucucuuguucaucaucaaggugaagaauguuaaggacacuaccacucaacuuuuugagcugugcugcacuucuugacaguuuugugaauucuccgcgugguauaggcagaugagugagaaag

SEQ ID NO: 225 - RNA, 76 nt, Callitrichine herpesvirus 3
gacggacgauacaggcgcuugggcccaagaauuguccacauuuuuggcaucuauggcucaaccugucauacacguu

SEQ ID NO: 226 - RNA, 83 nt, Callitrichine herpesvirus 3
gaugcgugauuuccuugauguugacaacuuuuguuccaacaguauauggaacccuguaaauuaguugauaucuuuuacgcauu

SEQ ID NO: 227 - RNA, 66 nt, Callitrichine herpesvirus 3
gcaggugaguuguggcagaggggacuuuaguuuacauaacugcuccucugaagcuccggagccugc

SEQ ID NO: 228 - RNA, 109 nt, Callitrichine herpesvirus 3
gcucuuuuugugcacucggugagguuuggugaaggucuggagggggccauguuuggaucuuaauuaacgcugugccuuccagauccgccacccauggaggcuccggagc

SEQ ID NO: 229 - RNA, 117 nt, Callitrichine herpesvirus 3
gcuuuuaaguuucagugacuuuggagagguggcugauuuuauugguauuuguaaccaaccaccaacauauaccaccuuuaagauauuuaucgaaguaacacuuggacgacgcagagc

SEQ ID NO: 230 - RNA, 85 nt, Callitrichine herpesvirus 3
ggcacauuuccaugguauccuuauugagcuuuuuucuuguaaacgcgggaaaguaaucaagaucccuaguccauugagaugugcc

SEQ ID NO: 231 - RNA, 77 nt, Callitrichine herpesvirus 3
ggcguccgagguaggagauugauccaaagugcaaauucacuucgguaaaguccacuguguuugguuccugggccgcc

SEQ ID NO: 232 - RNA, 109 nt, Callitrichine herpesvirus 3
ggcuuugugccacguagaaagagcagggcuucuuggcgcgguagccuuagugggagaaucucgcugcaucgcugggacuuggucacucuuuuggucggcagacaaagcc

SEQ ID NO: 233 - RNA, 81 nt, Callitrichine herpesvirus 3
gggccucaaacggaaacccuuguucaggcuuccgccuguucaucucaacaauuggagccuggcaaaguuuucaccccgccc

SEQ ID NO: 234 - RNA, 103 nt, Callitrichine herpesvirus 3
gggucgaagaaugguuguuuggcagccuuauauuucgagcaucuccuuuuuucucgcguugaccaauggaauggcuguagagcacaucauucuccuuugaccc

SEQ ID NO: 235 - RNA, 122 nt, Callitrichine herpesvirus 3
ggguuccucauuucuagcuaguauuuuuugauagacuauuagguggggcaucugcgugcuuuuguaugcagaaauuugucugcugaguucuguagugaaugacaguucugauaugggaaccc

SEQ ID NO: 236 - RNA, 72 nt, Callitrichine herpesvirus 3
ggucccacccuacagguuaauccuccugguucaaucugggcuccuauugguuaauaccuguagguugugacc

SEQ ID NO: 237 - RNA, 127 nt, Callitrichine herpesvirus 3
gguggcugaacuuuaaaagcguaugggggugggggcgaugaucagaacacauaaucuacucugauucugggguggauucaacuagcgccauccuuuccauuauaugccuugguggaguucaacuacu

SEQ ID NO: 238 - RNA, 97 nt, Callitrichine herpesvirus 3
gguuuggguaagguuuugcgaguugaacucugucgacggauuauuaucccgguaggacaaagacggccaaaucucaaucauauuucugcccuaaacc

SEQ ID NO: 239 - RNA, 74 nt, Callitrichine herpesvirus 3
gugaugguagccgauguggugcuugccgccauuaacuuauuugugcugcuuccauuaauuugguauaucaucac

SEQ ID NO: 240 - RNA, 113 nt, Callitrichine herpesvirus 3
guggcuccaauuauuccggugaacaucacauugcagauuaugcgcaugcgcguggaaaggcgcgugugccaaauuuuguaugugauguagcacguggcuauaauuguugcuac

SEQ ID NO: 241 - RNA, 84 nt, Callitrichine herpesvirus 3
uaauugcaugucucauggcuugucaauaaacacuuuaagcauuuaugguguguuuucuguuuuauugcauauagauuguaguua

SEQ ID NO: 242 - RNA, 70 nt, Callitrichine herpesvirus 3
uagaggauguaguagaaggugauacuacacagacauaaacauggcguagagguuuucugguacuccuuua

SEQ ID NO: 243 - RNA, 99 nt, Callitrichine herpesvirus 3
uauuucccauugguugccucuaguucauaggaaaugucuucgagaaacuuaaucacugccugaguucuuggaaccguuucuguaaugagugagggaaua

SEQ ID NO: 244 - RNA, 126 nt, Callitrichine herpesvirus 3
ucauucagccaugugcuuaucgguuggcuauuauugccagagaacaaaguccacuacaccuauacccaagacguucucugaaauguuugaucugaugccugccgcccuggaguuuauaaugaauga

SEQ ID NO: 245 - RNA, 63 nt, Callitrichine herpesvirus 3
ugcagcugaaauugagaaugggcggagcuagagaccugcugaagcuccgcccuguggguugua

SEQ ID NO: 246 - RNA, 131 nt, Callitrichine herpesvirus 3
ugcugggaauugauaucuuaugaucugaccaacagaaggacacggggggaguucuugacauguagcaucgaguuccagaacuuguuuguuuguuauuuugacaugagauuuguauaguucauauuuccaca

SEQ ID NO: 247 - RNA, 92 nt, Callitrichine herpesvirus 3
uguaacaugugccagaaccuagcucuauuucagggugccacccauguggcaugggauggggccucucuuaguaggugggaugcgcaguuaca

SEQ ID NO: 248 - RNA, 117 nt, Callitrichine herpesvirus 3
uguucccaagauacguuuggcgaccgugucuaauuuguagucugacaggcuuaguuuuucuuuacaaacugaauacaugucuaugggaauaacacccgauaugcguauuuuggugca

SEQ ID NO: 249 - RNA, 115 nt, Callitrichine herpesvirus 3
uguugugugggauaagcccaggaauaguugucugguugcucuuccagagauacaaacacguccacuuuuaaagacagccauaacuuauccuggccgauaucuaagcccacaaaca

SEQ ID NO: 250 - RNA, 104 nt, Callitrichine herpesvirus 3
uuauguuugugaugaucacagggaggaauuugacaugcaagacucuaugguggcuuguccuuguuucagacugcguauucccugcuacaucacccuggacauaa

SEQ ID NO: 251 - RNA, 123 nt, Callitrichine herpesvirus 3
uuuugcuaccauaucuauguagaaguuuuaaccacugugaugcguuuuccgaaggcaggauuggcgacagcuccuccgucgcagccuuuccaccgcauaacuuauucacuaugugugccaaaa

SEQ ID NO: 252 - RNA, 70 nt, Epiphyas postvittana nucleopolyhedrovirus
aaagaacguuuggcaacgugguacaagugcggcaauacaaaaggagugugccaugaaguuuacguuguuu

SEQ ID NO: 253 - RNA, 85 nt, Epiphyas postvittana nucleopolyhedrovirus
acgugccaguggguugcgcgccacacggacgcgucgccgacauuaacagcggcgacauucguugugugugcgacgacggguacgu

SEQ ID NO: 254 - RNA, 95 nt, Epiphyas postvittana nucleopolyhedrovirus
aucgccguuguacgacaauuugauugggucguugguggcauguaaucuaaaauacacaccgucaacuucaucaaaccguucgugaaacgcgcgau

SEQ ID NO: 255 - RNA, 114 nt, Epiphyas postvittana nucleopolyhedrovirus
auuugauucaaaaacguguugguugucaaauaagcguagacuaguuugcggcaucccaaagccgguccauagauaucuagcguuuuuuugcaaaaacuuguaauauuuucaaau

SEQ ID NO: 256 - RNA, 130 nt, Epiphyas postvittana nucleopolyhedrovirus
caacucguuuugucuccgcuucauucgacaauucuacggcggugugcguguuauaugccgucacugugcuaagcguguugcacgucacgcguuggcucuuuuuugaauggacaauuuugcuagaacguug

SEQ ID NO: 257 - RNA, 115 nt, Epiphyas postvittana nucleopolyhedrovirus
cagcuugaagauuuugaauauuuauagugcuagcauccauguuauuuucgcguaacuggucccaaugcguuuugauagcuugagugucgcgcacugucucgacugcuuuaagaug

SEQ ID NO: 258 - RNA, 73 nt, Epiphyas postvittana nucleopolyhedrovirus
cgcaauugcagcgugaauuugcucagcuuuauuuaccgugguggcagcugggcgucgugcguuggauguugug

SEQ ID NO: 259 - RNA, 109 nt, Epiphyas postvittana nucleopolyhedrovirus
cgcaauuucaggcgguaaacgcuucauugugcuuugcaacaacugacauuagcuugugaacauacagauuuauauagcguuuacaguucgucucucauuuugaauugcg

SEQ ID NO: 260 - RNA, 82 nt, Epiphyas postvittana nucleopolyhedrovirus
cgcagacuuugauuugaaacggacauuccaucguaagccuuauacuuaugaaauuggcguugacaaauuauuuaaguuugug

SEQ ID NO: 261 - RNA, 123 nt, Epiphyas postvittana nucleopolyhedrovirus
cggugccgucgggaauugcuuuaaguauuaacgacgcugacgccgaugaaccaauuauauacuuugaaaauauuaaagaauguuuaggcgacgcgucgugugacaagcuuaccuacuuugccg

SEQ ID NO: 262 - RNA, 61 nt, Epiphyas postvittana nucleopolyhedrovirus
cgucaugccacaucguguuuuacauuuuuuguugaaaauguaaaacacgugugggaugaug

SEQ ID NO: 263 - RNA, 80 nt, Epiphyas postvittana nucleopolyhedrovirus
cgugauucauuaaacgggccacuuuuugcaauggcacgccgcuguuguacaaauugcugcucaaauaaugccuuaucaug

SEQ ID NO: 264 - RNA, 119 nt, Epiphyas postvittana nucleopolyhedrovirus
cgugcacgcacauaugcuugaagaugauuccggugaaauuaaagauuauauaagagcaaauuuaagccgcuuuacaguaaucacuggcaaauguucgaagcguaaggugugccaucacg

SEQ ID NO: 265 - RNA, 62 nt, Epiphyas postvittana nucleopolyhedrovirus
cguguugguagauuugagguuggaauaugacaaacagcaaccagcagauuaaugccaacacg

SEQ ID NO: 266 - RNA, 60 nt, Epiphyas postvittana nucleopolyhedrovirus
cguugucggagccgagcacuagcgggacaaaacguaaaggcgcacccgauucggacaaug

SEQ ID NO: 267 - RNA, 131 nt, Epiphyas postvittana nucleopolyhedrovirus
cugcacaaacguauacggcguugugauuuccaugucaaugcucucuuaguuuaacacauaauacaaauggccauuuguaauuaguuuuuguucuaaauuuuuugauaacguucgcuuuguaauaaaugcag

SEQ ID NO: 268 - RNA, 76 nt, Epiphyas postvittana nucleopolyhedrovirus
gaagcauucgaauucaguuaugccggcgcuaacgaaauuaaucuaaacacuggcaaagugaaacccgacguguuuc

SEQ ID NO: 269 - RNA, 105 nt, Epiphyas postvittana nucleopolyhedrovirus
gaagcuauccucaacgaaucgaguccaaguuucacgcagaaacucuuugccgcuccaguugacaaugaguuucaucgugucgggcuugacguugcggauuucuuu

SEQ ID NO: 270 - RNA, 86 nt, Epiphyas postvittana nucleopolyhedrovirus
gauaaacuugucgcuguucacguucaauguuuuaauaugcuuuagcacaguuuuaauguugucacgcacaucaucgcagucguauc

SEQ ID NO: 271 - RNA, 102 nt, Epiphyas postvittana nucleopolyhedrovirus
gaucccaacgcguuuguauugacgggugacaaaagcgagguuaaaaugcauuguccgcaacauuuuaacuuugauuauaaccaauuaaaaugcgugccgauc

SEQ ID NO: 272 - RNA, 64 nt, Epiphyas postvittana nucleopolyhedrovirus
gaugucgacacauuugauacaauuuuguugaauaucacuaacaaguugccagaaguguuacauc

SEQ ID NO: 273 - RNA, 130 nt, Epiphyas postvittana nucleopolyhedrovirus
gauugugaacgcguaaaaucaacuuuuaguaagcguuuuaacacuaagcuaaucauauaaauuaaaccgguuugcugcuuuauuuuacaguugcuuguuguacaauauuaaaaacauacgcgcguugauc

SEQ ID NO: 274 - RNA, 70 nt, Epiphyas postvittana nucleopolyhedrovirus
gccaauuguguaaaguuguccugaccaugcucaccuugguggcaaacguaguugacuuuacaaguucggc

SEQ ID NO: 275 - RNA, 98 nt, Epiphyas postvittana nucleopolyhedrovirus
gcgacacacagguguuguucuauuacaaaugcuacauuuguacauugacuuaucaaaaauaauguucguguagcauuuaaaacacacugcgugauugc

SEQ ID NO: 276 - RNA, 66 nt, Epiphyas postvittana nucleopolyhedrovirus
gcuguaguagugauaguagcuuuacuaauuauuuuuauucaaucuagcagcaacgguaacaacagc

SEQ ID NO: 277 - RNA, 95 nt, Epiphyas postvittana nucleopolyhedrovirus
ggcacugguaagcuuguaguuacuguagcagagcacagguaagacugauuuacaaguuuguuacaggccuuuauauacccauguuuaucagcgcu

SEQ ID NO: 278 - RNA, 69 nt, Epiphyas postvittana nucleopolyhedrovirus
guauuuauuaacgaggcuuauuuaaaaggagcgcgaacaacgcucaaaaagcuuuuauuuagugauaac

SEQ ID NO: 279 - RNA, 107 nt, Epiphyas postvittana nucleopolyhedrovirus
gugugcuucucaacaagaacaugacaaagagcgcguuugugaacgcguaauggcacacaacgguggagaggaugcgcuauugaauuggaacuuguuguccgccacac

SEQ ID NO: 280 - RNA, 95 nt, Epiphyas postvittana nucleopolyhedrovirus
guugacaugaauguuaacuuuuacgaauugcuguacccguugacucucuacaacgacgagucuagccguaucauaaguuacauauuugcgucggc

SEQ ID NO: 281 - RNA, 96 nt, Epiphyas postvittana nucleopolyhedrovirus
guuuuuaaaauuuccaacagguuuuguaacucauuagccaugugauuuugauguauaaauuuaucaccacucuuguuuacauuguuguuuaaaaac

SEQ ID NO: 282 - RNA, 82 nt, Epiphyas postvittana nucleopolyhedrovirus
uaucucaucaugagcaaaccuuaaauaaaaacaaauuuuuucauauaaauaacauuuauuugcguuuguuuucuuuguugua

SEQ ID NO: 283 - RNA, 128 nt, Epiphyas postvittana nucleopolyhedrovirus
uauuuguaaagcgaguucgcgaagcacaugagucaccgagcauuggccucgcuuuucaaguagcauuauauuuguaaagcagguucagagcacaugagucaccgagcauuggccucgcuuuucaagua

SEQ ID NO: 284 - RNA, 102 nt, Epiphyas postvittana nucleopolyhedrovirus
ugacauuuuaaaaagcaaaucgcaaaaagcguuugacguugcuguugaaacugacggcaaagauuuaaauagcaugcaggaugugcuuucguuacuaugucg

SEQ ID NO: 285 - RNA, 89 nt, Epiphyas postvittana nucleopolyhedrovirus
ugaucgccaauuaaugacuugugugcaagcgcacccaugcgcguuuaacggcgcugggcauacuuacaucacagccgauauuggcgaca

SEQ ID NO: 286 - RNA, 86 nt, Epiphyas postvittana nucleopolyhedrovirus
ugcgcguugaggcggcuacgcgcggucaaagcaaaaaugacuugugguuuuguuugcguuccgaucgcagcaccgcgucacguuca

SEQ ID NO: 287 - RNA, 67 nt, Epiphyas postvittana nucleopolyhedrovirus
ugucaauuggccaacagcgcgacuuguuaaccaacugugcuucugaaauugccaauuuaaaaagaca

SEQ ID NO: 288 - RNA, 86 nt, Epiphyas postvittana nucleopolyhedrovirus
uguugcccacggugauaauaaaguaagucaaguguauguggccgacaagccacugucgauggaugauauuguuaaacaaggcaaca

SEQ ID NO: 289 - RNA, 122 nt, Epiphyas postvittana nucleopolyhedrovirus
uugaaaagcgaggccaaugcucggugacucaugugcuucgcgaacuagcuuuacaaauauaaugcuauuugaaaagcgaggucgaugcucggugacucaugugcucugaacuugcuuuacaa

SEQ ID NO: 290 - RNA, 74 nt, Equine herpesvirus 4
cggcuucuauggugaguugucgguugggggacaacgaggaccccucccauauacucgaguagcuauuuaagucg

SEQ ID NO: 291 - RNA, 74 nt, Equine herpesvirus 4
gggugagggggguugaguuuucgggggugagcaauaaaacgucgucuauugcccccgacgaacagucuuuaccc

SEQ ID NO: 292 - RNA, 62 nt, Equine herpesvirus 4
gguagcguagagaguagcauccacaaacgauaaguuuacuaauguuagcaucgagcgccacc

SEQ ID NO: 293 - RNA, 98 nt, Human adenovirus E
aauuucaucgcaugaauacuggagauaaagcuguguugugugcacuuugcuauaugagagcuuacaaccauuguguuuacaguaagugugauuaaguu

SEQ ID NO: 294 - RNA, 64 nt, Paramecium bursaria Chlorella virus 1
uaucaagcggguucuaauauaucaaacguguaugacacgauuauaaucggaacgucgaguggug

SEQ ID NO: 295 - RNA, 74 nt, Human herpesvirus 6
cuuugacuuuuccuuuuguuccuugucggauauuuauuaucugacuggaccuggcauucuagagaaaaucacag

SEQ ID NO: 296 - RNA, 96 nt, Pothos latent virus
acuucucucgagagggugcccacuaagcugcggccuagacuagcuugcaagauugcugucagggcuauagccaaagugggauuacuuaagaggagu

SEQ ID NO: 297 - RNA, 101 nt, Pothos latent virus
ggagaaaucaacagucucgcucguuauaguuuuugguuggcauucgguauuacaccggaugaacaacucgcuauugaacgugaccugaugaauuggacucc

SEQ ID NO: 298 - RNA, 109 nt, Pothos latent virus
uaggggugccuauuacaacaccgugguuauaacacugcuaucauuagcgccauaccagauggaguguuauugaaucacgaagggauggugguacguaaaggagccccua

SEQ ID NO: 299 - RNA, 120 nt, porcine enteric calicivirus
guccucuuuuacaccucaggacaggcugccgucugggccacaccugcgcgcuuuccaauaguuacgccaggagaggcgucaguuggcaaggagguuuguucagaguccuccuggugggac

SEQ ID NO: 300 - RNA, 70 nt, Murine adenovirus A
gagcuauugcacaagauguguuugguguuaaaaguugauggcaagcaguguaccuucuugcccaaugcuc

SEQ ID NO: 301 - RNA, 66 nt, Cryphonectria hypovirus 3
cagugagcuucaucuagauaaagcuagccugaaggcuggcuugcacaggaugauugaggcugacug

SEQ ID NO: 302 - RNA, 109 nt, Cryphonectria hypovirus 3
gguaaucaagaagcuacggaaaaaagguuuccaaaaacacucucaacgugaugcuaucgagagugcuauugaugcaaccuaugacaaucucguugcuucuuggauuauu

SEQ ID NO: 303 - RNA, 97 nt, Cryphonectria hypovirus 3
guacucugcacuguuugguaugcacguaggugacuuuggugacgagauggacgucuucaaguuccuagcaaauauagaucugaugguguaugaguac

SEQ ID NO: 304 - RNA, 118 nt, Cryphonectria hypovirus 3
ucuuacugucuaacggaucugaaagggugugcucugaagcagguugggaaccauccgauuauccaagcugcugcaaagaaacagaacacauuuugucaugcuucugaagauguuagga

SEQ ID NO: 305 - RNA, 66 nt, Myxoma virus
auaccaugucuaacacggcagaucgacagcugcauaagaccguugugaucaacccaaacaucguau

SEQ ID NO: 306 - RNA, 118 nt, Myxoma virus
guuuuccgcggacgauauaaaaaccauccuagaaucggacacguuuaugaaguacagcaagucuaaaccugccgcgauguaucaauaucugauucuuucguucuucgucagcgguaac

SEQ ID NO: 307 - RNA, 64 nt, Myxoma virus
gggguuguuuaacgcgagcaacgucgauuaucuauauaauaaagcuaagcaauuauacagcucc

SEQ ID NO: 308 - RNA, 131 nt, Myxoma virus
aaauccgucaucaaacccacgcgggacgagucguugacguguauucuuccgacguacuacaauacagucgcgaauguaucuauacccgucaauacaaacaccguaacguguugguuuuguaaacaggauuu

SEQ ID NO: 309 - RNA, 84 nt, Myxoma virus
uauauacccuguucgauaacagacgagccguguacaagaauaucgucgauguagcccgaugucuguuaucaaacggggcagaua

SEQ ID NO: 310 - RNA, 130 nt, Rabbit fibroma virus
acaacauuaacggucaacggcguagaauuagaauauauuagagaaaaagaaacggaagguauccgcggugcuaaagcgucuacggucuguuuuuuuguuuuaauacuagccguuagugccuuguuguugu

SEQ ID NO: 311 - RNA, 65 nt, Rabbit fibroma virus
gaugaaugaacugggauacaguggauacuuuauacgagaucacugguguuccaacuaucauaauc

SEQ ID NO: 312 - RNA, 131 nt, Rabbit fibroma virus
uguguugauuuuggaucguaucuuaucccuauuaaguuggauacgguuacguucuuaccucaggcuauacgccgagggacgggcgauggguggauggucaaaaaggcagauaaaguggauccgucggcuca

SEQ ID NO: 313 - RNA, 93 nt, Rabbit fibroma virus
cggguuaacgagaugaaacacggacuauggaacagagcuagucaauggaugucuggcaaguucccuaacauaacguacuuccuaucgcauccg

SEQ ID NO: 314 - RNA, 75 nt, Rabbit fibroma virus
aggugcauuggauaugauuauccuguuuacggaaguguauacgucgaucaugccggaagaauuacaauugcaucu

SEQ ID NO: 315 - RNA, 131 nt, Rabbit fibroma virus
uuggaaguuacaaaauuuguaucuaucuuuucuguaaaagagugcaaugcccagcagaacaaagugcucagguguaugagaucaaacuuuucuauuacacgaacgaccgauacggauaaaacuaguuuuca

SEQ ID NO: 316 - RNA, 130 nt, Human herpesvirus 5
gugcugcugacgaugguauggggugccgcacccgugauaaugaugacgugguucuacgcauucuucuacucaaccguacagcgcacgucacagaaacaaaggagucguaccuuaaccuuuguuagcgugc

SEQ ID NO: 317 - RNA, 93 nt, Human herpesvirus 5
cggcguuguuuuuccucuuucugauacuggaucgucugucggccauaucuuacggccgugaucucuggcaucaugagacgcgcgaaaacgccg

SEQ ID NO: 318 - RNA, 94 nt, Human herpesvirus 3
ucgauacacaagcggcugccauuuacgaauauaacuggccgacuaucccaccccacugugcgguuccgguuauagccguucuaacgccuaucga

SEQ ID NO: 319 - RNA, 118 nt, Human herpesvirus 3
cgguuagcugccuuaacccuggaguuauugucuggaacaaacaaagcccccuuacacgaagcagcgguuaauggggcgggugccgggauugacugugauggugcagcuacuucugccg

SEQ ID NO: 320 - RNA, 85 nt, Human herpesvirus 3
ggaugauguaauuuuuacggcacuuaacgacgagguuauugacuugguauacugccaguacgaauuuuccuaucccaaaucaucc

SEQ ID NO: 321 - RNA, 107 nt, Saimiriine herpesvirus 2
aaaccucagaacugggcaagugccgguagaggaauuaacauuuucuacagaauugaguagaccuauuucuucuuacaaaacugaaaacuugccucauuuaacuguuu

SEQ ID NO: 322 - RNA, 74 nt, Saimiriine herpesvirus 2
aagacccugagguaaaagcagcugcucagcuuuugucaacaaaagauccagacuaugcuuuuagagaagggcuu

SEQ ID NO: 323 - RNA, 82 nt, Saimiriine herpesvirus 2
aguaacuuguaaugcuguguauggguuuacaggaguugcgucaggcuugcugccaugcauaagcauugcagagacuguuacu

SEQ ID NO: 324 - RNA, 109 nt, Saimiriine herpesvirus 2
auucagauuucauguguguuuuggcacgcuggggcgcuugauacaacuagaaauaugcuauuaucuuuaggaacgugcucagcuguugaaaauacugaaguuuaugagu

SEQ ID NO: 325 - RNA, 85 nt, Saimiriine herpesvirus 2
cacauucaggcaucucuucuaucuaggcucuuaacuguguggcuuucuaagagaaaagcuauuaggcaaaagcuugcugaaugug

SEQ ID NO: 326 - RNA, 65 nt, Tobacco mosaic virus
acccuugcauggcaagauccugacuuuuacccaaucggauaaagaagcucugcuuucaagagggu

SEQ ID NO: 327 - RNA, 129 nt, Tobacco mosaic virus
agccgcggaaaugaucagaagacgugcgaauuccucagggauuauuguggccacgaaggacaacguuaaaaccguugauucuuucaugaugaauuuugggaaaagcacacgcugucaguucaagagguu

SEQ ID NO: 328 - RNA, 73 nt, Tobacco mosaic virus
caaguacuacacuguuguuauggauccuuuaguuaguaucauuagagaucuagagaaacuuagcucguacuug

SEQ ID NO: 329 - RNA, 66 nt, Tobacco mosaic virus
cuacugaggcgaauguugcgcuagcuuuacaggaucaagagaaggcuucagaaggugcuuugguag

SEQ ID NO: 330 - RNA, 127 nt, Tobacco mosaic virus
ggcagauucguuaauucguaagcagaugagcucgauuguguacacggguccgauuaaaguucagcaaaugaaaaacuuuaucgauagccugguagcaucacuaucugcugcggugucgaaucucguc

SEQ ID NO: 331 - RNA, 87 nt, Human adenovirus C
cagagcuguccuaucaacucuugcuugauuccauaggugauagaaccagauauuuuucuauguggaaucaggcuguagacagcuaug

SEQ ID NO: 332 - RNA, 83 nt, Black beetle virus
acacaaggacccgcaauacacauccaugauuguccaguauuauacuggcaagaagguagugucaccaauuaguccaacugugu

SEQ ID NO: 333 - RNA, 102 nt, Black beetle virus
ccgacugagaucgccgacgguguuugugaguuuguuagugaaugugacgcugaagucauagaaacugacuucuccaaucuugauggcaggguuuccagcugg

SEQ ID NO: 334 - RNA, 82 nt, Human enterovirus C
ccacugagguacaaagaucugaagauugaugugaagacaguuccccccccugagugcaucagugauuuauuacaagcagugg

SEQ ID NO: 335 - RNA, 61 nt, Human enterovirus C
uccuggugcauccagugaugccaaugaaagaaauucacgaaucaaucagauggaccaagga

SEQ ID NO: 336 - RNA, 70 nt, Avian infectious bronchitis virus
aaacacuggaaagguuuuuguguacaguugaaaagagcuaagcucauugucaccgaaaccuucuguguuu

SEQ ID NO: 337 - RNA, 93 nt, Avian infectious bronchitis virus
acuaguuguuguuguauuaaucuuugcaaugguuauaaaguuucaagguguuuuuaaagcuuaugcaaccacuguuuuuauaacaauguuagu

SEQ ID NO: 338 - RNA, 77 nt, Avian infectious bronchitis virus
caagauaguuuuuacagccgaugauguugaggacaaagaaauucucuacguccccacgacugauaaaagcauucuug

SEQ ID NO: 339 - RNA, 67 nt, Avian infectious bronchitis virus
ccugugucuaagaguguuauagauaaaguguguagcauuuugucuaguauaauaucuguagauacug

SEQ ID NO: 340 - RNA, 116 nt, Avian infectious bronchitis virus
cuuuuacauacuuuuuacagcauguuguucggguuauuacuauauggaggugaguaaaaguuuuguucaccccauguaugauguaaacuccacacugcauguugaagguuuuaaag

SEQ ID NO: 341 - RNA, 65 nt, Avian infectious bronchitis virus
gaugaaauuuuugaccccacugaaauacuuuggcuucagguggcugcaaaaauucauguuucauc

SEQ ID NO: 342 - RNA, 76 nt, Avian infectious bronchitis virus
gcaagagguuagcgugguuguugguggacgcaagcagauagugcauguuuacacuaacucuggcuauaacuuuugu

SEQ ID NO: 343 - RNA, 125 nt, Avian infectious bronchitis virus
gcagaagauguuuggucuucauuuacugaaaagucuuuugaauucuggaagcuugcauauggaaaagugcgcaaccuugaagaauuugugaagaccuauguuuguaaggcucaaaugucgauugu

SEQ ID NO: 344 - RNA, 129 nt, Avian infectious bronchitis virus
gcuauaugaauucuuucaauacuucuuuguuaaugcuguaucaguuugugaaguuagguuuuguuauuuacaccucuucuaauacucuuacugcauacacagaagguaauugggaguuauucuucgagu

SEQ ID NO: 345 - RNA, 63 nt, Avian infectious bronchitis virus
ggugauaguuucacuauagcuugugcuuauggugguacaguuguaggacucuacccuguuacu

SEQ ID NO: 346 - RNA, 131 nt, Avian infectious bronchitis virus
ggugcuauaucuaauguuguugucuuacagucuaaagggcaugaaacagaggaaguggaugcuguuggcauucuuucacuauguucauuugcaguagaucccgcggacacauauuguaaauauguggcagc

SEQ ID NO: 347 - RNA, 101 nt, Avian infectious bronchitis virus
gguuuuauaguguguaauacacagagugcucaugcauuagaggaagcaaagaaugcagccaucuauuaugcgcaauaucuguguaagccaauacuuauacu

SEQ ID NO: 348 - RNA, 64 nt, Avian infectious bronchitis virus
guggcgcaaauaauacggaugaaguaauagaagcuucguuaccguacuuauugcuuuuugcuac

SEQ ID NO: 349 - RNA, 60 nt, Avian infectious bronchitis virus
ugguuugucuacacaaguaacccaguaauguuuacaggaauacguguguuagauuuucua

SEQ ID NO: 350 - RNA, 62 nt, Avian infectious bronchitis virus
uuugagugaguauugugaugacauacuuaagaggucaacuguauuacaaucgguuacucaag

SEQ ID NO: 351 - RNA, 63 nt, Avian infectious bronchitis virus
cuaaugugaccgacucagcuguuaguuauaauuaucuagcagacgcagguuuggcuauuuuag

SEQ ID NO: 352 - RNA, 67 nt, Avian infectious bronchitis virus
cuauuagguacuccuuuugugguaauggacgacauguucuaaccauaccgcaaaaugcaccuaaugg

SEQ ID NO: 353 - RNA, 90 nt, Avian infectious bronchitis virus
cuuuauuuaauguuacugaaaaugugcucauaccuaacaguuucaacuuaacuguuacagaugaguacauacaaacgcguauggauaagg

SEQ ID NO: 354 - RNA, 85 nt, Avian infectious bronchitis virus
gugauucaagaaaucuaccagcaauuugacgccauacaagcaaaugcucaaguggaucgucuuauaacugguagauugucaucac

SEQ ID NO: 355 - RNA, 77 nt, Avian infectious bronchitis virus
augcuaugaaccagagagcuuaccguaugcuuggacuuaauguucaaacaguagauucuucucaagguucagaguau

SEQ ID NO: 356 - RNA, 72 nt, Avian infectious bronchitis virus
cgccugagggacuuguagauacuucaauaggcaauaauuuugagccugugaauucuaaagcaccuccaggug

SEQ ID NO: 357 - RNA, 80 nt, Avian infectious bronchitis virus
gcuuacaagagcuaagcgugguauacuaguugucaugcgccagcgugaugaauuguauucugcucuuaaguuuacagagc

SEQ ID NO: 358 - RNA, 74 nt, Avian infectious bronchitis virus
ggcacagaguuacacccaacuucuacagguaguggauugacauacuguauaaguggugcuaauauagcauggcc

SEQ ID NO: 359 - RNA, 78 nt, Avian infectious bronchitis virus
guauuuauguuaaaccugguggcacuagcaguggugaugcuacuacugcuuaugcaaacaguguuuuuaacauaauac

SEQ ID NO: 360 - RNA, 66 nt, Avian infectious bronchitis virus
ucaaacugguaaugcugcuauaaacgauuaugauuauuaucguuauaacaggccuaccauguuuga

SEQ ID NO: 361 - RNA, 67 nt, Avian infectious bronchitis virus
ugauauuguagacuaugugucugaugcacauguuucugugcuuucagauugcaauaaauauaauaca

SEQ ID NO: 362 - RNA, 81 nt, Eggplant mosaic virus
agcacgcuugggucacuccaaacgcgugggacaaucugcagaccuugucugucaaugccccccaccgcccccaaguaugcu

SEQ ID NO: 363 - RNA, 94 nt, Eggplant mosaic virus
caggcuuacgcgcaugaaucuuccaucacccaugccaaaaaccucaucuccaacaugaagaaugguuuugauggaaucaugucuucucucacug

SEQ ID NO: 364 - RNA, 69 nt, Feline immunodeficiency virus
gaugguggaaucaaauggccuauuauaacaguuguaaaugggaagaggcaaaaguaaaguuucauuguc

SEQ ID NO: 365 - RNA, 67 nt, Feline immunodeficiency virus
ggaggaaaaauguuguacaauaaaguuacaaaacaauuaagcuauuguacagacccauuacaaaucc

SEQ ID NO: 366 - RNA, 79 nt, Feline immunodeficiency virus
ucccuccugaguuguggacaagguauaauaugacuauaaaucaaacaauauggaaucauggaaauauaacuuuggggga

SEQ ID NO: 367 - RNA, 131 nt, Feline immunodeficiency virus
uuacaaaagugggaagauuggguaggauggauaggaaauauuccacaauauuuaaagggacuauugggagguaucuugggaauaggauuaggaguguuauuauugauuuuauguuuaccuacauugguuga

SEQ ID NO: 368 - RNA, 78 nt, Hepatitis A virus
aaauccucacaaugauauguugaauguuaauuuagcuaaaacaaaugaugcaaucaaagauaugucuuguguugauuu

SEQ ID NO: 369 - RNA, 60 nt, Hepatitis A virus
gauuucucugcuuuugaugcuagucuuaguccauuuaugauuagagaagcagguagaauc

SEQ ID NO: 370 - RNA, 97 nt, Hepatitis A virus
gcugguaauguuguuauucaaucuuuggaugugggauuccaggauguuguucugaugaagguuccuacaauuccuaaguuuagagauauuacucagc

SEQ ID NO: 371 - RNA, 122 nt, Hepatitis A virus
ggaauuuugcuuuauguaauacaacaauugaaucaggaugaacauucucacauaauugguuuguugagagucaugaauuaugcagauauugguuguucaguuauuucauguggcaaaguuuu

SEQ ID NO: 372 - RNA, 72 nt, Hepatitis A virus
ggggauugaucugugcuaugguuccuggugaccagagcuaugguucuauagcaucauugacuguuuauccuc

SEQ ID NO: 373 - RNA, 114 nt, Equine herpesvirus 1
cuggacuuuuaguuacccuccgacccgccgcgucugcgggugaaggcgguggcgaccacgucucuccgcgggcggcgaucguaaaugugucgguggagguagacuuggacccag

SEQ ID NO: 374 - RNA, 126 nt, Equine herpesvirus 1
cugugucggcgcgguagcgacuacaccgcagaguuuugucacguucccgucucgggcgaacucuugaaacgcggagcucgcgacgcaucucugguaacaccggcgcgcguugccagcgccgcgcag

SEQ ID NO: 375 - RNA, 126 nt, Equine herpesvirus 1
gacuguauggucuaucuuacguccauuuucaaaacuuaucuaagcauguuaaacagagcaauaucugccucgugcgacgcggaugaaucuaugaauguggacuuuccaaucucugauuaugcauuu

SEQ ID NO: 376 - RNA, 63 nt, Equine herpesvirus 1
gcgcgaugcaauggccgccuauagacuguccgacgggcuguggccggcucuagguaugagcgc

SEQ ID NO: 377 - RNA, 109 nt, Equine herpesvirus 1
ugcuguuucccgccaaugagcgcuuggcugaggugguuagauugagggcacguggccaacaccccacccuuaagcucgccuugguauccuuuuuuggggggcugcagca

SEQ ID NO: 378 - RNA, 131 nt, Equine herpesvirus 1
agcgccccggucuacccguuuguggaggagcuggcgcgcagaaagcuacacgaaggaaucgcggaacucuuuggggccaugaacaugccucgcaugguucugcgcgaccagcacggguucaugucggugcu

SEQ ID NO: 379 - RNA, 130 nt, Cryphonectria hypovirus 1
aagcaaaacuggaggacaccgcgcgcaagguguguaguguauggcaauauaacaucaugaucgcuucaucugucgcguuucuagugccauuauacuucacacucuaugugccguaccugcaauucuacuu

SEQ ID NO: 380 - RNA, 83 nt, Cryphonectria hypovirus 1
acgugacugcuaaugcagacuggguucggucagagacgacgauaaauuuuaucucugaccaacccggcaaggcucagucacgu

SEQ ID NO: 381 - RNA, 130 nt, Cryphonectria hypovirus 1
caugauagauaaggugcgcaucuaccaaggcaugacugucaucaucucggccauguauuucgcaaugcauugggucgagcuguuuauucagucacuguucuugauagggccauuauauaaucuauucaug

SEQ ID NO: 382 - RNA, 91 nt, Cryphonectria hypovirus 1
ccgaggacaaggaaauagcgcuucaggauuacaaucacaagcaguugcugggugagauguucuugaagcuuccugacuccuauguugacgg

SEQ ID NO: 383 - RNA, 129 nt, Cryphonectria hypovirus 1
ccuugacagagauuaucacacaaugccuacgcagaaagacuuucaccaacccuccauacugccauacuucgcauggcuguggaggcaaggguuugauguuaaacugccacgcguguugcucgucauagg

SEQ ID NO: 384 - RNA, 83 nt, Cryphonectria hypovirus 1
cggugcugagggguuacaaagccgcguucacuccgcaugucgagcuugacaugccgaacgcaacuucguacaacuuagcaccg

SEQ ID NO: 385 - RNA, 88 nt, Cryphonectria hypovirus 1
gaggugucgguugacggaaagaguuuuggccagggcggcaaccguuauagauucgucuuucgcuaugacucuuugcugucgacaccuu

SEQ ID NO: 386 - RNA, 86 nt, Cryphonectria hypovirus 1
gccucuauucaucagacugccaaaccguuucagggccguggcuuuguuaaacgguaggcagucugauuaugacaauuaugguuggc

SEQ ID NO: 387 - RNA, 122 nt, Cryphonectria hypovirus 1
guacuucuacaccagcgggaacaugcagagaucggcauguggcaagcgcaggucaacgagcucagagcccagaaccuugcccuucagucacagcugagaucagcaugcacccgaagaagcac

SEQ ID NO: 388 - RNA, 130 nt, Cryphonectria hypovirus 1
guagucgaacuggcuuacacccagcuuguccaggacgaaaaggaacgcauaccagaaccgaagggaacuaagauucuggacaugccgaauuggaagccuggcaacugggccaaguuaauagacgagacgc

SEQ ID NO: 389 - RNA, 129 nt, Cryphonectria hypovirus 1
gucaacaagauaggaugaagaugcagguuauaaacgugaacccgaacuggaaacggaacuucaaguugucaccaagacaagaagcauuccuucgguggaucaggcaggccaaguuuccaucuuaucgac

SEQ ID NO: 390 - RNA, 103 nt, Cryphonectria hypovirus 1
guccgauucgauacaagaacccugucaugucucaccaggcugccgaaaucuguggauugaagccuggggaguaugaaguggaugauagguaucaggaaaggau

SEQ ID NO: 391 - RNA, 94 nt, Cryphonectria hypovirus 1
ugaaaccuuccggaacuacgaugaaaucaaagccguucucgaggucauucuugagaacgagccugacauccucguuggagcugaagaagguuca

SEQ ID NO: 392 - RNA, 131 nt, Cryphonectria hypovirus 1
ugacgaaaugccacacauuaggagugugaggaacacgggcauccaugggcuaccuggggauuucuugucgaauuacccuagacugccuacgccuguauuucaucgccuccgcgauuugugggaugauguca

SEQ ID NO: 393 - RNA, 130 nt, Melon necrotic spot virus
acuugguuucgucggaaacuccauaguauuguggguacucauuccaguauuaguccaggucaguucuuggacuucuauacuggcaggaggcgcacgauuuaugaaggugcugugaaaucguuggaggggu

SEQ ID NO: 394 - RNA, 96 nt, Melon necrotic spot virus
ccgccauaguugggauugguuaucuugggguuaggauuggugccgcuuggugccgccguacucccggaauaacgaauuccauaaucaccuaugggg

SEQ ID NO: 395 - RNA, 88 nt, Melon necrotic spot virus
ggggugccuggaggagcucgcuggguucuguacuucgguacggagagggacacacccagacaugaccgaguuuccucaggaucguccc

SEQ ID NO: 396 - RNA, 73 nt, O'nyong-nyong virus
gagguccacgaagagaaaugcuauccaccuaaauuggaugagaucaaagagcaacuacuacuuaagagacuuc

SEQ ID NO: 397 - RNA, 60 nt, Igbo Ora virus
ucagauagugcaagcuuuuaaagaagauagggccuacucuccagaaguugcacugaauga

SEQ ID NO: 398 - RNA, 67 nt, O'nyong-nyong virus
ucuacugcagggacaaggaaugggagaagaagaucacugaagccauaucacuaagaucccagguaga

SEQ ID NO: 399 - RNA, 64 nt, Pepper mottle virus
cccagggcaaaugaauuuuuccagccuaagaugugggcguauggaaagaguauguugaauaagg

SEQ ID NO: 400 - RNA, 73 nt, Pepper mottle virus
gaaaggguguucucaacuuggcucauuuacuugaauacaaaccaagccaaguugacauaucgaacacucguuc

SEQ ID NO: 401 - RNA, 60 nt, Pepper mottle virus
gaauggaugaacgauuauguucuaaaucuaucaaaaguuagcacaugggguucacuauuu

SEQ ID NO: 402 - RNA, 61 nt, Pepper mottle virus
gcauuugaggaagcuaucguuagaguuauuguauacucagauccacggcuuucgcaaaugu

SEQ ID NO: 403 - RNA, 115 nt, Pepper mottle virus
gcuguaucugaaucaagauguacaaaugaugagcuucaggucuuaccucaaguauuucgcugaugcagaugaagaguuugaaugcgguacauaugaaguucgucaucagagcagc

SEQ ID NO: 404 - RNA, 94 nt, Pepper mottle virus
ugagaaugcgugguaauaguguguuugggucgucgccuauuucuguaaugacaaguggguucgcuuugcauuucuuugcuaauaacaucacuca

SEQ ID NO: 405 - RNA, 79 nt, Pepper mottle virus
uugaagauuuacuggcauucaagagugaaagugugagggaacaagcacacacaucaucuuggaugcuugaagucuugaa

SEQ ID NO: 406 - RNA, 61 nt, Human papillomavirus type 39
agaugcauuauuugauauauaugcugauguggacaauaacacauauuuagauacugcauuu

SEQ ID NO: 407 - RNA, 82 nt, Human papillomavirus type 39
guaccuguccaccagacguuguugauaaaguugaggguacuacacuugcugacaaaauuuuacaguggacuaguuuagguau

SEQ ID NO: 408 - RNA, 70 nt, canine parvovirus
cuuuaauaugugcaugguuaguuaaacaugguuaugaaucaaccauggcuaacuauacacaucauugggg

SEQ ID NO: 409 - RNA, 131 nt, canine parvovirus
gaauuaauacuugaaaaagcagauaauacuaaacuaacuaacuuugaucuugcaaauucuagaacaugucaaauuuuuagaaugcacggauggaauuggauuaaaguuugucacgcuauagcauguguuuu

SEQ ID NO: 410 - RNA, 95 nt, Rabies virus
aggguugauuaugauaaugcauuuggaagguaucuugccaacacguauuccucuuacuuguucuuccauguaaucaccuuauacaugaacgcccu

SEQ ID NO: 411 - RNA, 112 nt, Rabies virus
agucacuaauguucauguggugaagagagcucuaucguuaaaagaaucuauaaacugguucauuacuagagauuccaacuuggcucaaacucuaauuaggaacauugugucu

SEQ ID NO: 412 - RNA, 75 nt, Rabies virus
cuuggcccauuucuauuccaagucgucccccauagagaagcuguuaaaucucacgcuaggaaauagagggcugag

SEQ ID NO: 413 - RNA, 102 nt, Rabies virus
cuuugauagaagauccugcuagacuaauguuagaaugguuaaaaacagggaauagaccuuaucggaugacucuaacagacaauugcuccaggucuuucagag

SEQ ID NO: 414 - RNA, 61 nt, Rabies virus
ggagugcuuagcaagcgaccuagccaggaggauccuuagaugggguuuugauaaguacucc

SEQ ID NO: 415 - RNA, 118 nt, Rabbit hemorrhagic disease virus
agguggaugaguuuauugagcgagcggcugccgacguuuugggcuacuugcgcuuccuaaccaagggggagcgccaggcaaaccugaacuuuaaagcugcguucaacacucuagaccu

SEQ ID NO: 416 - RNA, 130 nt, Rabbit hemorrhagic disease virus
cauuggaacuugaauggcagcacauauggcuggucaagcccucgguuuggcgacauugaccaucgaagaggcagugcaaguuacucugggagcaacgcaaccaacgugcuucaguuuugguaugccaaug

SEQ ID NO: 417 - RNA, 74 nt, Rabbit hemorrhagic disease virus
gcucgucggugcggaacccagaccucccguuaguggaaccagguaugcuaaggucccgggugugccugaugagu

SEQ ID NO: 418 - RNA, 67 nt, Rabbit hemorrhagic disease virus
gcuggcguaugacgguugcacacagaccacccacggggacugugggcugccguuguaugacuccagc

SEQ ID NO: 419 - RNA, 88 nt, Rabbit hemorrhagic disease virus
uugaaggugugaagaguuucugggacaagguggucugugcaacggaccgcugcuuugacuugcucaagaggcuguuugacacauuuga

SEQ ID NO: 420 - RNA, 66 nt, Sendai virus
cucuuggcccaugcaucaacuauuauaacucggggguauacucuugugaugucaaugggcagagag

SEQ ID NO: 421 - RNA, 84 nt, Sendai virus
gguguuguauaggguaaugaaucaagagccuggugauucuaguuuucuagauugggcuucagauccuuauucaugcaaccuucc

SEQ ID NO: 422 - RNA, 131 nt, Sendai virus
uaccagucuaggucagaggguuaagguauuguucaacgggaauccuggcucgacauggaucgggaaugaugaaugugaggcuuugauuuggaaugaacuacagaauaauucgauaggccuaguccacugug

SEQ ID NO: 423 - RNA, 88 nt, Tomato bushy stunt virus
agcuuaacccguugaaugguacauuguucucuugguugccagcgauagcauccaauuuugaucaguacacauucaacagcguugugcu

SEQ ID NO: 424 - RNA, 104 nt, Tomato bushy stunt virus
gaagcgaugcuuaggguacccaccgauaagauuaagagauuuugugaugacaguuccacaucugaucacaaacuuaucgacuugggucaauugggcauugcuac

SEQ ID NO: 425 - RNA, 74 nt, Tomato bushy stunt virus
guagcagugacuagacaacuugucgguaguaagccuaaguuuacuggcaggacgucuggcucugucacaguuac

SEQ ID NO: 426 - RNA, 101 nt, Vaccinia virus
uagcggauaucauuugaucggugaaucuaaaucguauugugaauuaggaucuacuggaucuaugguauggaaucccgaggcaccuauuugugaaucuguua

SEQ ID NO: 427 - RNA, 104 nt, Vaccinia virus
gccuugggcggaucuguaaacauuugggccauuauaccucucagugcaucaguguucuaccgaggagccgaaaacauuguguuuaaucuuccuguguccaaggu

SEQ ID NO: 428 - RNA, 130 nt, Vaccinia virus
guugugguagaaccgucauucauuuagaaugguuguugggcuuuaucaaguguauuagucagcaucagcaucuggcuauuauguuuaaagaugacaauauuauuaugaagacuccugguaauacugaugc

SEQ ID NO: 429 - RNA, 130 nt, Vaccinia virus
ccaccgaaacaagauaauaaaugcagagaagagaauggagauuuuaucaauauuagauugugugccuacgaaaaggaauauugcaaugacggauaucuaucuccugccuauuauauguuaaaacaggugg

SEQ ID NO: 430 - RNA, 81 nt, Vaccinia virus
uaguguuagaaauagaagacuuuaauaucaagcauuuauuuauggcaggugagauguuuguuagaagucagucuaguacua

SEQ ID NO: 431 - RNA, 64 nt, Human papillomavirus type 17
agaagauuuuguguuugccuguugcaguaguugugcguaugcuacagcacaguaugaauuuucu

SEQ ID NO: 432 - RNA, 98 nt, Human papillomavirus type 17
ucagugaguggaagggaguuagaggaaauagagcacaagccaauaggggaaauaccuauucgcugcaaguuuuguuuaaagaaauuggauuuacuaga

SEQ ID NO: 433 - RNA, 93 nt, Human papillomavirus type 40
gagcuguuuaaaugcaaggaccuaaaugcuaagcuguaugguaaguuuaaagagcuuuauggagugggguuuggagaccugguaagacaguuu

SEQ ID NO: 434 - RNA, 90 nt, Human papillomavirus type 40
uaccuaaaaaaaauugcauuuguauuguggguccuccagacacaggaaagucauguuuuggaaugagccugaugcacuuuaugcaaggua

SEQ ID NO: 435 - RNA, 63 nt, Human papillomavirus type 7
acuggugcagcugaagaaauaccuauggacacauuuguuguucauagugauccacuguccagu

SEQ ID NO: 436 - RNA, 71 nt, Cardamine chlorotic fleck virus
cgcucuuuuaccggaguuucucgcccacaagcuuucgcguuuagugcucaaaugcuuugguauagguagug

SEQ ID NO: 437 - RNA, 94 nt, Cardamine chlorotic fleck virus
gcaccccaugacuggcagaucauggcuacgggcguggaggaggcuuaccggccuucccgacgacguggcugugcaauuuguccgcuaggggugc

SEQ ID NO: 438 - RNA, 127 nt, Cardamine chlorotic fleck virus
gggguccaaagagguuucugaagcagcucgguacucauuuuacguggcuuucggguacaccccugaugaacaaaggggacucgaaggcuacuaugauaaucuggcguuagaagcagcaugggacccc

SEQ ID NO: 439 - RNA, 96 nt, Borna disease virus
acugccaugcuuuaccacguuuauuauucaagacagguucaacccgcccuauucccucaguggugagcccguugaagacggaguuacaugcgcggu

SEQ ID NO: 440 - RNA, 99 nt, Borna disease virus
auuagacucgacagguuagagucaguuuguuaugcucaccccuguuuagaggaacuagaguuuaaugcauaucuagacucugaguugguugacauuagu

SEQ ID NO: 441 - RNA, 109 nt, Borna disease virus
ugaguauggaaagaagcuuuucuuccgugguguaccugucccgggcuguuugaagcagcucucacgggugacggauucuacuggagagcuauucccaaaccuauacuca

SEQ ID NO: 442 - RNA, 94 nt, Variola virus
auguaucguaaguucucuaaguguacuauaguugacaguaugauaauagggcauauaggucaucauuauauuuggauuaaaaauuuagaaacau

SEQ ID NO: 443 - RNA, 68 nt, Variola virus
cgaugaugaauauuacaagauuagaaguuauaggauuaacuacucauugcacaaaauuaagaucaucg

SEQ ID NO: 444 - RNA, 83 nt, Camelpox virus
guauuaauaugaauuauagcgaugauuauaugaugaacaucuauuugaauuuuccuuggcuaucgcaugauuuauaugauuac

SEQ ID NO: 445 - RNA, 78 nt, Ectromelia virus
uacuaauauccuugacgaaugaaauauauacaucuauaauuaauagagauaucauaguuauuuacccaaacuuuagua

SEQ ID NO: 446 - RNA, 130 nt, Variola virus
ccaccaagacaagauaauaaaugcagagaagagaauggagauuuuaucaauauucgauugugugccuacgagaaggaauauugcaaugacggauaucuaucuccugccuauuauauguuaaaacaggugg

SEQ ID NO: 447 - RNA, 66 nt, Variola virus
ggaagacacauuauuugacgacgaguuauacucuauuauagaacgcucuuucgaugauaauuuucc

SEQ ID NO: 448 - RNA, 118 nt, Variola virus
gauacaacgguuacuaucaauauuauucauuuagcgauuaugaaaauuauaaugaauauuauuaugaugauuaugauagaacugguaugaauagcgagagugagagugauaauauauc

SEQ ID NO: 449 - RNA, 129 nt, Variola virus
gcguaucaaauguaaaugacgcggaacacauaucucagauaacuaaugauguaucuacacaaacaugggaaaagaaaucagaguuagauagauacauggaaauguauccucgucauagauauaguaagc

SEQ ID NO: 450 - RNA, 70 nt, Variola virus
ucacugacuaaccauauaauagauuauguucuuacagacaauaaaaauauuauuuggcaaagucaaauga

SEQ ID NO: 451 - RNA, 103 nt, Variola virus
cacuuauuacuccauuauuggcggaggucugagaaugaacuuuggauucaccaaauguccucagauuaaauccaucucagaauccgcuaauggaaacgcagug

SEQ ID NO: 452 - RNA, 91 nt, Autographa californica nucleopolyhedrovirus
auauuacguuccugucggcgacaaauuuccccgcgcuguauuaugugauuuagacgguacaguagcuuugcccacaaauagaucguuuuau

SEQ ID NO: 453 - RNA, 95 nt, Autographa californica nucleopolyhedrovirus
gccagcacccgaggaagugcuuuugcagaaaaccuuugcgugucagacgugacguuuaaacguuuaguuuugcaagcucuucaacuugacgaggc

SEQ ID NO: 454 - RNA, 131 nt, Equine herpesvirus 2
cucaugugguacgagcugagcaagaucaaccccaccagcgucaugagcgccaucuauggcaggccagugucugccaaguugauaggggacguggugucagugucagauuguaucaguguugaccaaaagag

SEQ ID NO: 455 - RNA, 73 nt, Equine herpesvirus 2
caccgagguggugacuaauaucaugcugggaccggccuuugagcuggcccagcuccagaucaccgccgcggug

SEQ ID NO: 456 - RNA, 60 nt, African swine fever virus
augucuaugacauccuugacaugauaauuaacguuaucauggauguauuuuacgagacau

SEQ ID NO: 457 - RNA, 81 nt, Human herpesvirus 6
gauggguuagugaaaaagguggcaucagaauccagaaacuugcuccuggauuugagagcuaauaugaacaaugacauuauu

SEQ ID NO: 458 - RNA, 86 nt, Tick-borne encephalitis virus
cguugcgggagcaauacagcgaaaccuggcauauggacgaggaacacccguaccggacauggcaguacuggggcagcuaccgcacg

SEQ ID NO: 459 - RNA, 89 nt, Tick-borne encephalitis virus
ggauggacgcacccugguggugccgugccgagaccaagaugaacucguugggagggcgcgcaucucaccggggugcggcuggagugucc

SEQ ID NO: 460 - RNA, 97 nt, Tick-borne encephalitis virus
gucugguguuggccacaguguugugccucaugucgguggucaugaaccgaacgguggccuccauaacagaggcuucagcagugggacuggcagcagc

SEQ ID NO: 461 - RNA, 130 nt, Tick-borne encephalitis virus
ugaugauucacuguccuaugagugugugaccauagaucaaggagaagagccuguugacguggauuguuuuugccggaacguugauggagucuaucuggaguacggacgcugugggaaacaggaaggcuca

SEQ ID NO: 462 - RNA, 61 nt, Tick-borne encephalitis virus
ugcagccuugggagcuuggucagaugagcaaaacagaugggcaagugcaagagaggcugua

SEQ ID NO: 463 - RNA, 106 nt, Hepatitis G virus
aggucucagccgugcuccggcgccugagccucacccgcacagugguugcccuggucaacagggagccuaagguggaugagguacaggugggguaugucugggaccu

SEQ ID NO: 464 - RNA, 130 nt, Hepatitis G virus
agguucugagcgaccucaagcucccuggcuuagcaguccaccgaaagaaggccggggcguugcgaacacgcaugcuccgcucgcgcgguugggcugaguuggcuaggggcuuguuguggcauccaggccu

SEQ ID NO: 465 - RNA, 131 nt, Hepatitis G virus
augauacaacugcuuucacaaggaucacugacuccccccugacguauucaaccuaugggagguuuuuggccaacccuaggcagaugcuacggggcguuucgguggucauuugugaugagugccacagucau

SEQ ID NO: 466 - RNA, 125 nt, Hepatitis G virus
augggcauggaauaccccucgagcggaugcgaaccggaaggcaccucguguucugccauucuaaggcugagugcgagcgccuugcuggccaguucuccgcuaggggggucaaugccauugccuau

SEQ ID NO: 467 - RNA, 130 nt, Hepatitis G virus
caucuggccagaugcugugaugaugguggugguugccuugguccuucucuuuggccuguucgacgcguuggauugggccuuggaggagaucuuggugucccggcccucguugcggcguuuggcucgggug

SEQ ID NO: 468 - RNA, 98 nt, Hepatitis G virus
ccguccggcuggucuccaagaugugugcgagaggagcuuauuuguucgaucauaugggcucuuuuucgcgugcugucaaggagcgccuguuggaaugg

SEQ ID NO: 469 - RNA, 73 nt, Hepatitis G virus
cggcugauaucggagaagccgcgguguucuucucugggcucgccccauugaggaugcacccugaugucagcug

SEQ ID NO: 470 - RNA, 64 nt, Hepatitis G virus
cucagggcccucugccccguggugucacuacccuuguggcauugcggggaggggugguccgggg

SEQ ID NO: 471 - RNA, 131 nt, Hepatitis G virus
cuugguuugccuccaccaguggucgcgacucgaagauagauguguggaguuuagugccaguuggcucugccaccugcaccauagccgcacuuggaucaucggaucgcgacacggugccugggcucuccgag

SEQ ID NO: 472 - RNA, 103 nt, Hepatitis G virus
gacucgguguggcggaggguuacguccgcugcgacgcugggccgaucuugaugaucggucuagcuaucgcggggggaaugaucuacgcgucauacaccggguc

SEQ ID NO: 473 - RNA, 63 nt, Hepatitis G virus
gccagaggagucgcuggcggugguugggguucuuagcccugcucaucguagcccucuucgggu

SEQ ID NO: 474 - RNA, 123 nt, Hepatitis G virus
ggcacgguuggucccgcugaucuugcugcugcuaugguggugggugaaccagcuggcaguccuagggcugccggcuguggaagccgccguggcaggugaggucuucgcgggcccugcccuguc

SEQ ID NO: 475 - RNA, 90 nt, Hepatitis G virus
gggcacuugggaaauacuaugccucaggcaccauggucaccccggaaggggugcccgucggugagagguauugcagauccucgggugucc

SEQ ID NO: 476 - RNA, 129 nt, Hepatitis G virus
guccgcggcccaacuggugggggagcuggguagccuauacgggccccugucggucucggccuauguggcugggauccugggccugggugagguguacucggguguccuaacggugggagucgcguugac

SEQ ID NO: 477 - RNA, 100 nt, Hepatitis G virus
gucggccugccuccugcggcaccugugugagggacugcuggcccgagaccgggucgguuagguucccauuccaucggugcggcguggggccucggcugac

SEQ ID NO: 478 - RNA, 105 nt, Hepatitis G virus
gugcuguuaggcauugggagaguccgggagcuggcgcgugggugcggggugcaacuagugcucuacgccaccgcuacaccucccggauccccuaugacgcagcac

SEQ ID NO: 479 - RNA, 125 nt, Hepatitis G virus
uauuuccacagagcgacgcgaccaggaagcuuaccgucaagaugucgugcugcguugaaaagagcgucacgcgcuuuuucucauugggguugacgguggcugauguugcuagccugugugagaug

SEQ ID NO: 480 - RNA, 61 nt, Hepatitis G virus
ucccugcggacagugccugcgucggcugaacugucgaugcaaagacgaggacgcacgggua

SEQ ID NO: 481 - RNA, 113 nt, Hepatitis G virus
ucgcaucauacgggaugccgcgaggacuuuguccugcgggcagugcgucauggguuuacccgugguugcgcgccguggugaugagguucucaucggcgucuuccaggauguga

SEQ ID NO: 482 - RNA, 72 nt, Human herpesvirus 7
augacaaauuucaggaaaaacgguguuguaauaauucauuuguuuaagacauuauuugcugaacucugucau

SEQ ID NO: 483 - RNA, 97 nt, Human herpesvirus 7
guugacaucauugagaaagauuuggauuuuuccacaaaacaauauggucuuguaaaagaguauauggcgaaaaucacaaauauuuuucaacagcaac

SEQ ID NO: 484 - RNA, 64 nt, Human herpesvirus 7
cucaccugacugucucauguauccagcugaaacaaauccuggaaugaguacugaagaaagugag

SEQ ID NO: 485 - RNA, 65 nt, Strawberry vein banding virus (SVBV)
ggacgaaagucucagcaacauguauccacaguuuugugcuguauauguugaugacaucaucgucu

SEQ ID NO: 486 - RNA, 121 nt, Strawberry vein banding virus (SVBV)
ggauuuuggcagguacgccuugcuccagaaacaauucagcuaaccgcuuucagcuguccccaaggacacuacgaaugguuagucaugccuuuuggauuaaaacaagccccugcuauuuucc

SEQ ID NO: 487 - RNA, 74 nt, Carrot mottle mimic virus
gcuuggcguuuggauugucuauuccaaugcaaauagcauuggaggguauauaugacaaucuuaagagaccaggu

SEQ ID NO: 488 - RNA, 90 nt, Carrot mottle mimic virus
ugccaguguuuggcaguuuuuaccguugguuguguagaauugggaaagcuaauacuaaagugaccgagcauccacuguacaaaugcggca

SEQ ID NO: 489 - RNA, 79 nt, Molluscum contagiosum virus
uagcuacgggcagaacuaccagugcgagucagugcucgucccgcugacaagcgagugcugcaauguccuguccgagcua

SEQ ID NO: 490 - RNA, 130 nt, Molluscum contagiosum virus
uucuaguaccgguucccgugcggccugcagcgggugcucuugucccgcggagccgcggcgcgccguauacgccgucugcuuuuguucaggucacgcccgcgugggcaggcccugucacgcuggacaucua

SEQ ID NO: 491 - RNA, 92 nt, Molluscum contagiosum virus
cgcagcgcgacuuucccgaggcgcacugccugcuccggcacuccacggaggagcaguacgucuuccuggacuuucgcaacuuuaacucugcg

SEQ ID NO: 492 - RNA, 121 nt, Saguaro cactus virus
aacaauggugacgauuguguucucauaugcgaaacucgugacguggggcgugucguggauaaguuaacgacagcguggcuccacuuugguuuuacauguaucgcagaggaaccagucuaug

SEQ ID NO: 493 - RNA, 127 nt, Saguaro cactus virus
caaccgggccuauucugagauuuccgaugcugccagauuuagcuuuuggaaagccuucgacaucuuaccagauguucaggaggccaccgaagcugaacugcgucgcaccuggauuagucucgauuuu

SEQ ID NO: 494 - RNA, 131 nt, Saguaro cactus virus
uggcauauuuaaagcggcggcuugugcguaucguugggcugcauacccggaucuccgcugcgcaagugguggauuguuaucagggcaggaagcgcaccguguaucacaaugcucgcuuaucucuugaugaa

SEQ ID NO: 495 - RNA, 70 nt, Papaya ringspot virus
gcaaagugguggucguuggcucuuugacaaauuacacggcaauuugaaaggaguuagcuccgcuccuagc

SEQ ID NO: 496 - RNA, 111 nt, Papaya ringspot virus
ugauugcguuuauagaaucuuaaacaaguuuaaaggcgugauaaauucuagcaacacaaauguuuaucaccagucuuuagaugacauucgggauuucuaugaagacaagca

SEQ ID NO: 497 - RNA, 73 nt, Cucumber green mottle mosaic virus
gucuuaaaucugccguagaaggacuaggugauugcgucuaugaugcucuaguucaaaccggcugguuugacac

SEQ ID NO: 498 - RNA, 115 nt, Cucumber green mottle mosaic virus
guuguaugacugcgaaaagugcaagugguuauuguugccagccgagaagaagcacgcaugggccgugguucuggcaagugacgauaccacucgcauaaucuuccuuucauaugac

SEQ ID NO: 499 - RNA, 104 nt, Cucumber green mottle mosaic virus
ucacuccagucguuuacacugggaccauucgagagaggcaaaugaagaauuauauugauuacuuaucggccucucuugguuccacgcuggguaaucuggagaga

SEQ ID NO: 500 - RNA, 90 nt, Cucumber green mottle mosaic virus
uucgcagaaggcugggguaacaguaacgggucugggcacgcucucuccugagaugggcgcuucuguugcguuauccaguaccucuguaga

SEQ ID NO: 501 - RNA, 63 nt, Cucumber green mottle mosaic virus
uuuuggcuuggauguggucuaugggucacaaaagaacuauacugcaagauuuccaagccggga

SEQ ID NO: 502 - RNA, 120 nt, Galinsoga mosaic virus
cgaccaguacagauucuuaaaggucuggcuugaauaugccccauuuugcucaaccacugaggcuggcagggugggguuguacuucgacaaagacucacaagauccugagccuacugaucg

SEQ ID NO: 503 - RNA, 69 nt, Galinsoga mosaic virus
ggcucuaguagugccggccccacuguagccgcuguaacggcuagcacuggcaccaguacuacucuuacc

SEQ ID NO: 504 - RNA, 76 nt, Lymphocystis disease virus 1
gaaguuuuucugaaguaaaaugguuguuccugaauaagcaaaaaucguuaacgaucuauuauuuuaaaucaacuuc

SEQ ID NO: 505 - RNA, 72 nt, Lymphocystis disease virus 1
guuguacuuauuuuaaaccauguaaacaaugucuucaaugucuuacauuacaagaugagcaauuucuacagc

SEQ ID NO: 506 - RNA, 130 nt, Lymphocystis disease virus 1
uguuuaaaccagcauuuaaacuuguuauuauauauuacauuugaagagaguuuauacauuacaucuauugcacuagaguacaaaccauuuuuuaaugauaugaauauaguacaacguuuaagcuuaaaca

SEQ ID NO: 507 - RNA, 110 nt, Lymphocystis disease virus 1
guguuaaaaacaauugcgcgauuuaacgauuuuuuauuaaaauggaaacaagaugugauuguaaccagcgacuauuuaaaauuaauuaauacguauuguguuuuugauac

SEQ ID NO: 508 - RNA, 68 nt, Lymphocystis disease virus 1
uaccgguacauuaaacauuauaaacgcauguuuauuaaauaacguucgauguuuaaucuacaacggua

SEQ ID NO: 509 - RNA, 115 nt, murid herpesvirus 4
aauuggucugggucauaucaucagaccagaggggccaguugacuggauugcugcuuuucacuaucugaggaggugcacauuuggcauucugcaugagauaaauccagauucaauu

SEQ ID NO: 510 - RNA, 109 nt, murid herpesvirus 4
acagagagggcaagaauugaauguugagcaggauauuaugcucauggggcuguuuauggcauauacucacaagcuugguucaauauuuaaucugaguacgcggcucugu

SEQ ID NO: 511 - RNA, 69 nt, murid herpesvirus 4
gaggguuaauugauggacuguuguaucuaaacuuuacaugugguauaacacacugcgauguuagcccuu

SEQ ID NO: 512 - RNA, 76 nt, murid herpesvirus 4
guucacuccagagaaaaggguaacaauuuuaucugaaaguguucaagcuuucguugugccuuuucuaagauuggac

SEQ ID NO: 513 - RNA, 92 nt, murid herpesvirus 4
uccccaagagagugcuuccauauuugagaucuguggcaagacuuacuagaguugucauagcuauggauagauauggaggucugcuuggagga

SEQ ID NO: 514 - RNA, 84 nt, murid herpesvirus 4
uacacccugaugauguacaccaccucuaagcucauagaugauccagaccuggcugaaaucaucaccagucggggacccaaugua

SEQ ID NO: 515 - RNA, 76 nt, murid herpesvirus 4
ucucguggguagcugacaggugccugaguacagaucucaucuguuacauccugcauaucaugcaugccccccggga

SEQ ID NO: 516 - RNA, 61 nt, Common chimpanzee papillomavirus 1
gccacauuggaccacagguggugccaccauuacagguaucacagacuaagggacaugaggc

SEQ ID NO: 517 - RNA, 76 nt, Equine herpesvirus 4
ccaugauguuguuuauaugaaaugcaauccaaaguuauuauuuggaaugugugaugagcgaucaaauauauuaugg

SEQ ID NO: 518 - RNA, 76 nt, Murine hepatitis virus
uggccccguaagaggcagucauagcuauggccguguugguccuaaggcuacauuggcugcugucuuuauuggucca

SEQ ID NO: 519 - RNA, 83 nt, Turnip vein-clearing virus
uagucucguacgaaccuaaggugagugauuuccucaaucuuucgaagaaggaagagaucuugccgaaggcucuaacgagguua

SEQ ID NO: 520 - RNA, 100 nt, Orgyia pseudotsugata single capsid nuclear polyhedrosis virus
ugccucgcgggcugcacgguuuucacgugcacgaauucggcgacaccagcaacggcugcacguccgcuggcgagcacuuuaaccccacccgccagagaca

SEQ ID NO: 521 - RNA, 87 nt, Hendra virus
gugggugagguauuggauaggggugauaaggugccaucaauguuuaugaccaauguuuggacaccacccaauccaagcaccauccau

SEQ ID NO: 522 - RNA, 84 nt, Ateline herpesvirus 3
cagguauagcauacgguaucgaaguuacauauauuuuucuuuuauuauauuauuguuuguugccauuuguauuugcuauguuug

SEQ ID NO: 523 - RNA, 102 nt, Ateline herpesvirus 3
ugguauagcuuugcggggccgcuucuguugacucuuauaugcuacacuaugucaugcuauaagauaguuaagacgaaguuguccagaaaagcagagauacua

SEQ ID NO: 524 - RNA, 71 nt, Ateline herpesvirus 3
gcuacuugauaugaauuuguacacuuuguggacccugcuaagaaacuauaaaacaaaacagcgaucacagc

SEQ ID NO: 525 - RNA, 130 nt, Bovine respiratory syncytial virus
auuccuuuugccacuguuauauguacuuauagacaugcuccaccuuacauaagaaaucauauaacagaucuuaauaagguugaugagcaaaguggacuguauagauaucauaugggugguauagaagguu

SEQ ID NO: 526 - RNA, 98 nt, Bovine respiratory syncytial virus
cauaaaauauauuuauagaagucuaaaagauuguaaugaucauaguuuaccaauugaguuucuaagauuauacaauggccauauaaguauagauuaug

SEQ ID NO: 527 - RNA, 69 nt, Bovine respiratory syncytial virus
ugguuagaucauauauuaaauuuucgaucucuagaguucagcuauaaucacuuauauaugauugaauca

SEQ ID NO: 528 - RNA, 130 nt, Melanoplus sanguinipes entomopoxvirus
gauauauguaauaaauguaacaaaauuaauuuuguucaugauggaguaugcggugaauguuaugcuaacaaaauuguauguaauggugauaauacaaaaucuacauguuauauaauuauuauaaaugauc

SEQ ID NO: 529 - RNA, 129 nt, Melanoplus sanguinipes entomopoxvirus
aguaucaugauaaauuacauugggaauauauaucacaauaucaagaauuaucagaagauauaauuuuacaauaucaugauaaauuacauugggaauauauagcuaaacaucaaauuuuaucagaauacu

SEQ ID NO: 530 - RNA, 58 nt, infectious spleen and kidney necrosis virus
accugccacuguguguauguguuuaaauaaacauauaacaugacauuuuuuggcuggu

SEQ ID NO: 531 - RNA, 86 nt, Melanoplus sanguinipes entomopoxvirus
auauaaauuagaugauucauuuccauuauuuacaacaaaaucaauguuuuggagaggaauuguugaagaauuauuaugguuuauau

SEQ ID NO: 532 - RNA, 108 nt, Peanut stunt virus
cugacacccgguuagcugagagagcuuccgccaugcuggaguauguugcguaugaacgucaauuacaucagaauguuauuucgaaucuucagcggauuugguguucag

SEQ ID NO: 533 - RNA, 97 nt, Peanut stunt virus
gauagcuaugagguguuacaaugauaagaagacauggcaagaccaauuuaaaaucauuuuaggugucuugucaucaaaaucuuccaccauaguuauc

SEQ ID NO: 534 - RNA, 85 nt, tomato leaf curl virus
gugucgguaagcgguuuuguguuaaguccguuuacauauuagggaagauauggauggacgagaacaucaagcucaagaaccacac

SEQ ID NO: 535 - RNA, 131 nt, Leishmania RNA virus 1-1
aucuuggcaacugcugcauugguucaucuuucugauccuggaaugacagugaaugacgucacauauccgacuacacucacuacaaaaguugcaucaguagauggccguaacagugacauagcagcacagau

SEQ ID NO: 536 - RNA, 131 nt, Leishmania RNA virus 2-1
acgcugagagugugaugcugcgacaauacggugcugacauagcugauaucauggcccagucaagcuggaugaaauccauggaggcaagcucacgagucaguccuucaaguaugcgcgucacguugucacgu

SEQ ID NO: 537 - RNA, 100 nt, Leishmania RNA virus 2-1
ggucauucacgagcacuagaacaugcacacccagaacugcgaacucgaaaagaaguccgagcguaucguaagugugugcucgagcaguggcggaauaacc

SEQ ID NO: 538 - RNA, 80 nt, Human adenovirus D
uuuguguuggacaauccugaggugcccgggcaaggcuguaaauccugccaguaccaccgggauaagaccggagacacgaa

SEQ ID NO: 539 - RNA, 107 nt, Bovine parainfluenza virus 3
auuccaucguuaguaaucaaucaucuaaucuaugcuuacaccucuaaucuuauuacccagggcugucaagauauagggaaaucuuaccaaguacuacaaauagggau

SEQ ID NO: 540 - RNA, 83 nt, Spodoptera exigua nucleopolyhedrovirus
augaaagcgaucuguguguuaucgggugacgugcauggucgagucauuuucgaacaacaaucacccgaccauuugcuccacau

SEQ ID NO: 541 - RNA, 88 nt, Spodoptera exigua nucleopolyhedrovirus
gagcgucacguaggcgaucuggguaacauugaagcgaaaaaaucaaacaguuugaccgaaaucgauaagaucgacaacgugaugaguc

SEQ ID NO: 542 - RNA, 62 nt, Spodoptera exigua nucleopolyhedrovirus
gcgacgacuugggucucggcggucauccauugagcaagaccaccggcaacucgggcggucgc

SEQ ID NO: 543 - RNA, 85 nt, Spodoptera exigua nucleopolyhedrovirus
gaucgccgucugcugaugugcgucgacgccgaaccguguagcguccacggcgucgacuauacguacauuacggacgacaucgguc

SEQ ID NO: 544 - RNA, 86 nt, Spodoptera exigua nucleopolyhedrovirus
ucuuuuaauucauuacgucuuugacggcaucaguuauagcgagaacacuaauguaauuaaaguaugcaaaguucgagugaaaaaga

SEQ ID NO: 545 - RNA, 100 nt, Fowlpox virus
ggugaaacuauuccuugauucugguauugauauuaauucuacaauaugugaaaacucgcauacugcacuauaucaugcuguagaacaagaaaacguuacc

SEQ ID NO: 546 - RNA, 112 nt, Fowlpox virus
auuuaccaaacugauaacguguuuaauuuauuauuacaaaaaggagcggauguaaacgcuaaaaacucugacgggaauacuauauuacacacuuuagcagcguguuguaaau

SEQ ID NO: 547 - RNA, 86 nt, Fowlpox virus
auagugauugguuaauaucuaugucaagcgguuauaauaacaaaguuuauauaccuucggauuauuucguuauacuaacauacugu

SEQ ID NO: 548 - RNA, 75 nt, Fowlpox virus
auaauuuacuagcuauuaucuguuuaguagaaaacuauaaccuuauagacuaugaaacaauaagcgauaaauuau

SEQ ID NO: 549 - RNA, 67 nt, Fowlpox virus
gaagcuauuauauaauauaaccgauaaacaaaaucacgguauauuaguuguaggagauguuaguuuu

SEQ ID NO: 550 - RNA, 106 nt, Fowlpox virus
guauuucagauuuuggguucgaaaaagauauaaacgauggaauucuagggauagcgcauuuacuagaacacauauuaauaucauucgauaacaaguauuuuaaugc

SEQ ID NO: 551 - RNA, 89 nt, Fowlpox virus
acuacgucuaaaguagauuacagacuaccuaaaguagaacauauuacuuacaaaggaaguuccuguaaugauaucacuguagaugaagu

SEQ ID NO: 552 - RNA, 72 nt, Fowlpox virus
gauguuagagaucgcuggguacuggaaaauccuuuugaaaggaacaguaaacaccggcaguuauuuacguuc

SEQ ID NO: 553 - RNA, 109 nt, Fowlpox virus
gacuuuagggacacaggcggugaaguauuacuuacuaaguacaaucaaagacagagcaguuugauguuuaauguagacacuaguacgaguaucguaaaaccuagacguc

SEQ ID NO: 554 - RNA, 65 nt, Fowlpox virus
gguaaguuacgcggcuuauaucaagcuuacaaagaguuguacgaauacaccgacgggacucuacc

SEQ ID NO: 555 - RNA, 73 nt, Fowlpox virus
gucuuugauggcagaaguuguaaccccuccuaauucauaucuuaauauuauuggaaauuucuccauuaaggau

SEQ ID NO: 556 - RNA, 128 nt, Fowlpox virus
ugauacggucauaaaaccuaacgaaauaucaggccaugcgaaguuuugcgccaauagacaguccaaccauugucacugguucgacgucauggugcuggaugauauuucauccugugaaaaucguguua

SEQ ID NO: 557 - RNA, 65 nt, Fowlpox virus
caaaaccguaauuucagugauauaguaauaaaaccuaauacuguucaaggacauucuaaauuuug

SEQ ID NO: 558 - RNA, 127 nt, Fowlpox virus
cauauuaacuuuguaucccaagcguacaacgagucuguuauauucauagacgaguucacggguagagaacgaguauuugaagacauggcaaaacuagggacuaugccuuggcggucuaggaaaugug

SEQ ID NO: 559 - RNA, 62 nt, Fowlpox virus
gaauugauguaugaauucgacaugaauauaaguacuauauuaaugagacauaacgucaguuc

SEQ ID NO: 560 - RNA, 90 nt, Fowlpox virus
gcuaaaaauauguauagaacguauaguucuaucguuuuaauuuuaauaccguguacgaugagagcuaacaugcuaauauauaauacuagc

SEQ ID NO: 561 - RNA, 60 nt, Fowlpox virus
guuuuuuauaacgguguggaaaacaccguguucaaucuacccguuuuaaaaguaaagaac

SEQ ID NO: 562 - RNA, 112 nt, Fowlpox virus
ucuaugacugaauggucuccuacucuucagaauuauucuuucaaaauagcaauuuucucguugaauaagcuaagaggguuuaagaaaagaguauuaguauucgagucaaaga

SEQ ID NO: 563 - RNA, 71 nt, Fowlpox virus
uccuguaagugcuuuaaagcgcgcuacauuuggcgauaacaaagccaucauuaacgcagcauuauacaaga

SEQ ID NO: 564 - RNA, 123 nt, Fowlpox virus
uggagaaccuauugauacaaaaauauauggaagaguacuacccuauuucuuacccgauucuaaggacccugaaggaaaggguuacauacucaauucucucauacaaggauugacggguuccca

SEQ ID NO: 565 - RNA, 100 nt, Fowlpox virus
guugauaaagauaccucuucuuauagguuacggaaauaaaaacccucuugauaauucuaaauuuguaucuccuaauauuauaggaggagucuuuauuaau

SEQ ID NO: 566 - RNA, 123 nt, Fowlpox virus
aucuuguuauuagauuuugacugucacauaaaaacuauagguaagaugauauacaacguagaaccuuuuuacuguaaaaaaacuaaauacuuauauguuggaggacagaaugaugaacaagau

SEQ ID NO: 567 - RNA, 87 nt, Fowlpox virus
uucuuacguauauaugauuuauguuucuaugaucauagaguacuuuaaaguauaucauaacuacauauuuccuacacuuugugagaa

SEQ ID NO: 568 - RNA, 101 nt, Fowlpox virus
ccuucuaaugcaauacaaagccgaugccucuauacgugacaguaaaggaauuacuccauucuguuaugccauguaucuaggauauuacggcguuaauaagg

SEQ ID NO: 569 - RNA, 64 nt, Fowlpox virus
ucccuuguuaacagcuaucaaaauaggaucacacgauauaguaaaacugcuguugauuaacgga

SEQ ID NO: 570 - RNA, 124 nt, Fowlpox virus
auauccaagaaguuuucaucuauaauagguauguauucuccuaauacagauaguaucaacuuuucuaaaguaaaccauaccaucaguauuacggaugcuucuauaccuguuagcuucuggguau

SEQ ID NO: 571 - RNA, 74 nt, Gallid herpesvirus 2
ggauguuuaaggagauccucgcaggucgauuaggauauacugauggccaggguauauauaacuccguaagaucu

SEQ ID NO: 572 - RNA, 96 nt, Gallid herpesvirus 2
ucagggucaugagguuucaauuuccuacucgaacagugcgauaacuuuacuacucgcuccuuacuuuuuuuccguauugaauauuuaugauauugg

SEQ ID NO: 573 - RNA, 61 nt, Gallid herpesvirus 2
uguuaagguagcagaaaauguuuuuguaacauggcgcaaaacucugcaaacuacauugaua

SEQ ID NO: 574 - RNA, 87 nt, Gallid herpesvirus 2
gguaacuuauauaugugacgaacauaugaagcauguaacagauuauacaaaugcgacaucauguuccuguuauguauugaacaagcc

SEQ ID NO: 575 - RNA, 63 nt, Gallid herpesvirus 2
ugcguguggcgaauuccauaauauuucaagaauaugacgagauggaaugugcagcccaucgca

SEQ ID NO: 576 - RNA, 93 nt, Gallid herpesvirus 2
uugcaauuccggugcccagacgacaucagacagugaugccugccauaggcauauuacauaacugcugcgauaguuuggguauuuauucugcga

SEQ ID NO: 577 - RNA, 77 nt, Gallid herpesvirus 2
gaaagagguacgguagaucaaaugcuuagaauucuacuagagaaagcuccaccagcuccucuacugauaccgcuuuc

SEQ ID NO: 578 - RNA, 74 nt, Gallid herpesvirus 2
ggggugcaguuuucucuuacacaaccccgggccaacguugaccuggguguaggauauacagccacguguacucc

SEQ ID NO: 579 - RNA, 73 nt, Gallid herpesvirus 2
uagagagcgcauucccaguggaauaugugaugcguaugaugaaugacugggccaaaggcgaauguaauccuua

SEQ ID NO: 580 - RNA, 72 nt, Northern cereal mosaic virus
acuuggcagacggaucuuacaaccccaaguucgacagugaccuacaauggguugaugauaaaucugguaagu

SEQ ID NO: 581 - RNA, 73 nt, Northern cereal mosaic virus
ugaggugaaugucagacugugucaugacauacuuggggcgacucuguauggauacucugaaucaaucucuuca

SEQ ID NO: 582 - RNA, 121 nt, Northern cereal mosaic virus
ugauguauuaccaaucuggaacaacccguaucuugcacaaauuugacuucaaggaauuuucugagauagcugaauugauucaauguaugaggcauugcuucucggauugggugauauuuca

SEQ ID NO: 583 - RNA, 70 nt, Transmissible gastroenteritis virus
cuaacaaccuuucugcaccuaagaacgcauaugacgcuaugauucuuagugcuaaauugauugguguugg

SEQ ID NO: 584 - RNA, 99 nt, Transmissible gastroenteritis virus
gaaucugcugaaggcuaugacuacaugguuauuaagaauggaauuguucaaccuuuugacgauaccauuucauguguucauaacacuuauaaaggauuc

SEQ ID NO: 585 - RNA, 105 nt, Transmissible gastroenteritis virus
gcuugaagucuuuaaauauuugcugguuuuauuuaugugucuuagaaguacuaagaugccuaaaguuaaagucaaaccaccucuugcauuuaaagauuuuggugc

SEQ ID NO: 586 - RNA, 65 nt, Transmissible gastroenteritis virus
gucaugaugcuuauaaauuugaaguuguuacacauagcaauuucauugugcauaagcagacugac

SEQ ID NO: 587 - RNA, 104 nt, Transmissible gastroenteritis virus
guugagaauacuaacacuauguuuuugccuguugacaugcaaggugucaugcucacaguguuuugcuuuauugucuuuguuacauauaguguuagauucuucac

SEQ ID NO: 588 - RNA, 82 nt, Transmissible gastroenteritis virus
uacaaaggauuggaugguugucauugcaucauacagaauugcauauuauauuguuguauguguaaugccaucugcuuuugua

SEQ ID NO: 589 - RNA, 89 nt, Transmissible gastroenteritis virus
ugauauuauaccuauugaacuugaagcuccauugcguuucuauguugacggcgcuaaugguccugaagucaaguauuuguauuuuguca

SEQ ID NO: 590 - RNA, 108 nt, Transmissible gastroenteritis virus
ugguuaggagaugaagucauuugcccuagacauguuauugcuagugauaccacacguguuaucaacuaugaaaaugaaaugucuagugugagacuucacaacuuuuca

SEQ ID NO: 591 - RNA, 116 nt, Transmissible gastroenteritis virus
uucuuggaaccugauguuauuguuaaugcugcuaauggugaucuuaaacacauggguggugucgcaagagccaucgauguuuucacugguggcaaauuaacagaacguucuaagga

SEQ ID NO: 592 - RNA, 70 nt, Transmissible gastroenteritis virus
uuuuauuuguuugucaguauaccaguagugcauaaauuaacauguaacggugcuguacaggcauauaaaa

SEQ ID NO: 593 - RNA, 85 nt, Rice grassy stunt virus
acuuugagcuaucuucaguauuagguggauaucuagguaguuuagaugaugacauagaucuaccuagcaugauugagcugaaggu

SEQ ID NO: 594 - RNA, 103 nt, Rice grassy stunt virus
augaaacugagggaugaagcuaaauacuguaggagagacauuauggagaagauaagaauugguaaucuaggucuacuagguggcuacguccaaaagcaaucau

SEQ ID NO: 595 - RNA, 112 nt, Rice grassy stunt virus
ggucagaauccugaacuuacuaagaagcagaaacauuuuuuauuggacucugaaggaaaccuauggggugcuguaaaaagugguuugccagugacaguucucagagaugacc

SEQ ID NO: 596 - RNA, 77 nt, Rice grassy stunt virus
uguuauuauagauugcauggagucaucagaugauagcucaaugaugauaucauucucaacuaaaucuaugaaugaca

SEQ ID NO: 597 - RNA, 67 nt, Xestia c-nigrum granulovirus
caguauagugugcacguauaacgucugcaacgauaugcaaaaaacagucggcacgcugcaagagcug

SEQ ID NO: 598 - RNA, 93 nt, Xestia c-nigrum granulovirus
cgcacgacgauuacggugauauggcgccugguaccacgcuuguuuacgaagcugaaaaagguuacucauaucgaccgucgucgucguucagug

SEQ ID NO: 599 - RNA, 75 nt, Xestia c-nigrum granulovirus
ccaaaaugcacgaguguguacgcgucaacgaaggguuuguguccuuggaugucacguucgugcgauucuacuugg

SEQ ID NO: 600 - RNA, 117 nt, Xestia c-nigrum granulovirus
ugcguaaauuuguacaacuguccgacuacacaaaagugcuaaaauuugucgaaaacugccuaugggaacgagguuacgaagauuuuuacacguugggucaacaauugagcauacgua

SEQ ID NO: 601 - RNA, 79 nt, Xestia c-nigrum granulovirus
auguaaugguggcggguguaaaagcgggguuggccaaagaaaaaaugcguagucgacuguguuacgaguaccagugcau

SEQ ID NO: 602 - RNA, 130 nt, Xestia c-nigrum granulovirus
ggguuaauaauaguuuuuacagugacgacagauuauuguacaaauugugcgaggagugugugauaaauuugugucucacaaccaaguucacuuuguacacuguaaaacaaugugucaaggcuugugaucu

SEQ ID NO: 603 - RNA, 98 nt, Xestia c-nigrum granulovirus
gccaggaagaguuaauuuuuagagauaaauuaaaguauugcguugguacucgaguaaugauaacacacaaucuuaaaggacuggcuuuuugcaauggc

SEQ ID NO: 604 - RNA, 65 nt, rabbit oral papillomavirus
agguuuuuagaggagguaccgauacccagacauaugcaaguguuuguugggaacuucuuuggcuu

SEQ ID NO: 605 - RNA, 129 nt, Hepatitis GB virus C
aagguucugagcgaccucaagcucccuggucuagccguccaccgcaagaaggccggggcauugcgaacacgcaugcuccggucgcgcgguugggcggaguuggcuaggggccuguuguggcauccagga

SEQ ID NO: 606 - RNA, 76 nt, Hepatitis GB virus C
acgucaugguuuuggggacggcuaccucgcgcagcaugggaacgugcuuaaacggguugcuguucacgacauucca

SEQ ID NO: 607 - RNA, 129 nt, Hepatitis GB virus C
aguccgccgcccaguuggugggggaacucgguagucucuacgggcccuugucggucucggcuuauguggccgggauccuggggcuuggggaggucuacucggggguccucaccgucgggguggcguuga

SEQ ID NO: 608 - RNA, 106 nt, Hepatitis GB virus C
caaggucucggcaaucgugcgccgccugagccuuacucgcaccgugguggcccuggucaacagggagccuaagguggaugagguccaggugggguacgucugggau

SEQ ID NO: 609 - RNA, 96 nt, Hepatitis GB virus C
gcggccugccucguguggcaccugugugagggacugcuggcccgagaccgggucgguacguuucccauuccacagguguggcgcgggaccgaggcu

SEQ ID NO: 610 - RNA, 60 nt, Hepatitis GB virus C
ggcccgaauccugucccacuacugcugagguggggcaaugauuugccaucaaaaguggcc

SEQ ID NO: 611 - RNA, 118 nt, Hepatitis GB virus C
ggucuacgguccgggccaaaguguuaccauugauggggagcgcuacacccuuccgcaccaguugcggaugcggaauguggcgcccucugagguuucaucugaggucagcaucgagauc

SEQ ID NO: 612 - RNA, 129 nt, Hepatitis GB virus C
ucccaccggaacguuuggguucuucccaggaguccccccccuuaacaacugcaugcuucucggcacugaggugucagagguauuggguggggcgggccucacugggggguuuuacgaaccucuggugcg

SEQ ID NO: 613 - RNA, 131 nt, Hepatitis GB virus C
ucuugguuugcuuccacugggggucgcgacuccaagguugauguguggaguuugguuccaguuggcucugccagcugcaccauagccgcacugggaucuucggaucgcgacacagugguugagcucuccga

SEQ ID NO: 614 - RNA, 113 nt, Hepatitis GB virus C
ugucgcaucauacgagacgccgccaggacccugagcugcggccaaugcgucaugggcuugcccgugguggcuaggcgcggcgaugagguccugauuggggucuuucaggaugu

SEQ ID NO: 615 - RNA, 125 nt, Hepatitis GB virus C
uuauuuccacagagcgaugccacacgaaagcuaacgguuaagaugucuugcuguguugagaagagcguaacacgcuucuuuucuuuaggguugaccguggcugacguggcuagccugugugagau

SEQ ID NO: 616 - RNA, 125 nt, Hepatitis GB virus C
uuuuaugggcaugguaucccccucgagcguaugaggacuggucgccaccuuguauucugccauuccaaggcggagugcgagagauuggccggccaguucuccgcgcgggggguuaaugccaucgc

SEQ ID NO: 617 - RNA, 79 nt, Ovine astrovirus
aucuuuuguuaguggccguuacagaggguguccguguggaggaccacaugacauacucuguggccacucguaacgggau

SEQ ID NO: 618 - RNA, 107 nt, Ovine astrovirus
guugguucggacgaugcagucaagauuagguggggugcccaagaagacauggcacgugucacauauaggcaucccacuaaggauauugcauugauggccuugccaac

SEQ ID NO: 619 - RNA, 86 nt, Turkey astrovirus
acuaagguaucacaugcagcuauuuugacagaauuggauaggaugagaacuaaaguugaggagguggcgcuugugucugcuagagu

SEQ ID NO: 620 - RNA, 78 nt, Turkey astrovirus
ucaaaagugagucaacacaagugaaaguuaaagucaagcguguuauugacuuguuugaauguguggacacacuggugg

SEQ ID NO: 621 - RNA, 118 nt, Cherry mottle leaf virus
uaucccuacauagccugcuugaguauuaaagcaaauaaaaugagcaaaauggaaagaaugggagcucauaguguuaagaauuaugauauauuuaacaggcuuguaacuucaagggaua

SEQ ID NO: 622 - RNA, 101 nt, Cherry mottle leaf virus
uguucagagugcaauuugcuccauucagaaaacuggaauugauguggagauaauauugguugcuagcaugauagagaaagagcuauauugcaauuugggca

SEQ ID NO: 623 - RNA, 73 nt, Frog adenovirus 1
cgcggaagcguacggcuugaagacaaccaaaggaaauuguccuuuuaaagcuguaacagaauuuuauuccgug

SEQ ID NO: 624 - RNA, 102 nt, Turnip mosaic virus
acuuccagaacuccaucaauuacuuugcugcuuucccagaugauuuugccgagaaguaucuucauaccauugaagcacacgagugggucaagcacuggaagu

SEQ ID NO: 625 - RNA, 73 nt, Turnip mosaic virus
cuugguaauguaacgguaaagcaggcacgaacaaugucuguauuugagauaacaccguucuacacaagccaag

SEQ ID NO: 626 - RNA, 81 nt, Turnip mosaic virus
gacaugagcuuagcucgauacgcauuugauuucuaugaaaugacuucuaggacuccaauacgugcgagagaggcacacauc

SEQ ID NO: 627 - RNA, 67 nt, Rat cytomegalovirus
gaucauggacgaguaccgggacccggacaucgacgcccaagaugcgauccugccgccgccgaagauc

SEQ ID NO: 628 - RNA, 81 nt, Rat cytomegalovirus
cgccacgguggcggacaacggccuguucacgcucaacuucguggacgaggacgcggugaaggucuuccagcugccgcggug

SEQ ID NO: 629 - RNA, 71 nt, Rat cytomegalovirus
gguccaggaccuguuccagaucuucccgaugcacguguaccgcaacgaggagaucgacgcguggguccgcc

SEQ ID NO: 630 - RNA, 97 nt, Parvovirus H1
cagagaguuugaaaccaaggcgggaaacggaagugggcguggcuaacuguauauaagcagucacucuggucgguuacucacucugcuuucauuucug

SEQ ID NO: 631 - RNA, 118 nt, Parvovirus H1
cauuuuuagaacugaccaaccauguucacgcaagugacgugaugacgcgcgcugcgcgcgcugccuucggcagucacacgucacuagcguuucacaugguuggucaguucuaaaaaug

SEQ ID NO: 632 - RNA, 86 nt, Lactate dehydrogenase-elevating virus
uccagacccaguucuccugcaucagugagcccggcuagcaguguugaucucagcgcugcuggcuuguugcugagcgguacugaguc

SEQ ID NO: 633 - RNA, 116 nt, acute bee paralysis virus
agacuuuucuaagcauguaaguauaguuucuuauggagaugauaauguuauuaacuuuagugaugaaguuagugaaugguucaacauggaaacuauuacugaagcuuuugagaagu

SEQ ID NO: 634 - RNA, 78 nt, acute bee paralysis virus
agcuauuuguggaaaugauucaagugaauuuauaucagcaauaaauagaucuaguucaccggguuucccauggauacg

SEQ ID NO: 635 - RNA, 111 nt, acute bee paralysis virus
gguggauacauuaaaggaugagagaagaccaauugaaaaaguagaucaacugaaaacacguguguuuucuaaugggccuauggacuuuucuaucacuuuuagaauguacua

SEQ ID NO: 636 - RNA, 87 nt, Saimiriine herpesvirus 2
auaaaaguuuaaguaagauacuuauuuucuaguagcuaguacguugcuugcucauuuuucuaauaguguuuauucuaaaacuuauau

SEQ ID NO: 637 - RNA, 77 nt, Meleagrid herpesvirus 1
gcaacuuaauuacugucaccucauuauaaauucucgaucggucgggcgguuuauggcaagcauagauaaguauuugc

SEQ ID NO: 638 - RNA, 94 nt, Meleagrid herpesvirus 1
accgcgacaagaauagauuuugugaucuuuugcgccccaugggcacaauugugaccaugcuggggaucacagaaugugguaaacgaguggcggu

SEQ ID NO: 639 - RNA, 76 nt, Meleagrid herpesvirus 1
ugaaauuggauggauauggcaucguuaaucaaaaagggauguucaggguuugggaugcaggugccaaucaguuuca

SEQ ID NO: 640 - RNA, 126 nt, Meleagrid herpesvirus 1
cagucucggugcugaaggaagcaauagcagauauuaauacggucgaugagacgauaucucaacaggauauagucuuaucuacugaacgcgcggauauguuuucauucuuacacgcauuauugacug

SEQ ID NO: 641 - RNA, 82 nt, Meleagrid herpesvirus 1
ggauaugaaagagacgucuaaauuuaaaaucguacacaccgaacagcuggaacguaugaccagauuacuuucuucccugucc

SEQ ID NO: 642 - RNA, 60 nt, Meleagrid herpesvirus 1
uaauggauguguuuaccaaauuguuuaauuacauaauagagaauggugcacagacuguua

SEQ ID NO: 643 - RNA, 67 nt, Meleagrid herpesvirus 1
uuauggacaucuuccguuacuucaguguuggucaaugcugaaauaaaaucggaauuugaugccguaa

SEQ ID NO: 644 - RNA, 87 nt, Meleagrid herpesvirus 1
ccugugugauaguuuguuggaggaggccaguauguuuagcgaugccgcugcaagauucuucucugaucugggagcugauuaugcggg

SEQ ID NO: 645 - RNA, 92 nt, Meleagrid herpesvirus 1
gcggauauaauggcugcuauuagggacucguauaauucgucaaacgcuauguuggcugauaugaggcucaaagugguaacguuuagaaccgu

SEQ ID NO: 646 - RNA, 61 nt, Meleagrid herpesvirus 1
guggaugucgauaauagcgaaauggauaugguacacauagcuauaaauauucgauauccac

SEQ ID NO: 647 - RNA, 53 nt, Heliothis zea virus 1 (HZV-1)
acucuuguacaccauuccauuuauacuaaauguacccguuauuuuacaagugu

SEQ ID NO: 648 - RNA, 87 nt, Vaccinia virus
gcugaaguaauuaauuuuucugccucguuuuuacuacaacuaguuuucaucaauguagugacgauguauuguuuaguuacucuuggu

SEQ ID NO: 649 - RNA, 62 nt, Rachiplusia ou multiple nucleopolyhedrovirus
acgaguuaaaaagggucauauuuaaauuuaguugaguuuaugagauaagauuaaaagcacgu

SEQ ID NO: 650 - RNA, 130 nt, Rachiplusia ou multiple nucleopolyhedrovirus
cgaguucgguuuugaaaaacaaaugaugucauucuugaucauguuuuacgagcagaauucuacccguaaagcgaguucagguuuaaaaacaaaugacaucauuuauauaaugacaucaucucugaucgcg

SEQ ID NO: 651 - RNA, 53 nt, Rachiplusia ou multiple nucleopolyhedrovirus
uaugacucaaguuaugagccgugugcaaaacaugacauagccuaugagucaua

SEQ ID NO: 652 - RNA, 74 nt, Yaba-like disease virus
uggauaacguaauagaaauacuaucuguaauaaaggauucucagaauacaauagcuuuuuuagauauguuacca

SEQ ID NO: 653 - RNA, 130 nt, Fowlpox virus
uuacagcguuagguguuauagucuuaauauuuguaguaccuauauuacuauaauuguuuaaauagauuaacuauuguuacggguauaugauauaucuacuauaauuaguauguuauaaaaaauaaaaaca

SEQ ID NO: 654 - RNA, 109 nt, Fowlpox virus
ggugauaagucuuauauagcaauauagaaguaaacauaggcaaaacaaguauucuaauagauauuuugcuaacuauguaguacaauauaaguauauuaauuuuguuacc

SEQ ID NO: 655 - RNA, 84 nt, Yaba-like disease virus
cgcaaaauaugccuagugcucuggugucguuauauccguucgauaccgaauauauaaugauagugcuuuuuuuugguauaugug

SEQ ID NO: 656 - RNA, 96 nt, Yaba-like disease virus
ccgauaauguagaaaauauaacguaugauuuaccucaggauaguauaauuuacgauuuagauggaaaaucagauguugcuguuuaugauauuccgg

SEQ ID NO: 657 - RNA, 87 nt, Yaba-like disease virus
gaguguauaaaaguaaaacaacugaacaaauacauggaguuuuuauacaucaaaaaauuuuaugggauguuuuaacuuggauaucuc

SEQ ID NO: 658 - RNA, 62 nt, Yaba-like disease virus
uauaugucaaaauuacgacauuuuacacggagaguguuuuaaagucguuuuaaugucaaaua

SEQ ID NO: 659 - RNA, 131 nt, Human coronavirus 229E
aaaagccaaaccaccguuaaaccguaauucuguuuuuacaugcuuccaaauuacaaaagacuccaaguuucaaguuggugaguuuguguuugagaaaguagauuacgguucugauacgguuacuuacaaau

SEQ ID NO: 660 - RNA, 130 nt, Human coronavirus 229E
aguuaugacuacguuaguuugcugguuaugcuacuuugugcaauuucuaaugaaugguauauuggugcuauuauuuuuagaauuugucguuuugguguugcauuuuuaccaguggaauacgugucuuacu

SEQ ID NO: 661 - RNA, 112 nt, Human coronavirus 229E
caaccauggacgguuuuugucaguacaaaggcaaguggguacaagugccuauagguacaaaugacccuauaagauuuugucuugaaaauacuguuuguaaaguuugugguug

SEQ ID NO: 662 - RNA, 60 nt, Human coronavirus 229E
caagacuucaaaacuuuugauuuguugaaauaugauuucacagaacauaaggagguuuug

SEQ ID NO: 663 - RNA, 129 nt, Human coronavirus 229E
caccaauuaaaaauacaguugauacaacaccuaaggaagaauuuguuguuaaagagaaguugaacgccuuccucguucaugacaauguagcuuucuaccaaggugauguugauacuguuguuaauggug

SEQ ID NO: 664 - RNA, 91 nt, Human coronavirus 229E
cagacaucagauacugcucaugccuguaaugccaaucguuuuaacguugccauuacuagagcaaagaaagguauuuucuguauuaugucug

SEQ ID NO: 665 - RNA, 90 nt, Human coronavirus 229E
caggugaacuugugagauuuguuaagucuauuugcaauucagcuguugcugucgugggugguacuauacaaauucucgcuagugugccug

SEQ ID NO: 666 - RNA, 105 nt, Human coronavirus 229E
ccugauggccgauguugaugauccuaaauugaugggaugggacuauccuaagugugauagagcuaugcccucaaugauucguauguugucggcuaugaucuuagg

SEQ ID NO: 667 - RNA, 108 nt, Human coronavirus 229E
gacaucuuguacacaccuccgacugucaguuaugguucuacauuacaggcugguuugcgcaaaauggcacaaccaucuggcuuuguggagaaauguguuguccguguc

SEQ ID NO: 668 - RNA, 124 nt, Human coronavirus 229E
gauguacuacguaauagcuuugguaaagaucuuaaugcuaauaugucuuuagccgagugcaagagagcuuuaggccugucuauuagugaucaugaauuuacuagugcuauuucuaaugcacauc

SEQ ID NO: 669 - RNA, 72 nt, Human coronavirus 229E
gauguuucaaaaacuacucuaggcgguuuacacuuguugauuucacaaguacgucugaguaaaaugggcauc

SEQ ID NO: 670 - RNA, 64 nt, Human coronavirus 229E
gcagaggauguuuguacuuguuacgauaauaguauacaagguucauacgaacguuuuacucugu

SEQ ID NO: 671 - RNA, 131 nt, Human coronavirus 229E
ggaguuucugaaauuguuaauacugucgcuggcauuccaucuaauguguaucuuguugguaaaacuuuaauuuuuacacuacaagcugcuuuugguaaugcugguguuuguuaugacauuuuuggagucac

SEQ ID NO: 672 - RNA, 87 nt, Human coronavirus 229E
gguggcgucucuuuauuagcuacuaugacuacaagacaguuucaucagaaaugucugaaauccauaguagcuaccagaaaugccacc

SEQ ID NO: 673 - RNA, 117 nt, Human coronavirus 229E
gucuuuaauauauuucaggcuguaaguucuaacauuaauugcguuuugagcguuaacucgucaaauugcaauaauuuuaauguuaagaaguuacagagacaacuuuaugauaauugc

SEQ ID NO: 674 - RNA, 94 nt, Human coronavirus 229E
gugaaacauuuuggcguuacaacuuugauauaacugaaagcaaguauucuugcaaagagguuuuuaaaaauuguaauguuuuggaugauuucau

SEQ ID NO: 675 - RNA, 64 nt, Human coronavirus 229E
gugguaagaguuugccggcuauuaaauugaauuuuggaaugcuuaaugguaaugcaauugcuac

SEQ ID NO: 676 - RNA, 106 nt, Human coronavirus 229E
gugucgaacagcuugaaccgugugcucagucuagacuuuugagugguguugcuuauacugcuuuuucuggaccuguugacaaaggucauuauacuguuuaugauac

SEQ ID NO: 677 - RNA, 118 nt, Human coronavirus 229E
guuacaacagaccuacuaugcuggauauuggacaagcucgcguagcauaucaaguggcagcucgcuauuuugacuguuacgaggguggcuguauuacaucuagagagguuguuguuac

SEQ ID NO: 678 - RNA, 119 nt, Human coronavirus 229E
guuaccaagaguuaagucaauuuagccauuuggauguuguguggaagcauauaacagacccuuuguuuaguaauaugcaaccuuucauugucaugguuuugcugcuuauauuuggugac

SEQ ID NO: 679 - RNA, 130 nt, Human coronavirus 229E
uaugcuuacuuuggaugaccgugguuuagcucuagacaaugcacuuaguggugugcuuagugcugcuauuaaggauuguguugacauaaauaaagcuauaccuucugguaaucuuauuaaguuugauaua

SEQ ID NO: 680 - RNA, 98 nt, Human coronavirus 229E
uccgugguucauuuauuaauggugcgugugguuccccuggcuacaaucuuaaaaauggcgagguggaauuuguuuauaugcaucaaauugaacucgga

SEQ ID NO: 681 - RNA, 100 nt, Human coronavirus 229E
ugcuuacaugccaauugcagacccuacacauuuugacauugaagaaguugaacuuuuagaugcagaguuuguagaaccaggcuguggugguauuuuggca

SEQ ID NO: 682 - RNA, 60 nt, Human coronavirus 229E
ugggaauacccuacugcacgucauacuauucuuauaugaugccuguuauggguaugacua

SEQ ID NO: 683 - RNA, 73 nt, Human coronavirus 229E
uguuuuguuuguuaaugacaaaauuacugaauuccaauuggauuacaguauugaugucauugauaaugaaaua

SEQ ID NO: 684 - RNA, 103 nt, Human coronavirus 229E
uuaaugcguuaccugaaguuaaugcagacauuguugucguggaugaggugucuaugugcacuaacuaugacuugucugugauuaaccagcguauaucauauaa

SEQ ID NO: 685 - RNA, 81 nt, Human coronavirus 229E
uuucauuuucugaugacguugaaguaaaagacauugaaccuguuuacagagucaagcuuugcuuugaguuugaagaugaaa

SEQ ID NO: 686 - RNA, 96 nt, Human coronavirus 229E
uuuuauggcuuuaaagaugcuguuacuuuugcaacaguugaucauagugcuuuugccuaugaaagugcuguuguuaaugguauuagaguguuaaaa

SEQ ID NO: 687 - RNA, 131 nt, Human coronavirus 229E
acaguucgugaguuuguuauuucacgcacaggacauuuuuauauuaauggcuaucgcuauuucacuuuagguaauguagaagccguuaauuucaaugucacuacugcagaaaccacugauuuuuguacugu

SEQ ID NO: 688 - RNA, 85 nt, Human coronavirus 229E
auuauguugcauugcagacugauguuuuacaagaaaaucagaaaauucuugcugcaucuuuuaacaaagcaaugaccaacauagu

SEQ ID NO: 689 - RNA, 64 nt, Human coronavirus 229E
cugcagauguuagugagaugcucacuuuugacaagaaagcguuuacacuugcuaauguuaguag

SEQ ID NO: 690 - RNA, 116 nt, Human coronavirus 229E
gaaacuaaagggccuuuguguguugacacaucacacuucacuaccaaauacguugcuguuuaugccaauguugguagguggagugcuaguauuaacacgggaaauugcccuuuuuc

SEQ ID NO: 691 - RNA, 108 nt, Human coronavirus 229E
gugcguugaugguacaaacgguuauguguugcgacaaccuaaucuugcucuuuacaaagaaggcaauuauuauagaaucacaucucgcauaauguuugaaccacguau

SEQ ID NO: 692 - RNA, 131 nt, Human coronavirus 229E
uggcagauuuuguucaaauugaaaauugcaaugucacauuuguuaacauuucucgcucugaguugcaaaccauugugccagaguauauugauguuaauaagacgcugcaagaauuaaguuacaaauugcca

SEQ ID NO: 693 - RNA, 82 nt, Invertebrate iridescent virus 6
ggcaccaaauugauuuguugauaacaaaguuacagauggaauucucacucuuagccaaguauauaacaaauaaucuccggcc

SEQ ID NO: 694 - RNA, 58 nt, Potato virus V
uuggaauuaaugggguggcuuagcgaaacacucgcugagguaaacucauugauuucaa

SEQ ID NO: 695 - RNA, 126 nt, Helicoverpa armigera nuclear polyhedrosis virus
gugucugaagcguaugcgaaaaucauuaauugucaagugcccucugugcagaucgaucaauauuaaauauucguauuacuguaucagcggcaauacagugaauguugucaguacgaugucgagcac

SEQ ID NO: 696 - RNA, 131 nt, pestivirus type 2
aucauagaugaaauagcaggagggaccaacuucaucucaagacuuguagccgcuuugaucgaagccaauugggccuuugacaacgaagaaguuagggguuuaaagaaguucuuccuguugucuaguagggu

SEQ ID NO: 697 - RNA, 66 nt, pestivirus type 2
cgagcgcugagggauuuaaccagggucuggaauagcgcaucaaccacggcauuccucaucugcuug

SEQ ID NO: 698 - RNA, 112 nt, pestivirus type 2
uuccgugacauuugagcuccuguucgacgggaccaacccaucaacugaggaaaugggagaugacuucggguucgggcugugcccguucgauacgaguccuguugucaaggga

SEQ ID NO: 699 - RNA, 73 nt, Bovine herpesvirus 4
ggcuuugacuccaucaagaaacaucagcagauuuaucaugcucucagaucaaaaauggaaugucucaauggcu

SEQ ID NO: 700 - RNA, 67 nt, Bovine herpesvirus 4
gucugauuauagcaucauaugugaaucaucaauuuauagcaugagaacugaaaauaaaucaucagac

SEQ ID NO: 701 - RNA, 95 nt, Cercopithecine herpesvirus 7
aauugaggcauuagaacaugcuauaaguuuaauucguaacaaacuugauacuauucaauuacccgacuugucgucugaaauucaaaaacucaauu

SEQ ID NO: 702 - RNA, 61 nt, Cercopithecine herpesvirus 7
caggcauuggaaguuacaaccaauuugaugagcaacuugguccugcguccggaguuuccug

SEQ ID NO: 703 - RNA, 88 nt, Cercopithecine herpesvirus 7
gaaauauuuuaaggcccguggcagauuuugucggacuuagaucuucaguagacauauuuccggagauuuguguugaacuuaauauuuc

SEQ ID NO: 704 - RNA, 121 nt, Cercopithecine herpesvirus 7
gaauugaugcauuguauucguuaagaguuaaguuagauguacuugagaagcgcauugaagccgcugaaauaucuugggauacggcauggcaauccuuuaaacaaaauacagguguuaauuc

SEQ ID NO: 705 - RNA, 113 nt, Ectocarpus siliculosus virus
gcgauggcacgggaccacucgauagguauuuuguuguguacagcguauucccucuucgcauauucgaggugcgcaacggagccgaguguacggaaguccagagcgugcugcgc

SEQ ID NO: 706 - RNA, 79 nt, Ectocarpus siliculosus virus
guucuuggaguacauucuccguccgguggagucgugggacaagcauaacuacgucguagacgugaacuacuuugagaac

SEQ ID NO: 707 - RNA, 108 nt, Tomato mosaic virus
aaagauggaagaaacugaggaaauguacaaugcacuguccgaacugucuguacuuaaaaauucagacaaguucgauguugauguuuuuucccagaugugccaaucuuu

SEQ ID NO: 708 - RNA, 90 nt, Tomato mosaic virus
accggaaacugaucaaaauuacggagaaugcguuagagaucagggugcccgaucuuuaugucacuuuccaugauagguuaguuucugagu

SEQ ID NO: 709 - RNA, 130 nt, Tomato mosaic virus
cagcaaaggugguuuugguggauggcguuccagggugcgggaagacaaaggaaauucuuucgagaguuaauuucgaagaagaucuaauucuugucccuggucgucaagcugccgagaugaucagaagaag

SEQ ID NO: 710 - RNA, 79 nt, Tomato mosaic virus
cuaaaguacuacaccguugugauggauccuuuaguuaguaucauuagagauuuagaacggguuaguaguuacuuauuag

SEQ ID NO: 711 - RNA, 130 nt, Tomato mosaic virus
guuacaacuuuuaucgguaauaccgucaucauugcuucgugucuugcaucaaugcucccgauggaaaaauugauaaaaggagccuucugcggagaugacaguuuguuguacuuuccuaaggguugugagu

SEQ ID NO: 712 - RNA, 71 nt, Tomato mosaic virus
aaguacuacaccguugugauggauccuuuaguuaguaucauuagagauuuagaacggguuaguaguuacuu

SEQ ID NO: 713 - RNA, 63 nt, Aconitum latent virus
auagcguuagagcugggaugcuugcugauaccuuucauaaagcucaaaccggcguauugcagu

SEQ ID NO: 714 - RNA, 99 nt, Aconitum latent virus
uggaguugguauucaaagcuuuugacauugaagcauauguuacugaaaaugaugauaccagaguguacaaugcuucggguacgcuucggaaaaacuuca

SEQ ID NO: 715 - RNA, 84 nt, Cydia pomonella granulovirus
gcgagcgauauugucauuaugaugauuaagcggagcggucaacugcagaacguguuaaacaauauaguggcgcuguccgagugu

SEQ ID NO: 716 - RNA, 121 nt, Cydia pomonella granulovirus
guauaacaaguugaggcagcaguguaaugugugguccgauuugcuaauugugcaccagcccggcgagaauauguacgauuggcucacucgcuucuacauucgcuccuuccucaacgauuac

SEQ ID NO: 717 - RNA, 103 nt, Cydia pomonella granulovirus
guguguauucgcacgagaaaaagugguuugaguacauggugaagacggagacgauaagccggugugacuuuuugcccgaguaccaguuuuugugcgaccacau

SEQ ID NO: 718 - RNA, 62 nt, Cydia pomonella granulovirus
uaagauauugguugacggauaugacagggcgugcagcaaucguauaggacaaauguauuuug

SEQ ID NO: 719 - RNA, 64 nt, Barley yellow mosaic virus
agcucaaaaguguacccaagucuguuauggagcauaacaacucaguugcacucgaaucugagcu

SEQ ID NO: 720 - RNA, 80 nt, Barley yellow mosaic virus
agucggggucgacgucgcaacucgaguuggaagaauuagcauugguacuuucaacaugaacuguuacuucuacaacgacu

SEQ ID NO: 721 - RNA, 67 nt, Barley yellow mosaic virus
augguacauacuuuggcgaacauguugcuaugcuacgcgacuuaaaacguuauaucuaugguaccgu

SEQ ID NO: 722 - RNA, 68 nt, Barley yellow mosaic virus
caucaagagggauauggaugaagccguugagagcaaacuaugugguuucaccuuuguuuuuccagaug

SEQ ID NO: 723 - RNA, 83 nt, Barley yellow mosaic virus
guccugaagcagcuaggaaauauccuuuacauguugaaacuagcguuugcgauucguaucggaaguucauugcagcucaaggc

SEQ ID NO: 724 - RNA, 94 nt, Barley yellow mosaic virus
uugcugacaaacugcgcucuuuucucgacacaaagcuuguuguuggacaccaccagcggaagcuacuagaagaaacagcucagguuguuaucaa

SEQ ID NO: 725 - RNA, 104 nt, Taura syndrome virus
gauauuguaauaugugaaaugggaaauucuauuucagcacgcaaggacauaacuucauauuucccuacggugaaggaacucccaggauuaacagguaugauauc

SEQ ID NO: 726 - RNA, 130 nt, Taura syndrome virus
gaugccuguguucaugacguaaagcgaauuuugaaugcuccaggagugucuaaugcggagaagagaguuuugacgcaugaggaauccauuacggguauugagaaucgucaguacaugaaugcauugaauc

SEQ ID NO: 727 - RNA, 115 nt, Taura syndrome virus
ugcaaccucaaacguaaauccaggcgcguauguccccaagucuauucauagugcagaugcauucagacggcguuuagaucuaugcguuuauguagauguuaaagaugaguuugca

SEQ ID NO: 728 - RNA, 129 nt, Taura syndrome virus
uugcuaaugaugaauacguuauuacuauuucauguagccuauuaguuguugcugacguuggccccacccaagcaguugcacgagaaagagcugcaaagagauuuuugaagauguaugauuauucugcaa

SEQ ID NO: 729 - RNA, 76 nt, Invertebrate iridescent virus 6
gucaaaaguuuuguuaaaagaaaugauguucuuguugguaaaguuauaacaaaaauaucaaaagacggaacuagac

SEQ ID NO: 730 - RNA, 62 nt, Bovine coronavirus
aagauugugguuuuguuaugcaguuugguuauauugacugcgaacaagacuugugugauuuu

SEQ ID NO: 731 - RNA, 74 nt, Bovine coronavirus
aaguauuaauaccucuuguagggucuugcagcguguuaugcuuaaagcugcaaugcucugcaacagauauacuu

SEQ ID NO: 732 - RNA, 79 nt, Bovine coronavirus
aaguuuguggauuuuggcgggauggaaguuguucauguguuagcacugacacuacuguucagucaaaagauacuaauuu

SEQ ID NO: 733 - RNA, 125 nt, Bovine coronavirus
acccuguauggccaaacuguaguuuauuuuggagguuguguguauuggaguccagcacguaauauauggauuccuauauuaaaaucuucuguuaagucuuaugacgguuugguuuauacuggagu

SEQ ID NO: 734 - RNA, 85 nt, Bovine coronavirus
agauuuucaguucaugcuuugguguaacgaugagaaaguuaugacuuucuauccucguuugcaagcugcaucugacuggaagccu

SEQ ID NO: 735 - RNA, 130 nt, Bovine coronavirus
agggucaggaugucaucuucagccaauucgacagccugagagucagcucuaaccagagcccacaagguaaucuggggaguaaugaacccgguaaugucggugguaaugaugcucuggcaaccuccacuau

SEQ ID NO: 736 - RNA, 88 nt, Bovine coronavirus
cagcuuuuuaaagguuuagcacagccuguggauuucuuggcauugacugcuaguucuauugcuggugcuauacuugcuguaauuguug

SEQ ID NO: 737 - RNA, 73 nt, Bovine coronavirus
gcuucaauguugcuauuacucgagccaagaaagguauucuuuguguuaugaguaauaugcaguuguuugaagc

SEQ ID NO: 738 - RNA, 63 nt, Bovine coronavirus
guuaaacgcgugcgugcuuggguuggcuuugaugcugaaggcgcucaugccacgcgugauagc

SEQ ID NO: 739 - RNA, 83 nt, Bovine coronavirus
uaguugcuccuuugaggaugaauugacaccuagcgauguuuaucaacaacucgcugguaucaaguuacaaucaaagcguacua

SEQ ID NO: 740 - RNA, 89 nt, Bovine coronavirus
uauaauaagcagauggcuaaugucucuguuuuaacuacacccuuuagucuuaaagggggugcaguuuuuaguuauuuuguuuauguaug

SEQ ID NO: 741 - RNA, 110 nt, Bovine coronavirus
uauuaaagcccaauuuaaaacauuugagaaaguagaugguguguauacuaauuuuaaauugauaggacacaccaucugugauauucuuaaugcuaaguuggguuuugaua

SEQ ID NO: 742 - RNA, 76 nt, Bovine coronavirus
uauuuggaguauauaaagaaguuguacaaugaccuggguaaucagaucuuggauagcuacaguguuauuuuaagua

SEQ ID NO: 743 - RNA, 69 nt, Bovine coronavirus
ucaugugaugguggauugucgccgacuucuuaaacaagaauguugugugcagucuagccuaauacguga

SEQ ID NO: 744 - RNA, 70 nt, Bovine coronavirus
ucauuugaggagcaggaugaaauuuacgccuauacuaagcgcaauguccugccaacacuuacucaaauga

SEQ ID NO: 745 - RNA, 108 nt, Bovine coronavirus
ucuaagguuaagggugugccuaauaugcauguugugguaguggaaaaugaugccgauaaagcuaauuuucuuaaugcugcuguauuuuaugcacagucuuuguuuaga

SEQ ID NO: 746 - RNA, 68 nt, Bovine coronavirus
ugcuauuagugcuaagaauagagcccgcacugucgcugguguuuccauacuuaguacuaugacuggca

SEQ ID NO: 747 - RNA, 94 nt, Bovine coronavirus
ugguacauugagucgugaagaucuugagauugguuacaccguggauuguucuugcgguaaaaagcuaauccauuguguacgauuugauguacca

SEQ ID NO: 748 - RNA, 89 nt, Bovine coronavirus
uguaguuccacaaggugguuauguugccgauuuugcauauugguucuuaaccuuaugugauuggcaguguguugcauacuggaaaugca

SEQ ID NO: 749 - RNA, 118 nt, Bovine coronavirus
uguuggcgccauaguguuacaugugauuacuuguauaauccacuuauuguugauauucaacaguggggauauauuggaucuuuaucaaguaaucaugauuuauauuguaguguccaca

SEQ ID NO: 750 - RNA, 130 nt, Bovine coronavirus
uguuggucgugugauuucuguugucucuuugugguacauggguucuaacuuagaggaagaaauucuucuuauguuggcuucucuuuuugguacuuacacauggacaacagcuuuaucuauggcugcagca

SEQ ID NO: 751 - RNA, 108 nt, Bovine coronavirus
uucagauguugauacuaaguguuuagcugauucugucaugucugcuguaucggcaggccuugaauugacggaugaaaguuguaauaacuuggugccaacauauuugaa

SEQ ID NO: 752 - RNA, 109 nt, Bovine coronavirus
uugaucaaugguaugagucuacauuuggucuaaguuauuauaguaacaguauggcuugucccauuguuguugcuguaguagaccaggaucuuggcucuacuguguuuaa

SEQ ID NO: 753 - RNA, 124 nt, Bovine coronavirus
uugauuuguuaaauuuaagagagauuaagccuguuuuuaaugugguuaaagcugugcgaaauaaaauuucugcaugcuuuaauuuuauuaaauggcuuuuugucuuauuauuuggcuggauuaa

SEQ ID NO: 754 - RNA, 76 nt, Bovine coronavirus
uuguauauauugccgcgcacgaguugaacacccagauguugauggguugugcaaauuacgcggcaaguuuguacaa

SEQ ID NO: 755 - RNA, 69 nt, Bovine coronavirus
uugugaagaucauaagccacaauauucguuuaaguugguaaugaaugguaugguuuuuggucuauauaa

SEQ ID NO: 756 - RNA, 93 nt, Bovine coronavirus
guuugucaaguuuguggauuuuggcgggauggaaguuguucauguguuagcacugacacuacuguucagucaaaagauacuaauuuuuuaaac

SEQ ID NO: 757 - RNA, 130 nt, Bovine coronavirus
caugauguuaauagugguacuacuuguucuacugauuuacaaaaaucaaacacagacauaauucuugguguuuguguuaauuaugaucuuuaugguauuacuggccaagguauuuuuguugagguuaaug

SEQ ID NO: 758 - RNA, 87 nt, Bovine coronavirus
cucacuucuaaacaauaucuacuagcuuucaaucaagaugguguuauuuuuaaugcuguugauuguaagagugauuuuaugagugag

SEQ ID NO: 759 - RNA, 114 nt, Bovine coronavirus
guuauuaaagaugguguaauguauagugaguuuccugcuauaacuauagguaguacuuuuguaaauacaucuuauagugugguaguacaaccacauacuaccauuuuggguaau

SEQ ID NO: 760 - RNA, 68 nt, Bovine coronavirus
uguuuuugauacuuuuaauuuccuuaccaacggcuuuugcuguuauaggagauuuaaaguguacuaca

SEQ ID NO: 761 - RNA, 65 nt, Bovine coronavirus
uucccgauugcaauauugaggcuuggcuuaaugauaagucggugcccucuccauuaaauugggaa

SEQ ID NO: 762 - RNA, 62 nt, Culex nigripalpus baculovirus
gucuuggcgguucagucggcaauauuccacuucgcguggauggcuacaguaaaccgguggac

SEQ ID NO: 763 - RNA, 131 nt, Culex nigripalpus baculovirus
ccggugcacagcgagccccaguuguccgcauaucuguacacaauacgaauugcagguaaguuuguacgugugacucacguucgcaacgaguauugguacugcguggcggaccugaagcuggcggucgacgg

SEQ ID NO: 764 - RNA, 105 nt, Culex nigripalpus baculovirus
cguguauccgcgacgcacgccaagauggagugguaucguagugaguccaagagcgccaagagccgcugugaugccaaacugucggugaaggguaugcgggacgcg

SEQ ID NO: 765 - RNA, 75 nt, Spodoptera litura nucleopolyhedrovirus
ugcguaccguuugaauucggccauagugcacgaucgugacuuuaacuaugacuauuuuggauuuaaaacgaugca

SEQ ID NO: 766 - RNA, 131 nt, Spodoptera litura nucleopolyhedrovirus
cgacgugcgcgccuaccagagcuugaucgauucguacuuuacguuugaauauuacaaccaucuguucggcggcggcaccgugaacauguucaacguaaacaauucgaucaacauugcggguagcagacgcg

SEQ ID NO: 767 - RNA, 73 nt, deer tick virus
aagggaaaaugcuugagguggccggacacuuucguuugacggaggagaaaaggaaacauuucagacaucucuu

SEQ ID NO: 768 - RNA, 77 nt, deer tick virus
gggaaacugaaucuugagggagggcgagucaugggggccaucccaauagacuuaccucguggaaccucaggcagccc

SEQ ID NO: 769 - RNA, 104 nt, deer tick virus
ugcggauuuuuugggaaaggaagcauaguggccugugccaaguuugaaugcgaggaagcaaaaaaggcaguaggucauguuuaugacucaacaaaaaucacgua

SEQ ID NO: 770 - RNA, 104 nt, deer tick virus
ugcugucguggcuuuggcuuggcucaugcuggauaguuggauggcuagggugacugugauccuucuggcgcugagccuugggccuguauacgccacgagaugca

SEQ ID NO: 771 - RNA, 64 nt, Zucchini yellow mosaic virus
auaaacccgucacuguuaaucaauuggaucacgauaaauucuuggaagcaguugaugggguuau

SEQ ID NO: 772 - RNA, 79 nt, Zucchini yellow mosaic virus
cggcucaggugagaagacaguagcagcugucacgaaggacaaggaugugaacgcugguucucaugggaaaauugugccg

SEQ ID NO: 773 - RNA, 130 nt, Zucchini yellow mosaic virus
ucucuugugguuucaagauuuuugcgcgaugcuacagcgacauuauauaccuugugaacguguguuugguauucuccuugguauuacaaaugucuaauacuguacgcaacaugauagcggcgacaaggga

SEQ ID NO: 774 - RNA, 98 nt, Zucchini yellow mosaic virus
ugauccauacauauuauugcuuggcaugaucucaccuaccauucuuguacacauguauaggaugcgucauuuugagcgagguauugaaauauggauua

SEQ ID NO: 775 - RNA, 109 nt, shrimp white spot syndrome virus (white spot bacilliform virus)
agaagaagaggaagaagaagcggaagaagaagcgauggaccaggagccugcagaaguagacuuccuuucagugccucauuuacgccguaaaauucgucaagcuguuucu

SEQ ID NO: 776 - RNA, 75 nt, shrimp white spot syndrome virus (white spot bacilliform virus)
ucccccugcaagaagugccaagauaacgguugaaggagucaagggauuuuucagcgguuuucgugacauuuugga

SEQ ID NO: 777 - RNA, 70 nt, shrimp white spot syndrome virus (white spot bacilliform virus)
ugcugcucaaggagaauguggaucuugggcaacauucgacgacccgcauucuguauugccuuggguggca

SEQ ID NO: 778 - RNA, 75 nt, shrimp white spot syndrome virus (white spot bacilliform virus)
ccaugacaguagauguggaaaauucuguaucgucugcuaaagacucgguggauauuagauuuuucacucucaggg

SEQ ID NO: 779 - RNA, 68 nt, shrimp white spot syndrome virus (white spot bacilliform virus)
gaggagggguugcauucguagaagguuugacguuagaaaaugguaucuucacugaaguaauuguccuc

SEQ ID NO: 780 - RNA, 87 nt, shrimp white spot syndrome virus (white spot bacilliform virus)
uggggguaacaauaguagcaguaguaucaauaacgaagaugauggugaugaugacgaugccguugacgcuacugcauuaugccccca

SEQ ID NO: 781 - RNA, 128 nt, shrimp white spot syndrome virus (white spot bacilliform virus)
gguacauguggcccuucucugcuuugcaaguggggacaaaaauaagagacgcuagaacguuuaguguuuuauuugguucugauaugcaugaaggaagaaacaaugacaggauuugggaaaauauggcc

SEQ ID NO: 782 - RNA, 61 nt, shrimp white spot syndrome virus (white spot bacilliform virus)
gguguauaauuguacucuauguugucuagcuuuaagaaaauguagugauaguuauuugucc

SEQ ID NO: 783 - RNA, 66 nt, shrimp white spot syndrome virus (white spot bacilliform virus)
ggaugaggcaaaguuugugccuauaccuuuauuuggcguggaaccuuuacacccuuuacucaauuc

SEQ ID NO: 784 - RNA, 125 nt, shrimp white spot syndrome virus (white spot bacilliform virus)
ucuuaaaaaugcaaaaaagcccccaacugauuuaacgaugacggauuuugacuuuuaugaaaaauacauaaggucagauauuguauugggaaaaucaaacaaguugucggguauguuuagugaga

SEQ ID NO: 785 - RNA, 130 nt, shrimp white spot syndrome virus (white spot bacilliform virus)
aagguuaacaauuuucuugaacauaccaauuguacuauuaaauuggccaaaagaguucacuuugucaaaagauuauaaaguucuucuuuuggauaguauuucuaguuguucuucuaaaauggcugucccu

SEQ ID NO: 786 - RNA, 103 nt, shrimp white spot syndrome virus (white spot bacilliform virus)
uaguaaucaaacucaagcaaauuugcacauggaacugauaaauauacugaaagaagacgacgauaaucaaccaugucaaacguauaagcuuggucaaagacug

SEQ ID NO: 787 - RNA, 83 nt, murid herpesvirus 4
cugaccaucgaggagcacguguuauucuagaccucucuuccagcuaagauagcaugugccguccucuuuguuucccaagucag

SEQ ID NO: 788 - RNA, 63 nt, murid herpesvirus 4
gaaguagcgaaccucugcucacugcccgggcccuccgggaggugagcaggaguugcgcuuuuc

SEQ ID NO: 789 - RNA, 56 nt, murid herpesvirus 4
gaggaaguggguccaacuuuaucccuauagugugauagaaauggccguacuuccuu

SEQ ID NO: 790 - RNA, 80 nt, shrimp white spot syndrome virus (white spot bacilliform virus)
aauuuacucccuauuuucggagucaauacgggauaguaaauguugaaaaaaauaucccugguuacauauggggagaaauu

SEQ ID NO: 791 - RNA, 128 nt, Feline immunodeficiency virus
gaaaugguaggcaauguggcaugucugaaaaagaggaggaaugaugaaguaucucagacuuauuuuauaagggagauacugugcugaguucuucccuuugaggaagguaugucauaugaauccauuuc

SEQ ID NO: 792 - RNA, 93 nt, shrimp white spot syndrome virus (white spot bacilliform virus)
uguugaaauuauucuccaguaaauuucugguagcgccucuaauuucuagcacaguugaagaugaggauggugcauuggggaguuuuuuuacca

SEQ ID NO: 793 - RNA, 127 nt, Equine herpesvirus 2
cgccuugacccuggccacccuagcggcgagcgcguuucuccugagacuugaagcaagccuucuuguuucucucaaugagucucugucuacgcgcacguagugcuuuggacuuggggaccagaaggcg

SEQ ID NO: 794 - RNA, 103 nt, Equine herpesvirus 2
cgcguuggugaugagguagacgaugucccuggcgccgggguccugggcagaggcggcggucuguuugguguuggggaacaugcccgcgucgcucaugaccgcg

SEQ ID NO: 795 - RNA, 130 nt, Equine herpesvirus 2
gcggucugggccccgaucaggcccugcacgucccugaaggucagcuucugguugaggacgucaaagagcuggucguacuuuuugccagacagguugaugaggugcccgccgagggucuggcccgacccgc

SEQ ID NO: 796 - RNA, 107 nt, Amsacta moorei entomopoxvirus
acagauguagauauuacacaagguaaucuuauagauaguuuaucguguuuuuuauuuaacggauuuaauauaucaauaguaacaucuguuguauuauauauauuugu

SEQ ID NO: 797 - RNA, 78 nt, Melanoplus sanguinipes entomopoxvirus
uauauugauguauauaaugcauguguucuaauucuaucuucauuaaaauuauugccaucuguuaauuuacuuaauaua

SEQ ID NO: 798 - RNA, 84 nt, murid herpesvirus 4
acgugguuucauugcuguugccaaaaaguuuauuccuaucaauuaaauuguuugacacaucacugauaaaaucuucaaccacgu

SEQ ID NO: 799 - RNA, 114 nt, murid herpesvirus 4
uccucugauguaguucccuuuuuccauuuuuuucucaugguauugugaaaguuggcccagcugguaaacagggucucauaagugcaugaguuuagagcaaaucuauacagauga

SEQ ID NO: 800 - RNA, 131 nt, murid herpesvirus 4
uuaucaggauuagaacauuugggacagugagguguuuaguaaaaauggugggcaagcacagaagugugaauguccccgcuggguuuugaaaaucaucuauguuauuguccauucuguaagaguccagguaa

SEQ ID NO: 801 - RNA, 78 nt, Macaca mulatta rhadinovirus
gaugugacauucggauagguuaaugguugggucgcgcagaccggauaaagccugcaacguauucugagugaguauauu

SEQ ID NO: 802 - RNA, 52 nt, Macaca mulatta rhadinovirus
ugucuguaggugccgagauaagcagccuuaucuccguuaaacuccacagaca

SEQ ID NO: 803 - RNA, 101 nt, Monkeypox virus
uagcggauaucauuugaucggugaaucuaaaucguauugugaauuaggaucuacuggaucuaugguauggaauccugaggcaccuauuugcgaaucuguua

SEQ ID NO: 804 - RNA, 95 nt, Monkeypox virus
uagcguauaaaaauauucaaaauggggaugaggaugauaaugauaauauugucuucucaccguuuggguauucguuuucuauguuuaugucgcua

SEQ ID NO: 805 - RNA, 77 nt, Ateline herpesvirus 3
uguuuuuuucuuuuaaugccaugcguagucuccaaaaaaaggucaaaguuaugcugugcaauuaaaaacacaagaua

SEQ ID NO: 806 - RNA, 55 nt, Saimiriine herpesvirus 2
accauagccccuugcugcuuuaaugcugccauuaaagcaaauucauggcuuuggu

SEQ ID NO: 807 - RNA, 89 nt, Human herpesvirus 6
uaugggaauauucugguaaaagugcauguaucaauuuuagucguuuuuggauuucuguaauguuacgauuugcuauguguauuuucaug

SEQ ID NO: 808 - RNA, 58 nt, Human herpesvirus 6
uuaagcagccgcgaacucguuaauaguuacuuugauguuaacucaggugguggcuugg

SEQ ID NO: 809 - RNA, 88 nt, African swine fever virus
gagaagagucuggacuguaauuuuuaaauaauaagauauuuauuaauauccaauuauucguuugacucgcuauuuccaugcucucuuc

SEQ ID NO: 810 - RNA, 131 nt, African swine fever virus
ggaucugucguuuuuaaagauaaaagagagacguuugaauuauaaaaaucuuuaaaugauaauauuucuacuaauauaucaugauucuuuuguuuugcuaauucuaagcucucuucgaaagcauuagcucc

SEQ ID NO: 811 - RNA, 66 nt, Monkeypox virus
ccaccgcaauagauccuguuagauacauagauccucgucgugauaucgcauuuucuaacgugaugg

SEQ ID NO: 812 - RNA, 113 nt, Bovine herpesvirus 4
agaucagaggccauaaccucacaguggcaaaaaaagcagcuguauaagugccaauguaucuauggguucuuguauucugagacugagucacuguaucaauauucucaugaucu

SEQ ID NO: 813 - RNA, 130 nt, Bovine herpesvirus 4
uagaacuauuuggggguugagugugagacaacagcuguuguaaaugguguuugcgccuaaugccaguuuuugaugccaaauaccuaucauaacacuguugugcuaucagaaaaacaagguaguuccucug

SEQ ID NO: 814 - RNA, 60 nt, African swine fever virus
auguaaguuauaaauugguuccaaaacauauuggccaauacucauguuuauggcuuacau

SEQ ID NO: 815 - RNA, 109 nt, African swine fever virus
gaagcaauagaugauuucuacgacugaaauauagaauaguucauuuucuauuuguaaaauaaugauuuauauucucuccuaaaaauacgaucgauccuuuauaugcuuu

SEQ ID NO: 816 - RNA, 71 nt, African swine fever virus
uugcgaaaaggcauacauaugaucaauaucagaccuacaaugaauguuuccauaauaucccuuuaucgcaa

SEQ ID NO: 817 - RNA, 70 nt, Human herpesvirus 6B
cgguaaguugacgugcgucggaaucggaagcaacaacuguugcucgaacagaaacaugugcaacucauug

SEQ ID NO: 818 - RNA, 79 nt, Human herpesvirus 6B
uccugaaaucugagugaucugauucgacaaaucaucaccacguauggucgucauuucaaauacaccucacguuuuggga

SEQ ID NO: 819 - RNA, 123 nt, Monkeypox virus
aguauugacccacgaguuauaacaaagucaaagacccauuuuccuacuccauugaguguaaaauucaugguugacaauuuaggaaauggauaugacaacccuaauucauuuugggaagaugcu

SEQ ID NO: 820 - RNA, 67 nt, Monkeypox virus
gaaacgauaccaguuuuaaacagaauacggaugcgauggcuuuguauuucuuagauguuaucgacuc

SEQ ID NO: 821 - RNA, 63 nt, Monkeypox virus
gugguuuagcagcaacauuggugauuaaaccguacgagguacccaucagugauaugcaacuac

SEQ ID NO: 822 - RNA, 76 nt, Monkeypox virus
uacauuuaaauccguaacuagaucagaucaugagugugaaucuagcuuagaucugacgucuaaggaaguaacugug

SEQ ID NO: 823 - RNA, 78 nt, Monkeypox virus
uguuuucaggacaggagaggccaguagauccuguuauuaaauuauuuaauaaguacgcuggcuuaauguccgauaaua

SEQ ID NO: 824 - RNA, 116 nt, Monkeypox virus
uuuguaucaccuagacgguguagaagagcaagcucuggagucauaugugguaugauacaaucaaaaccaaacgaugauaccuauucacuucuucaacggccaaaaauugaaccaga

SEQ ID NO: 825 - RNA, 50 nt, Fowlpox virus
ugggacuaacguaguaagauguauaacuaugacuagauaugguaguccua

SEQ ID NO: 826 - RNA, 77 nt, ictalurid herpesvirus 1
ggaguucgggagucggcaguugacugacagccacggaaucaucggggguguacacaacuuccgaauccacggagucc

SEQ ID NO: 827 - RNA, 130 nt, Equine herpesvirus 2
auuacagcuuaacaacccuagaaaguuaccccauucuuuacagugugaaaucaugugugauuaguucugcaugauuucacacuguaaagaguggcauaauuaaaaacuuuaugggucgguaaucuguaau

SEQ ID NO: 828 - RNA, 121 nt, Equine herpesvirus 2
ggcuccuuacauuuuuggggauuguuuguguggaauguguuuuuggaauauacaaugugucuaucaccccaaacacaacacacaacuuuacauuacagcagaccucaacacccccgggacc

SEQ ID NO: 829 - RNA, 86 nt, Monkeypox virus
agagauugauaucgcauagaaauaguaaaguuuauaaucucaucauuguagauuacucuguuaccauuguaauaaauugguacucu

SEQ ID NO: 830 - RNA, 128 nt, Monkeypox virus
gccugaagcucaucuuguuuaguuacggauccuaaugaguuauuaagaaauacaucgaacggaugaacgaagguuguuuuaaguugaucacauacuuuguaaucuagacauagauguggaagaacggu

SEQ ID NO: 831 - RNA, 63 nt, Gallid herpesvirus 2
gaucaaggcccuccguauaauguaaauguuccaaagguuugcauaauacggaggguucugauc

SEQ ID NO: 832 - RNA, 95 nt, Gallid herpesvirus 2
gauucacuacaggcggcaugaaaaugugaaaaccucucccgcuagaaauagaaucugcugggggguucacauuuuuaaguuguauguaguguauc

SEQ ID NO: 833 - RNA, 82 nt, Gallid herpesvirus 2
uccccugugaaguuuaaugcuguaucggaacccuucguucggugaccacgaaugguucugacagcaugaccuuucuggggga

SEQ ID NO: 834 - RNA, 85 nt, Gallid herpesvirus 2
ucuccuaaaagaaaguuguauucugcccgguaguccguuuguaaggucuugaacggacugccgcagaauagcuuucuugagggga

SEQ ID NO: 835 - RNA, 95 nt, Lymphocystis disease virus 1
gaaaggcauguggguuaaugauuaaaucagguacuaugccaucuuuagugaaaggcauguuuucuugggcauaaaucauaccacagguaccuuuu

SEQ ID NO: 836 - RNA, 76 nt, Lymphocystis disease virus 1
ggcuuguuuucccauauuagauugauaugcuauacgaggagauuguguaugauuauaaaaugggaucacagaagcc

SEQ ID NO: 837 - RNA, 78 nt, Lymphocystis disease virus 1
gguuguauuaaaggcuuaauuucagcuuuaucaauaccuaguguaaaucuaacagauaaugcuguauuuaauacaacu

SEQ ID NO: 838 - RNA, 130 nt, Molluscum contagiosum virus
ggacuugcgcagauccucggguccgaucucagucucgucgagagagcgcccgcugcgcuugacaauguagagcagcgccuugauguguuccagcgcgaugagguccgcguagagcgacuuggacaggucc

SEQ ID NO: 839 - RNA, 84 nt, Ectromelia virus
cgaugaauacuuuaaugacguuauaccucuacauaaugcuuauagcgugcaacguugauauaaugucuuaucucguauauauug

SEQ ID NO: 840 - RNA, 87 nt, Amsacta moorei entomopoxvirus
caguaucucgugauaauuuuucauugacgaauugcgucucauuuauuucuauaacugcaauacguuugaccaaagcaggaucuacug

SEQ ID NO: 841 - RNA, 95 nt, African swine fever virus
ggaagcaaugauuuuuacauaguguuccugcaaauuuuaauaccucuucaaguucacuuuguuggauaguaucgcaggaacucgguguuguuucu

SEQ ID NO: 842 - RNA, 90 nt, African swine fever virus
gguuucagccgaggcaauguuuacauaguccuggugcuuaauuuccauuuuaaugcuuguauacuguuugacugucuccagcuuuucacc

SEQ ID NO: 843 - RNA, 107 nt, Ectromelia virus
ccauucuuaauaaucgucaguauuuaaacuguuaaauguugguauaucaacaucuaucuuauuucccgcaguauaagguuuguuacauguaugauguucaggaaugg

SEQ ID NO: 844 - RNA, 70 nt, Ectromelia virus
guuuguacugcaaaaauaauaucuauuuuuguuuucgaagauaugguaaaauuaaauaguaguacacaac

SEQ ID NO: 845 - RNA, 65 nt, Camelpox virus
ugauuuugguuuacauguaauacauuuugaacucuuugauuuuguaucacaugcgccggcaguca

SEQ ID NO: 846 - RNA, 63 nt, Camelpox virus
uguacugcaaaaauaauaucuauuuuuguuuucgaagauaugguaaaauuaaauaguaguaca

SEQ ID NO: 847 - RNA, 86 nt, ictalurid herpesvirus 1
ccccgcgaugauuuuuccggugaugccccggacaggcuccaccucggggucugcccggccguuaucgaaaaaacagaauugcgggg

SEQ ID NO: 848 - RNA, 59 nt, ictalurid herpesvirus 1
cgcuucaguuguucacauguaccauuucgcaccgcguggcacacgugaacggugaagug

SEQ ID NO: 849 - RNA, 99 nt, ictalurid herpesvirus 1
uauucgagggaugaccuauucucggcauuucuccuugggacgaguaugauggggagaccggacgaugcaacagauggguuauuuauagugacuugagug

SEQ ID NO: 850 - RNA, 131 nt, ictalurid herpesvirus 1
uuccacauuguggcucagugcuccuuccucgaucgucucccauaucugccgauacuuggugcgguccugucgggucacgccauuugaucgcuguaugauaucgaugacauuguggaacgacacgagcggag

SEQ ID NO: 851 - RNA, 112 nt, Swinepox virus
guauaaacggcaaaucuaaugguauaguaccuauguuaagaauauauaauaacacaguuagauauauuaaucagggaggugauaaaagaccaggagcaaugucgauuuauau

SEQ ID NO: 852 - RNA, 60 nt, Swinepox virus
uguguuuauauuauugggcuaugcauucgauagcgaagaagcaaaaauauuaaauauaca

SEQ ID NO: 853 - RNA, 124 nt, turkey adenovirus 3
auuucucgguuuucugguguuaaaauuaauuuugugaaguaaucugugagugcaaauaggauguuauuucuuaauuuucugaacuccguacuaaugaaguuuuuaacuuuagaaaaccagaagu

SEQ ID NO: 854 - RNA, 75 nt, turkey adenovirus 3
gauauauaaauuuuuuauacuuucuggauguggaauuccuucuuuaaucugugaaaguauuucacuuuuauuauu

SEQ ID NO: 855 - RNA, 123 nt, Fowlpox virus
acgauaauaacuccuucauguuaaaagggauuucguuuacuaccuguucauauuuaucuucuuuguaugauaaacucguaguaaaacuucuguaauugauauuaaagucguuauuaccuucgu

SEQ ID NO: 856 - RNA, 60 nt, Fowlpox virus
cuauauaagaaaauauagcuaccaaagauuuaucaucuauaucuauguuuuguucuauag

SEQ ID NO: 857 - RNA, 53 nt, Fowlpox virus
gcuaguuuauagucgugauaaacguaucuaucguuauccacgacguaucuagu

SEQ ID NO: 858 - RNA, 55 nt, Fowlpox virus
uagacuuaugugguccgcgaugaagauuuuaguaucuuccguacauguuagucua

SEQ ID NO: 859 - RNA, 73 nt, Fowlpox virus
ucuuccuagguucgaaggugacuuguuuuauauuaauuaacuccauaaacaaaucacacaaaccauaguuaga

SEQ ID NO: 860 - RNA, 64 nt, Swinepox virus
aguauuauauguugguaaaggucaagauauacaacgugcauuauaucugacaccguaugguacu

SEQ ID NO: 861 - RNA, 107 nt, Human herpesvirus 5
guuguaggugcagaugcugccgacgaaacgcagcggcucggggcagcagagguagcuggccagacgcugugcaucccguccuucgucgcgcaccaagcgccagcgac

SEQ ID NO: 862 - RNA, 108 nt, Human herpesvirus 5
guuugaaguccucguccgucucgaucuccugcagcacuagguuccagcccggcggccagaccacgggcaacaccuggccugcguugaugcgcacguaagcuuccagac

SEQ ID NO: 863 - RNA, 87 nt, Human herpesvirus 5
uucccauagccugucuaacuagccuucccgugagaguuuaugaacauguaucucaccagaaugcuaguuuguagaggcuaugcggga

SEQ ID NO: 864 - RNA, 99 nt, Swinepox virus
uauccguguuaacgucgaucacuaacauuuguacuaacgaauaucuauaucuagagaaacguauaugugaauaugugagaucguaugaugcuacagaua

SEQ ID NO: 865 - RNA, 54 nt, Amsacta moorei entomopoxvirus
uaggagcauuuuccaaagaauuuauauauauuauaaucuuauuuaauguuucug

SEQ ID NO: 866 - RNA, 127 nt, Gallid herpesvirus 3
guugccucugcguaucgcuaguucgagcucggguuuccgaagcaacguaacacacauauccuauaguguacaauguuucgaugcaacugaaagcaacgagcuaaagcgaagauguuuugcaggcgac

SEQ ID NO: 867 - RNA, 73 nt, Gallid herpesvirus 3
ucgaaaccauaucugcgugggccuuuaauuccauauccgaggcguucugauauguucccaguagguaugucga

SEQ ID NO: 868 - RNA, 65 nt, Meleagrid herpesvirus 1
guuagugauccgucaugcauuucauauucuguuccggcaucugaaaugcaugacggaucacuaau

SEQ ID NO: 869 - RNA, 110 nt, Gallid herpesvirus 3
cucgcuucgacauuccggguaaaacgcguauuuggcccuacacuuuauuucguacguuucuauggaguggucggggagggcaggcguaaggauuccgcgugcgcugcgag

SEQ ID NO: 870 - RNA, 64 nt, Rat cytomegalovirus
guugaaguaguucuuguacagggcguacaccgggaucaggugucucgugcaauugugguucgac

SEQ ID NO: 871 - RNA, 76 nt, Human adenovirus E
uugaagucgauauugucgcagccccccugcucccagagcuggaaguccgugcgcuucuuguaggcgggguugggca

SEQ ID NO: 872 - RNA, 67 nt, Vaccinia virus
gagacuugauagauauuagugaugaauugaaaauuauuuuuaucaccacguguguuucaggaucauc

SEQ ID NO: 873 - RNA, 79 nt, Vaccinia virus
ggcuauucuggcggcuagaauggcauaauccggauguuguguaguacaaguggcugcuauuucggcugccagagugucc

SEQ ID NO: 874 - RNA, 130 nt, Human herpesvirus 4
cagauauagauuaggauagcauaugcuacccagauauagauuaggauagccuaugcuacccagauauagauuaggauagcauaugcuacccagauauagauuaggauagcauaugcuauccagauauuug

SEQ ID NO: 875 - RNA, 53 nt, Human herpesvirus 4
gaagcuguaaaaauagaacgcccuggaacugccccacugugcaaugcagcuuu

SEQ ID NO: 876 - RNA, 89 nt, Human herpesvirus 4
gcgaccucgugaauaugaggaccaacaacccugugcuuggcgcucaggcgcaaguguguguaauuuguccuccagaucgcagcaaucgc

SEQ ID NO: 877 - RNA, 128 nt, Human herpesvirus 4
uagcauauacuacccagauauagauuaggauagcauaugcuacccagauauagauuaggauagccuaugcuacccagauauagauuaggauagcauaugcuauccagauauuuggguaguauaugcua

SEQ ID NO: 878 - RNA, 63 nt, Periplaneta fuliginosa densovirus
gacgucgcuaagguaccggcgaaaagguccgaaaggcguucuuuuaauucuugauacgauguc

SEQ ID NO: 879 - RNA, 120 nt, Periplaneta fuliginosa densovirus
uggccauagcuucgcuauaccccaccacaaccaccaccaccacgaccggacacauggccuuuggccguguccaugguguggugguggugguuguggugggguauagcgaagcuauggcca

SEQ ID NO: 880 - RNA, 84 nt, Periplaneta fuliginosa densovirus
uguagugggagaacccaucuugacauauguuuaucaaccuaaaauugcuccuuugaaaccuguucagaaauaucugccaacaca

SEQ ID NO: 881 - RNA, 82 nt, Gallid herpesvirus 2
acaaguauguuauaauaguauagaugaauaaagugagacuuauaauacuuauugcauagauguguuuuauuaugugccuugu

SEQ ID NO: 882 - RNA, 118 nt, Gallid herpesvirus 2
gcucaccaaguaccucggcaacgugagguuguauuuugcgucuaaucgguucaucggcaaaugcauuuacucgagcaaauguauaacccaucaaaguguagcugucuguuugaagagc

SEQ ID NO: 883 - RNA, 93 nt, Gallid herpesvirus 2
gcugucgacaacaaugaguguaccuaccgguccucguuguaugauaaaauucgaugauggaauauggucacaucuagauagcuugccgacggc

SEQ ID NO: 884 - RNA, 80 nt, Cowpea mottle virus
ccccgagugcaaauggugcagugcucguuugcuggccauagcuagcaacaaguaucuucccagcauccacaagcuugggg

SEQ ID NO: 885 - RNA, 79 nt, Human herpesvirus 2
gggagcucgggcaggcucgcguuccgaggccggccgagcagauaggucuuugggauguaaagcagcugcccgggguccc

SEQ ID NO: 886 - RNA, 62 nt, Human herpesvirus 5
gcugagggagcucacccaacaccgucgccacggaguccggcggaucgcggcccucccaaagc

SEQ ID NO: 887 - RNA, 96 nt, Sulfolobus virus SIRV-1
cuuucaaauucaauauuucuagcaagauaacuuuuucuauaacaaauaccaacuucagauggaaaaaucguaucugcaggauauuuaacuuuaaag

SEQ ID NO: 888 - RNA, 78 nt, Sulfolobus virus SIRV-1
uaaaaaagugauauaaugcauuuuuguuugaauucgcaagauuuacaaauauaauuguuaacuccuggaacuuuuuua

SEQ ID NO: 889 - RNA, 71 nt, Melanoplus sanguinipes entomopoxvirus
auuaaaucauuaauuucuuuauuugauaaucguuugacuggcauaucaaauaaauuuuuuaauccuuuagu

SEQ ID NO: 890 - RNA, 84 nt, Melanoplus sanguinipes entomopoxvirus
uauauucccaauguaauuuaucaugauauuguaaaauuauaucuucugauaauucuugauauugugauauauauucccaaugua

SEQ ID NO: 891 - RNA, 50 nt, Saimiriine herpesvirus 2
augugaucuuguggaguuguuugcauuaggcaaugacagaaagguaacau

SEQ ID NO: 892 - RNA, 130 nt, Saimiriine herpesvirus 2
cuuuuugcaauaugaaauuuucauuugugucugcuaugucauauacagcuuuuaacuguuugaccuuuucaggguugugugaaugauaaaguagauuguugauaucaaaugaauccaugacauauuguag

SEQ ID NO: 893 - RNA, 130 nt, Saimiriine herpesvirus 2
gacgucuccaggccuguacucuuuuagaauucucaugcagugagaauacagcuguguuucauuuuuggugcaaauuauggcagcugguaagcauacugcauaagcuaaaagcaauacaauaggagauuuu

SEQ ID NO: 894 - RNA, 100 nt, Saimiriine herpesvirus 2
ugaugggcgucucugugcagcagcuucucgcacucugucugcccagcuuguuuugcaagaucuagauguagaguugcugcugauacggggucgcuuacca

SEQ ID NO: 895 - RNA, 68 nt, Alcelaphine herpesvirus 1
gaauuccacgguguuguggucugacauagaugcauuagugcacauguccagagaaacaccaaaaauuc

SEQ ID NO: 896 - RNA, 89 nt, Alcelaphine herpesvirus 1
uauagacugguagcggugggguuggugucuuuucagucagaagggcuucgcccucugaaaaggcuucaaaguccucugcaauguuuaua

SEQ ID NO: 897 - RNA, 104 nt, Human herpesvirus 8
cuggauagguaacacuggaagaggacgcaagacggcuuauagagaugcuuacaaaugaguuuggguggcacccugaagucguagcaguguugcuuaaaccccag

SEQ ID NO: 898 - RNA, 84 nt, Human herpesvirus 8
gucuacgggcugugagggacguuugcagauagauaggagaaaucccauuugauauauggaaagguguccuucgcacuucuugac

SEQ ID NO: 899 - RNA, 101 nt, Pothos latent virus
ggaguccaauucaucaggucacguucaauagcgaguuguucauccgguguaauaccgaaugccaaccaaaaacuauaacgagcgagacuguugauuucucc

SEQ ID NO: 900 - RNA, 63 nt, Pothos latent virus
uagcuaacucuacccggucugcagguucaacaucuuguugauccuuaucgaaguagauggcua

SEQ ID NO: 901 - RNA, 63 nt, Trichoplusia ni cytoplasmic polyhedrosis virus 15
uuaauaagacagcagaauuaguuaaugaucagaauauagaugcugaguuuguuguuuuccuaa

SEQ ID NO: 902 - RNA, 102 nt, Trichoplusia ni cytoplasmic polyhedrosis virus 15
uugagugaucauaagaauuuauuugaguauauauuuguugaagauuuaguagaagaaguuucucauucaggaguauguucuaauggauuauugaugacucaa

SEQ ID NO: 903 - RNA, 74 nt, Vaccinia virus
ccguuauaaaugucuuugucgaugauauauucaacgcuuccaauugugauauauccagagauaucuuguaaugg

SEQ ID NO: 904 - RNA, 96 nt, Vaccinia virus
agagauaaaacuuuuuuacgacuccaucagaaagagguuuaauauuuuugugagaccaucgaaggagacuccaucagaaagagguuuaauauuuuu

SEQ ID NO: 905 - RNA, 128 nt, Vaccinia virus
cuuuuuuacgacuccaucagaaagagguuuaauauuuuugugagaccaucgaagagagaaagagauaaaacuuuuuuacgacuccaucagaaagagguuuaauauuuuugugagaccaucgaagagag

SEQ ID NO: 906 - RNA, 131 nt, Vaccinia virus
cuuuuuuacgacuacuccaucagaaagagguuuaauauuuuugugagaccaucgaagagagaaagagauaaaacuuuuuuacgacuccaucagaaagagguuuaauauuuuugugagaccaucgaagagag

SEQ ID NO: 907 - RNA, 129 nt, Peanut clump virus
acacucaaaaaggaaguuucucucguuuuugucguguuggcaugagugccacugcccagauaaacuuuuguauccacaguaggcgauccagaccauugacaguccgagcagacacaaccagaagagugu

SEQ ID NO: 908 - RNA, 51 nt, Peanut clump virus
gcucccugaacaaaaaccauaccaaaaggguuugguucaaaaucagcacgc

SEQ ID NO: 909 - RNA, 131 nt, Peanut clump virus
guggaauugcagacuauuccuggcugaaguaagagaauugacuucguacucagcgcgguucuuuucugcacuaaguuucagucucucuuucucuaucauuucccaggcauucuuaaacuuuugaguuucuc

SEQ ID NO: 910 - RNA, 87 nt, infectious spleen and kidney necrosis virus
auguggcacuaucgaugcugucuucacgcacgcaugugucaaacgccgccggccgccugucgaucauaucgaauagauccaccacau

SEQ ID NO: 911 - RNA, 54 nt, infectious spleen and kidney necrosis virus
cuggagcugcguggggccauagggugagaccacgauggcacugaguagcuccag

SEQ ID NO: 912 - RNA, 64 nt, infectious spleen and kidney necrosis virus
gacuguacaccggcugccaguggauugcaaugugaugcaucagcagcguguccuuauacauguc

SEQ ID NO: 913 - RNA, 65 nt, infectious spleen and kidney necrosis virus
gggcacccggcgaugauguguugcaccaggcguccccagacgguguaaugccaaaugccaagucc

SEQ ID NO: 914 - RNA, 123 nt, infectious spleen and kidney necrosis virus
gucggucagcgguaaguucagcaggguggccaccgcaguguuuccaugugcguccaccauguuccaauacuggauaggcacauagcgcuugaaugccgccaccgggaccaugcccuggccgac

SEQ ID NO: 915 - RNA, 75 nt, infectious spleen and kidney necrosis virus
uccaauccaucauaugacacggccgcaaaaugagcugcgagcugcucggcuguggcguugagugguggcauggga

SEQ ID NO: 916 - RNA, 101 nt, Amsacta moorei entomopoxvirus
guaaaaggauuauugcauuuauuaaguauuaaaacauuaucuauauauuuugaauuauuuacuaauguuugaauauauuuaauacaauuuuguccuuguac

SEQ ID NO: 917 - RNA, 79 nt, African swine fever virus
uucagucuccuuaaauucuuccacgauacgguugagacuauuuggcuuuaguuucaccagaauuucaaugguuucugaa

SEQ ID NO: 918 - RNA, 73 nt, Human herpesvirus 4
cuccuguagcccccaguaaauggauuucagggagggaccguccuugcugucauucucuuggacuaacgaggag

SEQ ID NO: 919 - RNA, 91 nt, Human herpesvirus 4
gcuggaggaguucgucgggcucaacuccgcagccauauucacauccauguuccucaaauggcucgagggccugucgcagcucgucucuggc

SEQ ID NO: 920 - RNA, 130 nt, Human herpesvirus 4
ggggaggugaucacagcgcgucauguucuccggcagcuuuacauagagggucuccgucaugucaucaauguuggucaccuucagguguuugugcugaaaggugaaguaaucaaugacagucaccuucccc

SEQ ID NO: 921 - RNA, 94 nt, Melanoplus sanguinipes entomopoxvirus
gauaacauuccauuuucaacugaucuuuuauuuacaauaacaccaucuucaauauuuuuauuauaacuaaaaaauccuacuaaaauauguuguc

SEQ ID NO: 922 - RNA, 72 nt, Melanoplus sanguinipes entomopoxvirus
uaauaaaucugacuuaguuaaauauguggauuuaguuaaaaauucauauaauuuuaauauuucagauuguua

SEQ ID NO: 923 - RNA, 87 nt, Melanoplus sanguinipes entomopoxvirus
uucauuuuuuuuaauuuuggguauacguacauuuguucuauucuacauguaacaaauuuuguaauuccuuuagauaaaauaaaugaa

SEQ ID NO: 924 - RNA, 67 nt, beet soil-borne mosaic virus
acgcgccuuuaaugcugcucgaauaugugccauaguucgagcagcauuuaauugcuaauuggugcgu

SEQ ID NO: 925 - RNA, 69 nt, beet soil-borne mosaic virus
gaguugagcaccaccuuguauaccugugugaauauaucuuucagucuucccgggcauacgcucaaccuc

SEQ ID NO: 926 - RNA, 66 nt, beet soil-borne mosaic virus
uuuguacccauccuccaccaauguuuucucaauaauagagaaaacaucaucugggugggugacaga

SEQ ID NO: 927 - RNA, 55 nt, infectious spleen and kidney necrosis virus
cagacaugaugacggugauacuuuuuuauauaugaccgggcucauuuuucuucug

SEQ ID NO: 928 - RNA, 59 nt, infectious spleen and kidney necrosis virus
ccauagcuuacaggauagggaagccugcggcgccgucagcaaucuucaugauguugugg

SEQ ID NO: 929 - RNA, 131 nt, infectious spleen and kidney necrosis virus
cgguggccaggggcaugccgaugagcaggcccgccagcacggcggccagcugccacagguccacgcccugggccuuggcgguggccagcugcugaagcuuguucaccacauccugcaugcugcugcugcug

SEQ ID NO: 930 - RNA, 69 nt, Human herpesvirus 7
gccagagguauuuuuuuguuaggucugauguuuucggaaccaaauaauuuacguuuuacuuuacaaggc

SEQ ID NO: 931 - RNA, 85 nt, Human herpesvirus 7
gugcucagcuaaaacuuugcaacaagcaucuuuauauucuaaaggguauuugauuggauucaaaguacaagcuucauuugaguac

SEQ ID NO: 932 - RNA, 56 nt, Human herpesvirus 6
gaacgauuggauuuucaaaguuuccauuucuacaauggcucgaguucgauauguuc

SEQ ID NO: 933 - RNA, 102 nt, Human herpesvirus 6
gaguggacgcugacauucuaguaugcuuuaccucuuuagugacuucagugauugaguaugaugaauuacuagaugguaaagcguuguuaguuauguguacuu

SEQ ID NO: 934 - RNA, 59 nt, Carnation Italian ringspot virus
gcaucgagaccaauggcgacaggcuuaugaaaccuaucccacuucucccgaaaaauugc

SEQ ID NO: 935 - RNA, 65 nt, Carnation Italian ringspot virus
ucugcaccugcuuaagauuucugcguucuaguauaagaacacagucauccccacaguuugccaga

SEQ ID NO: 936 - RNA, 100 nt, Tomato bushy stunt virus
agcaaugcccaauugacccaagucgauaaguuugugaucagauguggaacugucaucacaaaaucucuuaaucuuaucgguggguacccuaagcaucgcu

SEQ ID NO: 937 - RNA, 108 nt, Tomato bushy stunt virus
ggaacaguguugaucaaaccuagaugcaucgagcccuauggcgacaggcuuaucaaaccugucccauuuagcccggaaaauugcaccuaccucaucagcuguguaucc

SEQ ID NO: 938 - RNA, 113 nt, Tomato bushy stunt virus
ggcacauaauguagcacaacgcuguugaauguguacugaucaaaauuggaugcuaucgcuggcaaccaagagaacaauguaccauucaacggguuaagcuguaacaaauugcc

SEQ ID NO: 939 - RNA, 61 nt, Tomato spotted wilt virus
gauagcuuuguugaucuauuucccuauccgaugguuagugaacaagacgacuaaaccucuc

SEQ ID NO: 940 - RNA, 126 nt, Tomato spotted wilt virus
guaaucuggguagacaucuaagaugagaauucuaaaacuacuagaacuagugguaaaagugagucuuuucacaauugcccugaguucuguuuuguuggcauucuugaucuucagagccacagaugc

SEQ ID NO: 941 - RNA, 60 nt, Tomato spotted wilt virus
guaggaggaaaauucuucauuucagaaagccugacacaagauaauuauccuauaacuuac

SEQ ID NO: 942 - RNA, 100 nt, Tomato spotted wilt virus
ucagagugucccauacuauccaaagaagcagaucaugacuacaacaaacauaaguggacuagcauggaaugguuccaucuaauagugaacacuaagcuga

SEQ ID NO: 943 - RNA, 57 nt, Tomato spotted wilt virus
uguccaagaauacaugacacuaccaaaagaaaccccuuucuuguauucuuggcuaca

SEQ ID NO: 944 - RNA, 92 nt, Tomato spotted wilt virus
uugcaggaaaaaucaagcuuuaacagguuuccaagauuuuuguguaacaccaacuucuuauuggggaugugaagaagcuugguguuuugcaa

SEQ ID NO: 945 - RNA, 64 nt, lumpy skin disease virus
aucaggcccuuuaguugucaauaucccuaauacaucaguauauguuguaacuaauauacuuugu

SEQ ID NO: 946 - RNA, 128 nt, lumpy skin disease virus
aucuuaaaauuucuuucucuguuccauuugucguacguauaagaucacauaugucaggauaaucuuuauuugucucuauuaaaggcuuguuucuauacgauaauuuguuuuuugaaucuuuugaguau

SEQ ID NO: 947 - RNA, 119 nt, Goatpox virus
uuugauaaauuaauauaugugcgcuuaauccucuggaacuuaucucaugaauaucgguuuuugauuucauuaguauuguauuugaaaaauaaguauauaaaauauuauuauuuaucaaa

SEQ ID NO: 948 - RNA, 123 nt, Meleagrid herpesvirus 1
cccauguggcuuugagcaaagaaaccgcauguucgauguuagauagcugauugcagugcuuguuguucaagccgcucaauacauuuuuagucguuaucacgggucgcuucguagccgucuggg

SEQ ID NO: 949 - RNA, 108 nt, Meleagrid herpesvirus 1
gcguguguguaaacaccuucaaggcgcaucuggagauuuaucccaucugggaaacgcagcccaauugauguggucagucuauuagcgcuuucauuacacagaacacgc

SEQ ID NO: 950 - RNA, 96 nt, Meleagrid herpesvirus 1
uacaagcuguagcaauagugaaggaucuauacugcaauuauuccccuccaguggguuuauauguagagaaucugcccauuugcaacaaagccugua

SEQ ID NO: 951 - RNA, 103 nt, Meleagrid herpesvirus 1
ucguuagaaacguugauaaacuuugaaaggauauuguggguuuaauguauuugcgcacgaacacugcaacaacaucacugucgagaaugucaaccucuaaugg

SEQ ID NO: 952 - RNA, 77 nt, Meleagrid herpesvirus 1
uguuaauguccguaccgaagccccaucuaugaucagagguuuuucugccacguggaaugcauuaucggacacaugca

SEQ ID NO: 953 - RNA, 59 nt, sheeppox virus
uaaaauuugauaauagauguauugauuagaaaaucaauaguucguuuugucgauuuuug

SEQ ID NO: 954 - RNA, 98 nt, sheeppox virus
uauuauagaguggaaauuggauauggguucauuuagugaauaaauauuaguuauauaauugccuaaaaauuuauauucgauaaaaucuacaggugaua

SEQ ID NO: 955 - RNA, 89 nt, Goatpox virus
uuauuauaccaaucaguacuaaauguguaauccgaaacuaaguuugcguuuuuuucuaauaauacauuuauaucaauuguaucuaguag

SEQ ID NO: 956 - RNA, 119 nt, sheeppox virus
uuugauaaauuaauauaugugcacuuaauccucuggaacuuaucucaugaauaucgguuuuugauuucauuaguauuguauuugaaaaauaaguauauaaaauauuauuauuuaucaaa

SEQ ID NO: 957 - RNA, 73 nt, Melanoplus sanguinipes entomopoxvirus
ugaaucauauaauacaaauuuaauauuuuggccuuucauaccaaguuuugauaauguauuuaaccauggauca

SEQ ID NO: 958 - RNA, 61 nt, Melanoplus sanguinipes entomopoxvirus
uuguggaaaaacaaguuuuaaguguuucauuauauaaacacuuguuaauguuuuaccauaa

SEQ ID NO: 959 - RNA, 69 nt, Equine herpesvirus 1
gcucucgaacgaugggacuguuuagcucuaccaguagugccaauaucucaucgugcgcaacaccggggc

SEQ ID NO: 960 - RNA, 113 nt, Melanoplus sanguinipes entomopoxvirus
accacgucuagucguaucagccauaauuuuaagauuuaauuuauuuaauacaucauuuauuccugcuaauguauuuaauaaaaaauuaauauggcuuguaauagauccuuggu

SEQ ID NO: 961 - RNA, 82 nt, Variola virus
auguuuuuuaucucuuucaguaugugaauagauagguauuuuaucucuauucaucaucgaauuuaagagauccgauaaacau

SEQ ID NO: 962 - RNA, 122 nt, Camelpox virus
cuucauuaugaauugauucuugagguauaaaccuaacacaaauuauauuauuagacuuuucguauguaaugucuuucauguuauaaguuuuuaauccuggaauagaaucuauuuuaaugagg

SEQ ID NO: 963 - RNA, 83 nt, Variola virus
gccauagucauagcauccggcuuauccgccucaguugucauaaaccaacgaggaggaauaucgucggagcuguacaccauagc

SEQ ID NO: 964 - RNA, 74 nt, Ectromelia virus
guuaauacgucuugcacguaaucuauuauagaugccaagauaucuauauaauuauuuuguaagaugauguuaac

SEQ ID NO: 965 - RNA, 71 nt, Camelpox virus
uugguaacucauucuauauaugcuuuccuuguugaugaaggauaggauauacucaauagaauuuguaccaa

SEQ ID NO: 966 - RNA, 122 nt, Ectromelia virus
cuucauuaugaauuaauucuugagguauaaaccuaacacaaauuuuauuauuagacuuuucguauguaaugucuuucauguuauaaguuuuuaauccuggaauagaaucuaucuuaaugagg

SEQ ID NO: 967 - RNA, 76 nt, Cowpox virus
gaacuagauauauuaauaaaguacucauuaggcaguuuauggcagcuugauaauuagauauaguauauuccaguuc

SEQ ID NO: 968 - RNA, 124 nt, Ectromelia virus
gacauucuauuuuuuguggauuaguauacucucuucccucuaucauguucacuacugguguccacgaugacaaauaucuagagggaauauaauauaguccauaggaugccaaucuagcaauguc

SEQ ID NO: 969 - RNA, 78 nt, Ectromelia virus
gauacgaauaugucuuuguuaaaaacaguuauuuucugaauauuucuaguuuguaauuuuaacauaugauauucguuc

SEQ ID NO: 970 - RNA, 53 nt, Cowpox virus
ugugauaauuuaugugugaggcaaauuuguccacguuuuuuaauuuuguuaua

SEQ ID NO: 971 - RNA, 81 nt, Human herpesvirus 3
uuguacuuuuuguuggaucgacggauuauuaauagugacauuuacguauuguacccgcaacgauucauccccucugaacaa

SEQ ID NO: 972 - RNA, 92 nt, Leishmania RNA virus 1-4
aguuugguauaucagccauuuugcucaagaauuguauacucaagguauguucacguggaauucuuggguuaaagauggcugguaugauagcu

SEQ ID NO: 973 - RNA, 68 nt, Leishmania RNA virus 1-4
cagcugaguuacaacuccgacgacuugguugacccuccaacaaccauucauugaaggggcguaaccug

SEQ ID NO: 974 - RNA, 58 nt, Leishmania RNA virus 1-4
cucaacccgggccguagcagccgcaaguuuguuaggaucaauacgcgucgguguugag

SEQ ID NO: 975 - RNA, 66 nt, Leishmania RNA virus 1-4
gcaacaacgccccagaaugugcuuaaauucuccacgaauaugucacagaaucggguugcgcugugc

SEQ ID NO: 976 - RNA, 65 nt, Leishmania RNA virus 1-4
uccgaauggugcguccuuauacauauacauuauguauuacuuguauaacaacuccaccacaagga

SEQ ID NO: 977 - RNA, 61 nt, Leishmania RNA virus 1-1
cauccuguccaagaauuguauacucaggguauguucacguggaauucuuggguugaggaug

SEQ ID NO: 978 - RNA, 58 nt, Leishmania RNA virus 1-1
cguagcgcauauucgaaccacauguaugauaacguaucacacgcgaguaacagccucg

SEQ ID NO: 979 - RNA, 103 nt, Leishmania RNA virus 1-1
gucgcgugccuauauggagguaguuucucuucagaucucucuacucggcaguugauccuauagacuugaauguaauuugucugcucuccauauacaacgccac

SEQ ID NO: 980 - RNA, 79 nt, Leishmania RNA virus 1-1
gucuugcugaagacuuguuugcuggcauuuaaccugacucccuuccuguugagauuagcuaucaaguuaucagcguggc

SEQ ID NO: 981 - RNA, 69 nt, Leishmania RNA virus 1-1
ucaccagguaggcuccuguugagaaugccacgacaacacacuauggcauucaucaaugccuccugcuga

SEQ ID NO: 982 - RNA, 128 nt, Leishmania RNA virus 1-1
uuggguugugcugccacuguuccaucacggcuuuucuguaugcuuguccuucuuuccuuguugcaaguucaggaugggcauguucuaaugcucgugaaugugacccauuugcagcccacagccaacga

SEQ ID NO: 983 - RNA, 111 nt, Cowpox virus
acauuuuccauuuauaacacuuauguauuaacuuugaucauuuauauuuuuucauuauuauguugauauuaacaaaagugaauauauauguuaauaauuaugguguggugu

SEQ ID NO: 984 - RNA, 74 nt, Cowpox virus
aucuaaugaugacguaaccaagaaguguaucuacagccaauuuagcugcauuauuuuuagcaucucguuuagau

SEQ ID NO: 985 - RNA, 122 nt, Cowpox virus
cuucauuaugaauuaauucuugagguauaaaccuaacacaaauuauauuauuagacuuuucguauguaaugucuuucauguuauaaguuuuuaauccuggaauagaaucuaucuuaaugagg

SEQ ID NO: 986 - RNA, 63 nt, Cowpox virus
ggaagagauguaacgggaacuggguuuguugauucacaaacuauucuaauacauaguucuucu

SEQ ID NO: 987 - RNA, 95 nt, Cowpox virus
uuuuguggauuaguguacucucuucccucuaucauguucacuacugguguccacgaugacaaauaucuagagggaauauaauauaguccauagga

SEQ ID NO: 988 - RNA, 109 nt, Chimpanzee cytomegalovirus
accucagucgguguccgacgccggcaguucccgggguagcauacgccacaguugcguucggggaccguggccgcugccgagcgugaguacgagauaccgacgccaaggu

SEQ ID NO: 989 - RNA, 130 nt, Chimpanzee cytomegalovirus
cgaguauaguucguugaaucaaggcuuugggaugaaaucuagguccggguugccaguaguaggggaugucuucgcgugguccgaggaguauaguguugucguugcgauguuugaguuugaagcaugcucg

SEQ ID NO: 990 - RNA, 68 nt, Chimpanzee cytomegalovirus
gaagauuauggccaacccaauucccauacuccgucgaguccgugguagauguaauguccguauucuuc

SEQ ID NO: 991 - RNA, 69 nt, Chimpanzee cytomegalovirus
ggcguccagcagcacgaaaugcggcgcgcgguauagauccgccggcccguuucguccgcugcuggcgcu

SEQ ID NO: 992 - RNA, 76 nt, Chimpanzee cytomegalovirus
gggugaggccggggcggaaggcgggucgucguucguaacgacgucguccuccccuucuucaccgccucgucucccc

SEQ ID NO: 993 - RNA, 131 nt, Chimpanzee cytomegalovirus
uguggagguguguuguaaugguguugagauugugaaaguauagccccccuccuccgcguccccccggggcccguccuuucuccuccuugcagugcguucauuguccguucauuguccguucauucuccgca

SEQ ID NO: 994 - RNA, 119 nt, Chimpanzee cytomegalovirus
uguugacgagcauaccguaucucccugacguagacgguguauguugcaacgaguccuaaacaguaaugguguguuguacgguuuugguauguugcggcugaaugguguguugaacggcg

SEQ ID NO: 995 - RNA, 131 nt, Equine herpesvirus 4
cacgagguuuuguuuggccuaccccgcaggucaggugcccacugauauaacgcguugguaaauucucuguuauuuagacgugagggugggcaucuaggcucgcacggccgguuggcaaguuccugaagcgg

SEQ ID NO: 996 - RNA, 70 nt, Equine herpesvirus 4
guuucgucucuggccagcauuccgcgcauauuuaaaauggcgcggaugucugcgugccaggguucgaaau

SEQ ID NO: 997 - RNA, 83 nt, Equine herpesvirus 4
ugucaaagugguagugccuguugcacgcgucuuuaaacaucaaaaaugggcuuccugucauuacagcacuucuaacuaugaua

SEQ ID NO: 998 - RNA, 68 nt, Equine herpesvirus 1
guaaauaagcacgcuuuaaaucaaacaacaacagguuguauggcuguaaaggguauguuuuuauuuac

SEQ ID NO: 999 - RNA, 123 nt, Equine herpesvirus 1
guguaagcuucagcgauggguuaaagcuugaaagcauccacgaguuuugcucugaguugauggccgccguuaucacacccgcagaugaaaucuggaugccgcccauguugcugaucguuauac

SEQ ID NO: 1000 - RNA, 76 nt, Rana tigrina ranavirus
gagauuauaucuuacaccucagucucgucuuagaaaguuucugagagagauuacaucuuaagaugucuuacaucuc

SEQ ID NO: 1001 - RNA, 58 nt, Broad bean necrosis virus
ugacuccuugaauuaccauuuaucacaauagcauuguucguagaggccaaguaaguca

SEQ ID NO: 1002 - RNA, 89 nt, Broad bean necrosis virus
uuguuucugcgaucaauuguuucuucgccugcucagauugauucugccaccaccucugagaggcuucaauauuacuaaucggagaacaa

SEQ ID NO: 1003 - RNA, 53 nt, Beet western yellows virus
agaaggaggcauugucaccagucgucuugauaugacaagucaaaucuccaucu

SEQ ID NO: 1004 - RNA, 58 nt, Beet western yellows virus
cacuggcugagggcgcugagcgcgucguguuugccugcguggucgucuucuuccauug

SEQ ID NO: 1005 - RNA, 66 nt, Beet western yellows virus
gauggaacccccggcgaugauaguagcggcugccacaucugcuuuggaauauccgggguucacauc

SEQ ID NO: 1006 - RNA, 98 nt, Cereal yellow dwarf virus - RPV
gaaggugauacuuccagaggaguugcccgcgagugaguccuuugugaaaacaaaugucucgccacggcccccuccuccgaguccuggaguucuucuuc

SEQ ID NO: 1007 - RNA, 50 nt, Cereal yellow dwarf virus - RPV
gagagguuaguucugcgguggcgccaacggcgggccacccgaaaccuuuu

SEQ ID NO: 1008 - RNA, 55 nt, Cereal yellow dwarf virus - RPV
gagcuggagagacuugauggcuucgaggaagucaauccgaaagucaucccaguuc

SEQ ID NO: 1009 - RNA, 59 nt, Cereal yellow dwarf virus - RPV
gaggccucgcugacgaacuguaagauacaaccugugaucuuauacucaugguaggccuu

SEQ ID NO: 1010 - RNA, 100 nt, Cereal yellow dwarf virus - RPV
ugccggcagaguaccaaaaguccaccucaauaucuuguaaauccagcucguuguaauaccgagcgauaugagagaggcgaccuguaaguaguagcuggca

SEQ ID NO: 1011 - RNA, 57 nt, Cereal yellow dwarf virus - RPV
ugcucaguuaucuuuugugguuaugccagauacuaaccacauaugcaauaacgcgca

SEQ ID NO: 1012 - RNA, 53 nt, Cereal yellow dwarf virus - RPV
uugcugagacaucccagaagggacacuuguguccggggauguugcaauagcaa

SEQ ID NO: 1013 - RNA, 58 nt, ictalurid herpesvirus 1
cgcgcgagaaacuguguucgugcagcguauucguuagcacggguacggacgccgcgcg

SEQ ID NO: 1014 - RNA, 74 nt, ictalurid herpesvirus 1
ggaugauguacucgggggggaugccuuccugguuggucgccacuaguuucaccaaucgccccccuauuuuaucc

SEQ ID NO: 1015 - RNA, 65 nt, Barley yellow dwarf virus - PAV
uauugugaccgcuucccugcacuauaacuaagagcuaauugcugugcaggguauguuuuacagua

SEQ ID NO: 1016 - RNA, 92 nt, Beet mild yellowing virus
gaacgugauugcuccgcuggaacuucccgcgagauugucuuuugagaaaacgaaugucucgcucgaaccuguuccucugguagaaacaguuc

SEQ ID NO: 1017 - RNA, 65 nt, Beet mild yellowing virus
ggagugguaagcggccaucacucgaauucuagaguuagacgaggagguguuguagcugccacucu

SEQ ID NO: 1018 - RNA, 60 nt, Cercopithecine herpesvirus 7
ccugcuugucccguguguccucaucuucugacgaggaugaggacgacgaugacgaggagg

SEQ ID NO: 1019 - RNA, 97 nt, Cercopithecine herpesvirus 7
gcgcugccgggccugcggcccucggggagguagacgggucgcaggggcgcgcccaguccccaucuguuagccgcccuguggcuguaugccgcaucgu

SEQ ID NO: 1020 - RNA, 89 nt, Cercopithecine herpesvirus 7
ggaggccgauuguggcgaaagauguggcgggcggguuuuuacuuauuguugaccgcagucccccccgcuuuugcauacguaucuccucc

SEQ ID NO: 1021 - RNA, 88 nt, Cercopithecine herpesvirus 7
ugcacaucgcgugaagcgcccccuuccauacauguagguccacaaaggcucucacccgguagggggucguauauuauaacgagccgca

SEQ ID NO: 1022 - RNA, 67 nt, Cercopithecine herpesvirus 7
ugcaugucacagaacuguuuauccaauaacgcacuguguuucauuuugaacacugauaugagaugca

SEQ ID NO: 1023 - RNA, 124 nt, Molluscum contagiosum virus
cagcagguugaagaugcccagcuccuugaggcucaugagcuccacggucaugcggaacaugcgccgcgugcuguggaagucgucauaggccugguacucggaaauggggaucuuguacuugcug

SEQ ID NO: 1024 - RNA, 102 nt, Molluscum contagiosum virus
gcaggucgcacggcugguagagguaguccaggcccucgccguaggugcccagcagcgccucgcacaggaagcucuuggccgccucgaugccgaagaucucgu

SEQ ID NO: 1025 - RNA, 92 nt, Molluscum contagiosum virus
gcgggguucaggugcgugaggaagacguacucgaugaagucgauguccgagacgccgaagaaguaguucucgcgcacguccucuaccaccgc

SEQ ID NO: 1026 - RNA, 112 nt, Molluscum contagiosum virus
ucgcgacgaaagcgcgagugcgccacgggcccggcaagagcgcgcgucccuguuguccuggcaagagcgcgcgucccuguuguccuggcgagagcgcgcuucuuuuccgcgg

SEQ ID NO: 1027 - RNA, 131 nt, White clover mosaic virus
agcgaagcuagccaaccagucuuuacuuugcuucuugagaagugcgccuauucguagauuuuuuacaucagauccauaggcgcgagcucugugguugucaagugggacagugguuggcucucuguguaguu

SEQ ID NO: 1028 - RNA, 115 nt, White clover mosaic virus
gcuugacugaggcaacguaaucgauggacauaucaucgccagcauacacuugugcggcaucgcaugguauguugaauuugguguguguauaggcaauguuugcuucaguguuggc

SEQ ID NO: 1029 - RNA, 55 nt, White clover mosaic virus
ggaggauuucgaagaguguuggguugucgcaaccugagauuucaauggaagcucc

SEQ ID NO: 1030 - RNA, 97 nt, Human herpesvirus 8
ccugggcagccuaagggccaugugccuugggagucagcugcgccuguuuucgugccccaccuccccgcgccguguggccgcguuggugcugccuggg

SEQ ID NO: 1031 - RNA, 130 nt, Sulfolobus virus SIRV-1
ucguuuaacuuuuuucaaauucauuuccuguuucaccuaucucuaaaaaucaaaaauucuaugacauuuuuauaucuuuauuuuuuggaauaaguaggauuaauauuuggaauuugagaaaaauuaucga

SEQ ID NO: 1032 - RNA, 128 nt, Human herpesvirus 8
ucuggucugauuacaugucucagaacaggcugccaggccagcuacgccagcgccaggggauggguccuggcgcuguguaacgacccuaccugugccuccacccugacagaguuucuaaacagacccga

SEQ ID NO: 1033 - RNA, 114 nt, Strawberry mild yellow edge virus
caugagacuuuccacggcggauagcuaauugcagggaggcguagaguuucagaggauccuugaucacucccuucggcguuauuauccagccgcaaaacguggcaaagucuccug

SEQ ID NO: 1034 - RNA, 63 nt, Strawberry mild yellow edge virus
cauugcaacuguccaggugggcgacuaccaugaaguaguugaccaugugugucaguugcauug

SEQ ID NO: 1035 - RNA, 99 nt, Strawberry mild yellow edge virus
gcaggcagauguguagguaugucagggguagguccgggaccagaguagcaaaugcuuuugguuccgucggaauacuucccuccguauggcagugaaugc

SEQ ID NO: 1036 - RNA, 74 nt, Meleagrid herpesvirus 1
gguuggaaauuacacgacuggcguaauuuuugguauacauuauggcugaaaugcuaucucggucauuucuaacc

SEQ ID NO: 1037 - RNA, 67 nt, Meleagrid herpesvirus 1
guaguccaauucuaagcaaugaguauuaaccaucuacuuuauucauuaacuuagauuuccggacagc

SEQ ID NO: 1038 - RNA, 90 nt, Meleagrid herpesvirus 1
ucccgcuccauuagcacagcuuguugaauaauucuagaaaugccccccaauguagcacucccuaucagcagguaagguggugggacggga

SEQ ID NO: 1039 - RNA, 92 nt, Meleagrid herpesvirus 1
uuuuauuggcguguuuaugauuccucccgcuucgcgccaaauuacugagcgaaauguggagugcgagguugaaaucgucaugcaacauaaaa

SEQ ID NO: 1040 - RNA, 60 nt, Melanoplus sanguinipes entomopoxvirus
ugauauauuacacguuuuugagcaacuuuaacuauauuaaauucaggaugugauguguua

SEQ ID NO: 1041 - RNA, 81 nt, Mayaro virus
cgguccgagccaugaacugcgccgucggcaacauacccguuucgauggauaucgccgacagcgccuucacaagauugaccg

SEQ ID NO: 1042 - RNA, 125 nt, Mayaro virus
ugugaaccagacaguugaggcguaugugaacggugaccaugccguaacgauugccggaacaaaauuuauuuuugggccagugucaacgccuuggacaccguucgauacaaaaauucugguuuaca

SEQ ID NO: 1043 - RNA, 67 nt, murid herpesvirus 4
cuacugauugguuacgcccaaaaauccgacccagccauuggauaaaacgugcuagccaaucaggugg

SEQ ID NO: 1044 - RNA, 64 nt, murid herpesvirus 4
cugggcacaguuugauaauguaagaucuccccacacuguccacugaaaugucauaauugcccag

SEQ ID NO: 1045 - RNA, 56 nt, murid herpesvirus 4
uuugaaauuuggguccgcugggauauuuaaauagcaccagagggucaguuuucaga

SEQ ID NO: 1046 - RNA, 57 nt, Potato mop-top virus
cgcauucuuaggagucucacaagcaccgcugugaaacugaccauaaauaaaaucgcg

SEQ ID NO: 1047 - RNA, 95 nt, Canine adenovirus type 1
aguaaaagucccgucuucuaagugugcaggugugaguaacuuugaaaaaagacccgcaaaacucacacuuuugcauuggggaaaugucuuuuauu

SEQ ID NO: 1048 - RNA, 61 nt, Canine adenovirus type 1
gguaaguuaacagaguuuuuuauaaaaaucugguaugauucuauaagcuuguuaacuagcu

SEQ ID NO: 1049 - RNA, 82 nt, Tulip virus X
aacccauaggauacguggaguggggaaggguuugaggaauacaccccaagcuuguuggccaguucuuucacguuccuauggg

SEQ ID NO: 1050 - RNA, 55 nt, Tulip virus X
acccagcgacucagguccgcgggaguccucucacaguuaaucaugauguuguugg

SEQ ID NO: 1051 - RNA, 83 nt, Tulip virus X
acggguugccacugaagagccuugaucaguuucguguggucugggcugcccuugaagaaccugacuaaggcuugccaguuaac

SEQ ID NO: 1052 - RNA, 131 nt, Tulip virus X
gcuucgucuuuggcuugcuggugggagaagaguuggacggugagauccucgguuuggacgcaguuggugaagccgugguugguguugaggauuucucugucguacuugucggccagggaguccuggaugag

SEQ ID NO: 1053 - RNA, 116 nt, porcine epidemic diarrhea virus
aaaauuacaacacuccuuauaaaacuuacagcugcguagugagaggugauaaguguugcaucacuugcaccuuacaguucaaagcaccaaguuauguggaggaugcuguuaauuuu

SEQ ID NO: 1054 - RNA, 76 nt, porcine epidemic diarrhea virus
aaccaggauucauaugguggugcuuccgugugucuauauuguagagcacauguugagcauccaucuauggaugguu

SEQ ID NO: 1055 - RNA, 102 nt, porcine epidemic diarrhea virus
accaguuuugccuaauuuugaaccuuucaggauugaaggugcucaugcuuucuaugagugcaacccugaagguuugauguccuuaggugcugacaagcuggu

SEQ ID NO: 1056 - RNA, 110 nt, porcine epidemic diarrhea virus
accuauagguagccccgucugugaugauguuguugcugguuaugcuaauucuaguuuugacaagaaugaguacugcaacaguguuauuuguaaggucugucucuaugggu

SEQ ID NO: 1057 - RNA, 130 nt, porcine epidemic diarrhea virus
cauacuggguuuaccuuuccuagcgaaguuguuaacgguaggcgugugauuaaaaccacagauaauaauuguuggguuaaugucacauguuuacaauuacaguuugcuagauuuagguucaagucagcag

SEQ ID NO: 1058 - RNA, 91 nt, porcine epidemic diarrhea virus
ccugguuauguuacaccuauguuugcgugcuugucauugcuauccucacuuuugauguucacacucaagcauaagacauuguuuuuccagg

SEQ ID NO: 1059 - RNA, 71 nt, porcine epidemic diarrhea virus
cugcuuuuugguauguugagacguuuggauaugucuucuguagacaccauucucaacuuggcaaaggaugg

SEQ ID NO: 1060 - RNA, 71 nt, porcine epidemic diarrhea virus
cuuucuauuaugauggaacacuauacuaucccaccgaugguaauaguguugugccuaucuguuuuaagaag

SEQ ID NO: 1061 - RNA, 83 nt, porcine epidemic diarrhea virus
gagcauuguaauguacauagaaacgagcauguggcuucuggugaugccauaaugacucgcugucuggccauacaugauugcuu

SEQ ID NO: 1062 - RNA, 99 nt, porcine epidemic diarrhea virus
gcaauuaggguuuucuaacgguguugauuuuguugucagaccugaagguugcguuguaacugagucuggugacuacauuaaacccgucagagcucgugc

SEQ ID NO: 1063 - RNA, 129 nt, porcine epidemic diarrhea virus
gccaguccuuguggccucaugcucugcuaugccugguucuguuguggucacacgcgcuggugcuggcacugguguuaaguacuacaacaacauguuccugcgccauguggcugacauugauggauuggc

SEQ ID NO: 1064 - RNA, 93 nt, porcine epidemic diarrhea virus
gguuucacagacccuugcuacuuuuugaaugauucgagccuugcuacuaagcuuaaguucgacauccuuaguggcaaguuuucugaugaaguc

SEQ ID NO: 1065 - RNA, 120 nt, porcine epidemic diarrhea virus
guuuuugaucauggcacugguauggugcaugauggcgaugcuuuuguaccgggugaucuuaauguaucuccuguuacaaauguuguugucucagagcagacggcuguugugauuaaagac

SEQ ID NO: 1066 - RNA, 87 nt, porcine epidemic diarrhea virus
uauagaugccuacccguuaucuaagcaugaaaacccugaauauaagaagguguuuuaugugcuuuuggauuggguuaagcaucugua

SEQ ID NO: 1067 - RNA, 120 nt, porcine epidemic diarrhea virus
ucccugucauggccccugguccuugggugugagcguauuguuaagcuccagaauaaugagauuauuccugguaagcugaagcagcgcuccauuaaggcagaaggagauggcauaguugga

SEQ ID NO: 1068 - RNA, 95 nt, porcine epidemic diarrhea virus
uccgauuggacugauguuucugacuacagguuggcaaaugaugucaaggacucauugcgucuauuugcagcggaaacuaucaaggccaaggagga

SEQ ID NO: 1069 - RNA, 89 nt, porcine epidemic diarrhea virus
ugauauauuuggugaggauuuuaagucauaugaccugcuggaauaugauuucacggagcauaagacagcacucuucaacaaguauuuca

SEQ ID NO: 1070 - RNA, 130 nt, porcine epidemic diarrhea virus
ugcuacuaagcuuaacauuguuaccucugauaucgauucuuauaaucguauccagcgugagggauguguccacuacgcugguaccauuuggaauauaauugauaucaaggacaaugauggcaagguggua

SEQ ID NO: 1071 - RNA, 124 nt, porcine epidemic diarrhea virus
ugcuuaagaaccuuauugaugguguugaaaauccgugucuuauggguugggauuacccaaagugcgauagagcacugcccaauaugauacgcaugauuucagccaugaucuuaggcucuaagca

SEQ ID NO: 1072 - RNA, 109 nt, porcine epidemic diarrhea virus
uguacuggugauguugcuauguuugugcauugguuguacuggcuuacugguguugacaaaggucagccuagugauucagaaaaugcacuuaacauguuguccaaguaca

SEQ ID NO: 1073 - RNA, 87 nt, porcine epidemic diarrhea virus
uguccacauggucuuaacuacauuggcaaaguuguuguaguuaaagguacuacaauuguugucaauguaggaaaaccuguaguggca

SEQ ID NO: 1074 - RNA, 101 nt, porcine epidemic diarrhea virus
ugugaaucucgucgucguugacgaggauguaacccucaacaccacuggucguacaguugucguugauggacuugcauucuucgagagugacggguuuuaca

SEQ ID NO: 1075 - RNA, 112 nt, porcine epidemic diarrhea virus
uguuacggaugcaccaauugauuccgagggugaugaaguagacuccucugcaccugagaagguggcagauguggcuaacucugaaccuggggaugauggucuuccuguggca

SEQ ID NO: 1076 - RNA, 128 nt, porcine epidemic diarrhea virus
uuuugaguguuuuaugccuacaaucccacaguguccagcagugcuugaagagauugauggugguagcauauggcggucuuuuaucacuggucuuaauacaaugugggauuuuugcaagcgucuuaaag

SEQ ID NO: 1077 - RNA, 81 nt, Poinsettia mosaic virus
cgaugacggguggguugacgaaugcugguggccucggggagaagaacggcggcuggcacgucgaagcugacgaagucauug

SEQ ID NO: 1078 - RNA, 65 nt, Poinsettia mosaic virus
cuaagagaggugcggcaaccgugucgcgguggacggugcuggauagguuguugaaagcgucuugg

SEQ ID NO: 1079 - RNA, 84 nt, Poinsettia mosaic virus
gagcucugcgagcaagcgagggugauguccuggggugcgauaaaggagcugaagcccacguaaccuucgugcucguuugagcuc

SEQ ID NO: 1080 - RNA, 57 nt, Poinsettia mosaic virus
ggagucgacgugguuggauucgagcuguuugacgacuuggucugacaugucugcacc

SEQ ID NO: 1081 - RNA, 77 nt, Poinsettia mosaic virus
gugcucuggcuuguuggacugugugcgaacaaagccgacuggaucggagaugcgcagaguccgaacggcucgagugu

SEQ ID NO: 1082 - RNA, 77 nt, Strawberry mottle virus
accaagaugaagaggguuagggaagugccaaagacucgaauuuuugagauuuuacccuuccacuauaauauccuggu

SEQ ID NO: 1083 - RNA, 91 nt, Strawberry mottle virus
agaguugacggggguuggcuguguuaaucuccuagcuucauauucuucaaaugacgcuaguuauuacacaggcuuagccauguugacuacu

SEQ ID NO: 1084 - RNA, 60 nt, Strawberry mottle virus
cucccauguaagguaggccucaacguuuacaguaagaguugggauacuaugcaugcugag

SEQ ID NO: 1085 - RNA, 90 nt, African swine fever virus
cuccuuuugauauucaaucgucuuauucauugaauauuuguauauaacuauaauuacaaauguucaaugaauuguuauucaugucgggag

SEQ ID NO: 1086 - RNA, 82 nt, Strawberry mottle virus
ggaaaucuuguuaaauggauggaauuuucagaacuugauuuccucaagaggagauggguucuuuauuccggacaagguuuuc

SEQ ID NO: 1087 - RNA, 65 nt, African swine fever virus
ggaugaggccguuugucucggccucgcugauuuuuugcacgaacugagauauaucguucucauuc

SEQ ID NO: 1088 - RNA, 68 nt, African swine fever virus
guguauacacuuuguauuuacuuugagauauacuuuguguaucacaacgugcccuaagaugugugcac

SEQ ID NO: 1089 - RNA, 78 nt, Strawberry mottle virus
ucauggacucaagggucucgcugauggguacgagaaauucaaaucuaucacugagaaacuagcuuucuggguuuauga

SEQ ID NO: 1090 - RNA, 130 nt, Human herpesvirus 2
aacgugguggguuuggcggucucguccccgacggcguucaccaccuucgugagcuggggcuucgugaggcgcagcuggacgucggggucgcccugggggaguaguaccgcgaagcucgucaacucgcguu

SEQ ID NO: 1091 - RNA, 81 nt, Human herpesvirus 2
gcaccgaugccgugccgcuggcguugcgccgagagaacgacacggagucgcggugccacgucagcuggcaggugaaggugc

SEQ ID NO: 1092 - RNA, 131 nt, Human herpesvirus 2
gugggugugguucggggggcggaugcguuccgcggggacgcggagggggcggcauugcucgcguucccccgcgggcccaccguuaucgugcguccgggggaggcauuggccagcaccacgaccacacccac

SEQ ID NO: 1093 - RNA, 67 nt, Porcine adenovirus C
ucagauuggagauguugccggcgugguccuuccugggguucauguugugcaacacuaccaggacuga

SEQ ID NO: 1094 - RNA, 117 nt, Chimpanzee cytomegalovirus
gucugggcgucacgcguugucgcaugagcgcgcgguugacguagaaggccgacuccgagaucggccggccguuggcgucgcgcugcagguccgcgcgguugccguggcgcagcugac

SEQ ID NO: 1095 - RNA, 91 nt, Chimpanzee cytomegalovirus
ugacgaagccguuggccucgucggccucggccacguuccacgaaccgaaggugaaggugcaggccggcgagccgcccagacggaucuugca

SEQ ID NO: 1096 - RNA, 59 nt, Duck adenovirus 1
gcguacgugcagguaauguaucaauaaaacguuguauacuuugcccccgguuucuacgc

SEQ ID NO: 1097 - RNA, 70 nt, Camelpox virus
auaauaggaacaugauauuuucuguaccauuucaccaacaaguauagaaaugcgaaucuguaucuauuau

SEQ ID NO: 1098 - RNA, 102 nt, Camelpox virus
aucuaugauuccgguauucauuuagauaugugauaucuucuauaaauauaugagcauauauuuacggagaugaaauauccucuaugaauauauauugcagau

SEQ ID NO: 1099 - RNA, 64 nt, Camelpox virus
gaacaacaaagcgauuauuguuuuaccugaucccauaauauggaacaauaacacgcuucuguuc

SEQ ID NO: 1100 - RNA, 79 nt, Camelpox virus
uaugaaaacuuguuuuaucucuauuuguagacuuaguuaaugaaaaauuagaucucauggauuuuauuacauuuucaug

SEQ ID NO: 1101 - RNA, 88 nt, Camelpox virus
uuucucgaauuggcggucucuagcugcuggaugauaucccacuaugguaguuacuggagauucuaacuuggcccguauauucgagaaa

SEQ ID NO: 1102 - RNA, 69 nt, Monkeypox virus
aucguauugugguuauauggcuacaauuucauaaugaguugaagucaguguccuaugaucaaugacgau

SEQ ID NO: 1103 - RNA, 130 nt, Monkeypox virus
auuuggagcuuuaauaguaagaacuccuaauauauccguguauguggucacuaauacagauuguaguucuauaaucguaaauaauuuaccuauauuauauguuugaguuuguuuagaaaaguagcuaagu

SEQ ID NO: 1104 - RNA, 78 nt, Monkeypox virus
gauacgaauaugucuuuguuaaaaacaguuauuuucugaauauuucuagcuuguaauuuuaacauaugauauucguuc

SEQ ID NO: 1105 - RNA, 63 nt, Camelpox virus
ggaagagauguaacgggaacaggguuuguugauucgcaaacuauucuaauacauaauucuucu

SEQ ID NO: 1106 - RNA, 95 nt, Monkeypox virus
uuuuaggaacuauguucaugguauccuggcgaauauuaaaacuaucaaugauaugauuaucguuuucaucuuuuaucaccauauaguuucuaaga

SEQ ID NO: 1107 - RNA, 131 nt, Saimiriine herpesvirus 2
aaaaugcuacaaauaauaauuuuaaauauaauuuauuuuacauuuauuauguaugguacauguugcggguaucucaacaaauaauuaguauuacauggucgaucugaaguuuuaaaauuguaguuuguguu

SEQ ID NO: 1108 - RNA, 66 nt, Saimiriine herpesvirus 2
aagcaguuucuuggauaauuuccauaguuguugaaucuaugacaugauugaguccagaagcuacuu

SEQ ID NO: 1109 - RNA, 77 nt, Saimiriine herpesvirus 2
augaacaguuggcuguccaaugaacacagauguggaagcuuuagagcuauacauuauguguucagcaacaacuucau

SEQ ID NO: 1110 - RNA, 74 nt, Saimiriine herpesvirus 2
cguagacaauuugauauaaauucauggugugagcaucuucugaucugaugccguaaauguuuaaguugugcacg

SEQ ID NO: 1111 - RNA, 72 nt, Saimiriine herpesvirus 2
uuauaauaaauuguuuuugcuuuugugggcggcgcccgucuccaugagcaauuguaggcacauuuauuuuaa

SEQ ID NO: 1112 - RNA, 70 nt, Ononis yellow mosaic virus
cgaccaugcuaggggauuguuguccuggguuuggagacagaugagucccaggagcagagauggaggguug

SEQ ID NO: 1113 - RNA, 89 nt, Barley stripe mosaic virus
aagccauguuuggagacuuucugugguuuguuccaaauacucucucgagugucuggaagaacaugcgaaaaucacugauggaaugguuu

SEQ ID NO: 1114 - RNA, 129 nt, Barley stripe mosaic virus
acuaucaacuguguagcgugauuugugaaagggcucagauuuugagugucaucgaagacuuucgucagaauuugauauucucagauaaaguggccguuccauugaacgcuagauucuacaguuuucagu

SEQ ID NO: 1115 - RNA, 107 nt, Barley stripe mosaic virus
agcuuauuacuugcugaaggaccuuguguaccgcaagcugauagguuucauuuugaugaagcucuaaaaguucauuacggcgccauaauguucugugcugauaagcu

SEQ ID NO: 1116 - RNA, 123 nt, Barley stripe mosaic virus
cuggagauguugccuucuauuugagugcuaaggaauuuuacaaaguuaaaggaauaccucaaaagguuauaacuucuaacagugugaaacguuccuuguacgcuagaggcgaaacgacuccgg

SEQ ID NO: 1117 - RNA, 131 nt, Barley stripe mosaic virus
ggcccagaagguaacagggacggugaccgaaugcgagaaggaccugggaccucuuguucaaccgauaaaagagauauugguucaacuugugaugcccaauuuggucagagcgcuguguagaccucguagcc

SEQ ID NO: 1118 - RNA, 87 nt, Barley stripe mosaic virus
uccuguuuccuccugcuguauugauaggucagaaggaaggcauuuuaccuuccguggacggucauuacuugguggagaauggcagga

SEQ ID NO: 1119 - RNA, 79 nt, maize rayado fino virus
augcgggccaggucagcggguacggcgguggugcuggacagcauaacaggcccgcccacggugaucugacggcccccau

SEQ ID NO: 1120 - RNA, 64 nt, maize rayado fino virus
gcguuagccaugaugguugccugggucuuggaagagagcugcgcaaacucguugagguugaugc

SEQ ID NO: 1121 - RNA, 128 nt, maize rayado fino virus
ggcggagucggcaaagagcacuggcgggcggcaggcuggaugggucucccaaagaaaccuuggcucggggccauggaaugggagacgaggccagaaccuccggccgaugaugucgaagccgaacagcc

SEQ ID NO: 1122 - RNA, 65 nt, Beet mild yellowing virus
gcaccgcaagccacguacauuguaccucaaaagaggaauaugacgaauggccgagaugcuggugc

SEQ ID NO: 1123 - RNA, 84 nt, Beet mild yellowing virus
ggcaaccuugaaguucugacgaacuaucuugcagcuuguuucucaauuuuaaacgagcugagauccgaucaagaacucguugcc

SEQ ID NO: 1124 - RNA, 66 nt, Beet mild yellowing virus
ggugagcuccccaaguuuuacuucucuaaacaaaaaggaugcucggauuggggcacgaagcucacc

SEQ ID NO: 1125 - RNA, 130 nt, Chayote mosaic tymovirus
gaaucaucaccugagacgaagacugguuggucgguuauggcguacugacuaaaaaugguggccagauuguagucaguguugucgucauaggugccggguucgccggucagacgcaugcaggugagugggc

SEQ ID NO: 1126 - RNA, 72 nt, Chayote mosaic tymovirus
gcugguuguagcugccggcgugauggcuuucggggguguaauggagagacgagccggucacuuggaauuggu

SEQ ID NO: 1127 - RNA, 95 nt, Chayote mosaic tymovirus
gcuugggacguuacccaagagugcucggguuuguugcugugcaugcgaacgaagccugcgggauccgagacgcgaaggguucggacggcccgagu

SEQ ID NO: 1128 - RNA, 57 nt, Bamboo mosaic virus
gagguuuuucgauugucuaauggcgaacgucgguuuggcuagguaguaggugaccuu

SEQ ID NO: 1129 - RNA, 54 nt, Bamboo mosaic virus
gcuucgguaguugcugcgucuguguaauugaugccgaugagcgacuggacgagc

SEQ ID NO: 1130 - RNA, 119 nt, Bamboo mosaic virus
ggacgaucguggcgagcagggucucuaguuguggggagcuugugaaaaugugcuccagcaccucaggcuggaaguaaugcaggcuguccccaauaaaagccaucuuuguugugauuucc

SEQ ID NO: 1131 - RNA, 74 nt, Bamboo mosaic virus
ugguagcaguugccccuaauggauauagugugcccguuuauuauuauuucacauggugggggcagaugcuguug

SEQ ID NO: 1132 - RNA, 61 nt, Fowlpox virus
guuaaauauuguccuuauauauucaucuucuauuucgugaagguaugaaaacaauucauac

SEQ ID NO: 1133 - RNA, 81 nt, Fowlpox virus
uagaaaauuuuaaaauaucguauagcuuguaguuaucuuuugauacuauaucuucuauagcgaauguauuuuuauauucua

SEQ ID NO: 1134 - RNA, 118 nt, Cercopithecine herpesvirus 7
gacguucguuuccaggagccauaaacugcugugugguuaaaugugauuccaauguccaagcugguguaguuggggucauaucuggccauaguuccauaaaucguuccauuugaauguc

SEQ ID NO: 1135 - RNA, 74 nt, Cercopithecine herpesvirus 7
ggucguuuaaauugauacucugugucggcuggacuuugagaacaaaccgcacgagauucuaaaauuaaacgauc

SEQ ID NO: 1136 - RNA, 69 nt, Cercopithecine herpesvirus 7
ucguucaauagaucuggcaacaauuuuuccuauuaaaucucuugauaguuguuguggaauuguuaacgg

SEQ ID NO: 1137 - RNA, 88 nt, Cowpox virus
auaaaaauauuuuuacgacuccaucagaaagagguuuaauauuuuugugagaccauugaagagagaaagagaauaaaaauauuuuugu

SEQ ID NO: 1138 - RNA, 76 nt, Cowpox virus
augguucaugcgguguuauaucgcuguuuauuaugauuauacaugaaagcagcaauagcaauauauaugacuucau

SEQ ID NO: 1139 - RNA, 85 nt, Cowpox virus
uuuguggugugccugaaucgcucgauuaacccuacucauccaauuucagaugaauaggguuaucgauucagacacacgcuauaag

SEQ ID NO: 1140 - RNA, 91 nt, Cowpox virus
uuuuucuuaguacaaaagucaauguuuuaaaauauauggacaagaauuugucuguauaaaaacuugugugaaauuuuguaccaaagaaaaa

SEQ ID NO: 1141 - RNA, 51 nt, Cowpox virus
gagaugguuuugauccaagguugauuaauguuggaucuaacuguaguacuc

SEQ ID NO: 1142 - RNA, 100 nt, Camelpox virus
gcaaaacaauauugaccguuauaaaugucuuugucgaugauauauucgacgcuuccaauugugauauauccagagauaucuuguaauggcgauaucuugu

SEQ ID NO: 1143 - RNA, 76 nt, Camelpox virus
uuggaaauccuguuucaaaguaacuuauaucaucuuuauaauaugaucugauauacucacaaauuuucuuuuccaa

SEQ ID NO: 1144 - RNA, 92 nt, Swinepox virus
uauuaucauuacauguauuaauaucaaaaaacugagaacacuuacaauuacuuuuauucuuuucauugauaugauacaccaaaggauuaaua

SEQ ID NO: 1145 - RNA, 80 nt, Meleagrid herpesvirus 1
gauauccuagcauugugaaguagaacauuaaauguauuggggaucagauuccuaccauuuaguggaugccugggaucuuc

SEQ ID NO: 1146 - RNA, 87 nt, Meleagrid herpesvirus 1
gcuucguaugcauugaauuaccaaucgcaugagcagcccaaaguuacguucgcugccaugaauuacggcuucgaugauauagaaagc

SEQ ID NO: 1147 - RNA, 61 nt, Meleagrid herpesvirus 1
ggccauggugcaaugcaccaucgaacguucucaugcgucugguggaugcagaugcgccgcc

SEQ ID NO: 1148 - RNA, 73 nt, Ectromelia virus
aacuguagugcucaaauacucaucagauuuuuuaccggaaaaguaauuugcauuagugccuccauguacaguu

SEQ ID NO: 1149 - RNA, 74 nt, Ectromelia virus
ccguuauaaaugucuuuguagaugauauauucgaugcuuccaauugugauauauccagagauaucuuguaaugg

SEQ ID NO: 1150 - RNA, 72 nt, Camelpox virus
ggaaauccuguuucaaaguaacuuauaucaucuuuauaauaugaucugauauacucacaaauuuucuuuucc

SEQ ID NO: 1151 - RNA, 95 nt, Ectromelia virus
ggaacgucugaugaacaaaaguaaagauauugacuuggaugguauuuucugacagaaaacaucuuugaaaucuuuacuugaucaggauaaaaucc

SEQ ID NO: 1152 - RNA, 79 nt, Cucumber green mottle mosaic virus
acgggauuugcuuagcaucaccaaagacgaaggcuuuuuuacaaccugagaucuuuaacgcaaaauuaaguaaucccgu

SEQ ID NO: 1153 - RNA, 115 nt, Cucumber green mottle mosaic virus
gucauaugaaaggaagauuaugcgagugguaucgucacuugccagaaccacggcccaugcgugcuucuucucggcuggcaacaauaaccacuugcacuuuucgcagucauacaac

SEQ ID NO: 1154 - RNA, 91 nt, Rana tigrina ranavirus
gagguguaacuuuugcagaauaucuuacgauaguaacauuaagauguuacaaucuuaaguuucuuuauacuuucagaagauauauucccuc

SEQ ID NO: 1155 - RNA, 95 nt, Rana tigrina ranavirus
gugaucaggacagacaggaggucagucaggacggccggggcgucccugcgggcccuggcaaucaccagccuccucccccugcugguccugaugac

SEQ ID NO: 1156 - RNA, 68 nt, Melanoplus sanguinipes entomopoxvirus
gaugaguaaccaguaauaacuucaugaauuaaaucaguuucaaauaauuuauuacacaauacuguauc

SEQ ID NO: 1157 - RNA, 130 nt, Cucumber fruit mottle mosaic virus
aaauccuagcaagaauaucaucuagaccuaaacguucccaaauaagcaucuccacagccugaugaaaaucauucugugauuuaucauauuuggaaacaucuagcucuagaaucucauacuccugcuuauu

SEQ ID NO: 1158 - RNA, 86 nt, Cucumber fruit mottle mosaic virus
agaaguagaguaagacaucuugauuaugaacuuaguggcucagaagcgccgcuauccgaaaaagauucugccucacucuuacuuuu

SEQ ID NO: 1159 - RNA, 128 nt, Cucumber fruit mottle mosaic virus
cucuuagacccuucuuuaaaauagaauuggugguagccaccaaagaggcaaucuccagaguuaacggagaaaaaccaucuuugauccuaacaccagaaauccuaacaaacaaagaccaggguuuggag

SEQ ID NO: 1160 - RNA, 98 nt, Rift Valley fever virus
acucuguagauuagcuguagcuuauagcucucacuguauggaccuuguaguauacagaauagaaagugcuugagaauuucagcugacacacuacgagu

SEQ ID NO: 1161 - RNA, 105 nt, Rift Valley fever virus
auagaauguguagguccugaugagaauggugcuugguguacaaguuagaguagaccuaccaugaaaagacuccaucucguaagggccacuaacauccaacucuau

SEQ ID NO: 1162 - RNA, 58 nt, Rift Valley fever virus
ucucuggauaguucugcauaagcaguuuaauaaguaaacuugcagcucugaccugaga

SEQ ID NO: 1163 - RNA, 121 nt, Odontoglossum ringspot virus
aguuucucccaaaugaaguacucaacagcacaauggaauucguucugggauuugucauacuuugaaaugucuaacacuagagcuuccauuggcaccgucgaguccaaaucugagagaaacu

SEQ ID NO: 1164 - RNA, 125 nt, Odontoglossum ringspot virus
ggauaauuuuaaaggugaaucucuucuugcaagcagauguaugauaagagccaaguguugcuucauuagcucuuuucaugcguuugucuacaagacagauacucacaccaccuuugcaauugucc

SEQ ID NO: 1165 - RNA, 100 nt, Odontoglossum ringspot virus
ggucuguaauaguguaagacauauucaauacgauucagauugugcgucaaaugacucacaaucaucaucaauacgaauaucacuaacaccauuaccaacc

SEQ ID NO: 1166 - RNA, 105 nt, Odontoglossum ringspot virus
gugauaaccuccuaaccucccuacgauguaaacaaguguggccaaaauguuucggauaagggaaauuugccacucuguuuauaaagggaauuuguucaguaucac

SEQ ID NO: 1167 - RNA, 90 nt, Odontoglossum ringspot virus
uuauaauuuuaucaaccuuuggaauacguaccgacuugacagccguuaaagcugacgguaguaguuuuucaaaggcugauaaauuaauaa

SEQ ID NO: 1168 - RNA, 65 nt, Human herpesvirus 4
aagaaggagaccacguugaguccguuugcgcagcggcugaugaccagcugguugcucccauucuu

SEQ ID NO: 1169 - RNA, 60 nt, Cactus virus X
cguugucaaagcaguaauuaacuauuucuagugauaguggagugagguugguggcagacg

SEQ ID NO: 1170 - RNA, 69 nt, Cactus virus X
gaggccaaugguugcuuuggggcagagcgguuugaguccgugccugcucgcgaguuggaagauggcuuc

SEQ ID NO: 1171 - RNA, 109 nt, Cactus virus X
ucuccaucagucaaaaguugagaaaacacggccuccaccugcuuugaugaucuuucgaacgguuaauuuggugggccauggauugcuuucugagaagauugaguggaga

SEQ ID NO: 1172 - RNA, 65 nt, Human adenovirus C
cggugauagguuuuucucccaccauaagcaccaguuuuuggcgcuggguggguagcuuguagcug

SEQ ID NO: 1173 - RNA, 109 nt, Human adenovirus C
gcucuugggcuaacggcggcggcugcuuagacuuaccggcccugguuccaguggugucccaucuacgguugggucggcgaacaggcagugccggcggcgccugaggagc

SEQ ID NO: 1174 - RNA, 73 nt, Human adenovirus C
ggaucgccugacggggcguaaaugaagagcggccagcgccgccgaucugaaaugucccguccggacggagacc

SEQ ID NO: 1175 - RNA, 106 nt, Botrytis virus F
aauucaccguugcuguuagccaaugguauuucuucaagcggcucaucuucaacaguuggugagugguacggugaagcugcagggggguugggcgggggcggggguu

SEQ ID NO: 1176 - RNA, 126 nt, Botrytis virus F
augcuacuaauaggcagucauugcgggugggauauggugggggaguauccuucuuugcaagugcggccgcguagacuucuucagugagaucgccuuccugcaggggauugucuuccgguacagugu

SEQ ID NO: 1177 - RNA, 130 nt, Botrytis virus F
caugaggaggguuucaaaguugacaaaaguugcauccugcgaagcgucauacgcaguguagucgccaucggucgauucccgugugugaucccagugggcagcuacgaauuucucaaaaucuucauuggug

SEQ ID NO: 1178 - RNA, 74 nt, Cowpox virus
gugauaguuuauaccauucaauauaaucgcuucauccuuuagauggugauccugaaugcguuuaaaaaaauuau

SEQ ID NO: 1179 - RNA, 126 nt, Vaccinia virus
uagcuuucauaguuagauacauggucucagaaguaggauuauguaacaucagcuucgauaaaaugacuggguuauuuagucuuacacauucgcucauacauguaugaccguuaacuacagagucua

SEQ ID NO: 1180 - RNA, 66 nt, Camelpox virus
ucguaagauacuccuucaugaacauaaucaguuacaaaacguuuauaugaaguaaaguaucuacga

SEQ ID NO: 1181 - RNA, 85 nt, Equine herpesvirus 1
gccgccugagagccuggacgugcuccagaaggucgcgguagauagccgugcacuccucuggcagcucgccguuuccuagguaggc

SEQ ID NO: 1182 - RNA, 66 nt, Equine herpesvirus 1
ugagcagguuugguaucagcgagagcagcacaagcgaucccucguucauggcaaaaaucauguuua

SEQ ID NO: 1183 - RNA, 58 nt, Equine herpesvirus 1
uggugagguacaaucggguuucucuuguucucuccucgaaugggccuguugugcacca

SEQ ID NO: 1184 - RNA, 74 nt, Equine herpesvirus 1
ugucugaacgagcggguauacgcggucguaccguacucccaugguacagcaguuaccgcgcgagaaugcaggca

SEQ ID NO: 1185 - RNA, 84 nt, Avian nephritis virus
ggaaguagucacccugaccugguuguggaaagccugcccaagaaggcauguaccacguagugccagauugguuugcugcuagcc

SEQ ID NO: 1186 - RNA, 68 nt, Avian nephritis virus
uauugguagucauaauaagugacccaucauccggagacgguugaauggucacaguuugaccaccagua

SEQ ID NO: 1187 - RNA, 83 nt, Avian nephritis virus
ucucaagugcaguagcugcaacuuuggacauuuggagauugguaacuccaaauuuugcgagauuuccaguaacucgcuuguga

SEQ ID NO: 1188 - RNA, 130 nt, Avian nephritis virus
uucuccaaguguugguaaccaaacucaaaagcagucaaccacucauuaacaagguuguugucaacuguuguugaaaauugcccagauggguugccuuucuugacaugaguuaccucuccaguuggaagaa

SEQ ID NO: 1189 - RNA, 107 nt, Scallion virus X
cggcggggucgugcuggaguugugugccaucgaaaccguggcucuggaggaggggcacccaacugacccaugguauggcacacguggaauuagcaguggccacgucg

SEQ ID NO: 1190 - RNA, 108 nt, Scallion virus X
gcagaggcguccuggaggccuugagguggugggaggcgaaauugacuuuaagucuaccuuggcgcucugaauaaacccccagcuuguuggccaaagcuuggacguugc

SEQ ID NO: 1191 - RNA, 69 nt, Scallion virus X
uggguaagcaacuugccaguucuacaauuuuugaugucggaggcguaugagcuggcucguuggugguca

SEQ ID NO: 1192 - RNA, 69 nt, Clover yellow mosaic virus
acggucuugacguacaugaauaguugcaugaccaggguuuucuugaucggcacucugugguuaaacugu

SEQ ID NO: 1193 - RNA, 74 nt, Clover yellow mosaic virus
gaaccacugggucaucgguuuggacacaauuagaguauccauggucugagcuguauaacucccuuucguguuuc

SEQ ID NO: 1194 - RNA, 121 nt, Clover yellow mosaic virus
uggucgauucuguauggacagggguaccugcuggccucuuugaguuguucuagcaaguguggcuccgggaggcguccuucauacuuuggcagggauuuguuguccuugaugggaaagauua

SEQ ID NO: 1195 - RNA, 77 nt, Clover yellow mosaic virus
uuaaagucucccuaaucaguuuagcaguugaugggccaagccuauggcuggugguuuugaugaagugggggcuuuga

SEQ ID NO: 1196 - RNA, 87 nt, Camelpox virus
auauugaccguuauaaaugucuuugucgaugauauauucgacgcuuccaauugugauauauccagagauaucuuguaauggcgauau

SEQ ID NO: 1197 - RNA, 105 nt, Camelpox virus
gaagagguuggaauaucaacuaguugcugagaaagaaaaaguuaaguucuacaaaagauaacuagaacgugaucgguaucuuucuaguagauaucuuaccucuuc

SEQ ID NO: 1198 - RNA, 56 nt, Camelpox virus
uaauuucuauaguuuguaauauggagcuuuuuccacgcguuacuauagagugauua

SEQ ID NO: 1199 - RNA, 75 nt, Strawberry mottle virus
ucuccguuaaagugauaagcaaaccuauugugcucagcaugcauaguaucccaacucuuacuguaaacguugagg

SEQ ID NO: 1200 - RNA, 81 nt, Tupaia herpesvirus
ggaaaacguaaaggugggcccggucagcuggacguccgagucuccgaugccuaaccugauaccuggaucuaccuauguucc

SEQ ID NO: 1201 - RNA, 79 nt, Tupaia herpesvirus
gguccaagucccgggucuugggagggauguauuuggguggagccaagagucucucuggaguggugacuuucuguggacu

SEQ ID NO: 1202 - RNA, 80 nt, Tupaia herpesvirus
guccauguugaucaggucaucggccguggguucaaagucaugguucccggggaugcucaucugaucaaaacucaguggac

SEQ ID NO: 1203 - RNA, 75 nt, Tupaia herpesvirus
uccgucgaccugacuuagagucucugucuacacacuucacagguauccaggggcuccuguugggauaccgaggga

SEQ ID NO: 1204 - RNA, 130 nt, Fowlpox virus
ccgagcauucauccacuucuaaacucuguacguuaaugauauuauugauaacagcauccgaauuacauuuuugcuuuauauagguuucaaagucuugcguuaucguacucacguuaguuugaauguuaag

SEQ ID NO: 1205 - RNA, 80 nt, Fowlpox virus
uuuuaaugcguucuugaucuaacagucuuuccuuuaaccgauuaaaacaggauacugcguuagguucguaugcauuaaaa

SEQ ID NO: 1206 - RNA, 78 nt, Fowl adenovirus D
cgccgucggacucgaucgcuucccgugccgcguacagcccgucuguauggaagggagcgucggucucuuccgacggcg

SEQ ID NO: 1207 - RNA, 58 nt, Fowl adenovirus D
gcguuccaugaguuccagaagcgcgguaaaacgaacugccaugguaacaaugguucgu

SEQ ID NO: 1208 - RNA, 91 nt, Fowl adenovirus D
ggccacguaccguuggaucgcguccacgaagcgcugccaaccgauuuuuuccuucgcgguauugaugacgagauucagaaugaccguggcc

SEQ ID NO: 1209 - RNA, 87 nt, Equine herpesvirus 2
agcacgcagauggaggcgguccuguugcucuuuuuuagcugcagcgcuugagagagcaugcauggccccuggcaccggucugcgguu

SEQ ID NO: 1210 - RNA, 81 nt, Equine herpesvirus 2
gcgaggggcgagguauuaaggggaaaaaaggaccgcgggcuaaucccuuuuugaucuuuaauaccccgcgcgcccgcucgc

SEQ ID NO: 1211 - RNA, 87 nt, Human herpesvirus 1
ugugacguucuucucgccguccagguggcgaaucaggcgcuugaaaaacaggucuggcauccagagggcgcugaagauauugucgca

SEQ ID NO: 1212 - RNA, 131 nt, Tacaribe virus
acauuaauacuauuggaaacauuugugagggucaauccagaagaauuugagagaaaauggaagagugacaugacaaaacuacuaaaucucaaacaagaccuucugaggucaggcaucacacuuguuccugu

SEQ ID NO: 1213 - RNA, 64 nt, Tacaribe virus
gcugaaguucuuagauguuugcauagcauuggauuugaugaaugagaaucuaggaaucgucagc

SEQ ID NO: 1214 - RNA, 125 nt, Tacaribe virus
ucaauauuuucugaugaugagaugacaggcuucauuagaagcugugcuaaaaggguuuuuaaugauauaaaaagaggcaaaguuuuugaggaaaaccugaucagucuuauugguagagaugguga

SEQ ID NO: 1215 - RNA, 130 nt, Tacaribe virus
uuaggcuuuagaugggugaauuugucaaguuuuggugaccuaagacuaguauugaggaccaaguuaaugacgagcagaaggguucuugagagagaagaggugccaacacugauuaagacauugcagucca

SEQ ID NO: 1216 - RNA, 74 nt, Equine herpesvirus 2
aaggaguaaagccagcugguuaugcugauaagaacacaggcaucuuaaacacuaacuggcugguuuuacuccuu

SEQ ID NO: 1217 - RNA, 83 nt, Equine herpesvirus 2
aguuuaucaacagcauuaaccuauggacucuuauuacuaacacuauaccaauaaagcaccagcauuaaucuuuugacacuacu

SEQ ID NO: 1218 - RNA, 84 nt, Equine herpesvirus 2
ccagguaagggagcgagcuguuggauuauuguuucugacaucaaucugcucaaagcuuaaucuaccaacucccucccuuacagg

SEQ ID NO: 1219 - RNA, 79 nt, Equine herpesvirus 2
guaagaggggugcgauccgguuaugcuacucggaccagcaucaugcuuuaaucccagaaccugaucacaccucucuuac

SEQ ID NO: 1220 - RNA, 81 nt, Equine herpesvirus 2
guaaggaguggugaggucggguaugcuaaugggaccacagcaucuagccugauccagagaccugaccccagcgcucuuuac

SEQ ID NO: 1221 - RNA, 130 nt, Bovine herpesvirus 4
acaucugggagugcuucaaucuguucagugaagauauguucaaauguggauccugccagggucacuugguuggauauggauaggcauauuaaugaacuaccauucauuuucaguucuggagucacucugu

SEQ ID NO: 1222 - RNA, 97 nt, Bovine herpesvirus 4
acaugguuugacaaguuuuaguaaaauguuuuuuucaaaguguaguguucuucuaguuucugaagaaaaccuguuuuccuuaauugucauccauagu

SEQ ID NO: 1223 - RNA, 53 nt, Bovine herpesvirus 4
cacuaugguggcaagaugucucccaucuggggaugugaugcccgccacgugug

SEQ ID NO: 1224 - RNA, 54 nt, Bovine herpesvirus 4
gacaggacucuccuggcauuugaugcuguuauagccaggcucaggcuuccuguu

SEQ ID NO: 1225 - RNA, 75 nt, Bovine herpesvirus 4
ggucucauuguggccaucucaaaaaauauauaaauuuaaaaauuauuuauuguuuaccugcuagaagauaugacc

SEQ ID NO: 1226 - RNA, 130 nt, Bovine herpesvirus 4
uguccucgcacacaacuuacuacugaaugaaccacggaugcuuuccuucucagaucuguggauuuaucuguccaaucggaagugaaaccacaucuuugugucauuuuuaaucagccccguuaaagguaca

SEQ ID NO: 1227 - RNA, 86 nt, Gallid herpesvirus 3
gauauaugggcacuauuauccggugacgugcgcauaguugagcgacgucgacucgacuuacgucuauccgaaucucccauuguauc

SEQ ID NO: 1228 - RNA, 77 nt, Gallid herpesvirus 3
ggcggggagucuugagugaagugcauagugaagauggacuguccauuagaggcaggcgcuucacuggucucgccccc

SEQ ID NO: 1229 - RNA, 92 nt, turkey adenovirus 3
caaggcuggauaagcaaauugaguuacaugcuucaguuuuucuuucauggacauuaaucuuauguuaucagauuguaaauuaaccaaccuug

SEQ ID NO: 1230 - RNA, 64 nt, turkey adenovirus 3
gaggcaugauuguaaguguguaagugugaguccuuuuuauacuacacgcucagauucuuggcuc

SEQ ID NO: 1231 - RNA, 63 nt, turkey adenovirus 3
uacagcucacuauauuacuucucgcuaaaauaaauguucuaaaguuauucaauugagucugug

SEQ ID NO: 1232 - RNA, 102 nt, turkey adenovirus 3
uguguuucgcgccacagcauuacuaaugagaaaauucacacuugucuuaacuugacauuuuaauagccaaucguaaaggaguugugguuaaagccagacaua

SEQ ID NO: 1233 - RNA, 70 nt, Monkeypox virus
aaguuaugcagcauuucauauuuaaacucguuaaucguuaacugagauuuuuguuuaauguguucagcuu

SEQ ID NO: 1234 - RNA, 87 nt, Monkeypox virus
auauugaccguuauaaaugucuuugucgaugauauauuagacgcuuccaauugugauauauccagagauaucuuguaauggcgauau

SEQ ID NO: 1235 - RNA, 73 nt, Monkeypox virus
gacuguagugcucagauacucaucagacuuuuuaccggaaaaguaauuugcauuagugccuccauguacaguu

SEQ ID NO: 1236 - RNA, 53 nt, Camelpox virus
ugauaccuuuguacgacauuaaugcuauaguaacauguuguccgaagcaauua

SEQ ID NO: 1237 - RNA, 73 nt, Monkeypox virus
uugugauuguucaugauaucguuucggauguuaccuauguaauucucuaauucaucaugugccaacgucucaa

SEQ ID NO: 1238 - RNA, 92 nt, Human adenovirus D
caaugcuuuuuaggagacuuucauccaucuggucagaaaagacuauuuuuuuauugucaagcuugguggcaaaggagccauagagggcguug

SEQ ID NO: 1239 - RNA, 106 nt, Human adenovirus D
ccucguagaggcgggugagggcgugcuugagaugcagaugguacuugauuucuacgggugaguugguggccguguccacgcauugcaugagcccguagcugcgcgg

SEQ ID NO: 1240 - RNA, 79 nt, Human adenovirus D
gggcguugcgggccgagaccgugagcucgucuuccaggagccugaugagcucggcgaugguggcgcgcaccucgcgcuc

SEQ ID NO: 1241 - RNA, 80 nt, Human adenovirus D
gugcgagggguagcggucguuguccaccaggggguccaccuuuuccaccgugugcagacacauguccccuuccuccgcau

SEQ ID NO: 1242 - RNA, 80 nt, Human adenovirus D
uagcaccacugcauggccucgugcucuggggucguguuguagaugauccagucauagcaggggcgcugggcguggugcug

SEQ ID NO: 1243 - RNA, 75 nt, Yaba-like disease virus
aucuuuucaggcucuaaaguguagauacaguccuuaaaaaaaaaggaguuagcacuuuuuuuuagccuagcggau

SEQ ID NO: 1244 - RNA, 120 nt, Yaba-like disease virus
gucggcaauagacugaacuguugauuuaccuccuuguaccguauauucuauaauagcuccauucauuuuguuuauguaaauacauucuuuauuaaaaguuuuuuccucuauauugccgac

SEQ ID NO: 1245 - RNA, 87 nt, Blackcurrant reversion virus
cucuugccuuauuaauugguaguugugguuucuuccggggcaaucucacaguugucuuggaaugggccaccuuccuaaaggcaggag

SEQ ID NO: 1246 - RNA, 79 nt, Blackcurrant reversion virus
gauuuucguccacccguggugagaggcugcgacuacgaaaguagaguuaaagcuucuauccaaaggaaaaucgagaauc

SEQ ID NO: 1247 - RNA, 99 nt, Blackcurrant reversion virus
gccuacuguugcguuuguuaauguuauggacacacguauugaggauccuuuguauucuucauuauguggguccuacauugaucuuggaagggaucgggc

SEQ ID NO: 1248 - RNA, 69 nt, Blackcurrant reversion virus
gcgagugacacguggaugugucucgucgaguugcauaugacgagacucgaaucaucuacguuagcuugc

SEQ ID NO: 1249 - RNA, 104 nt, beet soil-borne mosaic virus
agcuaaggcuaagagagcuugagguugagcguaugcccgggaagacugaaagauauauucacacagguauacaagguggugcucaacucgcuggugcuuuagcu

SEQ ID NO: 1250 - RNA, 102 nt, beet soil-borne mosaic virus
gaggaugaugguguuuauacugaugcugagagugcugucauuguggguacuagugcuauuguuaaugaccacgaucaauuugaucucaauacugugauucuu

SEQ ID NO: 1251 - RNA, 80 nt, beet soil-borne mosaic virus
gccgcaagcuuaccuguuauuaaggccaauuuuaguagucucggugcuaauuggucugaagauggugauguguuuguggc

SEQ ID NO: 1252 - RNA, 118 nt, beet soil-borne mosaic virus
guaguagguuaguugaacuaaagagucuaugguuuucuagggguucugguggcggcggugauuucacuguugaguuaccaacuagaacuacugaugccuuuaguuuagguaccacuau

SEQ ID NO: 1253 - RNA, 131 nt, beet soil-borne mosaic virus
ugaggcccuuccuuuugaaacauggguuuauuuaaaucucucucguguguauuuuaguaucggguguucugaucucuuuuaugcgacuagagaauuuguuacuguguuuaauggggaguuugagggucuua

SEQ ID NO: 1254 - RNA, 89 nt, Grapevine virus A
acgcuuagcaaacguggaccuacccgugagaaaugaugggucauccaucuauaucucaacagccugcucgccgauugaugacugagcgu

SEQ ID NO: 1255 - RNA, 96 nt, Grapevine virus A
ccugguagguagcaugguucaucaucugcguggaauccuauacugcccccugccguguaucuuuggaucagacaaugaucguagcuaucaucuagg

SEQ ID NO: 1256 - RNA, 97 nt, Grapevine virus A
ccuuggaaagaguggacacugaacuccauaccauagccuguaagaauuucucuuaagguaucuggaauguaguaaucaaauaguccaucuagccugg

SEQ ID NO: 1257 - RNA, 131 nt, Grapevine virus A
cuucuugcuagcuuuaggaccuacuauaucuaccuccccauaaugaaucgccuuuuugcuugucccgaccaaggcgauguacccgaagagaguguucagguacauauuucggucguagccgcucucagaag

SEQ ID NO: 1258 - RNA, 84 nt, Grapevine virus A
ugcuacccaaucaucucugagcacuuuccuugggcuaaucacaagcacuuucuccacggaacaguguuuaaguaugguuuggca

SEQ ID NO: 1259 - RNA, 67 nt, A-2 plaque virus
aucauaccacucccgcucaagugccuugaaagcuggcaaauucaagcacuugccgacugguacugau

SEQ ID NO: 1260 - RNA, 70 nt, A-2 plaque virus
ccagugucaauacgguaauuucaagauugacuccuucugggucaaccaaguuuacugcauugacuacugg

SEQ ID NO: 1261 - RNA, 96 nt, A-2 plaque virus
ggaacuauccagccccuucgucugcaauaaucucggaccuccccugagucaacgcuacagagaagaucagagauugcagauggggcugguguuucc

SEQ ID NO: 1262 - RNA, 123 nt, A-2 plaque virus
uaugcuaucauccucaaaucagacaaagagauucguuuauacaccuugacuaauaauguccgaauuauaagauuauuuaucauuguguugaauauacuggucccugagcaucccgauggcaua

SEQ ID NO: 1263 - RNA, 71 nt, Human enterovirus C
acggaucaaucacuuuugaccguggguacagucuauaugauuucaccggggaaacagaagugcuuguucgu

SEQ ID NO: 1264 - RNA, 117 nt, Human enterovirus C
ccaaugaguguaauaauuuagaauuucacccaacauggugugacucagucguuugucagaagcaggugauaaagauagacagaauauaggugccuugcucaaauugucauucaaugg

SEQ ID NO: 1265 - RNA, 113 nt, Human enterovirus C
cccauaucuuuuagacaaucugguagcuuccaccaccauccccuugaaguggucuuccaagacaccgauuccaggguguaaaaacgguugcuacuaacgucugguucaguggg

SEQ ID NO: 1266 - RNA, 86 nt, Human enterovirus C
guguucauuguuggcaacccuugauguacugggaugguaauauuucucaacccauuaaauucuguacacaugggugcgauggucac

SEQ ID NO: 1267 - RNA, 61 nt, Beet virus Q
acuaauggugacguaaaagacaaaguuccucaauggaguaugaaguacgucgaaaguuggu

SEQ ID NO: 1268 - RNA, 75 nt, Beet virus Q
acuuauaggucaccauuggauguugccgcauuuuuaacucgaaaggguuauuacgguaacucggugauuaugagu

SEQ ID NO: 1269 - RNA, 125 nt, Beet virus Q
cuaucggucccaggacagguaugacuuccaucuauucuauuccaaaaguugccaauugucaauauuugaccuuuacgcaagcugaaaaagaagagauggagaaauacuugggcaaaggaaaaugg

SEQ ID NO: 1270 - RNA, 116 nt, Human enterovirus A
cuggcggcccguccugcauccaaucugcccaaaucugucuuguaugagucugucaccucaaugucacaguccauauagaaucugcggcggauggcaucagagucggacaccguugg

SEQ ID NO: 1271 - RNA, 76 nt, Beet virus Q
ggagguaauugggcaacacacgcuaugagaagugauaagcguuucguacauugcuguuguccgauuuuagacuucc

SEQ ID NO: 1272 - RNA, 131 nt, Human enterovirus A
ucuguagauuguucaccuccaauauggucucuacccugcaaaucuccaacagauugcgcacuucaccagguauguguauggcuggaguaggguggaauccgggcaaaaugggagcugagacaccaucauca

SEQ ID NO: 1273 - RNA, 68 nt, Beet virus Q
uguugguaggaugaaagagaaucaauuaaauguggaaacgauuuuugguuaucuugcauccacuaaua

SEQ ID NO: 1274 - RNA, 90 nt, Saimiriine herpesvirus 2
aauaaacguuuuuucuaagauuuguugagcuacugauccaaaaaggcuauaaucuuuuucaguaguuaacagaaauaagaaacuauuauu

SEQ ID NO: 1275 - RNA, 59 nt, Saimiriine herpesvirus 2
ccaugagguacacuguuauuagguaacaaguacacaauuacaguaugaaaccugcaugg

SEQ ID NO: 1276 - RNA, 87 nt, Grapevine fleck virus
gugcgguggaggagguacuggguguagaggauggccagguuguagucgguguugucgucguaggugccugguucaccggugaugcgc

SEQ ID NO: 1277 - RNA, 86 nt, Swinepox virus
caacgauaacugaugaugauguuugugauguuucuucuuacauaacgaacaaggcaucacauaaucuauuaucaaugguaucguug

SEQ ID NO: 1278 - RNA, 64 nt, Swinepox virus
uccauacuaugugaucaccucuauccguuaagugaauaacauuagaauccauuauaaguugaga

SEQ ID NO: 1279 - RNA, 125 nt, Swinepox virus
uucuauaaauauauauucuagauauucgucguuaauauuugcaaacuuuuuaugucuauugauaaaacuuucuauaucauguccgugaguucguauauuaaaauguuuagcuaguuuuuguugaa

SEQ ID NO: 1280 - RNA, 96 nt, Vaccinia virus
gaugucggauucuuugcguaucucagucuguggcguuugcuucguuuaaauaauauaucaaacauggagacgccugauauguaggcauucuucauu

SEQ ID NO: 1281 - RNA, 89 nt, Vaccinia virus
uaauaaauuucuuuucacgaugcaucuuauugaaugacguuuucucauaaguggacauauagaugcagaaguaaugaagaaaaguauua

SEQ ID NO: 1282 - RNA, 100 nt, Vaccinia virus
uaucuuuauugucuucuacaugcuccaauugaaugucaugauacaacgcaguuuuucuuaugcauguuucauaacaccacgaacaugucgcaguaagaua

SEQ ID NO: 1283 - RNA, 59 nt, Yaba-like disease virus
acuaagguaauaauuccaaggaaauacaccuucuauuuuauuuaaauuauauccuuugu

SEQ ID NO: 1284 - RNA, 91 nt, Yaba-like disease virus
aucgccaauugcagacuguaacagucuuuuuguaguagauuuuccuguagccguuuccccaaaaaagaaaguuauacacuguuuuguagau

SEQ ID NO: 1285 - RNA, 65 nt, Yaba-like disease virus
uaauguuaauucgugcggacuuaaguugacaggaagguaaacuuuuuuuguaaauguugacauua

SEQ ID NO: 1286 - RNA, 98 nt, Yaba-like disease virus
ucugaauuaaauaaauuuacagcaacguccauacuguaauuaaauauuuuuaauauauuuauguuaggaaccaaaauguaaacuuuuuuaaaucuaga

SEQ ID NO: 1287 - RNA, 130 nt, Yaba-like disease virus
uuuuaauuacagucauuaguucuccaguguuguucccaaaaauauuaugugccucaucuauaauaaauauugcauuauuauaucuagauagcccauuguaauuuauaacauugucguuguaauuaagaga

SEQ ID NO: 1288 - RNA, 61 nt, Human herpesvirus 5
ccaggcgcaauggagugagaggccggaccacuggcguuuuaaauccgagauaauugcccgg

SEQ ID NO: 1289 - RNA, 92 nt, Human herpesvirus 5
cuggugcuaguagggacguuugugcugcuggucauauuuguagcgucgcugaagucgaugugaagcagcaacccgaacgcgaccaggaccag

SEQ ID NO: 1290 - RNA, 78 nt, Human herpesvirus 5
guuucaucugacgugauaguuacggugauuguuguguuauaagaugauguagcguuugcuguuacguugguaaaagau

SEQ ID NO: 1291 - RNA, 105 nt, Foot-and-mouth disease virus SAT 2 (FMDV-SAT2)
ccagaaaccaaguaccagucucaguguuaccuuaaaguguguuucaugacaguauuaccgugcugggguugcacacacgcaagguucagagaacguggcuuucgg

SEQ ID NO: 1292 - RNA, 128 nt, Foot-and-mouth disease virus SAT 2 (FMDV-SAT2)
cgucgaugucaaagugaaaccuacgguuuagugcaucagggcaaaccaucguacguggggugaacccagaauacagguuagagguugcaaugaugaccuugcuguugaaaggcuuccccuuguccucg

SEQ ID NO: 1293 - RNA, 91 nt, Foot-and-mouth disease virus SAT 2 (FMDV-SAT2)
ggucugucauggcccugccgucaaucaugaucuugucauacuucucagcgaaaagaugacgaggcacgagauaggcaguaccaaacacucc

SEQ ID NO: 1294 - RNA, 59 nt, Foot-and-mouth disease virus SAT 2 (FMDV-SAT2)
guugcagucucuucauuucaacagccaugccguugagaagggcacaaucauacuggaac

SEQ ID NO: 1295 - RNA, 87 nt, Human adenovirus D
gucuguuuuuguucuguuucuuuacuauggucuucuaccuucaucucuucugauuuuggaaaaccaucugacacuacaaccucauac

SEQ ID NO: 1296 - RNA, 74 nt, Human adenovirus D
uuugcgcagguacgcggaaguccacaaccccggcgugaguuucagcggagcgguggacuccugcggaccuugca

SEQ ID NO: 1297 - RNA, 68 nt, Foot-and-mouth disease virus C
ccuguacacuuguuguuucagccuugugggacgcgguguacgcguagucagcggccgagauguacggg

SEQ ID NO: 1298 - RNA, 74 nt, Foot-and-mouth disease virus C
cgccgucguguagcgugaauuccauuuuuccugcaguccgugauaggaaaagugcuauuaccucuuugauggcg

SEQ ID NO: 1299 - RNA, 130 nt, Foot-and-mouth disease virus C
cgucgaugucaaagugaaaccuccgguucagagcaucaggacacaccauggucuucggggugaagcccgaguacagguuggugguugcaaugaugaccuuacugcugaaggguuugccuuuguccucaag

SEQ ID NO: 1300 - RNA, 55 nt, Foot-and-mouth disease virus C
cugaggcgauccaugccuuaauccagucgcggauggcaaggaucagcuugaccag

SEQ ID NO: 1301 - RNA, 86 nt, Foot-and-mouth disease virus C
gacaaugcgagucuugccggcacguacuuucuccaucgggcgaauuucguccuucaggaaggucuggcaagcaaacuuguauucuc

SEQ ID NO: 1302 - RNA, 65 nt, Foot-and-mouth disease virus C
gccaacacacgguguggcgcgguguaugggagagccagucgagucaccgggcccuugugguaggc

SEQ ID NO: 1303 - RNA, 110 nt, Foot-and-mouth disease virus O
gaacaguuggaggauggcguucagccaacaguugucgugguuguugggucuggaguagaagaccuucuuuucaccguuguaaagugugaauuccaucuucccuuguguuc

SEQ ID NO: 1304 - RNA, 65 nt, Foot-and-mouth disease virus O
guguucacuagagucuucagaauccacucggcguucggguggaauccgaacuccgugcggaacac

SEQ ID NO: 1305 - RNA, 83 nt, Foot-and-mouth disease virus O
ugucaaggcucugccguccaacaugaucuugucguacuuuuccgcgaagagaugacgaggcacgagguaggcagugccgaaca

SEQ ID NO: 1306 - RNA, 69 nt, Melanoplus sanguinipes entomopoxvirus
gaauuuggaauccaacauugauauauauuggaauuaguauuauaagauauaauuaauguuuccaaauuu

SEQ ID NO: 1307 - RNA, 130 nt, Melanoplus sanguinipes entomopoxvirus
uuagcaucaauaaauuuauuacauguaauacaucuaacuuuaaaauaucuuucuauacauucaacacaaugucuauauccagauugacagucaauguauuuuuuacauguuuuacauuuaaauguuaaaa

SEQ ID NO: 1308 - RNA, 67 nt, Garlic latent virus
aucuuacagcccagaugcguuuuaauauauuuguaaucauuuauuagagaucuggguagaccaagau

SEQ ID NO: 1309 - RNA, 95 nt, Garlic latent virus
gugcgauuucgaaggccaugauguauugaucuugggaggcaucaaaagcuucacagucagacucagugcagaucccauggaacuuauugucgcac

SEQ ID NO: 1310 - RNA, 111 nt, Garlic latent virus
uggcuuuuggagaacaccagaccaacgucagccaaccagucggaacaggaucgauuagcgugauucucaaugauggcggcugauuugcucacuuuuuuuuccucaaaauca

SEQ ID NO: 1311 - RNA, 115 nt, Garlic latent virus
uuguacuuguauucucucccuuuuaguagauuacaaauguccgauucauaaccgaggaagacgugccuaucguucauacugucauaaucacuguggaguggauccccgaguauga

SEQ ID NO: 1312 - RNA, 83 nt, Myxoma virus
gagucgguucacuaacagcauguaauuguccgguuuaaccuuuuugaaaucguauaacugcugcaacaaagugaaacuaucuc

SEQ ID NO: 1313 - RNA, 130 nt, Myxoma virus
ggaaaaguuuagaaacuugucgauaaacuccuuguccgcggaggucuuuaauauggaaaacugaacauuguuggaguccuuccacguaggggacuuuguaacgugucugauauaugucauaaacucgucc

SEQ ID NO: 1314 - RNA, 97 nt, Myxoma virus
uagauagucgagcgacgauaaaguguacguuuacauaccgccgauguuccgggguaaguacgugacuguuuaaucgaauggcucggccuauaaucug

SEQ ID NO: 1315 - RNA, 91 nt, Garlic virus C
ucugggauucuugcuaggcguuugugaaccugguccggauacaagucccggucuugaucccugggcagacguggccugguucaaucccuga

SEQ ID NO: 1316 - RNA, 98 nt, Human adenovirus A
agguggaaaaauuuguacuacucuuaaaucauaguaaauauuuguuucagaagcauugacuguauuuuuaacguuguaaauagccgaauuuuccaccu

SEQ ID NO: 1317 - RNA, 131 nt, Human adenovirus A
gcggugagagcggcuuguucuagcaguauuugguuacgccgggcucguaccccauucacccuggaaaucaugugggguccggcgcuuaaccaauucauuuugcuagaauagucuugagccgcgccggccgc

SEQ ID NO: 1318 - RNA, 54 nt, Human adenovirus A
ggaacaggacaaaugcaauauaaaguuaauauaguauuuccuugaucuuuuucc

SEQ ID NO: 1319 - RNA, 126 nt, Human adenovirus A
gugaaauugcugucagacugcggucccugcauuucgaagguaccaaugacuugacuuucacuuaauaguucaguauugcaaaccaaagaacgguggggggugcaaagauugcagcggcagugacac

SEQ ID NO: 1320 - RNA, 76 nt, Human adenovirus A
uaauuccauaaacccagccuauguaguuuguuucuuuaguauaacaaucuaaaaaauuccaugguuuauguaguug

SEQ ID NO: 1321 - RNA, 131 nt, Human adenovirus A
uuacugugcuuacuguauguguuaaacuguguugagauugggaugugggauaaucacagagcucauuaaaaggguaagugugauuaaagcuuuuaguaauaccugaaacauuaaaguuaguuauaaaguag

SEQ ID NO: 1322 - RNA, 64 nt, sheeppox virus
uaaaguuaaguuuaaaucuggcaaauguucguaaaacggcaacagaauguaaauuccuucuuua

SEQ ID NO: 1323 - RNA, 89 nt, sheeppox virus
uacgauucuuuugucugaauauuuuuaaccauguacccgauaaagcugaguucaguuacguaaauaaaaucuuuaacaaaagauucgua

SEQ ID NO: 1324 - RNA, 63 nt, Variola virus
gcggauaucauuagacaauuguaguauauucucacguauuacuuguuuaauaucuauauccgc

SEQ ID NO: 1325 - RNA, 101 nt, Fowlpox virus
uaguaucuuagcuguuaauguuguuuucuuacuaacggcaugauguaaaggggauaauccuuuagaaucuuguacguuaacauuagcaccguguaauauua

SEQ ID NO: 1326 - RNA, 63 nt, Garlic virus A
aucgucgaagaucuuguaacuaacagugguagauugaucacugggugugacgcgaaguucaag

SEQ ID NO: 1327 - RNA, 131 nt, Garlic virus A
cuagucgauugugaguuugaauauagacugucaacuguccuggucaaauauguuagagccgcauggauuuggcuuaaggaguuguuuugugacggggaguugauuggauuuaaauuuguuaaaauggaguc

SEQ ID NO: 1328 - RNA, 111 nt, Garlic virus A
uccaaucagucucucagcaugcacuuuaaugggauuugcuaaacguuugggcugucugugaguggcguugauguaguagucaguguauggugagaaaugggccacguugga

SEQ ID NO: 1329 - RNA, 81 nt, Garlic virus A
ugagggcuagggguuucugaagucgaaguuucggagguuugagucguagcaaggcuuggggcuucagauuguugguuuucg

SEQ ID NO: 1330 - RNA, 118 nt, Macaca mulatta rhadinovirus
caccguauagcuguugccguuggaggccugcacggccagcgguaauauguuccguuguaacgggagcaucaccgcggcgcauauugggucucucucgggcaacggucuccaggcggug

SEQ ID NO: 1331 - RNA, 115 nt, Bovine herpesvirus 1
gcguccucgauggugagcucgaggauggggauggacacgauggagccuuccggcggcggugaagggggcgcugcaucggccucaucagcgccucgauaguuuucguugacgacgc

SEQ ID NO: 1332 - RNA, 55 nt, Fowlpox virus
agucuuucuucucuaauuuaauaguauucuauuagauaagauuccugaacucacu

SEQ ID NO: 1333 - RNA, 72 nt, Fowlpox virus
gccguaauauccuagauacauggcauaacagaauggaguaauuccuuuacugucacguauagaggcaucggc

SEQ ID NO: 1334 - RNA, 55 nt, Fowlpox virus
ggcagccaaaugcaaggguguuugauuuagauuauuacacgcauuuauguuagcu

SEQ ID NO: 1335 - RNA, 93 nt, Fowlpox virus
guaguuuuuccauaacgcuauucuauuuuuaucauauauguuguuauaaacuaauacuucugauaccaugguaguguuauuuaggcucucuac

SEQ ID NO: 1336 - RNA, 66 nt, Fowlpox virus
ucgacauuauaggauaguaauaguuuuauagauucuauguuccuuccucuaaccgcauagugcaga

SEQ ID NO: 1337 - RNA, 87 nt, Fowlpox virus
ugugccaguucuuagauucuuuguaguauuuuacaugcuuuccauuaacaaugaaauaggauacuauaccauaaucuauuagguacg

SEQ ID NO: 1338 - RNA, 101 nt, Fowlpox virus
uguuauauuuuauuuauguucugaaaauaauuuauaagcuauuaacuaauugccuuaauagaucauaaucagguuuuucuucguacgauaguuuuguaaca

SEQ ID NO: 1339 - RNA, 91 nt, Fowlpox virus
uucuuuuuauuauuuaguaguaugguauauacaucguuaauaucucuaguaguuccguuaauagaauuauaccguguuauaauauuaagaa

SEQ ID NO: 1340 - RNA, 130 nt, Triatoma virus
acacgauagacguauucaucucuaacuaucuuaccauccgaauccauaacaucaucauacccaacaaagggaugaaauguaauuuggacucuuccagaaugauaguuaguuuugacaaaucuaaacguau

SEQ ID NO: 1341 - RNA, 62 nt, Triatoma virus
caacguacugugggucuuuguguauccuuuucacaagauucacauuuuaccacaggucguug

SEQ ID NO: 1342 - RNA, 127 nt, Triatoma virus
cauaagcuggauaaaucaaacucuucucgucagaaacguaucgccaagaauuucucuuaaucaauucagaaaaagauaagauucuuucaccaauacauucuugagaaggcuguucaucaaguucaug

SEQ ID NO: 1343 - RNA, 127 nt, Triatoma virus
cucgaguauuuaaaucuagaaaaguaauuagguauuuuuaaaacauacuccagcgccaccucaucagaagauguuccggcaaaagguguuuucaaaauaaccucauuuccauauuuaagacucaaag

SEQ ID NO: 1344 - RNA, 99 nt, Triatoma virus
cuguagcagaggaucccguaaaguuaucucuaagagccguagcugaaauagcuaauggagcucccaagagaaauccaaaacggaaaucaucagcagcag

SEQ ID NO: 1345 - RNA, 105 nt, Triatoma virus
ggauaagauaguguacuuuugcccacacccguaucuccagaaauauaaauaguaacuggaggauuacgaaugguagacucagaaaacccucuauucuuaaauucc

SEQ ID NO: 1346 - RNA, 67 nt, Triatoma virus
ggugacauaagugcaucagguaauuucaaggaaaagauuucuuuauuuucaauaucacuuguguucc

SEQ ID NO: 1347 - RNA, 85 nt, Triatoma virus
guaggauuccauaucucaucuggagacagaucaucuaguacaaaagcccuaguaucugcccaaucaugaaauauaguaguccuac

SEQ ID NO: 1348 - RNA, 64 nt, Duck adenovirus 1
gaacagguaauaccucugccggauauuucguuguaucuaacagugcuggaauauugccuuguuc

SEQ ID NO: 1349 - RNA, 131 nt, Duck adenovirus 1
gaauggguguaugccauguuaggcauuccagaggugggcgccaaaggauuguaagcugugccgcgguaugguuugaaagaugguccucuguccaagaugcccuggaugucgaaguagcugcuacccauauc

SEQ ID NO: 1350 - RNA, 70 nt, Duck adenovirus 1
gaugaaguuuuugugaccggucagugguaacaccguuuguaggagccacauauggaucacgaaacuuguc

SEQ ID NO: 1351 - RNA, 98 nt, Duck adenovirus 1
uguauccugaguaaaaguguuagaauuuguaaauggagccagaaacagaauuagaacucuuguauuugcagaaaguuugcuuguuacauuaggaggca

SEQ ID NO: 1352 - RNA, 111 nt, Human herpesvirus 6
cugaggcagccguagagguauucaggaugugagcauaguaucaaaagugugaauugcuugauggguaauucgaacgcuguggaaacaguacugucuucagaggcuguccag

SEQ ID NO: 1353 - RNA, 120 nt, Human herpesvirus 6
ggaucagaaauaaagucuugcaguuugauguuaaugaagucugggauguagagccuggaaucugaaacgaaggcuguccauuucguaucgaaugaaaguuuuguuauaugguucugaucc

SEQ ID NO: 1354 - RNA, 80 nt, Human herpesvirus 6
gguuuacguauuuuuggagguaguugguauacgcguuuaguagaaugcuuacgagaagguuugucuccggggaguagauc

SEQ ID NO: 1355 - RNA, 115 nt, Human herpesvirus 6
guagucgaugucgaaugugcgugcucugaggacagauuggaagucuuuaucguggaguacguuuuccaggugucucaugcaaagcagguauguuuuuucgaugauaucgauguac

SEQ ID NO: 1356 - RNA, 76 nt, Human herpesvirus 6
guuuguuggaagguaucuuucauaaguuuggcggguugccauagcugggugucgauacauauauuucucauuaaau

SEQ ID NO: 1357 - RNA, 77 nt, Human herpesvirus 6
uaugguccaguugaaauuagauuucauuauaggaaaagauuugagaucgugaaauaaagauugaaauugugaucgua

SEQ ID NO: 1358 - RNA, 99 nt, Alcelaphine herpesvirus 1
gaguaugugaguuuuguguugaggcaggccacuugcacuugcauugccuuccaaaugcaggugagagauagccugcuuuaacacauaucccacagguuu

SEQ ID NO: 1359 - RNA, 87 nt, Alcelaphine herpesvirus 1
gcaagucucuugcggaaaagcuauuuucaaauacauuauuuaauuacaaacguauuugaaacauagcuuuuccaacaagcaacuagc

SEQ ID NO: 1360 - RNA, 84 nt, Alcelaphine herpesvirus 1
gcagaucuuaugcuugucaguuaaagcccggaauguuuuuuuuuaauuaacaauuccugcuguaacugacacaacaaaaucugc

SEQ ID NO: 1361 - RNA, 70 nt, Alcelaphine herpesvirus 1
guagcuaggguggugaguggcgcucgcagcagcuagugagcugcugagcaacacucccugccccagcuac

SEQ ID NO: 1362 - RNA, 88 nt, Alcelaphine herpesvirus 1
uacccgcuccguggaguagucagacgcgucguaucuuuaauuuuacugaaaauaagacucgccugaccacuagcccggaguacaggua

SEQ ID NO: 1363 - RNA, 91 nt, Alcelaphine herpesvirus 1
ugcaugucucuugcuagguagccuguacaaaacaguccuuuuuuaauguaaaacaguguuuuguccagacuagccuaacacgaaccaagca

SEQ ID NO: 1364 - RNA, 106 nt, Human herpesvirus 1
cgucuccccgggggaaaacaggauagcuuccggagucuccauacgcacggucaccccacgcacaugugagacuucgggggcgcugggccaagaccucgggggggcg

SEQ ID NO: 1365 - RNA, 96 nt, Human herpesvirus 1
ggauccaaagguugugagcuggcggcgagauugaugcccaucgcuacggggguauacagacggagccguuggugauaagaucucaaagccggaucc

SEQ ID NO: 1366 - RNA, 98 nt, Himetobi P virus
cuggaugacuaucggcagacacuuguaccccaggguccacuccaaguacauacuuggagaagauccuguaacacauaguauaagucgauuuaauccag

SEQ ID NO: 1367 - RNA, 84 nt, Himetobi P virus
ggauuuuucaguauuuagggauauauucgaugagauuccaguuauaucuuuaauuucuaucuuaucuucuaaauaaucagaucu

SEQ ID NO: 1368 - RNA, 86 nt, Himetobi P virus
gguugcgaaaauagaccacaccacccucaugcuguuccuugaauuucuucaaagcagcaagaaagugaugaggcauuaucgcaauu

SEQ ID NO: 1369 - RNA, 90 nt, Himetobi P virus
uacacggcaacaaccacacguccccaccuauaucuuccuucaauuaaauuguaggcagaguagggggagauauaugguacucgcagugua

SEQ ID NO: 1370 - RNA, 122 nt, Himetobi P virus
ugagauucacaaggauauccgaugcugcuaccuccaggccaagcauggugucuguauacaagcuacaaacaccauuaccuauccuggaaacaacagaaucgauguauccuuuuguaucauca

SEQ ID NO: 1371 - RNA, 72 nt, Himetobi P virus
uggagaagguugcugagucguaagagaacguuccauuugaaaaacucuuauacggcucaccaagcuccucca

SEQ ID NO: 1372 - RNA, 129 nt, Himetobi P virus
uuccaagauaauggagcccccaaguaaaacccgcaaucaaaaucaucagcagcagccauagcauaagcuguagcguacucacugaugguugugaugcgugcauacguugugggauucacuagaucggaa

SEQ ID NO: 1373 - RNA, 93 nt, Himetobi P virus
uugaauucgaauaggaaaaugaaucaauguaauuugguaugcguuuaacauaaucaaaugacauuucauccaucuuacuaccagcgaaaucag

SEQ ID NO: 1374 - RNA, 80 nt, Cercopithecine herpesvirus 7
aauacaauaacaaaacccccgcguguaagauauguuuggauaucuccaguucuuacaugcgaagaguuguauuuuguauu

SEQ ID NO: 1375 - RNA, 69 nt, Cercopithecine herpesvirus 7
aaugcuaucuauugcauuuaaagauccaaguucuguugaaaacgcucuauuaaaaugcaaugguguauu

SEQ ID NO: 1376 - RNA, 65 nt, Cercopithecine herpesvirus 7
uucauauguaauauauaugccgucuaaacuuccuuuugguuugcaaguuauauuauaauuuugaa

SEQ ID NO: 1377 - RNA, 120 nt, Wheat streak mosaic virus
agcggugucacagacuuuucagcuaagaaauccaugaccucaauaguuaucggugugaaauaauucucaccuuucccuccaagguuauggaaucccacaacuuuuaggucugcuacugcu

SEQ ID NO: 1378 - RNA, 94 nt, Wheat streak mosaic virus
cgcacucagucgugccugugcaaacagcuuguucuguauuccgcguagccuguuuacugcaacgcuguucugcacuugcacaaaauuuggugug

SEQ ID NO: 1379 - RNA, 72 nt, Wheat streak mosaic virus
gagggcuugcuguguuugcaugucgccauuaacuguguuguucguggcuguuaacuugaugagcuugcccuc

SEQ ID NO: 1380 - RNA, 65 nt, Wheat streak mosaic virus
gcacuguguugacucugaugguaugcauuccugauugcuuuauaccauaugguguuggcacgugc

SEQ ID NO: 1381 - RNA, 100 nt, Cowpea aphid-borne mosaic virus
acaugagagagaaauugcccagcacuugguagaucuuuugauccuuuaaugaaaagaucauacauccggcaaaugguuugcucaucuuucucucuuuugu

SEQ ID NO: 1382 - RNA, 116 nt, Cowpea aphid-borne mosaic virus
augguuguggagguugguucauagcuuguugacacuucaaaaucaacugugaguuucuugcacucuucaauaucauugagaucauccaggcccugaacgcgaacuuccucagccau

SEQ ID NO: 1383 - RNA, 116 nt, Cowpea aphid-borne mosaic virus
guauuaggacaguucaacaguaaugaguggagugguucugcugccucugaaauuaaucccaguugcucaagcagaacgucuguuaccacuaacuucuuuguuaacugcucuaauau

SEQ ID NO: 1384 - RNA, 58 nt, Perina nuda picorna-like virus
accccguugcuuaaauacuuuuguugaaacaaaucaucaaaaguaggaagcucggggu

SEQ ID NO: 1385 - RNA, 93 nt, Perina nuda picorna-like virus
aucguuggugcugcagucugcauaacucguaguugauucucuacaaaaauagagacauaaccguaagccaugcaaacugcauuaaucgauggu

SEQ ID NO: 1386 - RNA, 86 nt, Perina nuda picorna-like virus
gaacgaaagacuuuaauggugugacaucaaacgaguacaauaaaguacccgaagcggcgucacuaguccauugaaaguaaucgcuc

SEQ ID NO: 1387 - RNA, 126 nt, Perina nuda picorna-like virus
gacugugcagcugggauccuaaaaggcucagccaacuccccauguauaauacucuuuucuagauugcucuuuccagaguaucuuacagguucaauagcuuuacccaaugggaucacaacugcuguc

SEQ ID NO: 1388 - RNA, 91 nt, Perina nuda picorna-like virus
gcucuugugguaaaguaauugaccauguuucuuccagcugguaaaguuaugaauugguagaccgcauagucaaacccuuuaacacaggagu

SEQ ID NO: 1389 - RNA, 117 nt, Perina nuda picorna-like virus
ggaccaagcgccauuacuguguagcgaaaugccaaacucgccaggcacccaagcaagaugcugaggugccagaacgaaauuugagcaaagucgaauacccaacaagcgcauugaucc

SEQ ID NO: 1390 - RNA, 60 nt, Perina nuda picorna-like virus
gucaauaggaauaaauuggcguuuuaagaaacuuguaacaccagauuuaucccuauugac

SEQ ID NO: 1391 - RNA, 103 nt, Perina nuda picorna-like virus
uucucaauugauauaucuguaaauugaacucuuuguauugguacugcaucaaaugcagguaccggcacaugaaaaacggucacauuuacauaaauauugggaa

SEQ ID NO: 1392 - RNA, 100 nt, Perina nuda picorna-like virus
uugguguauuuggugcuuccgucuucugaucguaaucucuagcuugugccuccacgcauucugcugaauuacgaaucaagcgauauacuuuauaggccaa

SEQ ID NO: 1393 - RNA, 65 nt, acute bee paralysis virus
cuaauuguuucacugucucguguagucauauuuuguacugucugaacaacaguccccacauuugg

SEQ ID NO: 1394 - RNA, 110 nt, acute bee paralysis virus
cugagcauaaccauuauauguacugauauccaaacaaucuccaguggccuucugauaggccuuagaaaucacuuuggaccacuuaucaaauacauauuccucaugcauag

SEQ ID NO: 1395 - RNA, 122 nt, acute bee paralysis virus
ucgaaauuuugacgcaaugguuagauuaugucaagaagcuuauaauuauaagcccuccaucuagugaguuugucuuauaaugucuucucgaaccauagugcuccuauugcucgguuuuucgg

SEQ ID NO: 1396 - RNA, 88 nt, acute bee paralysis virus
ucuccguaucauuaguuagauccaagauguauuuguaauuguuaucagaaggcgcuuuaauuccaucuaacugagucaaguccgggga

SEQ ID NO: 1397 - RNA, 130 nt, acute bee paralysis virus
uucacaccugaacucacuuuaacauaauauuucauuuccuuaaucuguucccauuguucuucguaguuuaguguggcuaguuuaaaugcuaaugauguuauuuuaacagcuauuccuucauacguguaua

SEQ ID NO: 1398 - RNA, 131 nt, Bean yellow mosaic virus
aaccucuagaaccauaucccucuucuuuacaaugcugagaaguuccuucgccacauaaugaauuguauguuggccuuucaggucucucuuuuuggccuguaugcgagguuuucuaaugguucuuuuguaau

SEQ ID NO: 1399 - RNA, 53 nt, Bean yellow mosaic virus
cuauuaugacaaacuuauacucuuucaucauugcuggauuguuugcauaauag

SEQ ID NO: 1400 - RNA, 68 nt, Bean yellow mosaic virus
gaccccacacaaaauuggcauuuuuguccagcugguugucacacauuaaauccaaauuaacguggguc

SEQ ID NO: 1401 - RNA, 69 nt, Bean yellow mosaic virus
uggugauuuaggucuguuggucuauugucaaugaauguuugauuauaucccuuccagaauaagucacca

SEQ ID NO: 1402 - RNA, 61 nt, Ryegrass mosaic virus
agcuugcgacguacacuagaauguuauugccauacuguaugauaucguacgucgacuugcu

SEQ ID NO: 1403 - RNA, 74 nt, Ryegrass mosaic virus
ggucuacucggacggcucugucgcaguucaccaucgugcgucgggaauccugcgauguuguugcuaagucgacc

SEQ ID NO: 1404 - RNA, 129 nt, Ryegrass mosaic virus
gucauacuuagguauauacaaugcuaccuugucguacaucaauuccucaaauuucucguuggucuucugcgcuguuuguuuauucuugacuagguaugugugaaggguugucauugugcuaaguaagau

SEQ ID NO: 1405 - RNA, 87 nt, Ryegrass mosaic virus
guucguggcgacuaugaaaugcuuaacuugagcgguuccguguagcucaauuccguguguguuaaguuucauaguucguccaucaac

SEQ ID NO: 1406 - RNA, 110 nt, Hepatitis GB virus A
accaucaagccacaaucaguaacugagucaaaguugccagaguauccgguggaaagcgcgucuguggcacaaacgcacacaucaccggcuggaauuucuguuucccugcc

SEQ ID NO: 1407 - RNA, 55 nt, Hepatitis GB virus A
caggcgaaccuuuugguagaacacgcaccaggugcgauaccaccuaagcuucacc

SEQ ID NO: 1408 - RNA, 76 nt, Hepatitis GB virus A
caguugucgaagaugccacccugugccucgcccaccacuaaaaguaguaggaaagccauuaggaggcguugcucca

SEQ ID NO: 1409 - RNA, 87 nt, Hepatitis GB virus A
cgucacuagcggccgcgaagauugcagcuuccaccugcaugucauguucgucgauugacgaaucaaagcaaguggcauccacaguua

SEQ ID NO: 1410 - RNA, 81 nt, Clover yellow vein virus
caucauuugucaggcuaccauaucuuaaaagcaccucauuuaucuuccuuaugugguuaaauggagucucuguaagugaug

SEQ ID NO: 1411 - RNA, 72 nt, Clover yellow vein virus
gcgucucuuucgaaccauaugguuaacaauuaugugcaugccauaaguugagccauauuuugagaaaguugc

SEQ ID NO: 1412 - RNA, 62 nt, Clover yellow vein virus
uauggugcuuggucaagaacccauaaauaaaaccugcguaugugauugagcaagucaucaua

SEQ ID NO: 1413 - RNA, 60 nt, Clover yellow vein virus
ucauaguucaagcccaacucuuugaaaaguguagaaaguuggucuagauaccacucauga

SEQ ID NO: 1414 - RNA, 65 nt, Clover yellow vein virus
ugaacuuacuuaggucauuccuuuggauggaaucaguucuguuucgaauguaccuaguaauuuca

SEQ ID NO: 1415 - RNA, 88 nt, Clover yellow vein virus
uguuaugucaucauuauuaaaguggcaguuuggaacuguuuuaguuugcaacacaaguccacugugccccucucuuaaugugcuaaca

SEQ ID NO: 1416 - RNA, 72 nt, Clover yellow vein virus
uuggucucuugagguauaagugcuguuugucaaguaacuccuugucaaccauaucaagccuuaugucgccaa

SEQ ID NO: 1417 - RNA, 77 nt, Potato virus A
agucgagauucgauccauucccuugagcuuugacgaaguccugaaaacucacuugguccucaacucgaaucucuacu

SEQ ID NO: 1418 - RNA, 67 nt, Potato virus A
caaugguuucaguuuccaucaugcuuggugguguaguuccagcaaauaugauggauguuaccagcug

SEQ ID NO: 1419 - RNA, 75 nt, Potato virus A
guccagaucgaagucgauggucauguucuucuccucgagaguuggaccuaugucaucuagacuuugaaacugaac

SEQ ID NO: 1420 - RNA, 74 nt, Potato virus A
guugguucaagcaguagaacgguuccuuucuuacugagaugguaggguagcccuguugauuugccagaaccaac

SEQ ID NO: 1421 - RNA, 81 nt, Potato virus A
guuucaauuggugcagcugugaauguucgagucuuguucagaucaacuuuuuccuuuggucgcagcucugcuuugagagac

SEQ ID NO: 1422 - RNA, 63 nt, Potato virus A
uuccaaaaguauguguuuuccuuugguauuauaugggauguuucugacaccauacuugaggaa

SEQ ID NO: 1423 - RNA, 123 nt, Potato virus A
uugaguauuuaaacugaauuuggguguuugauugaacuuguucaaguuuugauuguguuuaaaauguugugaacugcuugaagauuuagaagauugauugcucuaauucguuugauuucuuga

SEQ ID NO: 1424 - RNA, 111 nt, Bean common mosaic necrosis virus
accuuuccuugucaaaugaguccauguccuggaaguaguccugcuucuucccuuuauacugagcaccaaccgcugcuuucauguucaaugagucauagauaucgucagggu

SEQ ID NO: 1425 - RNA, 99 nt, Bean common mosaic necrosis virus
gaaucuauugaguccucucauucucaguguuacggcaugaaagaaugggucccuuccaagcugcuugcuaacauuuucagcaagaggacguguggguuc

SEQ ID NO: 1426 - RNA, 69 nt, Bean common mosaic necrosis virus
gcccugugagugaggagcuaauugugucaaaaugauuuuucuucaugauuuccucacuuauuaaguggu

SEQ ID NO: 1427 - RNA, 127 nt, Bean common mosaic necrosis virus
gcuuugccuuguagacgaacaguguucaacacuccaagauccucauaguuuugcagauuauugagaucgacuguauuacuauuaaauucaaggaguugcgcucgugccuguugcaagauugcaaugu

SEQ ID NO: 1428 - RNA, 61 nt, Bean common mosaic necrosis virus
guuuagcauaacugguuuguuauacuugaagaaaucuuucuuaaaagccucuuuguugagc

SEQ ID NO: 1429 - RNA, 62 nt, Pepper mottle virus
aagauaggcuaucuucaaccacuaauuucacugggaauuguguugugaacucuaccucucuu

SEQ ID NO: 1430 - RNA, 131 nt, Pepper mottle virus
cucaaauguaugcauugugcgaacuugugguauuguacaauuuuuaaucaugcuuguggagacgccacuagacaugacugguaaauuguacgcaaagcaauacagagcagcuucaguugauaucauuugag

SEQ ID NO: 1431 - RNA, 109 nt, Pepper mottle virus
gaugacucacuucagacauuuucgcggugaaccacguauacaauagccaugcaccaccacaugcaacaccggccgcaaugaucgcaucgcgaacaaugagugauuuauu

SEQ ID NO: 1432 - RNA, 110 nt, Pepper mottle virus
uacuaagcaauacuuucgcacuaggaaauuugcgcaugagugauccuacaaaauagguugaaaugcccaaacaccuugcgucaauaaaauucuuaguuccuugcuuggug

SEQ ID NO: 1433 - RNA, 60 nt, Pepper mottle virus
uccgaucuucauaugccaaauaaccuuuugaugggucuauuuguuggaagaaguucagga

SEQ ID NO: 1434 - RNA, 55 nt, Pepper mottle virus
uucugauuuauuccucguccgagaugagaaaucauaauugagcccuaaaucagaa

SEQ ID NO: 1435 - RNA, 71 nt, Equine herpesvirus 2
auggagacugauaguuuaggcacuugaauucugccuaggucaugaaaaggugcuuaaacuaucgcuuccgu

SEQ ID NO: 1436 - RNA, 85 nt, Equine herpesvirus 2
caggacuucaagugcuguguuaguagccuagaggcguuucuguuaaaccagcuccuaggcaacuacacagcugcauggugucuug

SEQ ID NO: 1437 - RNA, 122 nt, Equine herpesvirus 2
cccccaucguccuccagcagaggcgccgcgugcuguucuguagugaaauuaugcugguuauguaaugcaaaauuucacuacagcagcgcaucggcgccuuaugaacacuuggaagauggggg

SEQ ID NO: 1438 - RNA, 75 nt, Equine herpesvirus 2
ccccguggcagaguucucugccagaaccaggaugguaaaaaaaaacccuggcucugcagcgaacucuacccgggg

SEQ ID NO: 1439 - RNA, 88 nt, Equine herpesvirus 2
ccuaggccccgaguggggugguugggaaggcaguuuuguaucucuggcaaaaaagcuggcuucccaaacacucuguuuggugucuugg

SEQ ID NO: 1440 - RNA, 131 nt, Equine herpesvirus 2
cgguugguggguguguguguccaaacuauaagccccgaguggagugaaugagaaggcaguuuuguguaucagaaaagaaagcugccuucucagacuccgcucggugcucuggaccaccacacccaccagag

SEQ ID NO: 1441 - RNA, 85 nt, Equine herpesvirus 2
gaaaaccccgcuucggagauuucucuaguacuuagguucguguaauugauuccuaauacuucagaagucuccggacgguguuuuc

SEQ ID NO: 1442 - RNA, 108 nt, Equine herpesvirus 2
gagagcugcguaaucugcagauacuguguagaagagauugggaacuucugucguuaacccuaagcaccgaaguuucggucucuucugcaugcuaucuggcgggcucuu

SEQ ID NO: 1443 - RNA, 130 nt, Equine herpesvirus 2
gaggucuagggucugcagaaugccagagccccgaguguaagguuuacgaggaacgugguuuuguuucuaaaacaccuagcuccucguggaucuuuaaacggcgccuggcaaaauccacgagcagacucuc

SEQ ID NO: 1444 - RNA, 83 nt, Equine herpesvirus 2
gcgaaacacugaaucaagaucucaccucacuguaguugugccugugacaauccagugcugugagaucuugugcaguguuuugu

SEQ ID NO: 1445 - RNA, 84 nt, Equine herpesvirus 2
gcgggauaccgcguaagauagaaaggguuggcuaugugucucugguaaacauaguuacacuuuccuaucuucgcgguguuuugu

SEQ ID NO: 1446 - RNA, 70 nt, Equine herpesvirus 2
gcgugagauauuagggaaccuggaccgcuguguaagaaaagaccaguucagguacucuagugucucccgc

SEQ ID NO: 1447 - RNA, 83 nt, Equine herpesvirus 2
gguaucggguuucacuaucccguccacaguuccuuguagauacaucuucuccugcuuguuaacgcuuuuugaaagccgauacc

SEQ ID NO: 1448 - RNA, 96 nt, Equine herpesvirus 2
ggugggggguucagagugaacgaggagagguauugcagugauucucugugagauauuucaacaccaccccucguucaguccgaguucccaaacacc

SEQ ID NO: 1449 - RNA, 72 nt, Equine herpesvirus 2
guauauaccacacacccguauagauuguguuuauuuugcuacaccuaaucaguacggauguguggugucuau

SEQ ID NO: 1450 - RNA, 84 nt, Equine herpesvirus 2
gucacacccgagguagugaucugcugaaggcuggggugcucuugaggaccuagcuuuggucagaccauuacugcucguguggac

SEQ ID NO: 1451 - RNA, 87 nt, Equine herpesvirus 2
ucaaaauccugugaaucguccgaguggagucaguuguguguaagccauacucaccuggaucaacccugacgaugcacaguguuuuga

SEQ ID NO: 1452 - RNA, 70 nt, Equine herpesvirus 2
uggcuuaagcagucugugacacuuaaguuuuguauaaaaaauaauuuaaguucacagacucuuaggacca

SEQ ID NO: 1453 - RNA, 83 nt, Equine herpesvirus 2
ugggcgucuguguagaggagaggaggacuugcgauuagucauggaguaaucguaacuaccccucuccuccacaccgaguccca

SEQ ID NO: 1454 - RNA, 62 nt, Infectious flacherie virus
augucaauucauuagcuuucuugauaauaucauuaaccguauucaaaagcguaggauuacgu

SEQ ID NO: 1455 - RNA, 74 nt, Infectious flacherie virus
cgaccagccugcgcuugauuugaauuaauuuuaagaguaauuuccaagucaguuuucauaaguguaaacggucg

SEQ ID NO: 1456 - RNA, 84 nt, Cocksfoot streak virus (CSV)
agaugucuguuaucaaccauuuguucgcgaaugucugcgaaguguuccaugacaaucguuauaucuguuugaaugcucucaucu

SEQ ID NO: 1457 - RNA, 66 nt, Cocksfoot streak virus (CSV)
caacugaagcguucugagugacgacagggagaccaaaggcgaaacaaaggaaagccgcuucaguug

SEQ ID NO: 1458 - RNA, 57 nt, Cocksfoot streak virus (CSV)
cgaccaucgauuuugcugacuguguaaccgcguucuaucagcaguuuaccgagggcg

SEQ ID NO: 1459 - RNA, 62 nt, Cocksfoot streak virus (CSV)
ggcuauguauggggcuuuuccaauggaggccaaaugcuugaaaggcuccauuccuaauagcc

SEQ ID NO: 1460 - RNA, 106 nt, Cocksfoot streak virus (CSV)
gucgauuaaggaugugauuuugaaacgcacucguuggagggucuaaaccaacuuugagcccaguuucaugacguguuucaaccuuaaacacggacuuccaguugac

SEQ ID NO: 1461 - RNA, 61 nt, Cocksfoot streak virus (CSV)
guguuuuagcuugaugcuugaccaucggauacgucauuaacaucgcaguugauuuaagcgc

SEQ ID NO: 1462 - RNA, 59 nt, Cocksfoot streak virus (CSV)
guuuaaggaaaccuucuccaucggacggauuucugcuuucagagaggcguuccauaaac

SEQ ID NO: 1463 - RNA, 89 nt, Cocksfoot streak virus (CSV)
uuaaguccaagugcuguugaaagcuuagaagaaguuugauguugcacaauguugagcacaccaaaguuccuaagcauuucuggauuuga

SEQ ID NO: 1464 - RNA, 80 nt, Brome streak mosaic virus
agcucagugauaucgucucgcuccaugaaguacaaccuuauuguuagaacagcauucaugagcaacggcguuauugagcu

SEQ ID NO: 1465 - RNA, 95 nt, Brome streak mosaic virus
caugcguguccauuagcugagacaacacaaauagcguugauggguuacaaaucauauccacgagccauucguuguccugguuaaguuuuuccaug

SEQ ID NO: 1466 - RNA, 121 nt, Brome streak mosaic virus
gaaagaaacgccaugaaacgugcgccuccacaaaaguggcgaaacacgcgcccuggaauaacgcccgacuuuccauuuugcugcgcuuuuguuacgcucguuugaucaaguuugcucuuuc

SEQ ID NO: 1467 - RNA, 124 nt, Brome streak mosaic virus
gacguagugggacucuuggucugaugcgcuuuuucuucucguagucaacaaacacuagcggaauggcuuuuucugcgcauaucugcgacguuucggucaucagaucguagauuuccacuguguu

SEQ ID NO: 1468 - RNA, 68 nt, Brome streak mosaic virus
guuccacgagcgucgugaaggcuuucgaaaguugauuacuuuagaaggcuuugugugaguuugugagc

SEQ ID NO: 1469 - RNA, 130 nt, Brome streak mosaic virus
uccgaauaagaugucgaugggcgcugaugugaauguucucgucuuguuggcugcaaccuucucagcuggacguaacucagccuucaggagagcugaccacacuccgugcccauuugcacaaauuuuccca

SEQ ID NO: 1470 - RNA, 103 nt, Gallid herpesvirus 2
cauauugaucgauuagaucgagcuuugaaaagguuaacauguguggcccuauauuugccauaauggugaccauuacaucggcuggauccaaucgaacaaccug

SEQ ID NO: 1471 - RNA, 69 nt, Gallid herpesvirus 2
cauucaacaguuugcgaguccaacucuuuaguuucuucgacuuuaguuaaaagcagugcugcuugagug

SEQ ID NO: 1472 - RNA, 91 nt, Gallid herpesvirus 2
gcucuucuacgugaucuuuuuucaauucuucugcuauggacauuauaguguuuacagauggaauuauaauagagaccccauauucuagagc

SEQ ID NO: 1473 - RNA, 95 nt, Gallid herpesvirus 2
uggaauauuaucuuuggauaguuguacugauaagcaauucacaaacgcuacuguggauaucgagucugucauaacuucauaaauagucuugucca

SEQ ID NO: 1474 - RNA, 97 nt, Plum pox virus
aggcuguaaaacugauuauugaagucaucaacgcacacuuuuccccccagaaggguaucaaucggugcugcugugaaugaucgaguuuuauuagccu

SEQ ID NO: 1475 - RNA, 119 nt, Plum pox virus
gccuuucccuucaccuuuggcagagauaguuucgaagucauugccuucaaacguggcacuguaaaaguuccaguugauccugcaucgacaucccugucucuguuuguguugacuagcgc

SEQ ID NO: 1476 - RNA, 82 nt, Plum pox virus
ggaucaacaaagcgaacaaaguuguagucuguaggaucguacccguacauguucacaaauuugcguguuuucguucccaucc

SEQ ID NO: 1477 - RNA, 79 nt, Plum pox virus
ggcgccaaaguugcggauaaguucaggauaacuuggaucaauguucagguucuugaauucuagcaacugagacuucgcc

SEQ ID NO: 1478 - RNA, 115 nt, Johnsongrass mosaic virus
aaugugauauccaguuguaagugagccaaaagugucaacuacgugcauaguuuucgugucaugauccacuaaaauuuuugguauuuccgcuuguaauguuucuggauagaauauu

SEQ ID NO: 1479 - RNA, 98 nt, Johnsongrass mosaic virus
caguucuccgguaaucuccucauuaaggaaucccaacccuuguagaauuuugagauuccuacuguccaggguccuuugagaugauucugguagaacug

SEQ ID NO: 1480 - RNA, 79 nt, Johnsongrass mosaic virus
ccuuugagaauguuucuagguccucgucaguugguucuucguacuugucugcuaucuugaggaccagcuucuuuacagg

SEQ ID NO: 1481 - RNA, 51 nt, Johnsongrass mosaic virus
gcugauaugcuuuggaaaugacuaugcuuaaucuguuccucuuuuaucagc

SEQ ID NO: 1482 - RNA, 64 nt, Alcelaphine herpesvirus 1
guacaagugcauguuaauuaguuuguaaauucaaucugcauuagucgucagcuguacauuguac

SEQ ID NO: 1483 - RNA, 82 nt, Alcelaphine herpesvirus 1
gucuagcugagccacgaggucacagaucuuagugacgcauacguugagguuagauucuuccagggccugagguucaauagac

SEQ ID NO: 1484 - RNA, 75 nt, Alcelaphine herpesvirus 1
gugugcagcggcccacuccucaugucuguaacugaugccuccuaguuucagaugaguaggagggcuccuguguac

SEQ ID NO: 1485 - RNA, 60 nt, Alcelaphine herpesvirus 1
ugaaaaugcaaccuacacauguaaagucucuaggauguuauuguuuugguuggaguuuca

SEQ ID NO: 1486 - RNA, 131 nt, Aphid lethal paralysis virus
cgugugagucgauuagucguuucaguucgggauucuugaugauagaaggcaaaguauuacuaauuugcuuagucauaucauaaagaucggcuguuuuaaauccuugauagaaacgagucaacagacacacg

SEQ ID NO: 1487 - RNA, 131 nt, Aphid lethal paralysis virus
gauaauuuauuaauauaaagcguauuuagauauugcaaugucucacuacugccugacucaguuauaucggcgucuguagugaaauugaaugcaguaacauaaaaugcgaaaaucauaucaauaaaugcguu

SEQ ID NO: 1488 - RNA, 75 nt, Aphid lethal paralysis virus
guaauuuguccgagauagcauuagucaaaucugcaaacauaguuaaagauuuguuaauagcuaguucuaaguuau

SEQ ID NO: 1489 - RNA, 129 nt, Aphid lethal paralysis virus
uacaacgcguaacaaaggguggaccuaauagcccacagaaacugaaaucaucgcccacagcucuauaaaagagugcuuuagugguuucagccucugucaauauauugaccgauacuaaguuacguugua

SEQ ID NO: 1490 - RNA, 89 nt, Aphid lethal paralysis virus
ugagauaguaucagacacuguggaaguggcacguaauucauuaagaaugaguacguacaaccuaccaacagagugcugauaauccuuca

SEQ ID NO: 1491 - RNA, 67 nt, Aphid lethal paralysis virus
uuaggaucugcauugucugguaauuuaucaucauuugaauagucaccaggaacaaauaaaauccuaa

SEQ ID NO: 1492 - RNA, 131 nt, Aphid lethal paralysis virus
uucgaaaguuccuucaagauuucguggcauauauacaucagcagcuguucuagucucaucgaugacaguauugucuucuugaacuggaccagcauuagcuucuguagcgccauucucugggaucaaucgaa

SEQ ID NO: 1493 - RNA, 122 nt, Aphid lethal paralysis virus
uuuguggguaauuguacaauggcaaugucucuacgaggauccuuaacaugguuuucuuguucaagaauaaccgagcaugggaucaacggugagauagcauuacuacaauucuccaacacaaa

SEQ ID NO: 1494 - RNA, 127 nt, Potato virus V
acgaucucaguguacaaguuuuguaacauuugaaaaccaauaucccauuccuccauaaaugcauaccucacagcuagaacugcauugaucagauaaggugucaaagagcugucgaacugagauccgu

SEQ ID NO: 1495 - RNA, 78 nt, Potato virus V
aggcaucaaacuccucugaacuugaauccacauuuagauagaguuucuuaagugcaagcucaguaauguauggugccu

SEQ ID NO: 1496 - RNA, 79 nt, Potato virus V
uagugguugcacuugcaauuucaucauguuugagacuuuaaauguuccauggugagaucgcacuaugaguguuccauua

SEQ ID NO: 1497 - RNA, 80 nt, Potato virus V
uuugugugguaugcauguaucagacuucuaaaagccauugaagaggcguccaugacaugacauucaucaauuaucacaaa

SEQ ID NO: 1498 - RNA, 67 nt, Parsnip yellow fleck virus
gaagaauugaaaagagucuuguuuuggguuuuucauaaauuuuguccaaggcucuucucucaucuuu

SEQ ID NO: 1499 - RNA, 58 nt, Parsnip yellow fleck virus
gagagcuuugaagagaaagauuugaagaaugaauucuguaaucgaugcaauugcuuuu

SEQ ID NO: 1500 - RNA, 71 nt, Parsnip yellow fleck virus
guccuucacuuuaauuaaaaagcucaguucguauacuaacccuauuaacucaguuuaaagccaugaagggc

SEQ ID NO: 1501 - RNA, 88 nt, Parsnip yellow fleck virus
guugaguauuaggauugugccaaacugaaauugggcucugccauccaucgccaagagccuccucuuucaccacaaaccuguauucaau

SEQ ID NO: 1502 - RNA, 58 nt, Parsnip yellow fleck virus
uugugugaguuacuaucaugcgcagaaaccgcuuuguguaucgacaugaacucuaugg

SEQ ID NO: 1503 - RNA, 76 nt, Pea seed-borne mosaic virus
gauggauugguaagcuaugugucuucucaaugguaaacugcccaugccuugacacaauucuuguuuccccuucauu

SEQ ID NO: 1504 - RNA, 58 nt, Pea seed-borne mosaic virus
gucacugaaaugcgccauuaucugucugaaaguuggacgcgcauuauccaucacuggc

SEQ ID NO: 1505 - RNA, 104 nt, Pea seed-borne mosaic virus
uugcgccauuguuguaaaaauuguucuaacuuuugauaauguugaaaauacagcaucacuccuaucagagccaaacaucauugccaacaaugccaucaaugcaa

SEQ ID NO: 1506 - RNA, 54 nt, Ectromelia virus
aacaucaaugucgcaauuuguauuguccaauacagaaugucggugauucguguu

SEQ ID NO: 1507 - RNA, 62 nt, Ectromelia virus
accauuccaagucacuguguguaagaagauuauauucuaucauaagcuugacuacauuuggu

SEQ ID NO: 1508 - RNA, 83 nt, Ectromelia virus
cucccugaucuauguaucuagcgguguuauuauaaacucucaacauuggaauaauaccauuggaugcaccauuggucccggag

SEQ ID NO: 1509 - RNA, 91 nt, Cowpox virus
cucguuucauaaagagaucaggaauccaaagagcuauaaauagaucucugguucuaugcuccucguuuccuguauucuuuuuaagaucgag

SEQ ID NO: 1510 - RNA, 113 nt, Cowpox virus
gacauacauacuaucuuuaauagaacucuuuucauccaguugaauggauucguccuuaaccaacugauuaaugagaucuucuauuuuaucauuuuccagaugauauguauguc

SEQ ID NO: 1511 - RNA, 51 nt, Camelpox virus
gcgcaauucauuuucggguuuaaauucuuuaauaucgacaauuucauacgc

SEQ ID NO: 1512 - RNA, 92 nt, Ectromelia virus
gcuuuccagacgacucgagccuuuauuauauucuuguaucucuuuucucuuucguauuguguauauaaucguucgaacucgucuccccaagc

SEQ ID NO: 1513 - RNA, 101 nt, Camelpox virus
gugguaagaaccgauagguuauugacauuguaugguuuuaaauauucuauaacuugagacuugauagauauuaaugacgaauugaaaauuauuuuuaucac

SEQ ID NO: 1514 - RNA, 103 nt, Ectromelia virus
guguagauuugauacggcuauucuggcggcuagaauggcauaaucuggauguuguguaguacaaguggcugcuauuucugcugccagaguguccaauucuacc

SEQ ID NO: 1515 - RNA, 102 nt, Ectromelia virus
uacaaaggagaugauuuaucgaugguauuaagaauucguuuuucgacauccgucaaaaccaauuccuuuuugccuguaucauccaguuuuccauccuuugua

SEQ ID NO: 1516 - RNA, 109 nt, Ectromelia virus
ucauuaauagggacuugacguacguagcguacaaaaugaucguuccugguauauagauaaagaguccuauauauuugaaaaucguuacggcucgauuaaacuuuaauga

SEQ ID NO: 1517 - RNA, 60 nt, Ectromelia virus
ugauggcugauagugucacugcacaagauuuccaaucuuugacaauuuucagcaccauua

SEQ ID NO: 1518 - RNA, 64 nt, Cowpox virus
aaugguagcgcaucuuuaacucgucaguuagcucuuucuuuugaucgaguucgucgcuacuauu

SEQ ID NO: 1519 - RNA, 62 nt, Cowpox virus
gacuugauagauauuagugaugaauugaaaauuauuuuuaucaccacguguguuucaggauc

SEQ ID NO: 1520 - RNA, 79 nt, Cowpox virus
ggcuauucuggcggcuaaaauggcauaaucuggauguuguguaguacaaguggcugcuauuucggcugccagagugucc

SEQ ID NO: 1521 - RNA, 130 nt, Cowpox virus
gugcugaggucuuucaacgaucuuguuauuuauuuucaacaaguaagauuuuuccaaaguuuuaaaaccaaaauaguuguaugaaaagucucguucguaaauaauaaccgaguugaguuuauccuuauau

SEQ ID NO: 1522 - RNA, 102 nt, Cowpox virus
uacaaaggagaugauuuaucgaugguauuaagaauucguuuuucgacauccgucaaaaccaauuccuuuuugccuguaucauccaguuugccauccuuugua

SEQ ID NO: 1523 - RNA, 116 nt, Cowpox virus
ucgcuucuaucuuguuuagauuuauuuuuauaaaguuuagucucuccuuccaacauaauaaacguggaagucaucugacuagauaaacuaucaguaaguuuuauagagauagacga

SEQ ID NO: 1524 - RNA, 92 nt, Monkeypox virus
ggccauuuuuaauauuuaagugauacaaaacuaucucgacuuauuuaacucuuuagucgagauauauggacacagauaguuauaugauaacc

SEQ ID NO: 1525 - RNA, 102 nt, Monkeypox virus
uacaaaggagaugauuuaucgaugguauuaagaauucguuuuucgacauccgucaaaaccaauuccuuuuugccuguaucauccaguuugccauucuuugua

SEQ ID NO: 1526 - RNA, 104 nt, Monkeypox virus
uaucuuguuuagauuuauuuuuauaaaguuuagucucuccuuccaacauaauaaaaguggaagucaucugacuagauaaacuaucaguaaguuuuauagagaua

SEQ ID NO: 1527 - RNA, 98 nt, Monkeypox virus
uucacucguuucauaaagagaucaggaauccaaagagcuauaaauagaucucuuguucuauguuccucguuuccuguauucuuuuuaagaucgaggaa

SEQ ID NO: 1528 - RNA, 65 nt, Variola virus
caaacggaguaaaauaaauaucauuaauauaugcucuagauauuaguauuuuuauuaauccuuug

SEQ ID NO: 1529 - RNA, 91 nt, Vaccinia virus
cucguuucauaaagagaucaggaauccaaagagcuauaaauagaucucugguucuauguuccucguuuccuguauucuuuuuaagaucgag

SEQ ID NO: 1530 - RNA, 63 nt, Variola virus
ggacauguaaacuugacaaaaauugugacuuuguuauuggucaaccuuuguuguacaaauucc

SEQ ID NO: 1531 - RNA, 93 nt, Variola virus
ggucuaugucucuuauuagagauuucagcuucuggaauaggauaauaauuaauaucuauaauuuuauugagguuucugacaauuacuuugacc

SEQ ID NO: 1532 - RNA, 102 nt, Variola virus
uacaaaggagaugauuuaucgacgguauuaagaauucguuuuucaacauccgucaaaaccaauuccuuuuugccuguaucauccaguuugccauucuuugua

SEQ ID NO: 1533 - RNA, 108 nt, Vaccinia virus
ucuaucuuguuuagauuuauuuuuauaaaguuuagucucuccuuccaacauaauaaaaguggaagucauuugacuagauaaacuaucaguaaguuuuauagagauaga

SEQ ID NO: 1534 - RNA, 82 nt, Macaca mulatta rhadinovirus
aucguaacgagacggaauccaaagaacacgcccgaucuuaagaccacgggcacgugucuuuggguuccgggggcguuacgau

SEQ ID NO: 1535 - RNA, 121 nt, Macaca mulatta rhadinovirus
augggauuaaauaccagggauacaggcuguagguucgguaauggguaccaggcuggagugacucauaccaugggauuaaauaccagggauacaggcuguagguucgguaauuuaaaccuau

SEQ ID NO: 1536 - RNA, 84 nt, Macaca mulatta rhadinovirus
ccguuuaucaaaauggaaaaauuaaggcuuugcguuaaaaucugcuaacgcaaagggcacuuaauuuuuccaguuuggacucgg

SEQ ID NO: 1537 - RNA, 101 nt, Macaca mulatta rhadinovirus
gaaguuacauuccgacauacaagcggacccaaaaaaacaccccaacgcaaaacaacuggagacugugucuuugggucccuuccacgucgcaaugagauuuc

SEQ ID NO: 1538 - RNA, 123 nt, Macaca mulatta rhadinovirus
gaauacggccaacgcgccagcguccaaccgcccuccaaccgugcagcgccguauauucgaauugccuuccgcacgaauacggggcgcagcauggucgcgggaggcuggcauugcgcaauauuc

SEQ ID NO: 1539 - RNA, 107 nt, Macaca mulatta rhadinovirus
gacgccguuaauaauuggcaguaaacugcgaaagggcguacaucgcaguagugauuuuacgaugugcacaccuuuccgcgguucaccgccaacaacaaaagcggguc

SEQ ID NO: 1540 - RNA, 84 nt, Macaca mulatta rhadinovirus
ggcggguucgacccauugaccgcauccucgguggccgggcagaggccggccggccaaaggugcgaucgcggggucugacccacc

SEQ ID NO: 1541 - RNA, 81 nt, Macaca mulatta rhadinovirus
gggcgcugggggugauauguucugaugaccgccgccuuacguuugcagcggugucagcggaacauauucuccccggcuccc

SEQ ID NO: 1542 - RNA, 108 nt, Macaca mulatta rhadinovirus
uaacggcgacuuugggcagcgaaucagugucugucgcaaacccuguuaaauuuaaacacaacagggagcgcgacuaaacacggacuaacugcucaucgggcccuguug

SEQ ID NO: 1543 - RNA, 98 nt, Macaca mulatta rhadinovirus
ugguguugcaaugcauuagggaaucuaaaaacgaaauccugcucgguaacacggaaauugucuuuaguucccuacagcaucacaacaauuguaaacca

SEQ ID NO: 1544 - RNA, 77 nt, Bean common mosaic virus
agccgugggacaaccuucccuuuggagccugcguucacauccuugucucucauuguugaaucuccugcaccacggcu

SEQ ID NO: 1545 - RNA, 58 nt, Bean common mosaic virus
caaaugcuuuguuuuguugugcugacagaaucauguugugcauuguugacaucauuug

SEQ ID NO: 1546 - RNA, 65 nt, Bean common mosaic virus
cgaugaaauaagcuugaauuccagguuugcuccugauuagauuugcgucaaguucguccucaucg

SEQ ID NO: 1547 - RNA, 61 nt, Bean common mosaic virus
gugccaccaaaaagaucugaaaugagcuuugagauuuugaauucuucuuuugguuggucac

SEQ ID NO: 1548 - RNA, 93 nt, Bean common mosaic virus
guggaagaucaauguauuuaggaucuccagauguaccaaccacgaggugucucuuaguuggacucuugaguucagaauacauugguguuccau

SEQ ID NO: 1549 - RNA, 61 nt, Bean common mosaic virus
ucuggcucgauccgauguuuuggaugucaccucauagaaaucaaaagcguagcgagcuaga

SEQ ID NO: 1550 - RNA, 50 nt, Human herpesvirus 5
cguugagguagaagacaaacucgcguaaccguuguccguuauacgucacg

SEQ ID NO: 1551 - RNA, 58 nt, Human herpesvirus 5
ggauuacagaguauaacauagaguauaauauagaguauacaauagugacgugggaucc

SEQ ID NO: 1552 - RNA, 65 nt, Human herpesvirus 5
ucugguauacacccgucucgugguacgaaguagagcgcggcaccaccggacggaugcaguccaga

SEQ ID NO: 1553 - RNA, 71 nt, Human herpesvirus 5
cagugcuccagcggcguuucgguccacguguccuggagcaguugacugagauugagaucccgggagcguug

SEQ ID NO: 1554 - RNA, 75 nt, Human herpesvirus 5
gccgucgauaucggaacugacgaaagagcucaugugccgcacgcuguucuugacguaguuuugaaacuccacggc

SEQ ID NO: 1555 - RNA, 65 nt, Human herpesvirus 5
gccugcugcgucucauggaucagaaguugcggacccaaaauuugguccaagugguuuagcgaggc

SEQ ID NO: 1556 - RNA, 126 nt, Human herpesvirus 5
uguaggcgcugcugcacuucggguagcugcaggccgccuagcgcuuccagcugagcuagcugcuccuguaccaaggccagugucagcgccgagccgcggcugcccgggucgcgcaccagcgucucg

SEQ ID NO: 1557 - RNA, 75 nt, Rhopalosiphum padi virus
aaaggagccguaauuccuaaugagcagcauauagcgcggugugacgcggugugcgaagggauuauagguucuuuu

SEQ ID NO: 1558 - RNA, 130 nt, Rhopalosiphum padi virus
auauuugagauuaacuugugcuuuuuccauauguaaagcguaacaauggcauuuuguauaccauuucacgcacaaaucaacauucuuaugcuugcauuuuuuacaauuucuacacucauuaucuaaacau

SEQ ID NO: 1559 - RNA, 130 nt, Rhopalosiphum padi virus
caaaauugguguuggcuccaauuugccacaguguuuaaucaaugcuaauaacucaaccauaucaaauccuugugauaggcgagcacaaacacaaacacacggcauaucguauaccuucaucacauuuucg

SEQ ID NO: 1560 - RNA, 130 nt, Rhopalosiphum padi virus
caacagcauggagcgcgucaacgccagauuuagcauauccuauuaauugaccaacaccagguauuuuggugagugguuccaugauaguagaauaagcuucagacuggcgagugacgaacccuuguuuuug

SEQ ID NO: 1561 - RNA, 65 nt, Rhopalosiphum padi virus
ccugauacuauuuaacguaucuuuaaauaagggauaaaccauauucaaagguacaauaguucggg

SEQ ID NO: 1562 - RNA, 62 nt, Rhopalosiphum padi virus
gcugucguugguguuguuuuuuuucguaauaugaaauauaacgaaaaagcaccaauugcagc

SEQ ID NO: 1563 - RNA, 104 nt, Rhopalosiphum padi virus
gcuuccggacaauucaaugauucaaucuguaaacguuguaaauuagaagucaaacaaauuaauuuagguucugcaaauguguuguuuuuguccaacaaggaagc

SEQ ID NO: 1564 - RNA, 60 nt, Rhopalosiphum padi virus
ggcaauauuuuccgcaaucucauauuagugucaucaucaugagauugguaucguauagcc

SEQ ID NO: 1565 - RNA, 93 nt, Rhopalosiphum padi virus
guaccuauuuugaguaggcgggguuauggcacuaaaacgcuuaauaagcugucuaaaugacguaacuuuuucccccaucaucaacauagaugc

SEQ ID NO: 1566 - RNA, 131 nt, Rhopalosiphum padi virus
uagacauuucaucagaaucagugcgaaagagagauuggagauguucaauuucauuuuggcuuguuaaacccaaauuaguugccauauccgaaccaucugaauuacacaugaauuuugauggggcuuguuua

SEQ ID NO: 1567 - RNA, 70 nt, Saimiriine herpesvirus 2
aaauucuguugcuacuaagugauucaacagaagagaguagcuuguugaaucagauguguuugcaggauuu

SEQ ID NO: 1568 - RNA, 73 nt, Saimiriine herpesvirus 2
aagagagucagugccuggaguuguucuuucaacaggaugguugaaaaggguguuguccucuacugucucuguu

SEQ ID NO: 1569 - RNA, 75 nt, Saimiriine herpesvirus 2
gauugcaaguauauaugcaggagcuagcggaagcagacuguuuauagcuucugacauauuugauaugaugucuuc

SEQ ID NO: 1570 - RNA, 65 nt, Saimiriine herpesvirus 2
gcuggugauaugucuguuuuaucuuguuucauaguauguaacaagucuguuaauacauuauuagc

SEQ ID NO: 1571 - RNA, 83 nt, Saimiriine herpesvirus 2
gcuuuagguaugaaaaaugaaagcauguuugcaaguuuccaagaaaauuuguuugcaugacucaauguuucacuuucuauagc

SEQ ID NO: 1572 - RNA, 60 nt, Saimiriine herpesvirus 2
ggcuagaugucuguuugagaauauuuaaaaagucagugauauuuugagcugacucuaguu

SEQ ID NO: 1573 - RNA, 81 nt, Saimiriine herpesvirus 2
ucaagaguagauauagcauuuuguaaaacugaaagaucaucagugguguuagcgguuuuuucuaaguuguaaaacuguugg

SEQ ID NO: 1574 - RNA, 129 nt, Saimiriine herpesvirus 2
ucuaguuguaugaagcuuauaucuagcguaucaucaaugucaucaucugaauaugaccagucgugaauguuuucaucaccuaucauguauauuguuucuugaucacuauguguaguuucaguaucuagg

SEQ ID NO: 1575 - RNA, 131 nt, Ateline herpesvirus 3
aguagagaugguuguuagugugguuccacagagaauauccagagaugccaauauuugagaagauucugauauguuaucuagcaaggcuuucauuuguuggagcuugaccuuccaacuauccuuaguagccu

SEQ ID NO: 1576 - RNA, 131 nt, Ateline herpesvirus 3
auguucugaaacaauaauacuuuuagggucauuuguuuuguuaugcacuggggacaaaaaagucuugguuuuugguggcuuugguggguauaacagugguguuucugcaauauguuuuguuucacuuaugu

SEQ ID NO: 1577 - RNA, 109 nt, Ateline herpesvirus 3
guguuguuuuuuguuguauguagcuauuaguucccauaauauuuccuguuuguaugccauaugcguacacaggguuuggguucccuggcuccaagaauguugauggcac

SEQ ID NO: 1578 - RNA, 130 nt, Ateline herpesvirus 3
uuaugaguuuaggccacaucguaaguauuauuugaaugaguuuugugugguuuacauauauuggcacugugucgggaugcauuguuuguggguguaagucauucauaauuaucuuuauuauguggcagua

SEQ ID NO: 1579 - RNA, 60 nt, Ateline herpesvirus 3
uuucaguaauuaugagguugguuuuaagaagaguuuuaagaucuuuuguagguauugaaa

SEQ ID NO: 1580 - RNA, 70 nt, Leek yellow stripe potyvirus
ccuaauauucaaaguguuuauaaggugguuguaccacgcuacaccaguaaauaaaacuuacgauauuagg

SEQ ID NO: 1581 - RNA, 122 nt, Leek yellow stripe potyvirus
gauuauaugauacugcaacuggugcgccuguuugucuaagaucuagcguccuuucuggaaagcccaucacguuauuugaucucccacucacccgcaguggauugugcggaguuaagucaauc

SEQ ID NO: 1582 - RNA, 93 nt, Leek yellow stripe potyvirus
guuacguucaaucugauuuuuccaccacugcgaaaauguggcaccagguauucgauuaauggugggauccgcaucuguuaaguugaagucaac

SEQ ID NO: 1583 - RNA, 67 nt, Leek yellow stripe potyvirus
uagugagagcguaguuaaaagaugaacaggaacuagaugucacauuagcgaaauaugcuuucuucug

SEQ ID NO: 1584 - RNA, 124 nt, Human adenovirus E
agacugacacaguggccaguauuugacuaccacauuuagucaagcaaaguguuaguuuugcaucauuuucugcgaguauuugacaguuuggugauggaucagguguuguccacaaagugaguuu

SEQ ID NO: 1585 - RNA, 91 nt, Human adenovirus E
agccugaggcgcucggggaaaaugaggucggccagguccgaggcgguggugcgcucgucgaacccgguccacagacccuugaguucuucug

SEQ ID NO: 1586 - RNA, 107 nt, Human adenovirus E
agcuccuccucgugcuccgcgggcgucacauagcccaggucaaucucgauggauuccuccaucucuugcaugucugggacggccgcgucggagguggcggggcuggg

SEQ ID NO: 1587 - RNA, 120 nt, Human adenovirus E
ucuaagguaagcuuuauguuuccaucaguaucaaauguaaguggagagacuaacuguacugccaaggcagagccacggaguccuaaaccugauccaaaaccuaaagcuaguguguuuaga

SEQ ID NO: 1588 - RNA, 82 nt, Human adenovirus E
uggaacagccaggugagguacuucuuguggggcuuacacuggagcuggagcucggucucguucccggugaagaacaaagacu

SEQ ID NO: 1589 - RNA, 71 nt, Taura syndrome virus
aaaguccugaugggauuccaccacagcagucuuagcucuauaguccugaugggauucaacuacagcacuuu

SEQ ID NO: 1590 - RNA, 53 nt, Taura syndrome virus
gaccugagcuuuugcaauuaaguccuuaacugaauugcgugccuccuugaguc

SEQ ID NO: 1591 - RNA, 96 nt, Taura syndrome virus
gauaaguggauugagaacggaaaugacgauucggccuggggcacaaucugccguguacccaacuuucgcuggaucguacacucgcauccacuuauu

SEQ ID NO: 1592 - RNA, 93 nt, Taura syndrome virus
gcccgacacccaggaaacaggcuuggcaauuguggauagaauagguacuccuaccccaucuacuacauuugccaccgcaccaacggugucugc

SEQ ID NO: 1593 - RNA, 74 nt, Taura syndrome virus
ucaugaaacugguugcacaauucugcaaacguggcuucacgucuguauggaaugugugauuuguagcgucguga

SEQ ID NO: 1594 - RNA, 92 nt, Taura syndrome virus
uugcugcgucuuuccuggauucugauggagccauaucuucuguucacaagggaccuuacgaugacccuuagauccagcuacgaugcgugcaa

SEQ ID NO: 1595 - RNA, 109 nt, Chimpanzee cytomegalovirus
aacaagugcguacuaaugggucuggugguaacuguaucuuuauccgguugacaaacucuaguguaauugguuauguggguggcauuuaccguuaguauaaagccuuguu

SEQ ID NO: 1596 - RNA, 61 nt, Chimpanzee cytomegalovirus
ccacccuccgccgccauguggguccguucccgcgacgggauccucauguggcucugggugg

SEQ ID NO: 1597 - RNA, 119 nt, Chimpanzee cytomegalovirus
ccccuccccgugucauuaaaacgguguauguacaggacaauaaaaucacaucgggagacuuuuucugggacaaaauauaucuuuauuauacauagacacugacgcgcgcuagggagagg

SEQ ID NO: 1598 - RNA, 103 nt, Chimpanzee cytomegalovirus
ccgauauacgcuuucucuuucuuuauuaguagguagcuguuagcaauaaaauagaaguuugcaugcaguaucauugaacugaauaauaccugcgugugugugg

SEQ ID NO: 1599 - RNA, 130 nt, Chimpanzee cytomegalovirus
cgagcgggacgcgggccgcgaugagcgaaccgccggcggcgguggcgccaggcauggacggucgagcccccggccgucccucugccuugucgucguucggcgucgcucgucggcuccgccguccuucucg

SEQ ID NO: 1600 - RNA, 54 nt, Chimpanzee cytomegalovirus
cgccaugcccuggucgugccgguguuucucggccgucaugaccgucaaugagcg

SEQ ID NO: 1601 - RNA, 65 nt, Chimpanzee cytomegalovirus
cgcccaccgccauccccugaggcguucguggucguugcugugugucucauggcgguguagcggcg

SEQ ID NO: 1602 - RNA, 129 nt, Chimpanzee cytomegalovirus
ucuuguucaauuaucauucuuuuugcucaucuccguggcacccauuacagcaacguuggacugccgaccccggcuuuucaugauaguauguguauauaugguuauagaaaaaagaagguaaaauacaga

SEQ ID NO: 1603 - RNA, 92 nt, Fowl adenovirus D
cgacgucgggaucgcccgugagcaugaaacacaacauaaaggggugcauacguuuuccuuuauuuucgaagacgguauacgucucgaugucg

SEQ ID NO: 1604 - RNA, 119 nt, Fowl adenovirus D
cgucucggaaaagccguucgaugagcgcguccaucugcgacgccgaccuguuggucuccugagaguagcgggaaggagucuuuuuguucggaucgggugugggcggaguuucugggacg

SEQ ID NO: 1605 - RNA, 98 nt, Fowl adenovirus D
cucuuuuucgagcagcugauggaaccaguucucuucgggauuguagaaagcgagucugagggacucggguuccucguagggcaguugggcguagagag

SEQ ID NO: 1606 - RNA, 127 nt, Fowl adenovirus D
guacgcggugaagguaaguugcuuccaaaaggcguggguguugcugggaauggugggucgcaggaaaauguuaaagucgccgugcaugccgaguucgucuuugaaguacuugucguaacugucguac

SEQ ID NO: 1607 - RNA, 91 nt, Fowl adenovirus D
uguugggcgacguuggcuauccgcucuaugucguugagaucgcuaucugagauggccauugggaagcaggaggcgaggacguuguacagca

SEQ ID NO: 1608 - RNA, 70 nt, Bovine herpesvirus 4
aaagugauauauaggaugaguucuuuaauuuucaaauaaaaugaucugucuuuaucuuguauuuuacuuu

SEQ ID NO: 1609 - RNA, 84 nt, Bovine herpesvirus 4
cuggcacgugauugaagcuaucuaauguaucuauuaguucaucuauuuggagaaagauggaugcagaggguauagauguggcag

SEQ ID NO: 1610 - RNA, 78 nt, Bovine herpesvirus 4
gaacaucauuuuuaaggagugugaaccauuucucuuguauagagaugaggugcuucucauuuucuaugauugauaauc

SEQ ID NO: 1611 - RNA, 70 nt, Bovine herpesvirus 4
gaguguguugaaugucugguugggguaagggggugucuuuuguucucaguuuuagggauucaauauauuc

SEQ ID NO: 1612 - RNA, 63 nt, Bovine herpesvirus 4
gaguuuggaugccaguuuaucaauguuugcuaauguaucauuggguggugguaugccaagguu

SEQ ID NO: 1613 - RNA, 72 nt, Bovine herpesvirus 4
gcugugaaugcuagcaugggugucauaucagcaguggggguuuggugugagaauaugcuauauauuuccagu

SEQ ID NO: 1614 - RNA, 130 nt, Bovine herpesvirus 4
gggcgaggucaauauuggccccccuaagggguucauaggagaaugcuccauaucuagauguuauguagugauguggguuaguaaauucucugggaacuauauauaggaauguaccaguguauucugcacc

SEQ ID NO: 1615 - RNA, 131 nt, Bovine herpesvirus 4
ggugguauauauauugacuugugaauccauccugggguggcagauaagaguugaugacgugguuauugaggucaagugucacaacuauagguguuguuggggauggacucuguguuuguguaaaugcuguu

SEQ ID NO: 1616 - RNA, 130 nt, Bovine herpesvirus 4
guaucugcaggucagaauucaguagaaggguuaaaucauguguugggaucucuagucuuugugcccaaaggauaaagaauuggaggagggucuuacauugagauauuccaugaauggauuuagaagauau

SEQ ID NO: 1617 - RNA, 52 nt, Bovine herpesvirus 4
ucuguuguuacaauuauuguauguuugaucauaucaauaaauguaauuaagg

SEQ ID NO: 1618 - RNA, 84 nt, Bovine herpesvirus 4
uuccaguuguugaaggcugucuugauuuucauccaugcauuguuugcauuggcaguuauuugggcaucuauuuguuuuuuggag

SEQ ID NO: 1619 - RNA, 67 nt, Bovine herpesvirus 4
uugaugaggucuaggaugagauuuucagaauuugugaguuucuggauacugucucugagccuauuaa

SEQ ID NO: 1620 - RNA, 131 nt, Bovine herpesvirus 4
uugguuaugguauccucuggaguuggggggauaaaaaaagaaagcacaugaaucagauuccaugaaaauggaaauugauaauaguuugaugugaugaucucugagcuuugcuccaucauggccauauccag

SEQ ID NO: 1621 - RNA, 130 nt, Human herpesvirus 8
caaauuucuauaauuggugucaccgcggcagcucuagcccuggaagaucuggaagcuugcuucaauggcucagaucgacccggacuacaguuagcgaaguagacccauuauaaucuuaaucuuaaaucug

SEQ ID NO: 1622 - RNA, 116 nt, Human herpesvirus 8
gaaggaggguugaauacaguuggggguaguccgcugguauucccagcugagguugccuuauuugguaaugcuuccggaaauaccaccugaguaccccauugguuuauaccuuguuu

SEQ ID NO: 1623 - RNA, 64 nt, Human herpesvirus 8
gcgggucuaagugaagcaggucgcgcaagaggucucugcgaccugcacgaaacagacauuccgc

SEQ ID NO: 1624 - RNA, 104 nt, Human herpesvirus 8
gggucaucgucugguguauuaucuccuggugggcuacuggcaauuuguucaugugugcuaacaacaggguaauccacuuccauuucguccucggaugacgaccc

SEQ ID NO: 1625 - RNA, 82 nt, Human herpesvirus 8
gguaguauaaucagcuaggccucaguauucuauguaacaaaugaaugcccuagaguacugcgguuuagcuaguuauacugcc

SEQ ID NO: 1626 - RNA, 105 nt, Human herpesvirus 8
uuguuuuugaacauguggcacacgcugcaauguacugccaugaaaggugguucuauauccaccacuuggcgucugccgaagucagugccacaauuucauuaacaa

SEQ ID NO: 1627 - RNA, 74 nt, Cell fusing agent virus
accgugccgcugccguauuuugaguguguucguggaaacauggccacaauguucugauaugccagucgcauggu

SEQ ID NO: 1628 - RNA, 74 nt, Cell fusing agent virus
auacgcggucguaaguugcgauucuugaagagccgaauaaaaugcuuuguaaucguccuguugacccgccguau

SEQ ID NO: 1629 - RNA, 70 nt, Cell fusing agent virus
ugugagcgguaugucgccaaccaucuguugugugucacuaacggaguggaagcuagccguaacguucaua

SEQ ID NO: 1630 - RNA, 79 nt, Dengue virus
agaaccuguugauucaacagcaccauuccauuuucuggcguccugugccuggaaugaugcugaggagacagcaggaucu

SEQ ID NO: 1631 - RNA, 85 nt, Dengue virus
agcccugauagcuggaguuugguaucuuauuggaaguccucuaagggcuuccuccauuucagcugccacgacucuagugggggcu

SEQ ID NO: 1632 - RNA, 97 nt, Dengue virus
cacacuuuguuccaaacugucaacaugucuuccgucgucauccauucauggcuggcguguauggaccagguuguccggcuuguuggaacccagugug

SEQ ID NO: 1633 - RNA, 84 nt, Human herpesvirus 8
acacaauggugcgguagugguuugcgauguagugcucugggcugauguagucaugugggauaaaguaaaggaagcacccggugu

SEQ ID NO: 1634 - RNA, 84 nt, Human herpesvirus 8
acggguugcgugucgggagggcgccggccuucgcccucaguccgggggggcuggagcgccguccucucauaucgcgugaucggu

SEQ ID NO: 1635 - RNA, 110 nt, Human herpesvirus 8
gccagcaguguauccaaguuuguaaaaucguauggcgagaccagggugcccagcgauuccugacuggcgcuggcauaccuguccgcauccgugcuuguggucuuguuggu

SEQ ID NO: 1636 - RNA, 81 nt, Human herpesvirus 8
gccccuucggaucugcgguguuccgggcagaccccguccaggcacggggcccgcuacggacaacgcuaaucggaucugggc

SEQ ID NO: 1637 - RNA, 130 nt, Human herpesvirus 8
guggacguugggcacguugguaaggugaugcucagcaguggcagcgcucuguagguaugccuguagacuuuccaccguuugcguugucaccugcgccucaaccagggucaggugcuccacgagcgugcgc

SEQ ID NO: 1638 - RNA, 87 nt, Yellow fever virus
agugguuuuguguuugucauccaaaggucugcuuauucuugagcaaacugugcucacagaccucuggaggaaaagcagagaaccacu

SEQ ID NO: 1639 - RNA, 84 nt, Yellow fever virus
aucuccucucccaacgauaauguagcugucuccaaaagguggguucaccucaaucagcacuucaucaucauugguugaggcgau

SEQ ID NO: 1640 - RNA, 70 nt, Yellow fever virus
gaugaccauucccgaugucaguaguccagccaguauaaacagcaugacuauugucauugccucaggcauc

SEQ ID NO: 1641 - RNA, 94 nt, Yellow fever virus
ucucagcgauguaacuguuaccaaaguccaccgcaguuugcaccuggcauuccaguguagcuuuuccauacccaaugaacucgacuuccuggga

SEQ ID NO: 1642 - RNA, 123 nt, Molluscum contagiosum virus
cgcacugcaucggcgccacaagacacauggcuguuucuuccgcuguccuccguucugaagcuaagauuucaguuuuggacacucgcgagcacguacggcauggucuccaggcuggucagcgug

SEQ ID NO: 1643 - RNA, 105 nt, Molluscum contagiosum virus
cgccgcguucacuagcucggacaggacauugcagcacucgcuugucagcgggacgagcacugacucgcacugguaguucugcccguagcuacacauacgcgcgcg

SEQ ID NO: 1644 - RNA, 77 nt, Molluscum contagiosum virus
gccucgugcuccucgaacuuggcagccgcggucagcaugcgcgcgauguccacggaaacaagagaguucacgagcgc

SEQ ID NO: 1645 - RNA, 109 nt, Molluscum contagiosum virus
gcuucguccgcuacgcugugcacgcacgcgguugcgccuccgcguacgaaacacagguacgacaaguagcgcgcggccauguguacgcagugccggauggcggggaagc

SEQ ID NO: 1646 - RNA, 125 nt, Molluscum contagiosum virus
guugugggcacuuucacguugaguaguagauaacuuuuguccgagguucuuccgugcagcguggagcgcagagaacucggaggaaaguucccagugauccgaagcugagcguccuggcccgcggc

SEQ ID NO: 1647 - RNA, 104 nt, Cercopithecine herpesvirus 7
aacaacgcguaccuuuuccgguggacaaaagcgaguccaggcaaauauguccuucuuaaugggaaauauuucuucgccguuguuuacccgcugucuguauuguu

SEQ ID NO: 1648 - RNA, 130 nt, Cercopithecine herpesvirus 7
auauuugaccguucuuccaauuguaaaaccguuugugagcaacuuaaaucgcauguauuuaacauguuuuguauuuguaaauguucuccccaaccccacuguaauacaguuaauauugauggcacuauau

SEQ ID NO: 1649 - RNA, 55 nt, Cercopithecine herpesvirus 7
cguuuguauacacuaagacguuacauguuuuuuaugucgucuauguaagcgugcg

SEQ ID NO: 1650 - RNA, 75 nt, Cercopithecine herpesvirus 7
ucccugcgccugucucgcgauguccuuacacccgucgaacccggguagcacguauugccgauagucccgugggga

SEQ ID NO: 1651 - RNA, 103 nt, infectious spleen and kidney necrosis virus
cgugucguugugcaaguacaggccggcgcacugggcgucgcucggcaccagcauaaaguccaccguguucuugugcaccgguuuguauuugauaaucugcacg

SEQ ID NO: 1652 - RNA, 67 nt, infectious spleen and kidney necrosis virus
ggucaagagacucuucagaacacagugccaccaccaugugcacagugaccugcgggucaggcugacc

SEQ ID NO: 1653 - RNA, 60 nt, infectious spleen and kidney necrosis virus
uggaugucauggaccaucguggcuacggugucacaguggccagaauguccaugacauccg

SEQ ID NO: 1654 - RNA, 103 nt, Human adenovirus D
ggacuguucgaggcugagacagcggucgggcgaagaggccacggcgcuucggcgcagcauggccucguacucgaagcuguaaaucugcuugagccggcggucc

SEQ ID NO: 1655 - RNA, 59 nt, Human adenovirus D
ggugccuccaggugugucaaagaaagccaaaucuaugucauaaucuuuagguugcugcc

SEQ ID NO: 1656 - RNA, 85 nt, Human adenovirus D
uccucgguaauucggaacggggaugcgcaggcggcaagugagagccaucucucugcaacaguaucacagcacacggauuaaagga

SEQ ID NO: 1657 - RNA, 130 nt, Human adenovirus D
ucuauggucauggucucggaaaaguugcccucgggcaggguaaacucaaaccacucauacucuaagauauccuugcuuaaaucuguugcuucuacccccuguggguguuuucuagccaccaucacccgcg

SEQ ID NO: 1658 - RNA, 61 nt, Tick-borne encephalitis virus
cugcugaguuaauggcaagcccgagcguccucaggucucgucgguggaaguagcucagcag

SEQ ID NO: 1659 - RNA, 72 nt, Tick-borne encephalitis virus
gagaagaugucggaagugcuuucuuuucucuucagugagucgaaagugaccggccaccuccggcaucuuguc

SEQ ID NO: 1660 - RNA, 86 nt, Tick-borne encephalitis virus
ucucgagcucagucaagugaaaguuacccaucgcguccugccggacccgcaggcuaaccucuccacccucauucacuaguuccgga

SEQ ID NO: 1661 - RNA, 52 nt, Viral hemorrhagic septicemia virus
agcugaccuguugucuuugggggcguugucuagucucuuguccaggucagcu

SEQ ID NO: 1662 - RNA, 131 nt, Viral hemorrhagic septicemia virus
ccucgggcuccuuguggaccauuguggacuccccuuucugaagaaggauucccugcgaccugacuugccuccggguggccucauucugaaagggguauucccacccuuuccacguuugucucugugcgagg

SEQ ID NO: 1663 - RNA, 131 nt, Viral hemorrhagic septicemia virus
gaucggguucaagggucuggcagauggccgugagcaggagugcuugugcccuuugguugaugauuuugaagagggccaaguacuccacauauguuacugcgccaagcuuugcccccccaaggaacucauuc

SEQ ID NO: 1664 - RNA, 88 nt, Viral hemorrhagic septicemia virus
gccucggaccugugucaauguggacauccuggaggaugauggcgucugcguuguguucccagucuccugauuuuaguccccuaagggc

SEQ ID NO: 1665 - RNA, 86 nt, Viral hemorrhagic septicemia virus
gcuuugaucaaagagaaauucuuauaaucgugccguuuuuuucuaucuguguugguuaugagacgggagugccuuuuagucagagu

SEQ ID NO: 1666 - RNA, 130 nt, Viral hemorrhagic septicemia virus
ugguuccaguggaguguugcugucuuucuuccucuucuaauuguguuuacccucugggcgaauugucgggguccggucucccggauggugugaacggaggugagguugcacacguuguccauucuugcca

SEQ ID NO: 1667 - RNA, 83 nt, Vesicular stomatitis Indiana virus
gaaugccagguuguagaguuauggacaguggggcauauguaauugcugcauuuuccguugaugaacugugaaucaacccauuc

SEQ ID NO: 1668 - RNA, 77 nt, Vesicular stomatitis Indiana virus
guacagguuuuuccaggauucauugauggaagaccaaucgggauuggguucaucgauuaauuucuucaaaccuuuac

SEQ ID NO: 1669 - RNA, 61 nt, Vesicular stomatitis Indiana virus
ucggcaugaguagauuuucuauacgccaagucuccauauagaaaaccuauacaucugccga

SEQ ID NO: 1670 - RNA, 107 nt, Vesicular stomatitis Indiana virus
ugauaugauuuucaaaaugagggaauugugggacuaaaggccuugauucucuugcuaauuucaucagcuucaaguugcauaucgguuccaccauuuuaaucaaguca

SEQ ID NO: 1671 - RNA, 87 nt, Vesicular stomatitis Indiana virus
uggcaucaugauuaucagacauuaaccaacuucccauccauuuaugcaucugagauguugagaugggauuggcuugacaugauguua

SEQ ID NO: 1672 - RNA, 87 nt, Vesicular stomatitis Indiana virus
uuucauagucuacagagaauauuugacucucgccugauuguacaacuuuuuguaucucaggccgagcaggauggccucuuuaugaga

SEQ ID NO: 1673 - RNA, 63 nt, Chimpanzee cytomegalovirus
cguaggccacgcacguguucgacguguagcccagccccaugucaacgguguugauguucugcg

SEQ ID NO: 1674 - RNA, 81 nt, Chimpanzee cytomegalovirus
ggacccucgcugcggucgcacgucacguugaaacgcaggacgcaguccugguacagcgugagcgacgacagcgucaggucc

SEQ ID NO: 1675 - RNA, 130 nt, Chimpanzee cytomegalovirus
gguaguuggcguuggucacggugcucuugaagagccgcagcgucuccucguagucgggcggcggccguagccgcacgugcuccaugaucugccaggcgcgcagcucguggaagggccccggcgccagccc

SEQ ID NO: 1676 - RNA, 79 nt, Ectocarpus siliculosus virus
caaacgacgucguacgguaaauggcaagugauaccaccauuccccacguuauuucuugccacaucacacgauuuguuug

SEQ ID NO: 1677 - RNA, 62 nt, Ectocarpus siliculosus virus
caaguggaugguucucggguauuucgcuguucaagucagauacucaaguaccaaacaugaug

SEQ ID NO: 1678 - RNA, 76 nt, Ectocarpus siliculosus virus
gugagcuacacacccuuuugucccguugcagcacgauaaaucguauuacguugcagcacgauuuagugagcuacgc

SEQ ID NO: 1679 - RNA, 73 nt, Ectocarpus siliculosus virus
guugcagcacgauuuagugagcuacaaacccuuuuguccccuugcagcacgauaaaucguauuacguugcagc

SEQ ID NO: 1680 - RNA, 73 nt, Ectocarpus siliculosus virus
guugcagcacgauuuagugagcuacacacccuuuuguccccuugcagcacgauaaaucguauuacguugcagc

SEQ ID NO: 1681 - RNA, 73 nt, Ectocarpus siliculosus virus
guugcagcacgauuuagugagcuacacacgcuuuuguccccuugcagcacgauaaaucguauuacguugcagc

SEQ ID NO: 1682 - RNA, 130 nt, Ectocarpus siliculosus virus
guuuguccccuugcagcacgauaaaucguauuacguugcagcacgauuuagugagcugcacacauuuuuguccccuugcagcacgauaaaucguauuacguugcagcacgauuuagugagcugcacaccc

SEQ ID NO: 1683 - RNA, 94 nt, Ectocarpus siliculosus virus
uaaaucguauuacguugcagcacgauuuagugagcuacacacccuuuuguccccuugcagcacgauaaaucguauuacguugcagcacgauuua

SEQ ID NO: 1684 - RNA, 94 nt, Ectocarpus siliculosus virus
uaaaucguauuacguugcagcacgauuuagugagcugcacacccuuucguccccuugcagcacgauaaaucguauuacguugcagcacgauuug

SEQ ID NO: 1685 - RNA, 94 nt, Ectocarpus siliculosus virus
uaaaucguguuacguugcagcacgauuuagugagcuacacacccuuuuguccccuugcagcacgauaaaucguguuacguugcagcacgauuua

SEQ ID NO: 1686 - RNA, 93 nt, Ectocarpus siliculosus virus
uaaaucguguuacguugcagcacgauuuagugagcuacacaccuuuuuguccucugaagcacaauaaaucguguuacguugcagcacgauuua

SEQ ID NO: 1687 - RNA, 94 nt, Ectocarpus siliculosus virus
uaaaucguguuacguugcagcacgauuuagugagcugcacaucuuuuuguccccuugcagcacgauaaaucguguuacguugcagcacgauuua

SEQ ID NO: 1688 - RNA, 74 nt, Ectocarpus siliculosus virus
ugagcuacacacccuuuuguccccuugcagcacgauaaaucguauuacguugcagcacgauuuagugagcuacg

SEQ ID NO: 1689 - RNA, 113 nt, Ectocarpus siliculosus virus
ugcagcacaauaaaucguguuacguugcagcacgauuuagugagcuacacacccuuuuguccucugaagcacgauaaaucguguuacguugcagcacgauuuagugagcugca

SEQ ID NO: 1690 - RNA, 114 nt, Ectocarpus siliculosus virus
ugcagcacgauaaaucguauuacguugcagcacgauuaagugagcugcacacauuuuuguccccuugcagcacgauaaaucguauuacguugcagcacgauuuagugagcugca

SEQ ID NO: 1691 - RNA, 116 nt, Ectocarpus siliculosus virus
ugcagcacgauaaaucguauuacguugcagcacgauuuagugaacugcacacccuuuugucccccugcagcacgauaaaucguauuacguugcagcacgauuuagugagcuaugca

SEQ ID NO: 1692 - RNA, 114 nt, Ectocarpus siliculosus virus
ugcagcacgauaaaucguauuacguugcagcacgauuuagugagcugcacacccuuuugucccccugcagcacaauaaaucguauuacguugcagcacgauuuagugagcugca

SEQ ID NO: 1693 - RNA, 115 nt, Ectocarpus siliculosus virus
uguugagggaagaagcggggccguggauuuaugcugaaacguaaacuggaacgcugcugcaaagaugucaaauuuugaauuucgcacuggauccaaucuguuuguucggucaaca

SEQ ID NO: 1694 - RNA, 80 nt, Bovine adenovirus B
gagggagagucaguggccgcuaaacaaaaaacacaauccugcuuuuuuauguucucuuuauuaccgcugcgcgcccccuc

SEQ ID NO: 1695 - RNA, 130 nt, Semliki forest virus
agcaacuccacagccguccucaugucaauggcuuccuggauuuucuucucccaacuuuugucucugcaguagauggucacgucagcguccguggcguccauugcugugaauagaugguugagggauugcu

SEQ ID NO: 1696 - RNA, 122 nt, Semliki forest virus
aucuaggaccgccguagagguguauaacagguccucucaauuucuuaaacgccuuaaugucccucgccaagguggucauggcuaugaggauacuuuugcagcccucuaccucauaccuagau

SEQ ID NO: 1697 - RNA, 118 nt, Semliki forest virus
ggcccugcauacgccauccccuacaguuccacgggcguuagcugcguuaaccacagccgcuucugugcacguggcuaugucugcucucuuaacucuguaggauggugcacacccggcc

SEQ ID NO: 1698 - RNA, 113 nt, Sindbis virus
aaguauccuuuguagcuaagccuucuacacgguccugaggugcuaaucuugaugucauccauggugccuucuuuaacggugugauccugcuuaagcgacauguagcgguacuu

SEQ ID NO: 1699 - RNA, 81 nt, Sindbis virus
cguggugccaguuauagaauccuucgggguguucacugguguaggugaaugccucacuucucauguugacuggcaacugug

SEQ ID NO: 1700 - RNA, 56 nt, Sindbis virus
gaugguguacacaggauggcgaugguaguaaugcuguacuauuucguguggccauc

SEQ ID NO: 1701 - RNA, 67 nt, Sindbis virus
ggcgaugagauccuugcuagucaaggagguagcuugaaugucuccaaacgcuccugguuucaucgcu

SEQ ID NO: 1702 - RNA, 103 nt, Sindbis virus
gucguacacugugcaaggaauuuuuuuaccgugaacgggagguagaucauauuuuucccgucccacgaauuuugguuuuaucuugcgggccaguguacaugac

SEQ ID NO: 1703 - RNA, 67 nt, Molluscum contagiosum virus
cacggugugcaggcggcggccggagauaugcgugacaaagucuaucccgugcacgcuggcgcaugug

SEQ ID NO: 1704 - RNA, 80 nt, Molluscum contagiosum virus
gccgggcuugagcuugccggccucgaaguaguuguucucgaccaggcucacgaugaggcuggccagcacgccgucgcggu

SEQ ID NO: 1705 - RNA, 111 nt, Rat cytomegalovirus
gcccuugaagaugcacacggcggauuugucguccggcgagaugucgcacaccacgaacagcggcugcuccgccacgauguccgagaucugccggaucaucaccagcagggc

SEQ ID NO: 1706 - RNA, 66 nt, Rat cytomegalovirus
gugucccagccgcucuuugcuccgcgcguuguacaucacgucgcccagggagccccgcugggacgc

SEQ ID NO: 1707 - RNA, 66 nt, Myxoma virus
acgucgguuccagacuguauucuguguauuuaccaacccgggucagucuggcccaagacacgacgu

SEQ ID NO: 1708 - RNA, 75 nt, Myxoma virus
aguacggguugagagaaggcagauaagaguacggacuucccacgacgaaccauaucauuuucacgaccagguauu

SEQ ID NO: 1709 - RNA, 58 nt, Myxoma virus
cguacacaacguguuuacggaguaugcgaaacugugacuucguacgcacgacgugucg

SEQ ID NO: 1710 - RNA, 89 nt, Rabies virus
acucccuuuggaugcucucuucccucuacuauugguaaaaaugucacaagacaucccuagucucggauucucgggcauccaaauggugu

SEQ ID NO: 1711 - RNA, 127 nt, Rabies virus
cccaacaucucagaagggugaggaacugucgugccuaccacuuuucuuccccaagagaucucccuaaguagaucugcccucucugaagagcaaggccacacccccccaacccucugaggugucuggg

SEQ ID NO: 1712 - RNA, 117 nt, Rabies virus
ccccugagaucaauucaagaggucuauuaauauugauauuugucauucucgucaagaagcaaaucgaggauccuaucaauacuccccuugcgagcccucucaaauagucucuagggg

SEQ ID NO: 1713 - RNA, 114 nt, Rabies virus
gagacacaauguuccuaauuagaguuugagccaaguuggaaucucuaguaaugaaccaguuuauagauucuuuuaacgauagagcucucuucaccacaugaacauuagugacuu

SEQ ID NO: 1714 - RNA, 77 nt, Rabies virus
gauuguguuguguagguuccgaucgauugacucuucuccagcaugucaucaggaaaauuaucaacaucaaggcaguc

SEQ ID NO: 1715 - RNA, 82 nt, Rabies virus
gccuuucugauugcauccuugaguagaaugguaggacuggccccuccucugauauuuaaggugguaggaucuucuagaaggc

SEQ ID NO: 1716 - RNA, 83 nt, Rabies virus
ggguuuugauauaaggagucaagggguggucucgggcuaggaaucgugaauccagauaccacuuggaguacuuaucaaaaccc

SEQ ID NO: 1717 - RNA, 65 nt, Rabies virus
gguuggugcauccuucguccuccacuaccaaauuguuugggcagcugaggugauguaugucaauc

SEQ ID NO: 1718 - RNA, 89 nt, Rabies virus
uuuucugagggauagaaaauaucucuucucuaaaagacgguucucugagcauuauguacaaggagggaugguuaucuagccucaggaga

SEQ ID NO: 1719 - RNA, 58 nt, Human herpesvirus 3
acuguaaaaacugucguugccccgguuugaauauaagcaucuguaauuacuuuacggu

SEQ ID NO: 1720 - RNA, 72 nt, Human herpesvirus 3
cgucuggcauaaccaagggccuuguuacccaaaugggaacauuuguaugaccgguaauaacaguauccaacg

SEQ ID NO: 1721 - RNA, 82 nt, Human herpesvirus 3
cguuauuuuaacauuaucauguaaaaacguugcauuuacauucucccauguuccuauauuacauugugaaguuaaaaccgcg

SEQ ID NO: 1722 - RNA, 128 nt, Human herpesvirus 3
cugucuuuguuuuugcaacacaacauccaacgccguuuuacguuccuguugcuuuuuuuggagacgguuuuucguuuccacaggcaauaaaaaaaauucggguucggaacaaagcaugucaaccacag

SEQ ID NO: 1723 - RNA, 62 nt, Human herpesvirus 3
ggguguguacggguaaaagguucuaauauuguuauaagagcagauaguuuugugcgauaucc

SEQ ID NO: 1724 - RNA, 89 nt, Human herpesvirus 3
ugucggaauggagguaaucucaaguauugguuuacugaacgcuugguuuaacguuugguuuugcuguggauuauuuuuccaauccgaca

SEQ ID NO: 1725 - RNA, 76 nt, Human herpesvirus 3
uuauccacccuaucuuuauaaguaugcagggggccgguaccgucuauacgcacacuuaguggaugggagucaauaa

SEQ ID NO: 1726 - RNA, 70 nt, Human herpesvirus 3
uuuaagccuuguuuccaaucgucuuuuaaucgaagguuguaaaccggauuggaucauuggaucacuuaaa

SEQ ID NO: 1727 - RNA, 94 nt, Cercopithecine herpesvirus 7
agauggaaaugaggucaauauccccaaaagaggcuccaauaaggcagaaacaacgcucugggcgucuguaugugugcguguuccauuuucaacu

SEQ ID NO: 1728 - RNA, 75 nt, Cercopithecine herpesvirus 7
gcuagcgguaauaaauguuuugguggguuacuuauuacauauuuuuuaucggaagguuugagugacugaaccagc

SEQ ID NO: 1729 - RNA, 50 nt, Cercopithecine herpesvirus 7
ggagggguauuggcuaaagguuugcuagcaagcagcgccgauauuuuuuc

SEQ ID NO: 1730 - RNA, 72 nt, Cercopithecine herpesvirus 7
ggauugugcccuaaaacugcauucagggcuacuaaugcacaguucucacaugcagauauagauuggcgcgcc

SEQ ID NO: 1731 - RNA, 53 nt, Cercopithecine herpesvirus 7
uguuaaugcuggaaccgacgauacuaaagagguugcacguucuaaaauugaua

SEQ ID NO: 1732 - RNA, 126 nt, Cercopithecine herpesvirus 7
uguuuguuauauuaacuacagcuguuuuaaccgaaguguagggcgacguguuccaagguauaagaggaucacuaaauuuugcugauauuuucacaguuuuccagucuguauaauuaaaagcaaaca

SEQ ID NO: 1733 - RNA, 74 nt, Camelpox virus
acagaugaucugaguaauauaccucuguuauauauuuaauguucacggucuuaguauuuuuagauaucaauugu

SEQ ID NO: 1734 - RNA, 114 nt, Camelpox virus
cgacuccaucagaaagagguuuaauauuuuugugagaccaucgaagagagaaagagauaaaacuuuuuuuacgacuccaucagaaagagguuuaauauuuuugugagaccaucg

SEQ ID NO: 1735 - RNA, 58 nt, Camelpox virus
cuaucauggauaauauuuguaaugguucuuuccguacaacauacuguuuagaugauag

SEQ ID NO: 1736 - RNA, 129 nt, Camelpox virus
cuuuuuuacgacuccaucagaaagagguuuaauauuuuugugagaccaucgaagagagaaagagauaaaacuuuuuuuacgacuccaucagaaagagguuuaauauuuuugugagaccaucgaagagag

SEQ ID NO: 1737 - RNA, 130 nt, Camelpox virus
cuuuuuuuacgacuccaucagaaagagguuuaauauuuuugugagaccaucgaagagagaaagagauaaaacuuuuuuuacgacuccaucagaaagagguuuaauauuuuugugagaccaucgaagagag

SEQ ID NO: 1738 - RNA, 77 nt, Camelpox virus
gcaaaucuuaucauuggucgguguuuugucuugcuuugugacuuugauaauaacaucgauucccauaugauguuugu

SEQ ID NO: 1739 - RNA, 72 nt, Camelpox virus
gugugccugaaucguucgauuaacccuacucacccgaaucucggaugaauagaguuaucgauucagacacac

SEQ ID NO: 1740 - RNA, 59 nt, Camelpox virus
uacugaaaucucucuuugauuguagaguauaugcagucagagcaagaaacacugcagua

SEQ ID NO: 1741 - RNA, 130 nt, Camelpox virus
uuaguauaucaaagaccuuguuaucgauugauagugaaugaaucagauagugguguagaggaauauguccuuuguuauccuuguuaucaaaguuauucacgccguuguguaacaauaucuuuaauacaga

SEQ ID NO: 1742 - RNA, 67 nt, Camelpox virus
uuaucgaugauguagugguuauagucucuggaaucguacgaaguaauacuacgcauuacgucgauaa

SEQ ID NO: 1743 - RNA, 126 nt, Camelpox virus
uuaugaauauauaaaguagaugguguccuucuuccuuuuguaauuucccguauuuuuguucgugccaauugaguaacauuaugagaauaugaccuguugcacaaucauucuuuauguauuccauga

SEQ ID NO: 1744 - RNA, 130 nt, Camelpox virus
uuuuuuacgacuccaucagaaagagguuuaauauuuuugugagaccaucgaagagagaaagagauaaaacuuuuuuuacgacuccaucagaaagagguuuaauauuuuugugagaccaucgaagagagaa

SEQ ID NO: 1745 - RNA, 94 nt, Bovine viral diarrhea virus genotype 2 (BVDV-2)
acagcuaaagugcuuagugcauuggagguaguguuaaauuaggguaucuacuaucacuacauuacuauccaauuacaauaaauaucuuagcugu

SEQ ID NO: 1746 - RNA, 64 nt, Bovine viral diarrhea virus genotype 2 (BVDV-2)
caccaaaguugcaaaagcuguuucaugccccagucuggcugccaagcuuuuguagagugcugug

SEQ ID NO: 1747 - RNA, 83 nt, Bovine viral diarrhea virus genotype 2 (BVDV-2)
cuugagugagggcacgacgcucuggacggauucaccagcuuccgcuggccacugucaucagcaucacccucagucuucucaag

SEQ ID NO: 1748 - RNA, 65 nt, Bovine viral diarrhea virus genotype 2 (BVDV-2)
gcucucuggccccaauaaccccauauaucugucuuucgauauggcauauuggaagcccucuuugc

SEQ ID NO: 1749 - RNA, 81 nt, Bovine viral diarrhea virus genotype 2 (BVDV-2)
ggauuccaugaguacaucaaaaggaagcuaaaggcuacggccuucucauaagcugugcuaccccucucuccacuggaaucc

SEQ ID NO: 1750 - RNA, 83 nt, Bovine viral diarrhea virus genotype 2 (BVDV-2)
uacuacugcuacaguuauaucaaugcuagcgggcaguaggaauccugacguucuuauagcuagcaaugauacaaucaguggua

SEQ ID NO: 1751 - RNA, 122 nt, Bovine viral diarrhea virus genotype 2 (BVDV-2)
uagggguucuuccgcuuggaaccaaucugguaguuccuccucaaccucuggcuccauuaaccuccugaucauugcuguugugguuuuccucuuaauugguuuaccuaagcuuagggcuucua

SEQ ID NO: 1752 - RNA, 85 nt, Bovine viral diarrhea virus genotype 2 (BVDV-2)
ucaucagucaucuuauuguuacuaugacagacaacccugguccugcccaugcugucacacacuaguagauccuuuccggcuguga

SEQ ID NO: 1753 - RNA, 58 nt, Rabbit fibroma virus
gauauuccacgaagucaucgaccuccccggggugguuggugucgcuguacaugauauc

SEQ ID NO: 1754 - RNA, 116 nt, Rabbit fibroma virus
guagaaaaacacggggaauaucgcgucugugaugacacgauugcuuaauuacaugccuugaguuuaggcguauguauagaaaaggugucaucaucgaguaguucgccguucuuuac

SEQ ID NO: 1755 - RNA, 129 nt, Rabbit fibroma virus
uagcuguagagaauauguuuacuucuaccauguuagagguguagaaacacguacccguucauuagaagcagaccuacuagaaucgcgucuacuuaucuccgguagaaguagaaaauagaaacgagguua

SEQ ID NO: 1756 - RNA, 109 nt, Rabbit fibroma virus
ugaugugagacgcacgguaucuguagaugugacugugaggaaccaaaugaaaaacagucgcucuuucaucuuaaucauuaucacucuacucuacucuauuacucuuuca

SEQ ID NO: 1757 - RNA, 130 nt, pestivirus type 1
acuuccccugauccauacugaaucccuaaggccuucuguucugauaagaccauguauguaaccaguaaccaaaguacauaucugccacccaagagggcuacuaccaccacuaauauggacucagcgaagu

SEQ ID NO: 1758 - RNA, 82 nt, pestivirus type 1
uguaggauuagguacauuacacuagcuguuuccggugcgaagucggacagcaccacuaaagaaaguaguaguaccuccgaca

SEQ ID NO: 1759 - RNA, 90 nt, Cryphonectria hypovirus 1
accauauacgcgaauacaaaaccuagugcacuacgguacaugauccccuugaggaucacggucgugcaauugugauucgcgcuguaaggu

SEQ ID NO: 1760 - RNA, 62 nt, Cryphonectria hypovirus 1
agggaugccggccauuccaugaagugcaacaggaguugcacucaugaagaugguugguccuu

SEQ ID NO: 1761 - RNA, 82 nt, Cryphonectria hypovirus 1
auuguagcagccuaagauagucugccacacguacacaccaaccggugguacgggcgacgcgccaucuugcgcugucuacaau

SEQ ID NO: 1762 - RNA, 130 nt, Cryphonectria hypovirus 1
caugaauagauuauauaauggcccuaucaagaacagugacugaauaaacagcucgacccaaugcauugcgaaauacauggccgagaugaugacagucaugccuugguagaugcgcaccuuaucuaucaug

SEQ ID NO: 1763 - RNA, 105 nt, Cryphonectria hypovirus 1
cgaugguguuuauaccagguaguccuuucccggguuccuugauguuggagacaaaguugucauaaucaucaaggaaauucccucugcccugguauuccaucauug

SEQ ID NO: 1764 - RNA, 83 nt, Cryphonectria hypovirus 1
cgguggggauguccuucucguuccagaaccucgcgugcugucgguuggacaauagagagguuggaacggaggcaucgccaucg

SEQ ID NO: 1765 - RNA, 85 nt, Cryphonectria hypovirus 1
gacgugacugagccuugccggguuggucagagauaaaauuuaucgucgucucugaccgaacccagucugcauuagcagucacguu

SEQ ID NO: 1766 - RNA, 130 nt, Cryphonectria hypovirus 1
gcgucucgucuauuaacuuggcccaguugccaggcuuccaauucggcauguccagaaucuuaguucccuucgguucugguaugcguuccuuuucguccuggacaagcuggguguaagccaguucgacuac

SEQ ID NO: 1767 - RNA, 64 nt, Cryphonectria hypovirus 1
ucgugguuuccagcaacuugagguauaugaauuucuccacauacugguugugagugugccacgg

SEQ ID NO: 1768 - RNA, 72 nt, Cryphonectria hypovirus 1
ucuuguacagugcgggcuggaaugccgucacgagugcgugaccggcaccccguucacacgagguguacagga

SEQ ID NO: 1769 - RNA, 102 nt, Fowlpox virus
aguuuuuaaguaagcuacauuagaagauguuuuguaaacauuacgauagaaacucauacucguuacuguuucuauaucuuuuauucuuacucuaugaagacu

SEQ ID NO: 1770 - RNA, 103 nt, Fowlpox virus
cgcugccuuuagaacaucauaggauauagaaucuauuacaaaacuuuuucuugguuuauuuguguuauauucuaugauauaguucuguaucauauucaaagcg

SEQ ID NO: 1771 - RNA, 90 nt, Fowlpox virus
cuuaauuucauuagguaaauuguuccaagaggauguauuacugucauuaucuagaaauaaaucuucuaauacuuuacuugcuuuauuaag

SEQ ID NO: 1772 - RNA, 50 nt, Fowlpox virus
gauaaaauaacaauuauuauacuugauacgaguuugaauucuuauuuuuc

SEQ ID NO: 1773 - RNA, 103 nt, Fowlpox virus
gcguauuugcaauuauuuagauaagguaaguuuucuuuauguuuauuuauaucacauauauagcacuuauaauuaucggugucuaauaauguaacagauacgu

SEQ ID NO: 1774 - RNA, 70 nt, Fowlpox virus
gucuaugucaguuauccuaccaaaacgacauacaauauucggagaaauagguuuagcaucgacaugguac

SEQ ID NO: 1775 - RNA, 89 nt, Fowlpox virus
uauguaauuguaaaaacuguauuuuucuauuaucuuuacgacuauuaaccauaacguaagagauauuagagaauaagaaugaucgcaua

SEQ ID NO: 1776 - RNA, 76 nt, Rana tigrina ranavirus
agagguuuaaggauaguaaaaauauggauaguaaucuuaagauagauauuaucuuaauauauagucuuuacccucu

SEQ ID NO: 1777 - RNA, 78 nt, Rana tigrina ranavirus
cagacuauuccaggaggcucggcggaguguggcuccaccacgccagguuccccgaguacgcucccaagagguuguuug

SEQ ID NO: 1778 - RNA, 88 nt, Rana tigrina ranavirus
cccgucucguacucggugacgugguucucgaaaaaguuugucagaucggcuccaucuaugagccauuuuacccaugguaugggacagg

SEQ ID NO: 1779 - RNA, 64 nt, Rana tigrina ranavirus
cggacuugcgccggcuaccucaugaccgaggagaggggaccucugaggugcuggcgcaaggacg

SEQ ID NO: 1780 - RNA, 70 nt, Rana tigrina ranavirus
gaugaggcacacggcagccguccuggaguccaggaaccucucccuggaacccuauggcuccaaccccauc

SEQ ID NO: 1781 - RNA, 81 nt, Rana tigrina ranavirus
gcuuuucugaaagagauauauauauuaagaguacuacuaucuugcgauauuagucuugauauguaacaucuccuagaaagu

SEQ ID NO: 1782 - RNA, 88 nt, Rana tigrina ranavirus
guccuguaguuaaaguugguggaacaguaggcgcacgucaugucguugcacccgucaaucuuuuccacucucuuuuugcacucuggac

SEQ ID NO: 1783 - RNA, 67 nt, Rana tigrina ranavirus
gucucucaagacuauuacuaucguaagauaucucucacaaaguaucucacaauaauaguuucaggac

SEQ ID NO: 1784 - RNA, 116 nt, Rana tigrina ranavirus
uaucuuaagaucuuacaucuucuuguccuagaaauauucuugagaguaucuuacaauauuaguaaagauaucuucugaaagaguaucuuacuauaguaguaaaguaucuuaagaua

SEQ ID NO: 1785 - RNA, 68 nt, Tupaia herpesvirus
caguauccgcguauaguuuucauuuacuccccuuguagauaagacgauacgacacgggcggauagaug

SEQ ID NO: 1786 - RNA, 79 nt, Tupaia herpesvirus
gauuaauugccauaaccuagucggguucuccagaaacacguccaucucgacagauucgacuaguuuagcguagcuacuc

SEQ ID NO: 1787 - RNA, 122 nt, Tupaia herpesvirus
gcggcacugacgacccacgcaagaccggcaccguuucggacuccguuagcggucuucgcuguaaccaggaaccguuggcuguccggaacuggaguugaaaacacgcgucgauacggugccgu

SEQ ID NO: 1788 - RNA, 96 nt, Tupaia herpesvirus
gugguuguaacaguugcuucgaguugugaauuagaaucguuacaaaucuuacgugcgacguucaguccgauaucggagaaaguaccguuugaccac

SEQ ID NO: 1789 - RNA, 81 nt, Tupaia herpesvirus
guucgauaaauauggucacaccaucgacauaaauacagguauacuuuuauuaugacgauauuaacuguccguaguccgaac

SEQ ID NO: 1790 - RNA, 58 nt, Tupaia herpesvirus
ugccgccaaucauccguauaaguugacgauucguuauccaugauuggucuuaacggca

SEQ ID NO: 1791 - RNA, 81 nt, Tupaia herpesvirus
ugguuggacaccauuuauccuccacuugaauaacagucagacuccacuccccuuccgugguggagcgaauaaguccaaccg

SEQ ID NO: 1792 - RNA, 68 nt, Tupaia herpesvirus
ugucugaaaucguucgugucuacaaaaguaugcgaugcauacaacaaacacacgacucgaaaaagaca

SEQ ID NO: 1793 - RNA, 122 nt, Rana tigrina ranavirus
acauuuuuaggucuaaaaguuuccgagaugguaaagacucugagauaauaucgagagaauaaauacccuuucagagauaauauccuaagaugucguuacaccucauucucauccuaaaaagu

SEQ ID NO: 1794 - RNA, 58 nt, Rana tigrina ranavirus
agucucugacaucaaggaugagcaggucaacgaucuggcaucugccauguuuaggacu

SEQ ID NO: 1795 - RNA, 90 nt, Rana tigrina ranavirus
gagauuuaaugcuagucuaaauauuucuauauuaagauacuaucuuaagauaucgguacucugagauauuuuacgcugacauuuuuacuc

SEQ ID NO: 1796 - RNA, 93 nt, Equine herpesvirus 1
ccccacggcacgcgggugugggcuggcguuguccaugguuucaucuacguugauguuuccguaagcagugaguccaugaaucaugccacaggg

SEQ ID NO: 1797 - RNA, 104 nt, Equine herpesvirus 1
cuguuuacggaagcuggguauauuuaacauccuuaaaggucgagcguaggcgagucaagccguucugugcagacuuuuucaguuccuucuuccgacgcaagcag

SEQ ID NO: 1798 - RNA, 71 nt, Equine herpesvirus 1
guagcagucgcaguagcuguggugguuuccgcugauguagacgcggcuguaguaacagcugugguuguagc

SEQ ID NO: 1799 - RNA, 88 nt, Equine herpesvirus 1
gucgucuacgcggguugccggggcugcugcgcuagcaaaaaucgugucugcugguacggcugccgcgaucucaggagcgagcgacgac

SEQ ID NO: 1800 - RNA, 71 nt, Equine herpesvirus 1
ugcgauagcuuacaucuauggguggaucuaauaaaauuagcucacaacccuuggauucagcuuuaaucgca

SEQ ID NO: 1801 - RNA, 100 nt, Equine herpesvirus 1
ugcgcuguuggcccggacacgguauugugguugauuuggugguacaugaguugagguccaccccaucgccggcgacuagauucguggggcaagcagcgca

SEQ ID NO: 1802 - RNA, 75 nt, Camelpox virus
aauaacuaauggcaaauguauaaaacaacaaaauuauacuagaguuguuaaaguuaauauuuucuauuaguuguu

SEQ ID NO: 1803 - RNA, 121 nt, Variola virus
agugacauuaguagggauagaauguugagcuaauuuuuguaaauaacuaucuauaaaaagauuauacaaaguuuuaaacucuuuaguuucugccauuuauccagucugagaaaaugucccu

SEQ ID NO: 1804 - RNA, 80 nt, Variola virus
cacaguuuuuaauuucuuugguaauaaaauuauucacuauaucaguaucuucuuuaucuaccagagauuuuacuaacuug

SEQ ID NO: 1805 - RNA, 112 nt, Cryphonectria hypovirus
cgucgaccgaucaaguauucucagccugugaugucucaccaagccgccgcaaucuguggcuucaaggagggugaguacaucguggaugacgaguaccagaagaggaucgacg

SEQ ID NO: 1806 - RNA, 131 nt, Cryphonectria hypovirus
gcagguucagguaugccauugucacaggccauggcucgcaucugggaugaacuacacgacuuacgucuccgcgaaggaggccaguucaucauagcagaugccaaggcauaugacagcaagugcaagccugc

SEQ ID NO: 1807 - RNA, 95 nt, Variola virus
gccaauuccaauugcuguccguauuguauuagaguaucgauaugaguaaugguguccuugcguuuuucugauagaaugcgagcagcgauuuuggc

SEQ ID NO: 1808 - RNA, 82 nt, Cryphonectria hypovirus
gcuguaauccaaacgaauccuaacuggaaggucaacuacuguucgacuccaaggcaggaagcguuuuugaaauggauuaagc

SEQ ID NO: 1809 - RNA, 75 nt, Cryphonectria hypovirus
ggucaguuguacaagccgaugaugaauacauuugcccauuugauaaugucucaucauugccuggacguucugacc

SEQ ID NO: 1810 - RNA, 72 nt, Cryphonectria hypovirus
gucgaggguguagcggccggucguucaauguauccuccgggauuuuuggucggucguuacgauaccaucgau

SEQ ID NO: 1811 - RNA, 60 nt, Vaccinia virus
uggugaguuaauauucauguugaacauaaaacuaauauuuuauuucaaaauuauuuacca

SEQ ID NO: 1812 - RNA, 99 nt, Variola virus
uguccaagauagagagcuccuuuggugaauccaucucuauguuucaguuuaaccaagaaacagucagcuggucuaaaauuuccaucucuaucuaauaca

SEQ ID NO: 1813 - RNA, 60 nt, Rabbit fibroma virus
cucgaagucuuuguuuuuauacacgcacuaaucgcguaauacaaguaauguuauucguag

SEQ ID NO: 1814 - RNA, 128 nt, Rabbit fibroma virus
ggcguaugccgaugcauucucguuuuugcguuaauaucuacuccguggucuaauaauaguuuaaugauacucagcuugggauaaggagauuucagauacagauguagcagauuguguccauauacguc

SEQ ID NO: 1815 - RNA, 131 nt, Rabbit fibroma virus
uagagaacacauugaugcguuuugacuuuguuaauauaauguaagaacuuacaugauccauagugauacacuuacaaguauaguucuuuuauuuaaguuuaugaaguuauauguauaaaaauuguucuuua

SEQ ID NO: 1816 - RNA, 80 nt, Camelpox virus
cacaguuuuuaauuucuuugguaaugaaauuauucacuauaucaguaucuucuuuaucuaccagagauuuuacuaacuug

SEQ ID NO: 1817 - RNA, 95 nt, Camelpox virus
gccaaauccaauuguugucuguauuguauuagaguaucgauaugagcaaugguguccuuguguuucucugauagaaugcgagcagcgauuuuggc

SEQ ID NO: 1818 - RNA, 72 nt, Camelpox virus
gccgggcggagccgaacauucuccaauauucaauuuuuguauaucuauaauguuauuaaccuccgcauacgc

SEQ ID NO: 1819 - RNA, 63 nt, Camelpox virus
gguggaacguauauuuuauuuaaggacuuaacaauugucuguaaaccacaauuugcuuccgcc

SEQ ID NO: 1820 - RNA, 130 nt, Camelpox virus
uccagaugucaugauauugaauuggaaaaauaacaaaucuauuuugauuuuuugcaaggauugguuccauaacuaaauuaacaauaguaguaauuuuuuuucaguuaucaucuauaugaauguauuugga

SEQ ID NO: 1821 - RNA, 115 nt, Fowlpox virus
aaucaauaguauaguuuuauuuuuauuacguauauucacuuuucuccauugucuaauaauaguucaaauguuucuagaagaaugaaaaacguagaauaucggcguaucguugauu

SEQ ID NO: 1822 - RNA, 99 nt, Fowlpox virus
agagaagcuaguacaucuguuauaauagcuuccauauuuuucuuauccgccaagaacauauaauagcuauuuuuaucuauuuuagaaaacaagcucucu

SEQ ID NO: 1823 - RNA, 130 nt, Fowlpox virus
aguaaauucguuaagcaaagaaguaaaaucuucgucuuuagauauuucuggauauacuuuaaauaguacaugcgagaaaaaguggaagucguaauaccaauucuguucuuuguuaauagcgguuacagcu

SEQ ID NO: 1824 - RNA, 66 nt, Fowlpox virus
gauguucuauaaauaauuuauucagauaacauauauugucgaauaauuuuauuuuauuaggccauu

SEQ ID NO: 1825 - RNA, 77 nt, Fowlpox virus
gcuguagauguaaccgaguaugcgauugccauaaauaauccuagaaaaucaacguauauuucuuuacuuuuuacagc

SEQ ID NO: 1826 - RNA, 87 nt, Cowpea mottle virus
cugaagaagauuguagggacucauuccaggaucagcgacgacgcuuucguugcuuuguaucauggcaggaggaacacaaucuaucag

SEQ ID NO: 1827 - RNA, 109 nt, Cowpea mottle virus
ggcuuccgcguguccaacuaggggugccuaaggcgugugccaggguuuaauacuaguauaguucguggcgaacacccugacaugcugaucacgccuaggacaggaagcc

SEQ ID NO: 1828 - RNA, 84 nt, Chimpanzee cytomegalovirus
cuggguaugcagcaugagguaguuguugaucacucgucuuuaaggugugacgacggaucacucuucucaucgcccuugucccgg

SEQ ID NO: 1829 - RNA, 50 nt, Chimpanzee cytomegalovirus
cuguuccgccacuuaucguacaguuucugugggauacguaggcaaaacag

SEQ ID NO: 1830 - RNA, 67 nt, Chimpanzee cytomegalovirus
ggcgcaucuggaggccguucuguaggauguuguacugcaucacuguaaaauuacgaaucuccgugcc

SEQ ID NO: 1831 - RNA, 109 nt, Chimpanzee cytomegalovirus
ggugaugaggcaggugaaacccgugaugccgaugaaggacauuucugcgauaaaggcaaaguaacgaacuucgucgaucaucacggccucgcugaagcugcaugucacc

SEQ ID NO: 1832 - RNA, 94 nt, Chimpanzee cytomegalovirus
guuuuaggcuuaguuaccggcucuuguggccucuuuagaguagucguccucuuaggcuuuggcgguuuaacgaugguaaccguaaguuuaaaac

SEQ ID NO: 1833 - RNA, 90 nt, Sonchus yellow net virus
aacaggaugugcuucauggucuuaggaucuaaucgcuuauacaugaccucugccguugcauuuugaaccaucacggugagcaagucuguu

SEQ ID NO: 1834 - RNA, 61 nt, Sonchus yellow net virus
agccugucccgagcguugaugugauuccuccuagugaugugacaccaacguucgaauugcu

SEQ ID NO: 1835 - RNA, 120 nt, Cowpea chlorotic mottle virus
aucucuguuuaauauggaaauuaaaguuauggacccaaguuugccauacguuuguaguaaguuucuuuuagaaacugaaaugaauaacuuggugucugugccugauccuaugagagagau

SEQ ID NO: 1836 - RNA, 97 nt, Sonchus yellow net virus
auuguucgcuauggcauauauauuuaacggugaauuauaucccacuuccgugcuaauucccauauuuauuucaauguaugcuaacauagcaaucaau

SEQ ID NO: 1837 - RNA, 103 nt, Sonchus yellow net virus
ccccuucuauaaacgcgaugucugcgucuggcuuccccuguuucgcuuuuccgcaagcaucaucaguggacaucagagcuucuucugcaucauagaagaaagg

SEQ ID NO: 1838 - RNA, 130 nt, Sonchus yellow net virus
cuuguagcauacuaugcagcucuuccauuacugcuaguauaucauccucuaauucuccaucaccugcaugauggauugcagacuuguacuugcugguuaguaccucagaguucaucacugugcucuuaag

SEQ ID NO: 1839 - RNA, 67 nt, Sonchus yellow net virus
ggugcaauuuccgcucgugcaaugugucguguggauggcuuaugguauugcaucuugaaauagcacc

SEQ ID NO: 1840 - RNA, 91 nt, Cowpea chlorotic mottle virus
ggugugacaguuuugucugagauuaauuugcagagguaucagcacaugauaaagucugauauuaaaccaguugucucggauacguuacacc

SEQ ID NO: 1841 - RNA, 117 nt, Sonchus yellow net virus
guuguuugcaucauuauauagaucagguugguugauucugucaucuucuaucaaauuauucaaaaauucuagaggauuccauauucuuugaucaucauauguuaauaugcaagcgac

SEQ ID NO: 1842 - RNA, 69 nt, Rice yellow stunt virus
augucaugacccucuucucgucacaguccagugaucucaucaagacugagauaauaaauauuaugauau

SEQ ID NO: 1843 - RNA, 55 nt, Rice yellow stunt virus
cucuagaucucuggacaugcuugacaucuuuucuugcaugucgagcaaauuagag

SEQ ID NO: 1844 - RNA, 114 nt, Rice yellow stunt virus
uagugguaacauagaagcuccagguguaguggcuucaugaucggggggcaguuuccaauaggaggugaccugaugcauaucccugcacaaauuguugcagcuaucccuccacua

SEQ ID NO: 1845 - RNA, 55 nt, Rice yellow stunt virus
uauguggaguuggguuuuuaaaauaugaacaauauaaaacauugauaaauacaua

SEQ ID NO: 1846 - RNA, 84 nt, Rice yellow stunt virus
uccgguguuagaucccugguuccaucagcuauguauaguaugcugucucggaaaaucugaugagaucuagaauauagcccugga

SEQ ID NO: 1847 - RNA, 70 nt, Rice yellow stunt virus
ugucugucuugauuagauauccucaccguuaugugauuguugucacagauauguucgucaguccaagaua

SEQ ID NO: 1848 - RNA, 93 nt, Lactate dehydrogenase-elevating virus
cacuugaacagaauagccagugaacacagaaaaacagggacaaugcaaaagagaacaucaaccuugcuagcaucacuggcagaaucucauuca

SEQ ID NO: 1849 - RNA, 68 nt, Callitrichine herpesvirus 3
agggucugaggggacuaaguggaggccugaagccggguuaugaugcaggguccugggccugagacccu

SEQ ID NO: 1850 - RNA, 131 nt, Callitrichine herpesvirus 3
cccggccgccccuuggggguuucggggacacgguugcuggcugccaagacacuuagacagcccucuaguggccaacuagaugucggggcagccagccaccguguccccagaacccccaagggguggccggg

SEQ ID NO: 1851 - RNA, 103 nt, Callitrichine herpesvirus 3
ccuacuauguucuuauuggcuuauggccauagaccccugcccauauccuugaaggcagugggccgugggguugcuguggaaaccugcccagugacgucuuagg

SEQ ID NO: 1852 - RNA, 85 nt, Callitrichine herpesvirus 3
ggauaaugggggagguccgaaugggggucugugggcuggcaggcgcggccugggcccaauuuucgcuucacuccccuucuuauuc

SEQ ID NO: 1853 - RNA, 109 nt, Callitrichine herpesvirus 3
gugagucauggaagagggucugaggggacuaaguggaggccugaagccggguuaugaugcaggguccugggccugagaccccaggcuucuucccuuaggugugagucau

SEQ ID NO: 1854 - RNA, 110 nt, Callitrichine herpesvirus 3
uuuuuuagcugaugacagacaaagcauguucagauggucaauaugugcaguuagaauacaugacuagugugcgucuggagguagcauuguuaaacuaucaguauaagaaa

SEQ ID NO: 1855 - RNA, 131 nt, Equine herpesvirus 2
ggggcggaagacccucaucgcccucugccuggcuguucgggccgcugaccgccugcugugcuugagacgagcgggcgcucacggguacccgauggccgggcgaggcgccccgcccggcguccuccgccccc

SEQ ID NO: 1856 - RNA, 74 nt, Fowlpox virus
aauaauacuauuuagaugaaaaaaauuagcuuaucaacuucuguuuccaauuuuucaucguucgauucauuauu

SEQ ID NO: 1857 - RNA, 96 nt, Fowlpox virus
auuaccguguauauaaaauccuuuuaugucauuggaggucucugaauuauaauaaucugaucuaacugauauaacagcuuuuacauauuugguagu

SEQ ID NO: 1858 - RNA, 103 nt, Fowlpox virus
cguuagaugguugauaaucaccguguguuuuuguaucuuuaucagauaaugacauauuugauauuuaacaaaguaaaaaucgaccuuuauuauuuaucuaacg

SEQ ID NO: 1859 - RNA, 72 nt, Fowlpox virus
gauaggcaaaaaauauguuuacaacuugggagaauuccaaaauacuguucggaaauauguuuuuuguuuauu

SEQ ID NO: 1860 - RNA, 65 nt, Fowlpox virus
gauucuggcauaugucgaggcuggguuucuuuauaaggaacacaaucaucaucguagucauaguc

SEQ ID NO: 1861 - RNA, 86 nt, Fowlpox virus
guuaauaucgguaggguguaguauauauagaccacagauaucacauugaucuccguguauauacuuacauuuuuuaccauaauagc

SEQ ID NO: 1862 - RNA, 70 nt, Fowlpox virus
uuauauuuaaguucuauagguaaagcauuccaguaaccaucuguagugauauuacucagaauagauauag

SEQ ID NO: 1863 - RNA, 61 nt, Fowlpox virus
uuauauuuucauguagugucugaacaacuuguguauuuuaacgcuacccuaugauguauaa

SEQ ID NO: 1864 - RNA, 96 nt, Bovine respiratory syncytial virus
aaugcaggucuuggcggauagaacuuuugaauguauuaguaaauuuagcucaucacauuuaugauucugagguuuagauuguaaacauuaugcauu

SEQ ID NO: 1865 - RNA, 96 nt, Bovine respiratory syncytial virus
aauuagugaauuauacauaucuuuuuaaauaacuauauaugaacauaauugauauuauauggagguguguuguuagaucuguguaguugauugauu

SEQ ID NO: 1866 - RNA, 69 nt, Bovine respiratory syncytial virus
acaacuauauagauaaugugaguuuuuaaauaacuauauugauauuacauuacauauaaucaugguugu

SEQ ID NO: 1867 - RNA, 96 nt, Bovine respiratory syncytial virus
cauguggaggccauucaaaguaauuaugacuaaaaugacauuuuuuaccauuuaagcaauguccccuaaucucauauuugcagggauuucuucgug

SEQ ID NO: 1868 - RNA, 71 nt, Bovine respiratory syncytial virus
gauaauugauuugaauauuuagcuaauucugaaucacuuaaccuuuuagaaaauguuauuucacaauuauc

SEQ ID NO: 1869 - RNA, 131 nt, Bovine respiratory syncytial virus
gcuugcaggauaguauacaccauuaugcugaaugguuuuacucauaaauugcauaucacgggauauauaugucuccguaccuuuaaguuuaugaccuauacuagcauauucuuuauacaacaacuuaaggc

SEQ ID NO: 1870 - RNA, 100 nt, Bovine respiratory syncytial virus
ugauuuugagaauacauauuacauggauauugaaacuguaaguagucaagaacauuuugaugacuuaguacaauaacaucauuuucauucuuaauuagca

SEQ ID NO: 1871 - RNA, 62 nt, Newcastle disease virus
cacggccaauguggcuucauucuguuucccugcaagggcaacaugguuccucauuaccugug

SEQ ID NO: 1872 - RNA, 69 nt, Newcastle disease virus
cgggaugugcuaucgaauacugcagacgcaggguuaagucuugcuuguucaccaucaagcauugucccg

SEQ ID NO: 1873 - RNA, 61 nt, Newcastle disease virus
cuuaguagagguaaccucguggucagcggucacugcgacagcgcguuggguaccugcuugg

SEQ ID NO: 1874 - RNA, 75 nt, Newcastle disease virus
gaaaguagaauuccuggcauauucuuguauaaaucacccauauauaagacaauauugucuaggccucuuacucuc

SEQ ID NO: 1875 - RNA, 82 nt, Newcastle disease virus
gaagacauguuggcagaaggcuuccucgaguuugugcuucgggcucgcacucgagauucacaccuucuacccgugcgacuuc

SEQ ID NO: 1876 - RNA, 98 nt, Newcastle disease virus
gcuucaaucagcgcagugucaauauucuuccucaaguacuuuauuaaucuugguaaaggacuggauaggaugucugucacacgcugccgcugugaggu

SEQ ID NO: 1877 - RNA, 55 nt, Newcastle disease virus
gguaggauaaucugaugcucugcccuuucaggaccggagcucgccauguccuacc

SEQ ID NO: 1878 - RNA, 67 nt, Newcastle disease virus
guauaaggaguucccgugucuugcacaucuuaccucggguacagaaaggagaugggaugccuuauac

SEQ ID NO: 1879 - RNA, 57 nt, Newcastle disease virus
uggaaaugauccgcagaaacagggguauuguuuuggcucugcuuugaucggagacca

SEQ ID NO: 1880 - RNA, 64 nt, respiratory syncytial virus
augauagaguaacuuugcugucuaacuauuugaacauuguuggacauuaacuuuuucugaucau

SEQ ID NO: 1881 - RNA, 88 nt, Garlic latent virus
cacagcgaugaugaggaacucuuugagaaaaauaguaaaauucuuaccauuugcauucaaggagauugugaauuucgauuucgcugug

SEQ ID NO: 1882 - RNA, 84 nt, respiratory syncytial virus
cagauuggugaaugcuauguauugacucgagcucuugguagcucaaagguuuuguuauggaauacguuauauucacagaguuug

SEQ ID NO: 1883 - RNA, 72 nt, Garlic latent virus
cccuggcuaacaugcuuuucacguuuuugagguaugaucucaaugggcaggaaagcauuuguuuugcugggg

SEQ ID NO: 1884 - RNA, 72 nt, Garlic latent virus
gcacuaaaugggacaaucgcuuucgaucggcaaaagccgcccaaacaaucgucugcuuucaacauucagugu

SEQ ID NO: 1885 - RNA, 77 nt, respiratory syncytial virus
guccaacggcaauuaaugauaacaauauuacuauaaucacuauaauuauaguaguuaucaugauauuuaugguggau

SEQ ID NO: 1886 - RNA, 63 nt, respiratory syncytial virus
uccaaguaauucagauaauugauucauauaauuggucauuguugaaucacuuaguuuuuugga

SEQ ID NO: 1887 - RNA, 118 nt, respiratory syncytial virus
ucuauugaguugacagauaugauacuaucuuuuuucuugggaucuuuaggugaugugaauuugcccuuuauugauucuaggaauuugguagcucuguuguuugcaucuucuccaugga

SEQ ID NO: 1888 - RNA, 81 nt, respiratory syncytial virus
ucuuguaugucauaaguaaugacugaaaauaaguagguucuucuauuuuuauuucaccuuuaugauacuuagacauuaagg

SEQ ID NO: 1889 - RNA, 106 nt, respiratory syncytial virus
uuacaugcuugcuccacucuauuauaauuuuacuccaguugacuguuacaggcaauucagcaucacagacaaaaagacugauagguucagcaaacuuuauauguaa

SEQ ID NO: 1890 - RNA, 69 nt, respiratory syncytial virus
uugaugaugugguaagcauuaggauugaguguuaugacacuaauauauauauuguguauauaucaucag

SEQ ID NO: 1891 - RNA, 75 nt, Sendai virus
gugcugauguugccacuccaagugcuauggucccaaucacggcgccgaagaaucuugacugugggacaucagcac

SEQ ID NO: 1892 - RNA, 87 nt, Sendai virus
ucaucaaaaucuuuacuucuuuggugagaaaucuauauguuauacuauguauaguauucucaaaccuaucuaauauaguuuuuguga

SEQ ID NO: 1893 - RNA, 129 nt, Human parainfluenza virus 3
aagauccgacaucuguugugucaaugauauugguauauaauucuggacaugacucugaauuguaagaagccuuguguucacuccugacuguauuagaucauugguauuauccgaugccauuuggaucuu

SEQ ID NO: 1894 - RNA, 78 nt, Human parainfluenza virus 3
acucaggauagaguaugucagauacagugccauuguuagauucaguguccauuuuccgagcacgcuuugcuccuaagu

SEQ ID NO: 1895 - RNA, 80 nt, Human parainfluenza virus 3
aguuaauaaagggagucugacuuggagggugauugaguaaucauucaaaucaacaucuauaacucucaccuuuauugauu

SEQ ID NO: 1896 - RNA, 70 nt, Human parainfluenza virus 3
auguucuaucugcuuuaaguaauaauucagucacuuuacuguuaauaccagguauauauaauuugaacau

SEQ ID NO: 1897 - RNA, 106 nt, Human parainfluenza virus 3
ucccgucacauacuguugcauggcucuauuuuguacaacugccacucccauugcauagcuccauauggcaggauaguugccuggugcgaacucaccauguauggga

SEQ ID NO: 1898 - RNA, 108 nt, Human parainfluenza virus 3
ugagacuaucuaguguaaaauuugcacguguuugugcuaucugugaggcuuccauccaagauaucucaucauuaccaaaugcccauguauauaucauugcuauucuua

SEQ ID NO: 1899 - RNA, 65 nt, Human parainfluenza virus 3
uguuauacauccauuuggacaugaauguccccauggacauucaucguuuccuggucuugauagca

SEQ ID NO: 1900 - RNA, 73 nt, Human parainfluenza virus 3
uguugaauugggauucccauugaacaguacuuuaacccuguuaagaaucugugucacauuuccuaauuuuuua

SEQ ID NO: 1901 - RNA, 131 nt, Human parainfluenza virus 3
uuggcauaagccauugauaauaaggacaccaggaacccugcccuuugugcauguuguuucucauuauccagugaaugagauaaaaaaagaagagcuaaugucauuuucucauuaucaucaguuauugucgg

SEQ ID NO: 1902 - RNA, 64 nt, Human parainfluenza virus 1 strain Washington/1964
agagcuaaugggugucauuauugaggaguguagacuuauauccuccugauuuucccgaugcuuu

SEQ ID NO: 1903 - RNA, 110 nt, Human parainfluenza virus 1 strain Washington/1964
uucuuaucugcgucuuuuauccgaguccacucaaagauuguaucucuuaauacucuaucaaaugugauaauacaauuuuuugugucuacuauauuuaguguagauaagaa

SEQ ID NO: 1904 - RNA, 131 nt, Human parainfluenza virus 1 strain Washington/1964
uugucugauuaauucugugauugucucuuugauuauuuuggcacuuucguucauggaggauacugucaugauguuugucuucauacaagugucuuguuuuauaauuaggucaaugcauaggaucaugauaa

SEQ ID NO: 1905 - RNA, 68 nt, Equine herpesvirus 1
agaucucccccaugcaaauguuuuaggguaggcuguacauggaauagguaaacgcuugggggucuucu

SEQ ID NO: 1906 - RNA, 127 nt, Canine distemper virus
aguggaaauugggguaaucauucguaauuccucaagugagauguccgcucucuguuuugccaagguccaagccucuugccaagauucgucaucaucaccauaggcccaugaguacacaguugcuauu

SEQ ID NO: 1907 - RNA, 65 nt, Canine distemper virus
gauaccugauccugacaugcaaaguugaguaacguugaucaauugccauagcaguaucagucauu

SEQ ID NO: 1908 - RNA, 72 nt, Canine distemper virus
ggugcggggagaauugccaucuuggucaagagacagugaucuuguaagagggguucuaucacaucccguguc

SEQ ID NO: 1909 - RNA, 84 nt, Canine distemper virus
gucugauagucgagugaugcucauauauaccacccugaaucuuugugcuaugucuaaugguauuagauugacuguguuacagac

SEQ ID NO: 1910 - RNA, 84 nt, Canine distemper virus
gugcagaaaagugauuugggauugcuuaggaccaguagcucgaauuguccgguccucuguugucuuggaugcuauuucugacac

SEQ ID NO: 1911 - RNA, 61 nt, Canine distemper virus
ugcagugauuugugcagcuguagccacuccuaaagcuacaccugcaaguaccacuccugca

SEQ ID NO: 1912 - RNA, 129 nt, Canine distemper virus
ugguaagccauccggaguucaaaagugggcuuucauaauaauccauaccaucuccauucaguauaaccggaccguaugugaacgauauguuaaguugaaggucaacacuugcaucuagagguaauguca

SEQ ID NO: 1913 - RNA, 71 nt, Canine distemper virus
ugugacuggugaggucaauaauacauacaaggucccuagagacuaacacauucaaugauucaccuuuuaca

SEQ ID NO: 1914 - RNA, 79 nt, Canine distemper virus
uucucuauaagugaaacauuaggcaucaguuuuaugaccaaguacuggugacugggccuagucaugaucuuguaaugga

SEQ ID NO: 1915 - RNA, 105 nt, Simian hemorrhagic fever virus
ggugaaagguuaaggcagcuaugaagagggcauagacgugcugaugagauucagcgagcugaucagugaaauuaaagaugccaguuacagaccuuggccuuuccc

SEQ ID NO: 1916 - RNA, 58 nt, Human herpesvirus 4
auguaggcaauugcgugccuagaacauugcuaaugugcccuggguuuccugccuucau

SEQ ID NO: 1917 - RNA, 78 nt, Human herpesvirus 4
cccguggggggucuuaguggaagugacgugcugugaauacagguccauagcaccgcuauccacuaugucucgcccggg

SEQ ID NO: 1918 - RNA, 96 nt, Human herpesvirus 4
ccgagacgaaggcccgucuguagaggaagugguugcgcaugcgggccagcucccaguagaccacguccccccagacgcgcaggcacagggucucgg

SEQ ID NO: 1919 - RNA, 68 nt, Human herpesvirus 4
cgcguggcauccacguuggccucaaagauccgacacccgugcuugucuugcagccacguggccacgug

SEQ ID NO: 1920 - RNA, 112 nt, Human herpesvirus 4
gcgauguuuugcgccuggaaguuguacucccggaagaugcccuccaggucaaagacguuggaggcacgcuguucgucccgugaguacagcuccagggaggcaaagucaaugu

SEQ ID NO: 1921 - RNA, 80 nt, Human herpesvirus 4
gcuguagaugugccuggcucuguccagaauguagggccagucaaaguuggccacguuguagccggucacaaucuccacgc

SEQ ID NO: 1922 - RNA, 61 nt, Human herpesvirus 4
ggcagguggagugggacacaguuagagaacauuaguccucuggucccuaucuccacccgcc

SEQ ID NO: 1923 - RNA, 62 nt, Human herpesvirus 4
ucugguuguugccguugacccccguguacuuguugauggucacuggcagcgugacaaccgga

SEQ ID NO: 1924 - RNA, 78 nt, Human herpesvirus 4
ugugccgcuuggagggaaacaugaccaccugaagucuguuaaccaggucagugguuuuguuuccuugauagagacaca

SEQ ID NO: 1925 - RNA, 106 nt, Measles virus
acagaugauucaauuaucugcugcuugaucuuuucaggauucauuagccgguuagcuuugagaucugucauaacuaaauaagauucaguagauaugaaguugcugu

SEQ ID NO: 1926 - RNA, 130 nt, Variola virus
acgaugaaugaguaauaagaaauaugaaaucuaucuuauauacacauaauuauucuaucaauuuuaccaauuaguuaguguuuaauaaaaauaugggaaucuaauuaauuuuuccuuacacaaucgacgu

SEQ ID NO: 1927 - RNA, 78 nt, Variola virus
acuuagaguuaugauaaagauauuuauccuuagggugcagguaauggggauuaaucuuuguuggaucagucucuaagu

SEQ ID NO: 1928 - RNA, 82 nt, Variola virus
augaugauuuauggugaauugauuccggaagaucgcuauuguauuuugugguuccacaauucauuuccauacauguuauuau

SEQ ID NO: 1929 - RNA, 129 nt, Variola virus
cauuuuuggauuucauauaguugaauauauuaaaguuauuuauguugcuaaauccaguggcuucuaguagagccaucgcuauauccuuauuaacuuuaacaugucuacuauuuguguauucuucuaaug

SEQ ID NO: 1930 - RNA, 97 nt, Variola virus
gaaacgccauuuagcguagugaggacacaagugaaccuauaaugagcaaauuuauuaguaucgguuacaugaaggacuuuacguagaguggugauuc

SEQ ID NO: 1931 - RNA, 79 nt, Variola virus
gucaauauuaucagauucuauauauucgaauauaucaaagucauugauauuuuuauaauugguagaagacaauaaugac

SEQ ID NO: 1932 - RNA, 99 nt, Variola virus
uauaucaacggacacaaaguagcuaacauaaaccauuguauaauuuuuauguuuuauguuuauuagcguacacauuuuggaaguuccgguugccaugua

SEQ ID NO: 1933 - RNA, 110 nt, Variola virus
ucuguucccgaaagauaauauagaggcguuuuaugcuguuuaucgcacgcguuuggaucugcgccgugcgucaauagcaucgcaacuauucuauuauuauuaauuuuaga

SEQ ID NO: 1934 - RNA, 117 nt, Avian paramyxovirus 6
acauaugccaguggguccacugaugagauucagaugacuacuuugccgucuugaugaagggauugaauccaucuguuuucuuuuugucaguggagauggcucccuuggcuucuaugu

SEQ ID NO: 1935 - RNA, 98 nt, Avian paramyxovirus 6
agauuagugaugaacggauuuaauuugggugaaucaaauaucugagauaucccugaacaacauucccgaguucugugaucugucgccauccacaauuu

SEQ ID NO: 1936 - RNA, 81 nt, Avian paramyxovirus 6
cuuauaauuugggacuaugauuucuaauucauaaccaucuaguaguugugcaguauauuggucauaaccccauaguaugag

SEQ ID NO: 1937 - RNA, 86 nt, Avian paramyxovirus 6
gcaguggugucagugagugugcaugccugggugucaaucucuucaagaagcuggccagauuccacaacaaacugagguacuacugc

SEQ ID NO: 1938 - RNA, 89 nt, Avian paramyxovirus 6
ucacugucuccauacgcccagauguaaacacucgcuccucuuaaugccgcccuaaggugaguugacaucccuuugauuguugucaguga

SEQ ID NO: 1939 - RNA, 61 nt, Avian paramyxovirus 6
ucauugacagcaccguacggcuaacuuugaaaaggcugcugcgauguaagaaggucaauga

SEQ ID NO: 1940 - RNA, 92 nt, Avian paramyxovirus 6
uuguggcugaguguuagugccauuaguguucuugcuuggauauaaugcaaccaggcuaagaacgcacccacuuauugagcaagucagcgcaa

SEQ ID NO: 1941 - RNA, 66 nt, Macaca mulatta rhadinovirus
ccgguucuauaaacugcguguacccaaagagagcccuggcuuccucgcauaguucguuaagaccgg

SEQ ID NO: 1942 - RNA, 75 nt, Macaca mulatta rhadinovirus
ccugaagaguucgccgguggccgaggcgcugcacacgcgaaacuuaaacgccucggcccuagguggguucucggg

SEQ ID NO: 1943 - RNA, 70 nt, Macaca mulatta rhadinovirus
gaacuaacacgacaugccuuuuccauuuacucauugggggugcuauugguggauuuugugguggugguuu

SEQ ID NO: 1944 - RNA, 75 nt, Macaca mulatta rhadinovirus
gaccgugcggccgacaucgcccagguccgcgacuaucucggacaggucgcgggccaggcggucgcgguucagguc

SEQ ID NO: 1945 - RNA, 60 nt, Macaca mulatta rhadinovirus
gccgugacgggcggucaccucgcgaccgagacgcguucgcaggucuuccgucgucagggc

SEQ ID NO: 1946 - RNA, 104 nt, Macaca mulatta rhadinovirus
ggaugcuauugagucuggugaacagcucguuuuguuuucgcauaacguugguauaguuugccuguugaaagaacgucacggagcaaucccggcucagugcguuu

SEQ ID NO: 1947 - RNA, 71 nt, Camelpox virus
acauguguacuuauagucuacuaauaugaaguaccugauacacauuucuauuaacgauuuauuauauaugu

SEQ ID NO: 1948 - RNA, 75 nt, Camelpox virus
ggucuuggauagaauauuuguaucguuuaauacucguauauauuauauuaaacaauacuaaaauaucuuuagacc

SEQ ID NO: 1949 - RNA, 79 nt, Camelpox virus
gucgauauuaucagauucuauauauucgaauauaucaaagucauugauauuuuuauaauugguagaagacaauaaugac

SEQ ID NO: 1950 - RNA, 70 nt, Rana tigrina ranavirus
agcugaucuguaaaacuuuaggauaagacuauaucuuguccuaaucucuagcaacaauacauuucagacu

SEQ ID NO: 1951 - RNA, 78 nt, Rana tigrina ranavirus
cccgaaaugguguauaguuucauguugggguccauuuaaaaugcaauggauccagaaggaaugcuguacgguuucggg

SEQ ID NO: 1952 - RNA, 75 nt, Rana tigrina ranavirus
gacaucuuaagauucuuucuauaucacgguaauaguucuaugauaagaaggaaauguaacaucuuaagauacguc

SEQ ID NO: 1953 - RNA, 68 nt, Rana tigrina ranavirus
gcgcuuggccucuggcaugguguacucacuccaggcguccagguaugccguguuaaaggacugggcgc

SEQ ID NO: 1954 - RNA, 57 nt, Rana tigrina ranavirus
guugacgaaggcucucuugaagcugccgggagaggcgcuccaagaggccuugucgau

SEQ ID NO: 1955 - RNA, 69 nt, Rana tigrina ranavirus
uacaugagcgucucccaggguguggacaaacucucccgguucuagcccggugacgugagccaucaugua

SEQ ID NO: 1956 - RNA, 130 nt, Rana tigrina ranavirus
ucaaucaugguccucucgguuccgggucugcaaccgcguacaaucucuaucagccuccuugucauccagaccugaggcucagagucuggaucggucagaucgagguagcacuggacuauccucucccuga

SEQ ID NO: 1957 - RNA, 88 nt, Rana tigrina ranavirus
ucugggugagcauaaucuugagcuggcuagaaaacuuccaccuguuuggauccuccagggccaucucaaacaguuggccccaucugga

SEQ ID NO: 1958 - RNA, 131 nt, Bovine herpesvirus 4
aauagaugagguuugagaucucuaagauaugcugggaaaccuuuucaaaaauguuaugcuggucuauggcuucuauagaugcauuuuguauccuaguaucacucguuucaaguuguaccuuguuaucuguu

SEQ ID NO: 1959 - RNA, 59 nt, Bovine herpesvirus 4
ccccauagaauugacaauauuuucauauaguuuuggauauugucuuaucacaagugggg

SEQ ID NO: 1960 - RNA, 73 nt, Bovine herpesvirus 4
gggaauguacagacuuuauguagaaagaccagagggaaucugucuucuaaaaaacauauuuuauuuguuuccu

SEQ ID NO: 1961 - RNA, 66 nt, Bovine herpesvirus 4
gguagagggaugggagauauauuccucaauguuccuaggaaguuuauagucuccuccaacccuucc

SEQ ID NO: 1962 - RNA, 123 nt, Bovine herpesvirus 4
guucuccugcucagaggcuuugucaauguuuggauagaucauuuuuaugggggccucguucauguuauugguucuccuggagacuauaaaaacaacaaaaaccacaacuaugagaaggaggau

SEQ ID NO: 1963 - RNA, 54 nt, Bovine herpesvirus 4
ucuuauaagguaugaaauuuuauauauuuuuauauagaguccauguuuuaagga

SEQ ID NO: 1964 - RNA, 92 nt, Bovine herpesvirus 4
uguccuuaacuauguguaugugugguuuuuguguucuacguccuaaaaccuuguauuggcacccaugaauagcacauccggccuuaaggaca

SEQ ID NO: 1965 - RNA, 80 nt, Bovine herpesvirus 4
uguuuuuuaucuuuuguaucuggacaugucugaucaaggucaaaucugaauaguucuccagaggaagaugaugcacugca

SEQ ID NO: 1966 - RNA, 104 nt, Bovine herpesvirus 4
uucaaguucuagggagagacaggaacacucuguucuguucuguuccacaaggugggaguauagagcaucaaugagaaguuuaagucucuucuuauuucuuugaa

SEQ ID NO: 1967 - RNA, 87 nt, Hendra virus
aguguacaggguagcaaguuuaucgcucuuugauauuuaggaguucuauaaagaauuauacaaagagucauaugaucucuguaaacu

SEQ ID NO: 1968 - RNA, 123 nt, Hendra virus
aucguaaucauugagauggucugcaugauaauuuaaccuaucagugucaugggguaagaaaaguguuagcaaaaucaucugauggcauaauauauugucauccagacuaucuucguugcuggu

SEQ ID NO: 1969 - RNA, 90 nt, Hendra virus
aucugcaucgauuuugagguauacuagaagauugaaagcaauagcguuguuccuucugaauucuagcauuguccuugggaucauguagau

SEQ ID NO: 1970 - RNA, 90 nt, Hendra virus
gcccaacagcaaugcucucagaauuguaauuuauugaucccaaauauuuuccaaggcuuaugauuauguuuccuagaacaacuguugugc

SEQ ID NO: 1971 - RNA, 118 nt, Hendra virus
ggagucuauuuuguugaugaucuuggguaucucuuucaucuguuccucaaugugauucaaccucauaucaauguugaugaguuugauugcguuaacgaugcccaucaauacugacucc

SEQ ID NO: 1972 - RNA, 124 nt, Hendra virus
gggaaacacugacgguuuaugaaugguugagauuaagacacuggccauuaugauguguaccucuaauauaugaucuuggucugacugcuacucuaucaaauuacugacauguuuagauguuccc

SEQ ID NO: 1973 - RNA, 127 nt, Hendra virus
gguuaugucucaacugcgcauauucuauagcugaaaucaauuucccugauacuauaggacugucaaggugacauucaggauagaugauaucagagauagauaauucaugagccauguuguuauaucc

SEQ ID NO: 1974 - RNA, 57 nt, Hendra virus
ugagauagauuguuggaaguugagacaggaguuauagcuuuuaacacaucuauauca

SEQ ID NO: 1975 - RNA, 127 nt, Hendra virus
ugugcaguacucucuuugauagccuuugcagcuaaucuggaucugagauucaauagagaauuugucaaucucguuccuccggauguacucacugaacugcuugggacacugucugcgagagaugaca

SEQ ID NO: 1976 - RNA, 65 nt, Nipah virus
caauguucuuagcaguguuucauaauuuccaccgaaugccugagauauagccuguauagucauug

SEQ ID NO: 1977 - RNA, 55 nt, Nipah virus
ccugauguguaaucacuccacccucucucagggcuugaaguaaauccauauccgg

SEQ ID NO: 1978 - RNA, 100 nt, Nipah virus
cggguguaagauaauaacacuucuuuccaguuuugucugauuugaaaaugcagauaagauucggauuuaggauuauuucaguacuuuugucucgcaugug

SEQ ID NO: 1979 - RNA, 79 nt, Nipah virus
gagucuuugucaugagcuucgaucugaaaucuaagauuagaacuuuucuucugauguuauuuuugaugugauaaaguuc

SEQ ID NO: 1980 - RNA, 130 nt, Nipah virus
gauugggaauccagggguguaugcuaucuuggauacuaauaguccguccuccaucauaacauuuaucgcgauagauauuagaugggaauguucuacuaguaucuccucuacauuuuugucaaucccagac

SEQ ID NO: 1981 - RNA, 77 nt, Nipah virus
ggauuuggugggguccagacauuggucauaaauaaagaaggaacuucaucaccucugucuaguaccucuccaacucc

SEQ ID NO: 1982 - RNA, 91 nt, Nipah virus
guauaauuguaaggauauuuucuuggucgaaaugcuauuguaguaugaaacuauaucauaauccaauuugaauccuuauuugucauuauau

SEQ ID NO: 1983 - RNA, 69 nt, Nipah virus
gugucguauuaugauaguguacuauagaaagauuuuuggauacuguagaauauuggaaauagacgucac

SEQ ID NO: 1984 - RNA, 122 nt, Nipah virus
uagaaauucugugauuaagcuguugauguuaucgucagagucuauugcaagguguugcuuuaaaacauccuugucagccuuuguuauaaucucaagaacggucugagcaacagucuuagcua

SEQ ID NO: 1985 - RNA, 85 nt, Nipah virus
ucccaauuacuuucuuacuaaugauauuguaugcuuugaaugacuuuuucaugauguuaucaaguuugcuagucaugccuuggga

SEQ ID NO: 1986 - RNA, 103 nt, Nipah virus
ucuaaaguguacauauaaagaauugauuaucacuugaugaacuauaugauaucauuguucucaaagaucaccgaucaagauuauuuauuaacccaguuucaga

SEQ ID NO: 1987 - RNA, 76 nt, Nipah virus
ugacugcuaagcuuaauaggagauccuagaguaaaucucuuggauccuaaguuuuucuuaaugaguuaguaguaca

SEQ ID NO: 1988 - RNA, 52 nt, Nipah virus
ugcagccagucuugaucugagguuuaguaaugaauuagucaaucugguccca

SEQ ID NO: 1989 - RNA, 101 nt, Nipah virus
uuggggaugagaggcacucuuaccaacacccagaggguaggcagcaauuguccugaucuucuugcguuucccugucucugggguucucucaacaucuucaa

SEQ ID NO: 1990 - RNA, 82 nt, Chimpanzee cytomegalovirus
augguagcggucgguuauugguuuucuauugcagcauguagcccagcucugcguugcacacguccagucuccggcgggccau

SEQ ID NO: 1991 - RNA, 125 nt, Chimpanzee cytomegalovirus
guauuccaggcugauccagcgguacgguacgcugcccguggcgcccaagauguacuggggcuguucuuccuugaccuuagcgcagcgcagcuuaccgucugauuccaaguacagccugcggguac

SEQ ID NO: 1992 - RNA, 109 nt, Chimpanzee cytomegalovirus
gugagcagaagcgcgcagacggcguggaggaccaggcucaugggauagugucccuuaucuuccuccugucucucucccucuccuuugcguuucucguccgcuuccucac

SEQ ID NO: 1993 - RNA, 81 nt, Reston Ebola virus (REBOV)
ccauguuguauagguaauuuggggagguaagaaauagcagcuuacaaucccugauuugaauguguccuuguaugacuuugg

SEQ ID NO: 1994 - RNA, 121 nt, Reston Ebola virus (REBOV)
cuaaauagucuaucggcaguguugcuacagguguaucacuuaggaauuuggauacuauugugucgaacuuaagucgauauauauguuuugguaauuuacauugccuuaguugaggauuuag

SEQ ID NO: 1995 - RNA, 74 nt, Reston Ebola virus (REBOV)
gaacagagaauaauucacaaaacuguugaggagauaauugcaauuguaauaauauuuugugaaaaucucuaauc

SEQ ID NO: 1996 - RNA, 79 nt, Reston Ebola virus (REBOV)
ggagauucuuuguagcauacugugcgaugugacucaaccaguacacgccucgcuggacuugugcuugcaaagcaucucu

SEQ ID NO: 1997 - RNA, 104 nt, Reston Ebola virus (REBOV)
gucuggcugagguuccaucuaagguuguggcuugccuuguuaaauaaaucuugauucuuagaucuuaaguccaagcguuuuaccaucuugcaucuuaaacaaac

SEQ ID NO: 1998 - RNA, 74 nt, Reston Ebola virus (REBOV)
gugaaucuacaauauauagugguguccaacauagaccuuagcugauguagguacuguuuaauauuuugauucau

SEQ ID NO: 1999 - RNA, 89 nt, Reston Ebola virus (REBOV)
uccuuggcugucgaaauagugcuuggcaauauuguacuugaauacacaauaugucucaaagaugacauuaggucugagagccuuaagga

SEQ ID NO: 2000 - RNA, 52 nt, Reston Ebola virus (REBOV)
uguuuggaggauuguaaccuagcacauuggguucaaagacugcaucccaaca

SEQ ID NO: 2001 - RNA, 74 nt, Kyuri green mottle mosaic virus
aacuucgacuucucugacuugccgccggucgauauguauacgcauaugaucaagcgacagccaaagucgaaguu

SEQ ID NO: 2002 - RNA, 131 nt, Kyuri green mottle mosaic virus
agggacuuuuagagcgacucgcccaaaaagugucugaagcauucgaaggaugcaaugcgacgauucacgccgcguuaauguccaccgggugguuuagaugccaggcugacgaguuggucguagaagccccu

SEQ ID NO: 2003 - RNA, 90 nt, Zaire Ebola virus (ZEBOV)
auccaauguagauguguauguuaaauacugagcugguacuucccgggugcaacacuuaguuagaugaaggugagcacgauuauauuggau

SEQ ID NO: 2004 - RNA, 70 nt, Zaire Ebola virus (ZEBOV)
cgauucuccagugugagguuaugugguggauuauaauaaucacugacaugcauauaacacugugggauug

SEQ ID NO: 2005 - RNA, 89 nt, Kyuri green mottle mosaic virus
gacucugugaccaugcgguuagcugacaacgaguuuaaccugcaaccuugcagauugacucugucuaaggccgacccgguugccgaguc

SEQ ID NO: 2006 - RNA, 120 nt, Zaire Ebola virus (ZEBOV)
gagauaacuagauugaugucaaaccuuguuuaugauuaacugugaguuuaaaggaguuagaaucacauuggcuauguuuaaagcuccaguguauuauauuaucauuugucaaguaaucuu

SEQ ID NO: 2007 - RNA, 58 nt, Zaire Ebola virus (ZEBOV)
gagcaucuugcauuguguacuuaaugauuucaucuaagaacuguuggcaccgcggcuc

SEQ ID NO: 2008 - RNA, 59 nt, Zaire Ebola virus (ZEBOV)
gaugaagguuaaugaaaaaacacucucucagccgagguagguuuuucuuaaucuucauc

SEQ ID NO: 2009 - RNA, 122 nt, Zaire Ebola virus (ZEBOV)
gcuggcuuacagugaggauuuaucugugguuaaacaaauuaucaagaaauaugaguauuuauuuauuaugcuuauauaucugauuaugaaagcagagaugucaagauaacuauugagucagc

SEQ ID NO: 2010 - RNA, 66 nt, Kyuri green mottle mosaic virus
gggaauaccucaugaugcaagugccguacgguucgccgugcuaugauaucggaggaaacuauuccc

SEQ ID NO: 2011 - RNA, 96 nt, Kyuri green mottle mosaic virus
guuagacgugucuaaauacgauaagucucagacugacuuucaucaagcuguugagauguuaaucugggaaagauuggguuuagacgacauucuagc

SEQ ID NO: 2012 - RNA, 79 nt, Zaire Ebola virus (ZEBOV)
guuguuuauugagauuagaucaauaugauguaugagagcaauuuaugaguuuuuuauaaucuguauguuaauaaccaac

SEQ ID NO: 2013 - RNA, 81 nt, Kyuri green mottle mosaic virus
guuuaucauucuaaguuaguuaaugcgguuuucgguccuguuuuuagguacuuaacuagugaguuucuuagcaugguagau

SEQ ID NO: 2014 - RNA, 102 nt, Zaire Ebola virus (ZEBOV)
uaacgcuugcauguuugaauguuggcuuaaguauucgcaaugagcgaugugguagauuaugaauuugaguaguuaaguaauauaaaaaauugucaaguguua

SEQ ID NO: 2015 - RNA, 77 nt, Zaire Ebola virus (ZEBOV)
uaugguguaagaucaauuuauauacagcuucguacaauuucgaucuguuuauauucucuguugucucugcauccaug

SEQ ID NO: 2016 - RNA, 105 nt, Zaire Ebola virus (ZEBOV)
ucgaaaaucacuauagggcguaaugcuuuuagcaccguagcauguuuuuuaacuuuuuggauugcuguuucacuauguagcacaggaugcccccaguguuuuuga

SEQ ID NO: 2017 - RNA, 98 nt, Zaire Ebola virus (ZEBOV)
ugcuaaaaggagaugaagaaugccucuuggggccuaaucugaauaauaagguuuauucuuaucagaccuccgcauuaaucuucaucauuaguuuagca

SEQ ID NO: 2018 - RNA, 69 nt, Kyuri green mottle mosaic virus
uggcaaacuacuuggauuacuugucugcuagcuuaacggcuacgauagguaaucucgagcggauuguca

SEQ ID NO: 2019 - RNA, 124 nt, Zaire Ebola virus (ZEBOV)
ugggugauaguguaugaagcaagcaugauggcggccguaguugagucaaagcuguaggucuuuugaucagcgacaccuagaggaagccaaauuggaauuugcuucauuagcacuuuggggcccg

SEQ ID NO: 2020 - RNA, 114 nt, Kyuri green mottle mosaic virus
ugucgagaagcgguacacaagcaaacgguguccucgcgacgugacgcauuaccucaaugagguauacgcugcgccugugacgacaucgagugcuguugugcacucggucucgca

SEQ ID NO: 2021 - RNA, 77 nt, Zaire Ebola virus (ZEBOV)
uuuugauauaagaauuaagacccgguguuagauuccuaucugaaguaacacuguaccaagauccuugacuaucaaaa

SEQ ID NO: 2022 - RNA, 95 nt, Marburg virus
accuuugacuguugguucauuauacgcagauaugucaauuauugccucuaaagugaaagcauggcagacauucccuuugaacugaucaucuaggu

SEQ ID NO: 2023 - RNA, 119 nt, Marburg virus
aguggacuuguaauaucuguaauuuggauaguuagguuguucaauauuaaucuucuugauucaagcaaagcauuuaaccuaucuauguuauauaacauucucgguauuacccggccacu

SEQ ID NO: 2024 - RNA, 119 nt, Kyuri green mottle mosaic virus
cacuggccccauccgcgucaggcagauggcaaacuacuuggauuacuugucugcuagcuuaacggcuacgauagguaaucucgagcggauugucagauccucgugguccggggagaaug

SEQ ID NO: 2025 - RNA, 53 nt, Marburg virus
cucucugaaucaagucauguuuauuaaguuaaaucagauggcuugaaggagag

SEQ ID NO: 2026 - RNA, 74 nt, Marburg virus
gauauauguuaguaaaucaaaguaaaacuaagcaagaauuguuuauaaaacauuacuauuucuuuuauauaauc

SEQ ID NO: 2027 - RNA, 88 nt, Marburg virus
ucaaguuuaagauagcuuaagaauauuuuaaucgaguaauuuacaaugaauuggugauuauuaucgucguagucuucaguaaacuuga

SEQ ID NO: 2028 - RNA, 104 nt, Human herpesvirus 5
ccaugagcagcuuaaagcguuucaaccauuggaagagcugcuguucggccaccagcgcguggcugcgauggagcggcacgauggugaccgucggcgacucaugg

SEQ ID NO: 2029 - RNA, 62 nt, Human herpesvirus 5
cccugucuagacucaaaagcuguaaggcugucuuauagcauguagucuugcacgucacgggg

SEQ ID NO: 2030 - RNA, 109 nt, Human herpesvirus 5
cgccgcugucgaacaugguaaagugcagacgcgccgccucgcccauguguacgcagccuccguugcguuccagccuggccgcgcgccguagaccguguucguagcggcg

SEQ ID NO: 2031 - RNA, 53 nt, Human herpesvirus 5
gccaucguuuuucauaccacagccuguagcugucguacaugaaugaggacggu

SEQ ID NO: 2032 - RNA, 83 nt, Human herpesvirus 5
gggauggggaccuguuucagcguguguccgcgggcgugcauggcuuuugcucgccggccgcgcuguaaccaggccucuuucuc

SEQ ID NO: 2033 - RNA, 56 nt, Human herpesvirus 5
ggguccaugaggcgggugaugcgcccgagugaacgggugagcgucucgguggaguc

SEQ ID NO: 2034 - RNA, 125 nt, Human herpesvirus 5
gugggaguuugcggggacaacggucgaucgacggaccgcguagcagcaggaacaggcagccgacgggcacgacgaggcugagaugagaaagcggcggugggucgucgucccguccccgcucgcau

SEQ ID NO: 2035 - RNA, 66 nt, Human herpesvirus 5
ugaacgcuuucgucguguuuuucaugcagcuuuuacagaccaugacaagccugacgagagcguuca

SEQ ID NO: 2036 - RNA, 127 nt, Ovine adenovirus A
ccuugauggaucuucaguuauuggacgaauagugguggggucauuuucgucauaauucuguacaucuagcagcgcaggaauguuucccccaacuaaaucuucauaagugaucugaaaucccucuugg

SEQ ID NO: 2037 - RNA, 101 nt, Ovine adenovirus A
gcagcagguugaagaguuagcagaguguuaaugcugggguuaaaagaagagcggcuuccuccagcuagcugaaacacucguucuggcuucaaccgcguugu

SEQ ID NO: 2038 - RNA, 65 nt, Ovine adenovirus A
ucaccgcuagacgugcggagcucgugauccgaagggcaccccgcuuugcaagguggagaugguga

SEQ ID NO: 2039 - RNA, 55 nt, Ovine adenovirus A
ugcuguaaugcugcaauuuaauucaacguuagaaccuugugcagcauauacagua

SEQ ID NO: 2040 - RNA, 103 nt, Ectromelia virus
agcuugguuaugauauugcgcauaauuuccggaggcaaauacgauagucuagauugaccaucgaugauagacucuaauuuauugagugcuuugucuacgaguu

SEQ ID NO: 2041 - RNA, 61 nt, peanut bud necrosis virus
aggcaaagugaaguccauuacaucaaaacagaugaacaagaugugagagguuacuauguuu

SEQ ID NO: 2042 - RNA, 72 nt, peanut bud necrosis virus
aguuccagucuaugauaacacaaaucauaaaguuaccaagcuuuguuagugaaggaucauuacucaagaauu

SEQ ID NO: 2043 - RNA, 102 nt, Ectromelia virus
auuuauaucuaagauaacacagcaauagaucggaugauuuacuaaagucaucaaugugguccguuaguauaucaaagaucuuguuaucgauugauagugaau

SEQ ID NO: 2044 - RNA, 78 nt, peanut bud necrosis virus
gaagagggaaaucccuauaugugcuggugguuggaugcaugccccuauugaacuacugucuauccuggguccgucuuc

SEQ ID NO: 2045 - RNA, 56 nt, Ectromelia virus
gacguuucgcauacugcguuauuauaucuuucuauaaucgcacaaugauauacguc

SEQ ID NO: 2046 - RNA, 98 nt, Ectromelia virus
gguagagauacuuucagucugugguggaugaugucgugaauauccgcauuguauaagauguuucuguuuucaaacaccaagucgaauacugucuuacc

SEQ ID NO: 2047 - RNA, 112 nt, Ectromelia virus
gguuuaauauuuucuuaguacaaaagucaauguuuuaaaauauauggaugagagaauauuugucuguauaaaaacugugugaaauuuuguaccaaagaaaaaaacgugagcc

SEQ ID NO: 2048 - RNA, 63 nt, peanut bud necrosis virus
guccuugcugggagaagauugcauuuugcacccaagcauagauccgauguuuucuuaaaggac

SEQ ID NO: 2049 - RNA, 130 nt, Ectromelia virus
uauagcuuauuaucuguuugugcuaauauaauaucaaauauacucuuguuaucguuaguugggagauuaauauuacauccaauauauacgagauaagacauuauaucaacguugcacgcuauaagcauua

SEQ ID NO: 2050 - RNA, 70 nt, peanut bud necrosis virus
uaugacuugaucaaagaauucaauaagauaacagaaauugaucuggaaucucuagaaaaauuaggucgug

SEQ ID NO: 2051 - RNA, 54 nt, Ectromelia virus
ucuauauaguauuuuucugauauuuucuauaauaucagaauugucuuccauagg

SEQ ID NO: 2052 - RNA, 71 nt, Ectromelia virus
ugauauuaaacauggaaucaguugaaauuaauucuuugaaucuaguauccuuccacaauguuucaauauca

SEQ ID NO: 2053 - RNA, 120 nt, Ectromelia virus
uuacuuuauuaauaucagcuccauauuuuaccaacucuuuaauaaauuucuuuucacgaugcaucuuauugaauggcaucuuauuauaaguggacauauagacgcagaaguaaugaagaa

SEQ ID NO: 2054 - RNA, 91 nt, Monkeypox virus
cggcugccauguauuuccuggagagcaaguagaugaugaggaaccagauaguuuauauccauacuugcacuuaaagucuacauuguaguug

SEQ ID NO: 2055 - RNA, 50 nt, Monkeypox virus
gauaagauaguggucaguucauccuuugauaauuuuccaaauucuggauc

SEQ ID NO: 2056 - RNA, 74 nt, Monkeypox virus
ggaagucuuuuccauuucgaagugccguguuucaaauauucugcuauacccguugaaauagaaaauucuaaucc

SEQ ID NO: 2057 - RNA, 128 nt, Monkeypox virus
guaaaguaauuuccuguccaauuugauguaccuauauacgccguuuuaucgguuaccauauauuuugcaugguuuacccuagaauacggaaugggaggaucagcaucugguacaauaaauagcuuuac

SEQ ID NO: 2058 - RNA, 63 nt, Ectromelia virus
gugcuuuaacgucaaugguacaaauuuuauccucgcuuuguguaucauauucgucucuaguau

SEQ ID NO: 2059 - RNA, 116 nt, Monkeypox virus
uguucuauauacggggaugaguaguucucuucuuuaauuuuauacuuuuuacuaaucauauuuagacugauguauggguaauaguguuugaagagcucguucucaucaucagaaua

SEQ ID NO: 2060 - RNA, 95 nt, Monkeypox virus
uuccagauuaacagaauagauauuaaugucguauuugaacagagccuguaacaucucaaugucuuuauuaucuauagccaauuugauguccggaa

SEQ ID NO: 2061 - RNA, 94 nt, Variola virus
guacgguuuaauuaccaauguugcugcuaaaccacaugucaaucuaauaacuggauguuuggauaguagcguugccauucugauaaacuuguau

SEQ ID NO: 2062 - RNA, 89 nt, Variola virus
gugucggaugaacuagucccuguuagcauuauaacaauuucuucagaaguauuguuuacuaauguuauucuaaaacuagcauuugauac

SEQ ID NO: 2063 - RNA, 79 nt, Variola virus
uacuuccuuagccuucaaaucuaaaauagauucacacucaugaucggaucuauuuacagauuuaaauguauaguuggua

SEQ ID NO: 2064 - RNA, 77 nt, Variola virus
uaggauuugauauuuuacacaacuguuuaauagagucuacauuuauauguucucuaucggugagauacaaauaccua

SEQ ID NO: 2065 - RNA, 55 nt, Variola virus
uauauuugacuauuggaauaugaaccaucucauuaaccuaugguacauacauaug

SEQ ID NO: 2066 - RNA, 83 nt, Variola virus
ucaauuuuugguaguugaagaagugaauauguaucaucguuuggucuugauuguaucauaccacauacgacuccagagguuga

SEQ ID NO: 2067 - RNA, 83 nt, Variola virus
uguucuuaugucagauacaaaguuuaggaauguaggauucuuugcguaucucagucugugaugucuguuccauuuaaagaaua

SEQ ID NO: 2068 - RNA, 54 nt, Variola virus
uuggugauggagucacuuuuaguucuucaguaguacuaacagugcuauuaucga

SEQ ID NO: 2069 - RNA, 63 nt, Camelpox virus
uuuaaacuuuggcauauacaagucuauacuuuuaguguauaacuuaccacaccauuuuuuaaa

SEQ ID NO: 2070 - RNA, 130 nt, Variola virus
uuuuuuaauaacuuuuucgauaagaucaugauauauauuggaauuuacuguauuaauuaauuguuuguuguuuagacgauguacaggaaacucugauguauuauuuacaauagugucguauaguguuaca

SEQ ID NO: 2071 - RNA, 59 nt, Fowlpox virus
gauauucuacagcggguguaauuuuuguaguuacugauaaaccuggaagguagaauauc

SEQ ID NO: 2072 - RNA, 96 nt, Fowlpox virus
ggaaauagaguagcugauuuauuuauguuuuguaaaguaauaguagaagguucguauuucucuguuaucauaaguucugaaccuacgucuguuucu

SEQ ID NO: 2073 - RNA, 66 nt, Fowlpox virus
ggaggaaguacugguuuauuuccuaaauguuuucuagcauuagcuguaaauccuguaucuuuuucc

SEQ ID NO: 2074 - RNA, 114 nt, Fowlpox virus
guuugguauaucauuugagaaacauauguagaauuuauuuucauaucaucaaaucucuuuacuaaaguagcgucuguucugaauauagauucuaugucucuucuuauaucaaac

SEQ ID NO: 2075 - RNA, 85 nt, Fowlpox virus
uagacuauguucuaaucuauuucuaucuguagugaaaucaucuuuagauaauacuacuguaguacuaauagaugauucgugucua

SEQ ID NO: 2076 - RNA, 87 nt, Fowlpox virus
uauucuuguauuucguaguuaaacuauuaguaaaauaccuacaucuuaggguuaaucuacaguaauuuaacuagaaaagcuagaaua

SEQ ID NO: 2077 - RNA, 82 nt, Fowlpox virus
uccugguguaaaaccaccgucagaauuuauuauauuuuuacuuauuguagacauuaugcuauuuggugguguuucaacagga

SEQ ID NO: 2078 - RNA, 71 nt, Fowlpox virus
uucuagaaccuauagucucauauauguggucagaacuaucgcuacuaucggaucuuauaggaauucuagga

SEQ ID NO: 2079 - RNA, 61 nt, Camelpox virus
agacauuuauguaagucaaaaucuagacuuuguuuuauguuuuguauuuacgugaacguuu

SEQ ID NO: 2080 - RNA, 125 nt, Camelpox virus
auaaucagaaacuguacacauuuucuuacauggauuuucguauuuccauuuaucuguuucgcagacagcauuuggauccaaagaauaauaucccgaaucacauguaaauguaacuuucuguuuau

SEQ ID NO: 2081 - RNA, 88 nt, Camelpox virus
aucauacuuucuacaaauauuggugcauaucccaagaucaucacugauccacaugcaucauaugcagguggauaauuccagguaugau

SEQ ID NO: 2082 - RNA, 59 nt, Camelpox virus
auuaugccauuaaguguaucuaucacccauuguugaacacaugauucauuuggcauaau

SEQ ID NO: 2083 - RNA, 73 nt, Camelpox virus
auuuccauuccauaucggucaaccauucaggugagagauaauuccaucugauaaccgguaguauaucugaaau

SEQ ID NO: 2084 - RNA, 79 nt, Camelpox virus
gcguuagaagucauuuccaucaaucuaucauacucguuauauaacuucuugauuuucugauacauaguucuacuagcgu

SEQ ID NO: 2085 - RNA, 56 nt, Camelpox virus
ggauaauauuuguauacaucuaguauuuauagcugaucuaaagacagauguuaucu

SEQ ID NO: 2086 - RNA, 104 nt, Camelpox virus
guaaaucuauaauaauguauuuaggcaaauauauaaaaucuggauccuuauauauuaauaguauauuauccaauaugaaguuucuuacaucguuguagauauac

SEQ ID NO: 2087 - RNA, 103 nt, Camelpox virus
gucgccuuguucaaauuuaacccagaaagauacgaaaucauucuuuggaaauccggauaugucguauguuccuucugguacauuuguauacauuguuugccac

SEQ ID NO: 2088 - RNA, 51 nt, Camelpox virus
uguauuauguuguuuauguuuaguaauugcuaucauagacaguaucauaua

SEQ ID NO: 2089 - RNA, 76 nt, Camelpox virus
uguuaguguaaguaauuaaagcaauaaaacuauaggggugagauaccgcuauauguaaaaacuauuuauauuuuca

SEQ ID NO: 2090 - RNA, 67 nt, Camelpox virus
uugaaagaauauauuucacgauaucguuaguuaggcucaaugguaucccauaaauguaaucgaucaa

SEQ ID NO: 2091 - RNA, 95 nt, grapevine chrome mosaic virus
caacggucacgaacuaugugaaugcguuugccaucaugugugccacuacuggcaugcaugcugggaaaugcauucuacauuuuuccuggacguug

SEQ ID NO: 2092 - RNA, 64 nt, grapevine chrome mosaic virus
cacugggauugguuaaccucucuaacgguagauauccaaguucuaccagguuuccgauucuaug

SEQ ID NO: 2093 - RNA, 131 nt, grapevine chrome mosaic virus
cuuguguccacauguucauguguugcgagauuccaaaaccaguguuuggacuauugauuuucacaagauuuguggucaaagucuuaauuuuucugggcgaggauucucaaaaccaacauuguggguuauug

SEQ ID NO: 2094 - RNA, 79 nt, grapevine chrome mosaic virus
gaaagacauugagauaaugcuucccccucgccaaauggcaauugggaaugcuggcucaauaaauuuuccacugucuuuc

SEQ ID NO: 2095 - RNA, 75 nt, Goatpox virus
gcaauaguuucuacauauuuuuauuugauaauauauagauguaucaaauaacgauauuaaacuuguuacuauagc

SEQ ID NO: 2096 - RNA, 131 nt, grapevine chrome mosaic virus
ggaaccgaguucuucucuuauggauuucaagcggaaucgcauggguccuugccuucauauaguugaaaagagggugaggaauuccuauguggcuccaccuuggaagccauggggggaggauauugauauuc

SEQ ID NO: 2097 - RNA, 77 nt, sheeppox virus
uaaaaacaauacugaacagauaacaauuaaaaacaccaucuuuauggcuuucuuauucuuuguuugugauguuuuua

SEQ ID NO: 2098 - RNA, 108 nt, grapevine chrome mosaic virus
uggauagucuaaguucccaacuagaggauuuucuagaugucuucuaugauugugcugcacaauuugauggagagcuagaauuuucucuauccaaugauagacuaucca

SEQ ID NO: 2099 - RNA, 63 nt, sheeppox virus
uguacuaauaauuguaguagcuauagugguaauauuacugcuacuaacuguucuaagaguaua

SEQ ID NO: 2100 - RNA, 130 nt, Cowpox virus
acgaaguucuuuggcgguuuucauugauucauuucugaugaaacaguuaaugauccccacgcaauugucgauauugucccacggaagugaauccgagaacuccuucaacucgcuaccaaagagcuccguu

SEQ ID NO: 2101 - RNA, 64 nt, Cowpox virus
auaauuaauacaauauuuagaagacuuauucggaaaguauucuaauacacguaucauugauuau

SEQ ID NO: 2102 - RNA, 59 nt, Cowpox virus
caauguugcugcuagaccacaugucaaucuaauaacuggauguuuggauaguagcguug

SEQ ID NO: 2103 - RNA, 89 nt, Cowpox virus
gaauaacggaugucaucaaauucauugaacauuuaucacaauuagauguuacauucauauuuuguguuauacuuacaucacuaauauuc

SEQ ID NO: 2104 - RNA, 112 nt, Cowpox virus
gauuuuguaauaugccauggaaacaaaugaaacacauuaucacuccaugauaaauuauuuaauggaguaauaaaguauuucgcguuguaucuccauggguaauuucgaaauc

SEQ ID NO: 2105 - RNA, 89 nt, Cowpox virus
gugucggaugaacuagucccuguuagcauuagaacaauuucuucagaaguaucguuuacuaauguuauucuaaaacuagcauuugauac

SEQ ID NO: 2106 - RNA, 79 nt, Cowpox virus
guuuccaaauagcuuaagaaggcauuuacguaugacggagcacauguaacacaguuaccaucagaagcuuuaaggagac

SEQ ID NO: 2107 - RNA, 91 nt, Cowpox virus
uaucuaagauaacacagcaauagaucugaugauuuacuaaagucaucgauguuguccguuaguauaucaaagaucuuguuaucgauugaua

SEQ ID NO: 2108 - RNA, 131 nt, Cowpox virus
uauguuuuaugaauagauaaaguagaugguguccuucuuccuuuuguaauuucccguauuuuuguucgugccaauugaguaacaguaugagaauaugacaggcgacacaaucguucuuuauguauuccaug

SEQ ID NO: 2109 - RNA, 80 nt, Cowpox virus
ucaauuuuuggucguugaagaagugaauaaucaucguuuggucuugauuguaucauaccacauacgacuccagagguuga

SEQ ID NO: 2110 - RNA, 61 nt, Cowpox virus
uguuguauauggaguaacuguugguaguucuuccguggaaucaauagucauacuaacagca

SEQ ID NO: 2111 - RNA, 62 nt, Ateline herpesvirus 3
aagcacccuucguguugggauuuuugcaaguuuggcuauuucagaaauuucaacauguguuu

SEQ ID NO: 2112 - RNA, 76 nt, Ateline herpesvirus 3
acuguuguuuuuaacgcaugucauauaggugucugaugguuuguuauacccuauuguuuuaugauaaaacaacagu

SEQ ID NO: 2113 - RNA, 70 nt, Ateline herpesvirus 3
aucgcuuauaugaaaaucuggacaugucucacaguuagugaucauagcugugauguuagcauauguagau

SEQ ID NO: 2114 - RNA, 58 nt, Ateline herpesvirus 3
augagagcuuuauuugucauaguuaagccaauaauaaccggcucaaaaaaguucacau

SEQ ID NO: 2115 - RNA, 56 nt, Ateline herpesvirus 3
ccucacugaaagaguagucaugucaaucuuuuuauggacugcuuuuacauuaaagg

SEQ ID NO: 2116 - RNA, 58 nt, Ateline herpesvirus 3
cuuuauaaacucuuuauucaaagcauguauuuugucccaauauguggaguuuauaagg

SEQ ID NO: 2117 - RNA, 61 nt, Ateline herpesvirus 3
gacugacauaaaacaacuaucuuuuguguaaaauggggcauauaggucuuuuaugucaauc

SEQ ID NO: 2118 - RNA, 120 nt, Ateline herpesvirus 3
gagauaguaacuuuaaagaccucauguucaucuggaucauaccuggauaagauuuucuuuuuaacuaauucugucugguaagagcaucgugggcccaauuucucguuuaaagccuguuuc

SEQ ID NO: 2119 - RNA, 77 nt, Ateline herpesvirus 3
gugucuguuauauguauaaaaauugcccaguugaaauaaauauguuuuuucucucaaagaugcuucgguggccgcac

SEQ ID NO: 2120 - RNA, 64 nt, Ateline herpesvirus 3
uggccuggcaacuggaguggcaggaggugcuauuucuucguuguugcuuauugagaacaggcca

SEQ ID NO: 2121 - RNA, 96 nt, Ateline herpesvirus 3
ugugucggguguuccaacuugccaaaagacacaagaaauuugaauuauuaaaucuccuucauuuuuggcacauggaaauccuuuuucgccuauaca

SEQ ID NO: 2122 - RNA, 102 nt, Ectromelia virus
acugucgaguacuaaaaggaaacaauaauguagugugauuuuauccuacuuagauuuuauauuuuaauaguguuuauaagauuuuuuagauauguggacagu

SEQ ID NO: 2123 - RNA, 53 nt, Ectromelia virus
gguauaggauguugauuagaugaaugcauaugcacauaacagcguucuuugcc

SEQ ID NO: 2124 - RNA, 75 nt, Ectromelia virus
guagcuauauaauguaugguaacaugauaaucauauuauaucaagaucauaauuaauuacauuuagauaguuuac

SEQ ID NO: 2125 - RNA, 89 nt, Ectromelia virus
uaguuauuguagcauuuauacuauuaaugaacaaaacugugagaauuauagcucucaugguguuguuuguuauuugacuacggucacug

SEQ ID NO: 2126 - RNA, 60 nt, Ectromelia virus
ucaaguauuauaucuuaauuaguguuaaaauacauucuaauacgguccuguaguaucuga

SEQ ID NO: 2127 - RNA, 121 nt, Ectromelia virus
ucauauagauaauauuauccaugacagccacugcgaaacuacaccuauauccacgugaagauaucauuucccauguauuuuuuuuacgauuguagcaguuuauggaaaucuuaucacguga

SEQ ID NO: 2128 - RNA, 68 nt, Ectromelia virus
uccuuuuugguauacaaucucgacaaucuucagucugugaagaaucaguagcgcaauaccaaccagga

SEQ ID NO: 2129 - RNA, 75 nt, Ectromelia virus
ugagagaguacugguuucauguuucuacuaaagaaggcaaacucguuauuuuuuuuaugaacuuguacucuuuca

SEQ ID NO: 2130 - RNA, 86 nt, Ectromelia virus
uggggauugugguauauguaugagguaggcagcguucacauuuuguguuaucacugccacuacaucugaccuuggcaaauucucca

SEQ ID NO: 2131 - RNA, 64 nt, Ectromelia virus
uucagcaguggauccguuagcuccauaauacaauauugucaauacugacgagauugacgcugaa

SEQ ID NO: 2132 - RNA, 97 nt, Rana tigrina ranavirus
aaguggaccgggaggaccgaggaagagucuuuccugaucucugacaugaugggucagaucaagacagguuggauuagaucugggcccccguccucuu

SEQ ID NO: 2133 - RNA, 73 nt, Rana tigrina ranavirus
aggucccugacugccgaggagcaggccgaggagagggcggccauggccuuggacccuucggcgaugggggccu

SEQ ID NO: 2134 - RNA, 98 nt, Rana tigrina ranavirus
agugagauacuuucugagagauaauacaucuuacuccacauuuuuacucuccuaaaccauuauagugagauacuuucugagagauaauacaucuuacu

SEQ ID NO: 2135 - RNA, 65 nt, Rana tigrina ranavirus
cuauggguccccucccuccgucugucacguagaaaccgaggacagugcccauuggguucuuguag

SEQ ID NO: 2136 - RNA, 106 nt, Rana tigrina ranavirus
gacaaugauccugucagauucagggucgcagacaaaccuguccacuggcguaaacaugccugcgguagagucgucucugacauuguagucugaaggaucuauaguc

SEQ ID NO: 2137 - RNA, 76 nt, Rana tigrina ranavirus
gccugagggccauggucaaggcgucuggaaacuggccauccacuuuggccacagccgccgucgccauccccgaggc

SEQ ID NO: 2138 - RNA, 64 nt, Rana tigrina ranavirus
gcuuuggugucccagacgccagcuggcuuacugcucucaccggcgauuggcccgacgccaaggu

SEQ ID NO: 2139 - RNA, 54 nt, Rana tigrina ranavirus
guaaacggccucccuguucuuggaaugcuuccucagaacucccaggucguccac

SEQ ID NO: 2140 - RNA, 68 nt, Rana tigrina ranavirus
guggacuuguccugaaacuuucugagagauuagacaacauuuauagaaugucuugagauauaguacac

SEQ ID NO: 2141 - RNA, 69 nt, Monkeypox virus
gaauuuuguguuggugcaagacuuaagauauuuauuuauagucuguguaucaauucugacacaugauuc

SEQ ID NO: 2142 - RNA, 72 nt, Monkeypox virus
ggucguguagcgcgauagagauagucuaauauuaauauuagauauuagauaucagauauccguaacacuacc

SEQ ID NO: 2143 - RNA, 54 nt, Monkeypox virus
gucgagguagucucaucaccagguuuauacaccuugaugaaucuacaugcguac

SEQ ID NO: 2144 - RNA, 93 nt, Monkeypox virus
gugauucauuuggcauaguacguacuauaucaucgaacuguauaacggugcaucuuguaaauagccuguauauauuauguaauaugguguuac

SEQ ID NO: 2145 - RNA, 75 nt, Monkeypox virus
ugagagaguacugguuucauguuucuacuaaagaaugcaaacucguuauuuuuuuuaugaacuuguacucuuuca

SEQ ID NO: 2146 - RNA, 62 nt, Monkeypox virus
uguuacugaauuuaauauauguaugagaugauccaagacguguuuguugaguaucggugaua

SEQ ID NO: 2147 - RNA, 60 nt, Camelpox virus
aauagguaauauauaucuuuugccguaucuauuauaccugauauaagcgauauaccuauu

SEQ ID NO: 2148 - RNA, 57 nt, Camelpox virus
aauguugcugcuaaaccacaugucaaucuaauaacuggauguuuggauaguagcguu

SEQ ID NO: 2149 - RNA, 87 nt, Camelpox virus
acuauacuuugguagguggauacgauauauuauaaagaucguaaauugucaacauguauaauauuucauauaauuucugaagguagu

SEQ ID NO: 2150 - RNA, 118 nt, Parsnip yellow fleck virus
cauaggacaaacggcagugaaaugugaugaucuugggcaggacuugucgaaaggcuuuucuccuaccuauaaccagaucauacagaugaagaccaacaacuguuuuauagugccuaug

SEQ ID NO: 2151 - RNA, 119 nt, Camelpox virus
cgaauguauaaggagguugcugcaacacuuuagauucuauccauaugucucuauauucuauaugaauauaugacuuacauggaucauagucaggccagucgcuuuuccaaauaucuucg

SEQ ID NO: 2152 - RNA, 86 nt, Camelpox virus
ggauacauuuccauguaucuaucuaacucugauuucuuuucccauguuuguguagauacaucauuaguuaucggagacauguguuc

SEQ ID NO: 2153 - RNA, 68 nt, Parsnip yellow fleck virus
gguguugaguauuaugagccauugaauauguccacaagugaaggguauccuuugauacucaacaggcc

SEQ ID NO: 2154 - RNA, 105 nt, Parsnip yellow fleck virus
gucaaaacucuaugugaauucaaggauuauauuuacaggaugauaguuggggggauaacaccaacuucuucauaugugaaaguuucuggucuuacugguuuugac

SEQ ID NO: 2155 - RNA, 69 nt, Camelpox virus
uauaucgaagauagguagauauggaaguugauccaccaacgaucuuaucacauucuuaucuacgauaua

SEQ ID NO: 2156 - RNA, 115 nt, Parsnip yellow fleck virus
ucucccuagccauguagguuugcuuaaagaagccaccaagaaccauuuuucugcuuugacagggcaggaagaaauaaaggcuauuuuugaggagauugacaaugggaauggggga

SEQ ID NO: 2157 - RNA, 130 nt, Parsnip yellow fleck virus
ugauaccaggaagcacgaaucacaugagguucacauugcuaaauccuuugaauccggaugaaagaauaaugaaauauccagcaagaaugaaguacguggauuuccuuuguguuuguguugccgaggcccg

SEQ ID NO: 2158 - RNA, 67 nt, Parsnip yellow fleck virus
ugaugaggaaauaauggccaccacuuuugagccauuaaaagauagggcugagauuacuccuaccgca

SEQ ID NO: 2159 - RNA, 123 nt, Parsnip yellow fleck virus
ugucaaccaagcuaauagaggcuuccacuucaaucuuauccaaugcagcaacaagagcaauuucaacucuuuuugauguuaugauagggaaagugagggguguccuuucuucucugguagaca

SEQ ID NO: 2160 - RNA, 128 nt, Rabbit fibroma virus
agauggaauccccaccuagguguuauaaaacauauuauugguuaugauuucuggauaguuauuuuguaaacauguuuuacucuuuucaccggauuguguuuucuuaauacuuaaacaacauccguacu

SEQ ID NO: 2161 - RNA, 105 nt, Rabbit fibroma virus
gagguucaugacaaaauuccuacuguauuauguacgauggauuuuaacuagcacaugauucauuaguaucguacucguuuuucguagagacauguuauguaccuu

SEQ ID NO: 2162 - RNA, 113 nt, Rabbit fibroma virus
gauguguggcggagguugcgggucauuucacuuugugucauugucgucauucguucguuuggaacacacagauaguucacggggaacuuauucaucgucaaucgauacacguc

SEQ ID NO: 2163 - RNA, 65 nt, Rabbit fibroma virus
ggaacaucuuaaacugauaaucuguuagauuuucuaacacgguuauaauuacaccucgguguucc

SEQ ID NO: 2164 - RNA, 68 nt, Rabbit fibroma virus
uaccugaaaaagagugagugauuuauuaaagagacguguauccguuuuucuuucuucugguucuggua

SEQ ID NO: 2165 - RNA, 121 nt, Rabbit fibroma virus
ucguuuucauuuuguuuuguuuuuuauaucuugcccauuugaugaugaauuccaauauaacgucuuccuuagagacguuuaccucgucgucuuuaaguauguuauucaguucgaaauacga

SEQ ID NO: 2166 - RNA, 91 nt, Yaba-like disease virus
agaaucugaauaaguaacguuguuuauacccuuuacauauccaccuaacuuuguguaauauuuauaguuauuaguuauuucuuuuccuucu

SEQ ID NO: 2167 - RNA, 60 nt, Yaba-like disease virus
gaaacuauagcaguugccucuuuuugagaugcaaaucucacagagguucuucuaguguuc

SEQ ID NO: 2168 - RNA, 55 nt, Yaba-like disease virus
gagugugagauacccaaccauguuuugauagacuuucaacacaaucaacacauuc

SEQ ID NO: 2169 - RNA, 89 nt, Yaba-like disease virus
gcuauuaaaccuaauacaaauauaaaacaaauuauugauaguaaaauuauuauagugaugauguuuuguuguguguuauaguuaguugu

SEQ ID NO: 2170 - RNA, 87 nt, Monkeypox virus
auaguuuacaacacuuuaauucuuguguauuauaauaugagacacauuguucacauuucauagacacaacgaauuuguauuaauaau

SEQ ID NO: 2171 - RNA, 59 nt, Camelpox virus
caauguugcugcuaaaccacaugucaaucuaauaacuggauguuuggauaguagcguug

SEQ ID NO: 2172 - RNA, 100 nt, Monkeypox virus
gaggauaccuaucacagacaucggaugguauagauuuaguggauucugguucaccaggcgucgccauuuuuaguaguugcauaucacugauggguaccuc

SEQ ID NO: 2173 - RNA, 66 nt, Monkeypox virus
gauaucgggcgaacuguuuagauaauuaucuucuucuuuuauuauaauagcacuuacguuuuuauc

SEQ ID NO: 2174 - RNA, 89 nt, Monkeypox virus
gcgauaucuaacagauuaccaucuauauuaacacuugcuauuucucuacccucugaagucaaugccuuugcuaaucuguuuauagacgc

SEQ ID NO: 2175 - RNA, 69 nt, Monkeypox virus
ggauauguacaaauagucgauuauaucuuuuacaauacuauuagucccuauuguguuaucuauauaucc

SEQ ID NO: 2176 - RNA, 89 nt, Monkeypox virus
gugucggaugaacuaguuccuguuagcauuagcaaaauuucuucagaaguaucguuuacuaauguuauucuaaaacuagcaucugacac

SEQ ID NO: 2177 - RNA, 67 nt, Monkeypox virus
gugucugaaucguucgauuaacccaacucauccauuuucagaugaauagaguuaucgauucagacac

SEQ ID NO: 2178 - RNA, 73 nt, Monkeypox virus
uaccugauuacuaucacaucuuccguuacaacuuagacaagccuguaaaugauuauugugagauguaaaggua

SEQ ID NO: 2179 - RNA, 66 nt, Cowpox virus
ucuaauggaaguuuugauaggagauugucaucaguugauacauuguuuauuaucucaucuauuaga

SEQ ID NO: 2180 - RNA, 95 nt, Monkeypox virus
uuuuucuuaguacaaaagucaauguuuuaaaauauauggacgagaauuaauuugucuguauaaaaacuugugugaaauuauguacuagagaaaaa

SEQ ID NO: 2181 - RNA, 81 nt, Yaba-like disease virus
gcaguauuuguuaacuuuguuuaacgaaaugaucaugguagaaauauuaggucuguuaauuauaaguucguuaaaaauugc

SEQ ID NO: 2182 - RNA, 97 nt, Yaba-like disease virus
uaggcacguuuggguaacuuuuuuuaaaaauauuaacgugcuguauuacaucuuguauguaaacguuaaaagaaguuacacuuagccguuuucccug

SEQ ID NO: 2183 - RNA, 87 nt, Yaba-like disease virus
uauuguaauuuuuuaauugauauggaguuacgccauauuuguuaacguuauuuauaucaacuccuucuucaaucaaaaaguuagaua

SEQ ID NO: 2184 - RNA, 112 nt, Yaba-like disease virus
uccaagaagaaauuaauaaucuaaccuuaacaccucuauuaauaguugcacaaauaaucucauuauaaauaucuggccaauacguuguuuuauuaucuucucuuauuauggg

SEQ ID NO: 2185 - RNA, 122 nt, Yaba-like disease virus
ugaucauuuuacaaacuuuuguugauacuaugcuuauuauaucauaaauuaaacguacauugcacccguaaaauucuucgcguaauaucuuuaguaauucguuaagauuuggucguugauca

SEQ ID NO: 2186 - RNA, 126 nt, Cowpox virus
aaauagauguuucguuguauauaguacgauaguuaauaucaauaacuccuuuggauaauagauaaucuaaagauucaacggcgucaaaaauuauuaaaugacgaacuauauguucauuaucuauuu

SEQ ID NO: 2187 - RNA, 109 nt, Cowpox virus
aaaugaguauuuuucuuuaacugguugacacgauccguguucuaaucgaagagguuggcauuccgcauuaggacacguaacaguaucauuccaagaaguauuuccauuu

SEQ ID NO: 2188 - RNA, 95 nt, Camelpox virus
ggauauuuuagcucugguauaucauauauccaagaauuuguacauguauuguacgcuauaaccuuugaacuucuauacggggacugaucauaucc

SEQ ID NO: 2189 - RNA, 75 nt, Cowpox virus
ugagagaguacugguuucauguuucuacuaaagaaggcaaacucguuauuauuuuuaugaacuuguacucuuuca

SEQ ID NO: 2190 - RNA, 79 nt, Cowpox virus
uugucuauaugauacacaaauuguuaguuauuguauauaguuaccuuacccuaauuguuuagucauugucuauaguuaa

SEQ ID NO: 2191 - RNA, 72 nt, Cowpox virus
uuugauucuacauauuucaauguguggaaaucuaguccacuugccucuugaucacaauauacagaaaucaaa

SEQ ID NO: 2192 - RNA, 124 nt, Cowpox virus
uuuuuuuacgauuguagcaguuuauggaaaucuuaucaugcgaauuacuuauaccgauagauaucaacucgaugcuaugguaucuaggaaaugauucauccaagaaugcuauauuguuuaagaa

SEQ ID NO: 2193 - RNA, 85 nt, Myxoma virus
accgauccaacgugucuugccugacgacuuguauaucauacucguuuuauaucucgucguugguauaaaaaaauggauacgcggu

SEQ ID NO: 2194 - RNA, 68 nt, Myxoma virus
cggcgcggcuuuuccaaugcugaagauaguccauuguggacaugucacguacgaauuuugccgcgucg

SEQ ID NO: 2195 - RNA, 119 nt, Myxoma virus
gacggagaguccuccuccgacgaucgugugguaaguacuuccgaucacgaaaccgguuagaaacgauucgucguuuucgucguacucguauuccucgcuaagaucgucgggcugcuccg

SEQ ID NO: 2196 - RNA, 55 nt, Myxoma virus
gaucgccuauggcgcguuuacguauguacgucacgcguuuacuccauaggguguc

SEQ ID NO: 2197 - RNA, 68 nt, Myxoma virus
gauuccgacucguacgccgagucaggagacucguauucagaaucaccugguucguaguagucagaauc

SEQ ID NO: 2198 - RNA, 64 nt, Myxoma virus
guugucgcuuucguuguagacguaucggaacguccauaguccgauaucucgacacgcgcacgac

SEQ ID NO: 2199 - RNA, 76 nt, Myxoma virus
ucgggcgagguaaagucuccauuaaacagacgauagaaguaauccgagugaagagauaaaauaacuuuaugcccga

SEQ ID NO: 2200 - RNA, 87 nt, Myxoma virus
ucguccguacacggaaacagucgaucgcaguaaucgacguaauccguuuucuuaucguucagucgauguauuccguuaaaucgauga

SEQ ID NO: 2201 - RNA, 71 nt, Ectromelia virus
aacagauuaccaucuauauuaacacuugcuauuucucuacccucugaagucaaugccuuugcuaaucuguu

SEQ ID NO: 2202 - RNA, 70 nt, Ectromelia virus
accuauaauguauauguauugaucgaauacacacaugccguagcucgauauugcaucgggcauaucaggu

SEQ ID NO: 2203 - RNA, 55 nt, Ectromelia virus
cgcaguugaucuaaccuguugguuaauagccuguugaccaguuaguaacauugcg

SEQ ID NO: 2204 - RNA, 72 nt, Ectromelia virus
gaugacugucguuagauguauaguuggcuauccauaagucaccguuuuuaacacgucuauuaagaggucguc

SEQ ID NO: 2205 - RNA, 90 nt, Ectromelia virus
guacuuauuaaucauuugacucugccaaauaauaggucuauuguucguaagaacauaaucuauuauaugguuagucagugagcauaugac

SEQ ID NO: 2206 - RNA, 89 nt, Ectromelia virus
gugucggaugaacuagucccuguuagcauuagaacaauuucuucagaacuaucguuuacuaauguuauucuaaaacuagcaucugauac

SEQ ID NO: 2207 - RNA, 124 nt, Equine herpesvirus 2
acagauuaccgacccauaaaguuuuuaauuaugccacucuuuacagugugaaaucaugcagaacuaaucacacaugauuucacacuguaaagaaugggguaacuuucuaggguuguuaagcugu

SEQ ID NO: 2208 - RNA, 130 nt, Equine herpesvirus 2
cacccgcuugcgcaguuaagagguagugguguuaauccauaaauaaauuauguaaacaguaguagugggugaguaguguuuuagagguuauuuacauuagugucaggugagguaugugagucgauuggug

SEQ ID NO: 2209 - RNA, 59 nt, Equine herpesvirus 2
ggggggugcaguacuauuacucuuuacuuuguuguuguuugaggaguauugcacaaccc

SEQ ID NO: 2210 - RNA, 83 nt, Equine herpesvirus 2
gguaggauuaguggggggugcaguacuauuacuuauuaugcuauuauuuaguuaguauugcacaacccucaucuuuuuaggcc

SEQ ID NO: 2211 - RNA, 83 nt, Equine herpesvirus 2
guuaaaagaaauagcaagucagauauugccaaguuuaacaguaacauguuagugagguuuuugaucuucauguaucuuaugac

SEQ ID NO: 2212 - RNA, 114 nt, Equine herpesvirus 2
uuaacaacauuaggaacgaaaagauuuaagucugcaaggauacuacaaauuaauuguggugaccuuuuguaguauccuugcacaguuuauucuuuuuguucuuaaugauguuaa

SEQ ID NO: 2213 - RNA, 60 nt, Equine herpesvirus 2
uuguguguuguguuuggggugauagacacauuguauauuccaaaaacacauuccacacaa

SEQ ID NO: 2214 - RNA, 85 nt, Equine herpesvirus 2
uuuugucucuuacauuaguuacuucaauauagacuuacuucaaauccugaaaaguaccucuaagaauaauuccuaaaagacaaga

SEQ ID NO: 2215 - RNA, 106 nt, Potato aucuba mosaic virus
gaaucgcuaggcgcaaaccacuuguuuaucauuuccaagaagaaucugaucacuccaaagauuagauccuuuaagaaagauagucaugugcuuuugccucagauuu

SEQ ID NO: 2216 - RNA, 72 nt, Potato aucuba mosaic virus
guggagccugagaaggugucugaaauaugcuaacuguagaaguguagcuauugcuagacauuuggguaccac

SEQ ID NO: 2217 - RNA, 81 nt, Potato aucuba mosaic virus
uuguaugauccugaugaacuaacucacauugcgaacuacuucuauguaguaucccaucugaguugugucaaugaucaucaa

SEQ ID NO: 2218 - RNA, 116 nt, porcine epidemic diarrhea virus
aaaauuaacagcauccuccacauaacuuggugcuuugaacuguaaggugcaagugaugcaacacuuaucaccucucacuacgcagcuguaaguuuuauaaggaguguuguaauuuu

SEQ ID NO: 2219 - RNA, 67 nt, porcine epidemic diarrhea virus
acccaaccaaccucuaacauugcgcauggcaaagucgcgugugcaaaagagaguguggugguugggu

SEQ ID NO: 2220 - RNA, 81 nt, porcine epidemic diarrhea virus
agaugcuuaacccaauccaaaagcacauaaaacaccuucuuauauucaggguuuucaugcuuagauaacggguaggcaucu

SEQ ID NO: 2221 - RNA, 60 nt, porcine epidemic diarrhea virus
cgagggcuaaaaucagcgguuguucuaccuuggguaaaauagccaucaggauaguccucg

SEQ ID NO: 2222 - RNA, 125 nt, porcine epidemic diarrhea virus
cucauaacauuugcgaaccauuggaccaacucuaccagcacuaaaaaguuccauugcagggucaucaacgaugccaagcaauuguagcugcaccaagguagaaguaacccaacaauuguuaugag

SEQ ID NO: 2223 - RNA, 80 nt, porcine epidemic diarrhea virus
gaccuauuguugccauugccacgacuccugcuacgcgaauuugcacgugaagcaggagguguguuagguucaacaaucuc

SEQ ID NO: 2224 - RNA, 58 nt, porcine epidemic diarrhea virus
gcaacagcagcauuaaagguauccaaugguacaucaucaaaacccaaugugcucuugc

SEQ ID NO: 2225 - RNA, 112 nt, porcine epidemic diarrhea virus
gccaucauuguccuugauaucaauuauauuccaaaugguaccagcguaguggacacaucccucacgcuggauacgauuauaagaaucgauaucagagguaacaauguuaagc

SEQ ID NO: 2226 - RNA, 79 nt, porcine epidemic diarrhea virus
gcuagcucacgaacagccacauuaccaccaaagagcaaugcugcaacauuuggugcuaaacuggcgaucugagcauagc

SEQ ID NO: 2227 - RNA, 122 nt, porcine epidemic diarrhea virus
gcuuagagccuaagaucauggcugaaaucaugcguaucauauugggcagugcucuaucgcacuuuggguaaucccaacccauaagacacggauuuucaacaccaucaauaagguucuuaagc

SEQ ID NO: 2228 - RNA, 104 nt, porcine epidemic diarrhea virus
gcuugcaaaaaucccacauuguauuaagaccagugauaaaagaccgccauaugcuaccaccaucaaucucuucaagcacugcuggacacugugggauuguaggc

SEQ ID NO: 2229 - RNA, 94 nt, porcine epidemic diarrhea virus
ggcuugaaguuguggauaaaaugucuggaguuuaugauccuuacaccacaacauccaccuccacauuuuacaaucaaccauaacuucaugaacc

SEQ ID NO: 2230 - RNA, 70 nt, porcine epidemic diarrhea virus
guaagcauagaguuaacuucaacagacucaagccuagcgcugaguuguaaugcugacucuauggucuuac

SEQ ID NO: 2231 - RNA, 120 nt, porcine epidemic diarrhea virus
uccaacuaugccaucuccuucugccuuaauggagcgcugcuucagcuuaccaggaauaaucucauuauucuggagcuuaacaauacgcucacacccaaggaccaggggccaugacaggga

SEQ ID NO: 2232 - RNA, 104 nt, porcine epidemic diarrhea virus
ugcccuugguauaaacaucaauggccuuugcuaugccgccaccaugagacaacuucucauuugcagcauuaacaacaaagucacauggaaguuuaacaagguca

SEQ ID NO: 2233 - RNA, 102 nt, Transmissible gastroenteritis virus
acauucaacuuuugugacuucuugaugagaucuaucaguggcguaaacaguuuguuuaacacuauuacugagaucacguacaauuucgucacagaugaaugu

SEQ ID NO: 2234 - RNA, 59 nt, Transmissible gastroenteritis virus
caaucaauuuagcacuaagaaucauagcgucauaugcguucuuaggugcagaaagguug

SEQ ID NO: 2235 - RNA, 98 nt, Transmissible gastroenteritis virus
cauuguugacagccauuucaaauguagaaaaugaaacauuaagauugcaagcccuguaacauucgucaagauuuuugcauucugagacaucaacauug

SEQ ID NO: 2236 - RNA, 99 nt, Transmissible gastroenteritis virus
cuaucauuauguguacaacaaccaacaugcuuagaaccuaauaucauggcagaagccauucuaaucauauuagguaaagcacggucacacuuaggauag

SEQ ID NO: 2237 - RNA, 68 nt, Transmissible gastroenteritis virus
guaacauugacagggauagaacaagagaagaaauucucaauaguuugccucuccuggucaguguauac

SEQ ID NO: 2238 - RNA, 89 nt, Transmissible gastroenteritis virus
gugaagucucacacuagacauuucauuuucauaguugauaacacgugugguaucacuagcaauaacaugucuagggcaaaugacuucau

SEQ ID NO: 2239 - RNA, 79 nt, Transmissible gastroenteritis virus
guucaagaacaccaguuacaauuucauugucaaauucgaauucaaguuuaacacguguaacaggugcaauuucuugaac

SEQ ID NO: 2240 - RNA, 79 nt, Transmissible gastroenteritis virus
ugcagucauaauaggguagaagaaagauuuuacuuuaccagccugaagauuuacaccauacauuugccuuaugacuuca

SEQ ID NO: 2241 - RNA, 75 nt, Transmissible gastroenteritis virus
uggacauaucaaguuucuuaagcauaccaaaaaguaggcuaugcauagcagaaacaaucuuugacuuucugucca

SEQ ID NO: 2242 - RNA, 74 nt, Oat chlorotic stunt virus
aguuuugucagugcaggccgguguuugaugguguuaaauacaccaugugccggaacccccgcacugccauugcu

SEQ ID NO: 2243 - RNA, 93 nt, Oat chlorotic stunt virus
cuguuaguaccuuuucuucccucgaccgcuccgaugucacaucagcaauuuguugauagcacgccgagccgcaagaggaagguguaccaacag

SEQ ID NO: 2244 - RNA, 61 nt, Oat chlorotic stunt virus
cuucucagaaggcuuguuugaaugguuccuagaaaugggauucaacauggccaucgaggag

SEQ ID NO: 2245 - RNA, 125 nt, Alcelaphine herpesvirus 1
aaccaugcguuuuuuugacucaguagcucaaucgagaaaggcacuccucaccgguuguaauauauuuuuccugugggucuaguguccuuccgagagcuccugaguucauauucaucagcaugguu

SEQ ID NO: 2246 - RNA, 81 nt, Alcelaphine herpesvirus 1
aguugcuuguuggaaaagcuauguuucaaauacguuuguaauuaaauaauguauuugaaaauagcuuuuccgcaagagacu

SEQ ID NO: 2247 - RNA, 69 nt, Alcelaphine herpesvirus 1
caguauaacagcaggccaacugccacugguucacaggugcgcagcuucacuggcugguugcuuauauug

SEQ ID NO: 2248 - RNA, 64 nt, Alcelaphine herpesvirus 1
ccagugguugccauaccaguaaaaguccaccauuugugagauaguauugugcgguuccauuugg

SEQ ID NO: 2249 - RNA, 81 nt, Alcelaphine herpesvirus 1
cucauaguaagguagcuuguguguugugucuguggacauaaagaagaauagacacagcccgacaagcuauuuuaaaaugag

SEQ ID NO: 2250 - RNA, 70 nt, Alcelaphine herpesvirus 1
gacacucaauaucaaaugagagaauguuguauuguggccagucuagucucucagcaugguauugaauguc

SEQ ID NO: 2251 - RNA, 52 nt, Alcelaphine herpesvirus 1
gauaguuugggggaggccuuuguuuuacauauaauggcucagccaaacuauc

SEQ ID NO: 2252 - RNA, 84 nt, Alcelaphine herpesvirus 1
gcagauuuuguugugucaguuacagcaggaauuguuaauuaaaaaaaaacauuccgggcuuuaacugacaagcauaagaucugc

SEQ ID NO: 2253 - RNA, 81 nt, Alcelaphine herpesvirus 1
ggcaaacucauauuaguuacauugacugguaauaauguaauuguauuguuaccaguuuuuguaccaguacgagucaaugcc

SEQ ID NO: 2254 - RNA, 88 nt, Alcelaphine herpesvirus 1
ggcgcacgcauguugagcaccaucaguaguuauguguugguguuaggaauacaauaacugcugacagugcaaguaugcgugaaaagcc

SEQ ID NO: 2255 - RNA, 131 nt, Alcelaphine herpesvirus 1
gggugggaaaaugugaaagcgugcgaacugagggaaaagugguugguuaagguggcuuuuugaaaguuuuccugcccccugcccccacagugccucuguuaaacccuugcaguguuucauggguccugcuu

SEQ ID NO: 2256 - RNA, 131 nt, Alcelaphine herpesvirus 1
guaccucaagcuggaugugaccauguugcgucuauuauguuggcaccuggguuauuacauguauauaagugauuccauguaauagcacugugugcuacaugaaauucgcacacuugcuucuagagagguau

SEQ ID NO: 2257 - RNA, 87 nt, Alcelaphine herpesvirus 1
gugggauauguguuaaagcaggcuaucucucaccugcauuuggaaggcaaugcaagugcaaguggccugccucaacacaaaacucac

SEQ ID NO: 2258 - RNA, 94 nt, Alcelaphine herpesvirus 1
guucucguggcagaucucaacagcugugguagugagcaauauuucauuguugacacccaauuggcccuuguagagguggcugucauugaugaac

SEQ ID NO: 2259 - RNA, 78 nt, Alcelaphine herpesvirus 1
guucuguguaagauagauuggguuaggaucugugugugguaaaacggagauccuugcucaaucugucuugugcagaau

SEQ ID NO: 2260 - RNA, 107 nt, Alcelaphine herpesvirus 1
guuuucccgccaguugaaaaaauguuaggaccacuacccucucuuuuuagaaguuguugguuguuauccaaguuuauuuuuuuuacuggucauuuuuaagggacugc

SEQ ID NO: 2261 - RNA, 81 nt, Alcelaphine herpesvirus 1
uauguagucuguagacagacagugagcgggugcgggaguuuaaggagcgcaauccacucccugucugucacuagacacgua

SEQ ID NO: 2262 - RNA, 69 nt, Alcelaphine herpesvirus 1
uccuaaucagacggcuugugcauaagcuuuuuauuaauuuuaagcuuaugcacggcuaccugguaggga

SEQ ID NO: 2263 - RNA, 83 nt, Alcelaphine herpesvirus 1
ugcucaucucgugcuaagagcucuuggcgaaggcucuguguacuaaaaagaucuuugccaaguacucugguaggagacuggca

SEQ ID NO: 2264 - RNA, 112 nt, Alcelaphine herpesvirus 1
uguuuugagugggccugcucauucacggugcaguaacugauauagaaguaauaaaugucuucuauaacggaacaccugcaucggcaugcgcacugcccauggaucaccuaca

SEQ ID NO: 2265 - RNA, 131 nt, Alcelaphine herpesvirus 1
uuacccaaaacccaccagguagcuuuaugcauguagacaacuucuugagauucuuaucugagaguauacgagaaaaaaaaugucuuucagcgagcaaaaagugagcauuggcaauauggguuccaggggcg

SEQ ID NO: 2266 - RNA, 77 nt, Alcelaphine herpesvirus 1
uucguguuaggcuagucuggacaaaacacuguuuuacauuaaaaaaggacuguuuuguacaggcuaccuagcaagag

SEQ ID NO: 2267 - RNA, 131 nt, Murine hepatitis virus
agaauugcauuccuuuuguuucucuuucuucgucaaauugggccacagugcagugcggaauccagugucuggauugaucugccgugcaaccccuucugcggagaauuucaacaauaucuucaugcaacucu

SEQ ID NO: 2268 - RNA, 58 nt, Murine hepatitis virus
aguagcaccgguuguguagccagagaucugacucucugacaacacaggagguaauacu

SEQ ID NO: 2269 - RNA, 92 nt, Murine hepatitis virus
auguccccaggccuugugaaacuucaacggucucagugcuaaugcuuggagcacuaacauuagcaccguuugaauucacaagcuggauacau

SEQ ID NO: 2270 - RNA, 91 nt, Murine hepatitis virus
caaaucaacacauacaacccuucauucuacacacgguacgaaaauagaugcuauuaucgugcacaugucugaagaaguagguguuucuuug

SEQ ID NO: 2271 - RNA, 60 nt, Murine hepatitis virus
gacaguauugcagaguuggaggcauacucaguugccguacccgccugcaaucucacuguc

SEQ ID NO: 2272 - RNA, 83 nt, Murine hepatitis virus
gcagacaguccauauuagccugcacaaagacacgagcaucaucauccaauuguauaucaugucgcagcgcuucaacuuccugc

SEQ ID NO: 2273 - RNA, 107 nt, Murine hepatitis virus
ggauaauagacuugggcacgcucuuaacuaguuuguccacaaagcauuggucauagccggccuuguaagacaaccagagcuuuugcaucuccaagucuuuaaauucc

SEQ ID NO: 2274 - RNA, 68 nt, Murine hepatitis virus
guuaaaguauugucuuugcaaauggaggcgggcuuugcauuaccuccauaggcauaagacacauuaac

SEQ ID NO: 2275 - RNA, 87 nt, Murine hepatitis virus
guuuguaagagcuaaaucagccauacguuccagcuuacgagcaacagcucugucgcgcucauaugcugacuuagcaauauuacacgc

SEQ ID NO: 2276 - RNA, 67 nt, Murine hepatitis virus
ucuuuauauauucuaaauauacccggaacacauuuugauacucuggguucucaugguauacuaaagg

SEQ ID NO: 2277 - RNA, 76 nt, Murine hepatitis virus
ugauaaugccucauaauagagccuggccuuuccaaauuuauuaaauggauagccagcacucuuaucauaauuauua

SEQ ID NO: 2278 - RNA, 94 nt, Murine hepatitis virus
ugguacguuaaauugggugcaaugcacaaguuuacuaccgcacguacaugcgauauuauaaccccugacaagaucaccuuuauccaacguacca

SEQ ID NO: 2279 - RNA, 119 nt, Murine hepatitis virus
uuagcaaaaauuuggcagcgaucauuaacaaggcagguaucaugugaccauccaauaaaugaauuguuggcacagauacaacccuuauguggaucagcauugccacaauuaucuucuaa

SEQ ID NO: 2280 - RNA, 121 nt, Murine hepatitis virus
uuggucucccucacccguauaauuguaaaaaucagugaagugaaaacuccuaaagagagaguuaccacucuuugcggaaaucuuuccugaauuacacaacuuugggucgaggucaagccaa

SEQ ID NO: 2281 - RNA, 83 nt, Ectromelia virus
aaauuuagaaauauacagacucuaucgcgugucuauaucuucuuuuuauauccaauguauuuaugucugauuuuucuucauuu

SEQ ID NO: 2282 - RNA, 59 nt, Ectromelia virus
aagucaugcuauuguaggaauuuuuuuucacaguugcucaaaaacgaugguagugacuu

SEQ ID NO: 2283 - RNA, 51 nt, Ectromelia virus
aucccaacaaugcuauagcauugcgcauagcauuagucauaaacuugggau

SEQ ID NO: 2284 - RNA, 130 nt, Ectromelia virus
cgcagcauauuccuaaauacaucuaaauuuuuacuauuauacuuggcauaaagauauagauaauacucgucugauauaauuuuguccauuguaguauaaaaauuaauauuucuauuucuguauauuugcg

SEQ ID NO: 2285 - RNA, 61 nt, Ectromelia virus
gaauguucgcggaguauagccuauuauuuucuaaauaacaaacuguuuucuuuauauauuc

SEQ ID NO: 2286 - RNA, 57 nt, Ectromelia virus
ggaaguggauauacauaguugugaucaucauuaucgcuagccuuauccucuauaucc

SEQ ID NO: 2287 - RNA, 95 nt, Ectromelia virus
ggacguucucguacaggacguaacuauaaauugguuuauauuuguucaagauagauacaaauccgauaacuuuuuugacgaauucuacgggaucc

SEQ ID NO: 2288 - RNA, 63 nt, Ectromelia virus
gguggaacguauauuuuauuuaaggacuuaacaauugucuguaaaccacaauuugcguccgcc

SEQ ID NO: 2289 - RNA, 65 nt, Ectromelia virus
uauuuaugucauaaacuguaaaugauucuguagaugcugcaauaucaucacacaugauauuuaug

SEQ ID NO: 2290 - RNA, 83 nt, Ectromelia virus
ucauuuguacacuguuucauauuuuuuaauagucuacaucuuuuaguaggacuaguaucguauaauucauagcuguauuuuga

SEQ ID NO: 2291 - RNA, 83 nt, Camelpox virus
uguuggccgggcggagccgaacauucuccaauauucaauuuuuguauaucuauaauguuauuaaccuccgcauacgcauuaca

SEQ ID NO: 2292 - RNA, 61 nt, Ectromelia virus
uuaacuucgcaauaauuucugguuagauaacgcacucuaccagucaagucaaugauauuag

SEQ ID NO: 2293 - RNA, 108 nt, lumpy skin disease virus
auuagauguagugaaugguucagucguggugguaucauccgaauaauaacuaaaugcaguaguaaaugauucggucauauuaucaucugaauaauaacuauauguagu

SEQ ID NO: 2294 - RNA, 55 nt, Goatpox virus
cuauuguuucauaaucacuagaugaauaccuucuaagugauuguuuuuuuaaugg

SEQ ID NO: 2295 - RNA, 85 nt, lumpy skin disease virus
ggaaguugauucagaguaugauaauguaucgacguaaauauuauuuaauguuucuucuauuuccauuuuaacuuucucagcuuuc

SEQ ID NO: 2296 - RNA, 80 nt, lumpy skin disease virus
guaucaaaguauuuagaugaauuugauaaaauuauuuuaugaccuuuaauuuuaaucacaucauuaaaacauauugauac

SEQ ID NO: 2297 - RNA, 99 nt, lumpy skin disease virus
uggcuuauacacaacaaacauaugaaagauuacucuaauaucccucaacgacauacaguuaaagauauugucuuuuauuucuucagguaauauauccca

SEQ ID NO: 2298 - RNA, 82 nt, lumpy skin disease virus
uuauuuucuucuucugugcaucucuuuauugauauuccgcuuacacuacuaguaaaaaugaauaguugcaaaaagaaaauga

SEQ ID NO: 2299 - RNA, 96 nt, lumpy skin disease virus
uuggaaauauaagagguggagcaucuucccauuuugaugauguuaaaucccaaaaacuaacaucugauacaacggauccauuuuuuauuccuccaa

SEQ ID NO: 2300 - RNA, 67 nt, lumpy skin disease virus
uuguaaaaugaacgggaaaaaagucucuuuuaacccgaacuuguuauuuccugugcuuauuuuucaa

SEQ ID NO: 2301 - RNA, 127 nt, lumpy skin disease virus
uuuuaaaccguuuaacuuauaacaauuuuuauuucuauaucuagagagacgcacaauggauuggucgcaaucauugucucguuuucuaguaauaguacauagauauuuacuguuuaacguauuaaga

SEQ ID NO: 2302 - RNA, 104 nt, Rana tigrina ranavirus
cacucugcgucguugucccugcaccacucuauccucuuuuccagguccgacaagucuccccucacggggauguagugcguccagggcuucaggacgcucgagug

SEQ ID NO: 2303 - RNA, 97 nt, Rana tigrina ranavirus
ccacaggcaaaagcccacguugagccaagucugccugucgucggcgagguccgccgugagcauggcagugagcuccgucacccucuuuagccugugg

SEQ ID NO: 2304 - RNA, 69 nt, Rana tigrina ranavirus
ccagggccucuguccaguccccgaggcaagaagggucgaaccagcuggggaacucuccggggguccugg

SEQ ID NO: 2305 - RNA, 55 nt, Rana tigrina ranavirus
ccuaugacaacgagcuuaguuccgccuaggucggugucuaugcucuugucguugg

SEQ ID NO: 2306 - RNA, 55 nt, Rana tigrina ranavirus
cuaaaaauguugugauagaaucuuuagacuaagauuacaucucauucucuuuugg

SEQ ID NO: 2307 - RNA, 81 nt, Rana tigrina ranavirus
gaccagggugcccucggugaaacuguugggccucaucugguuguuccagaugguccagcacucguccucgucgcacuuguc

SEQ ID NO: 2308 - RNA, 62 nt, Rana tigrina ranavirus
gaggcugcaccagcagugacugcaccaacuguaccagcagugacugcaaaggcaccagccuu

SEQ ID NO: 2309 - RNA, 73 nt, Rana tigrina ranavirus
gccagaucguugaccugcucauccuugaugucagagacuuuuuuggccgucagggugggcgucauauccuggu

SEQ ID NO: 2310 - RNA, 86 nt, Rana tigrina ranavirus
uaauaauaucgagaugguaauaucuuaagauauuuagucugaaagagaaugucuaaagauauuucucuacaucucggauaauguua

SEQ ID NO: 2311 - RNA, 63 nt, Rana tigrina ranavirus
ugccaccagcccggucacugcgcucuccacucccaucguguugacaguaggcuuguuguggca

SEQ ID NO: 2312 - RNA, 87 nt, Rana tigrina ranavirus
ugggagacuuucugggagacuuucugggagacuuucugggagacuuucugggagacuuucugggagacuuucucccagcgccuccca

SEQ ID NO: 2313 - RNA, 89 nt, Rana tigrina ranavirus
uugucuugggaguaucucgcuguaaaaccuguugugugccauauuuccauauaacaggcaguaguuuuagaguaauuuacuccuugcaa

SEQ ID NO: 2314 - RNA, 117 nt, Rana tigrina ranavirus
uuuuuaggaugagaaugagguguaacgacaucuuaggauauuaucucugaaaggguauuuauucucucgauauuaucucagagucuuuaccaucucggaaacuuuuagaccuaaaaa

SEQ ID NO: 2315 - RNA, 77 nt, Equine herpesvirus 2
aaacacugcacaagaucucacagcacuggauugucacaggcacaacuacagugaggugagaucuugauucaguguuu

SEQ ID NO: 2316 - RNA, 116 nt, Equine herpesvirus 2
aauaggguugugagguaggcgguugccaggcagauuagguuaauguggggggugcgguacuauuacuuacuuacuuuguuauuguuggggguauacuauuacuuacuuacuuuguu

SEQ ID NO: 2317 - RNA, 131 nt, Equine herpesvirus 2
acgugugucgccuggugcgguguccacacgagcaguaauggucugaccaaagcuagguccucaagagcaccccagccuucagcagaucacuaccucgggugugacgguccgggcgcgccgguggcccaccu

SEQ ID NO: 2318 - RNA, 51 nt, Equine herpesvirus 2
acuugaggucaggccucuccccgggguccccgaggggcgugaagcccaggu

SEQ ID NO: 2319 - RNA, 81 nt, Equine herpesvirus 2
aguuggagauguuguagcccgucacaaacuccacguccgcgucccugaucauggugaaaaagagguagagcagguccagcu

SEQ ID NO: 2320 - RNA, 83 nt, Equine herpesvirus 2
ccaugcagcuguguaguugccuaggagcugguuuaacagaaacgccucuaggcuacuaacacagcacuugaaguccugugugg

SEQ ID NO: 2321 - RNA, 131 nt, Equine herpesvirus 2
cccccagacucucgaagauucuucaaaacaccggucuagaguucugggagaagcgaggggucucucaaaucgccagacucacuuccccuacggaacucaagcgggauuuugaaugagguuggagucggggg

SEQ ID NO: 2322 - RNA, 122 nt, Equine herpesvirus 2
cccccaucuuccaaguguucauaaggcgccgaugcgcugcuguagugaaauuuugcauuacauaaccagcauaauuucacuacagaacagcacgcggcgccucugcuggaggacgauggggg

SEQ ID NO: 2323 - RNA, 75 nt, Equine herpesvirus 2
ccccggguagaguucgcugcagagccaggguuuuuuuuuaccauccugguucuggcagagaacucugccacgggg

SEQ ID NO: 2324 - RNA, 55 nt, Equine herpesvirus 2
cguguccagcuuguaguuggacaggcucagcuugucccugcacaccugguacaug

SEQ ID NO: 2325 - RNA, 126 nt, Equine herpesvirus 2
cuagcacgagggguuggcauuugaaaacaccguccggagacuucugaaguauuaggaaucaauuacacgaaccuaaguacuagagaaaucuccgaagcgggguuuucuggugauccccuauccuag

SEQ ID NO: 2326 - RNA, 90 nt, Equine herpesvirus 2
cucucaacaccaucuugaguucucuagggaaacagguguuuuuuaaaucacaaucugugucccgggggaaccucaugcuggggucgagag

SEQ ID NO: 2327 - RNA, 54 nt, Equine herpesvirus 2
gacaguuuaagcacugaauguaucaaggggccucacucaguugccaaaacuauc

SEQ ID NO: 2328 - RNA, 83 nt, Equine herpesvirus 2
gacgcugcgaagcagugcauagagugccuggagaucccuccauuaccagaacucagacacucuaugcgcugucccacagcauc

SEQ ID NO: 2329 - RNA, 130 nt, Equine herpesvirus 2
gagagucugcucguggauuuugccaggcgccguuuaaagauccacgaggagcuagguguuuuagaaacaaaaccacguuccucguaaaccuuacacucggggcucuggcauucugcagacccuagaccuc

SEQ ID NO: 2330 - RNA, 54 nt, Equine herpesvirus 2
gauaguuuaagcaccuuuucaugaccuaggcagaauucaagugccuaaacuauc

SEQ ID NO: 2331 - RNA, 92 nt, Equine herpesvirus 2
gcaagaccucgagggggccgugcaaauagugccggugcuuuuaugagcuacacacaccuggcaucuaucuguacgguuacucgaggugucgc

SEQ ID NO: 2332 - RNA, 65 nt, Equine herpesvirus 2
gcacccucgcggccuuaucgcugucguucucaaacaggcacugcaggauguuggccgccccgugu

SEQ ID NO: 2333 - RNA, 85 nt, Equine herpesvirus 2
gcagacaccgugagagacucucuaagcuaguuagugauaaguauaucacaacuaacggcucagagggacucaugcgggaucuugc

SEQ ID NO: 2334 - RNA, 130 nt, Equine herpesvirus 2
gccauguuggugggugggcccuaugauguauuaguuggguggccaucuuggugggguggccaucuuggugggguggccaucuuggugggguggccaucuuaaugcacauccccuauuacucaauaagggu

SEQ ID NO: 2335 - RNA, 52 nt, Equine herpesvirus 2
gcccuuccuuacagcgaccacagaaaacucugacuccugagaggacagaggc

SEQ ID NO: 2336 - RNA, 69 nt, Equine herpesvirus 2
gccuguagguaagccccccauccucaccuuuuucagggccagggucuggcagcgucccccucagcaggc

SEQ ID NO: 2337 - RNA, 85 nt, Equine herpesvirus 2
ggcccccgggaagagcugcgagugguaggugcuuaggaaccucauguaggggccgcuuaccacgcagcugucccccuuggggguc

SEQ ID NO: 2338 - RNA, 123 nt, Equine herpesvirus 2
ggcgggguugggcaacacucgggcauuuauauagacuaagucccacauggccucugguuaauuaggcgggggccaauggggggccuguggguauuacucaaugcccaguggggucucucuggu

SEQ ID NO: 2339 - RNA, 84 nt, Equine herpesvirus 2
gggucuguaaagaggaagcgggcggggccgucccuucccccccagcggcccgcuggcaucuuccucuuuuuuuugacagcaccc

SEQ ID NO: 2340 - RNA, 94 nt, Equine herpesvirus 2
gguaaaggugugugagagcgagaguagagauucaccuuuauccccaaaaaagguaaaggugcuuauuucucucucuccuccacucugccagacc

SEQ ID NO: 2341 - RNA, 74 nt, Equine herpesvirus 2
ggugguccuaagagucugugaacuuaaauuauuuuuuauacaaaacuuaagugucacagacugcuuaagccauc

SEQ ID NO: 2342 - RNA, 118 nt, Equine herpesvirus 2
ggugucucuguugauagggcgagaugugguuuuaacagccugucaacuuaaauucuuucuuuaaacagacuuaagucuccagacugcauauuccaucucccguacgcaaggggcaacc

SEQ ID NO: 2343 - RNA, 88 nt, Equine herpesvirus 2
guugaauagaguguggucuuuucaagauuuucucuggcucugugccauuuucuuuuaaaaagggcgacaucucuauagugucaccaac

SEQ ID NO: 2344 - RNA, 110 nt, Equine herpesvirus 2
uacagacccugcagcgcuccagaugugacacagguagcccuggaucuccaggugauugagaggcuaagguaucggcuuucaaaaagcguuaacaagcaggagaagaugua

SEQ ID NO: 2345 - RNA, 130 nt, Equine herpesvirus 2
uagagcauucuaaugggggcagaguauaugcuccuggaccuggucauaaacagguacaccaccacuaccccggcuaugaugaggacuaugagcagcaugcccccaaagggauuuuugaaaaagcuuauca

SEQ ID NO: 2346 - RNA, 87 nt, Equine herpesvirus 2
ucaaaacacugugcaucgucaggguugauccaggugaguauggcuuacacacaacugacuccacucggacgauucacaggauuuuga

SEQ ID NO: 2347 - RNA, 79 nt, Equine herpesvirus 2
ucuauccuggcuaugggggccagggccaggcugaggacgcucucggcuauggccaucuuggccccggccucgggguaga

SEQ ID NO: 2348 - RNA, 58 nt, Equine herpesvirus 2
ucugugggauuggcgggguaggccauggcgggcccgcuggccacgucgcucccguaga

SEQ ID NO: 2349 - RNA, 83 nt, Equine herpesvirus 2
ugggacucgguguggaggagagggguaguuacgauuacuccaugacuaaucgcaaguccuccucuccucuacacagacgccca

SEQ ID NO: 2350 - RNA, 120 nt, Equine herpesvirus 2
uucuugcagcccaccguggggugccucaggauccccagcaggaccucccgggcguccgaggggggcccggcgucgcugcuguuguaggggacccuggagggcgcggugggccuguaggag

SEQ ID NO: 2351 - RNA, 77 nt, Rat cytomegalovirus
agacggcucgaccuucugggucucggauucgagagaaacuuaaccucucuccagacacgguauuuuugaaccgaucu

SEQ ID NO: 2352 - RNA, 113 nt, Rat cytomegalovirus
agccggucacuaauacuuuuucuggacgaauaagguccgguacauacgugucugggaccgagaucgucacggcacccgagaccguauuuacccagaaacacgcuaacaccgcu

SEQ ID NO: 2353 - RNA, 55 nt, Rat cytomegalovirus
aucguaauugucuucgauaaauuacuagggcuguuauuauaagcgcaauuacgau

SEQ ID NO: 2354 - RNA, 101 nt, Rat cytomegalovirus
ccgagaaggaccguagaauugaucaucgaguaguuucguacgagaauguaacccgcguacuuguuacaucuacaucgguuuugcguaaaaccuuucucagg

SEQ ID NO: 2355 - RNA, 101 nt, Rat cytomegalovirus
cgauauaaaaacgauaauaccacggagccucggauucuauaacgcauacaacugugucauucugaauguauaaaucauaggcauugguauuguuauuaucg

SEQ ID NO: 2356 - RNA, 93 nt, Rat cytomegalovirus
gaugacggccgauaagacaaugaugacuacgacgaggaguaugauuaucacauaacaacaguacacucucgaagucaaaucggucgauucauu

SEQ ID NO: 2357 - RNA, 58 nt, Rat cytomegalovirus
gcacgucugucuguguacagucuugugaaaccacugacacaugacacaagaacgucgc

SEQ ID NO: 2358 - RNA, 86 nt, Rat cytomegalovirus
gcaguacuuuucgguggauacgauacagcgaaaucaaaaagaugaguuuuuugcaucucgcauauugugugugcugguacgucugu

SEQ ID NO: 2359 - RNA, 111 nt, Rat cytomegalovirus
gccgguacugacaucuaacgugacaccguuucucgguccgauagugguuccauuuaucgcguggagcaaauguggacccgagggaccugucucgccaaccaagcugccggc

SEQ ID NO: 2360 - RNA, 100 nt, Rat cytomegalovirus
gcugcguuccgucccaauagauaugugcacuggauuuaacgucgucguugauaucauagacaacuugacauuuucugagacacgggacgaaauggcacgc

SEQ ID NO: 2361 - RNA, 84 nt, Rat cytomegalovirus
guauaucuaaauagaaauaaagaguguuaaugcuaaaacauugaaacauuaacuagaauucuaucauaucauauucagacauac

SEQ ID NO: 2362 - RNA, 59 nt, Rat cytomegalovirus
gucuuccuuccgcaaggacgccauaucccugcuccgauucguucuucgguugguaagau

SEQ ID NO: 2363 - RNA, 128 nt, Rat cytomegalovirus
guguaaaagucgacguuccacguucacgugcggaaacuuaacgucuuuagacaucaaauuucuguaaauuaacaaucuagacgagcaaccccaagcguguguguuauugaacgacaucgauuuaacau

SEQ ID NO: 2364 - RNA, 130 nt, Rat cytomegalovirus
uagacuauauauucuaagaaauuguacgaggccgugucugacgacgaugaagacgacgaucagaaucucauguauucuacgccguucucugucagaucucucgcucuccugacauuucuuucuccgucua

SEQ ID NO: 2365 - RNA, 67 nt, Rat cytomegalovirus
uuugcuuaacaguggcaugugacaauucuacgucgaucguuacauaccacacaaggaucaaagcaga

SEQ ID NO: 2366 - RNA, 130 nt, Human herpesvirus 4
caaauaucuggauagcauaugcuauccuaaucuauaucuggguagcauaugcuauccuaaucuauaucuggguagcauaggcuauccuaaucuauaucuggguagcauaugcuauccuaaucuauaucug

SEQ ID NO: 2367 - RNA, 77 nt, Human herpesvirus 4
cccguguuuuccccaacaaagauuguuaguggaauuaauggagugucugacaguuguuccugguagggauucgaggg

SEQ ID NO: 2368 - RNA, 126 nt, Human herpesvirus 4
ccuucuggauccaggaauguugucuucaauuaauguagaccagccgcccuguugaugaauccaaccauccaggccuucgcuggcuucuaacaucccacgaacugacagguccacaacauaguaagg

SEQ ID NO: 2369 - RNA, 108 nt, Human herpesvirus 4
gacgaaaccuugacccuucuugucaaccucuucaggcccgggguuagugaugaaacaggcaacuccggggcugaucagguuaauaaggagccguccuuauucuugcuc

SEQ ID NO: 2370 - RNA, 51 nt, Human herpesvirus 4
ggcguugggggccagaaucagaggugaucucuggacauuaacuuccacgcc

SEQ ID NO: 2371 - RNA, 130 nt, Human herpesvirus 4
guagcauauacuacccaaauaucuggauagcauaugcuauccuaaucuauaucuggguagcauaggcuauccuaaucuauaucuggguagcauaugcuauccuaaucuauaucuggguaguauaugcuau

SEQ ID NO: 2372 - RNA, 51 nt, Human herpesvirus 4
uaggcgggguuaagcgugcaucuucugggaugcaacguuaagccccguuua

SEQ ID NO: 2373 - RNA, 71 nt, Human herpesvirus 4
ucccagagggauuagagaauccugacuugcaaaugcucuaggcgggaagccucucuucuccucccccggga

SEQ ID NO: 2374 - RNA, 79 nt, Human herpesvirus 4
uguguuauuuuaacgaagagcgugaagcaccgcuugcaaauuacgugugugcuuacacacuucccguuagaacaccaca

SEQ ID NO: 2375 - RNA, 99 nt, Goatpox virus
aaacauaauauuaauucuuuugaguuaaaauuuauaaaugauuuaccaaaacuugucaucauauaaauugauggaccuaauggaguuauuauugaguuu

SEQ ID NO: 2376 - RNA, 126 nt, Goatpox virus
aaacuagaggcaguaauguuaccuuagguuccucccuuaacgcuauaugagauuuuaccauugaugcaaaagaaucucugcauauaguggaacaaaaagucccaacauuauuuccuuuuaugguuu

SEQ ID NO: 2377 - RNA, 88 nt, Goatpox virus
aaauugcaauaguuucuacauauuuuuauuugauaauauauagauguaucaaauaacgauauuaaacuuguuacuauagcugcauuuu

SEQ ID NO: 2378 - RNA, 128 nt, Goatpox virus
aacagaugaaguaaaauaauauguuaaguuauguacauuacaugcauauauuccagaaucauuuuucguuauauuauuuauccacaugcuaugcccaacagaauauaaggauuuuuacaucuccuguu

SEQ ID NO: 2379 - RNA, 127 nt, Goatpox virus
aacuuauuauuguuagaugaugaaauaacugauagaccuacuuuuggauauaugugcaucgacauuguaucuguaacuauaaauucuauacccguuauuuuguuauaauuauuaacgaacauuaguu

SEQ ID NO: 2380 - RNA, 63 nt, Goatpox virus
accgaaacaacuuuucagaugaugacgauaucacaaccgccaucucugauuauuuguuuuggu

SEQ ID NO: 2381 - RNA, 130 nt, Goatpox virus
acucuagcacuuguuuauuugucuuugauuguuuauuuuacaauaauguaaguuuaauaaguuuaccauuuguuaauaggagaaaaauuauuguugauaauaucaaugaaauaaaaaauaagguuauggu

SEQ ID NO: 2382 - RNA, 68 nt, Goatpox virus
agguuauaauguaacaaauuaucauacauaugauuuugaaucauauuauucuacuuuugcauuaaccu

SEQ ID NO: 2383 - RNA, 63 nt, Goatpox virus
aguguugguauugcuucgagaccucguuucugacaacgauauuucgcuaguuaaaucagcacu

SEQ ID NO: 2384 - RNA, 90 nt, Goatpox virus
auaaaaucaauccaaucaaugcucuaauaucacuucucaugagaauauuaggaaaaauauuuuuaaaugagugauguuuugauauuuuau

SEQ ID NO: 2385 - RNA, 129 nt, Goatpox virus
auaaacuaaacauuuuuugaaugggaaauuguaauugcuaguaucaacagugauaauacguuuaucaaugucuauaacugaauacauaggcauguuauuuuuucuuguuugauuacugauaaaguuuau

SEQ ID NO: 2386 - RNA, 89 nt, Goatpox virus
auauuuugcaauaucucuauuauuucuucuucccguuuaauauauucuucugauaauauagacuuauacgaagauuuguugucugauau

SEQ ID NO: 2387 - RNA, 93 nt, Goatpox virus
aucgcacacggugcagcaaacacaauaacagaaguauuaaaagauucggaagaggacuaucaagauguguauguuugugaaaacuguggagau

SEQ ID NO: 2388 - RNA, 85 nt, Goatpox virus
aucuaauacaguuaaugacagaucauuauuuauuucuuuacuuucuauaaguuugugauuaguguuuguuuauauuguuuuggau

SEQ ID NO: 2389 - RNA, 88 nt, Goatpox virus
auuuauuuuuugaugaaggaucuaguguacguaugucuugcaacgacaaauuuacaaaaucuaauuuuccuauuaauaaagaaaaagu

SEQ ID NO: 2390 - RNA, 131 nt, Goatpox virus
auuuuuaaaugcguuggaaaaauaacuaauuuaguagcguuugugucguuguaucuaaucaaaacuuuuaauucaucaucagauguuaucuuuuuaaauuguucccacauuuccuucguaucguuuaaaau

SEQ ID NO: 2391 - RNA, 84 nt, Goatpox virus
ccacuuuuauuaaaauguccacuuuuaaacgaauauagguuaaaauggccauauauggaaaaggaugauuaugaaauaaaaugg

SEQ ID NO: 2392 - RNA, 130 nt, Goatpox virus
cuguuuuaaucauauuaaaugauuaggaaauauuaugaauuuaauaaaacaguuucaaaagcagucuguguuuugaaaggauauaaacuucaugguguuauuaauuuugaucaguuacaaaauggaauag

SEQ ID NO: 2393 - RNA, 89 nt, Goatpox virus
gaguggcagagaaaucauuacaaucugauuuaguugauaaauuuguuauuaaaugaauaaaauuagauucaucuauaucuucuucacuc

SEQ ID NO: 2394 - RNA, 113 nt, Goatpox virus
gauacguaauuaauaauaucaucauuaggauacuuuuuuauuauuucuauagccuuuuucauauuauuuaguuuuaacaaagaaauauuuguuggugguacguuaagcguauc

SEQ ID NO: 2395 - RNA, 71 nt, Goatpox virus
gaugauauaaaugauaaaauguuuugcgauacaauuuuauaugaucccgaaacagauaaaccuuauucguc

SEQ ID NO: 2396 - RNA, 57 nt, Goatpox virus
gaugguaagaucucucuuguuggagauuauucuauuauaggaagaucguuaguuauu

SEQ ID NO: 2397 - RNA, 92 nt, Goatpox virus
gauuucauauuaaauguuacaaaauuuguaucuauauuuucuucucgagaauguaguacaaaucaaaauauuguguuaaaauguaugagauc

SEQ ID NO: 2398 - RNA, 83 nt, Goatpox virus
gcauauguuccaggauugaugacagcggcauuaaauauccaaacaaguguuaauacugugguuaaagauuuugaaacguaugu

SEQ ID NO: 2399 - RNA, 77 nt, Goatpox virus
gcgucuagauuuaaaaaaguuuauauauuaguaccaaauauaaauauacuaaagauuuuuaauuauaguauggacgu

SEQ ID NO: 2400 - RNA, 85 nt, Goatpox virus
gcuauaucaaucaaaaauaguucuuauuucugauguuagauccaaaagaggaggaaaugaaccuaguacauuugauuuauuaagc

SEQ ID NO: 2401 - RNA, 93 nt, Goatpox virus
ggaacgcuauucaguacauaaucuccauuaaauguuacguagcuguuuucguauucguuagaaaaguacugauaauaaauaauaaaguguuuc

SEQ ID NO: 2402 - RNA, 68 nt, Goatpox virus
gguaaauauauuuacaugggaucaaaagauuuugcaucugaugauaaaauauauuucaaauuuauacc

SEQ ID NO: 2403 - RNA, 57 nt, Goatpox virus
guaacugcguuaaugggcaucauuuauuuaguauuaaaugacaacuauaccgguuac

SEQ ID NO: 2404 - RNA, 83 nt, Goatpox virus
guauuaaaauauuguuuguguuuaauccuaucauguauuguccuaguaacaugaucagaguuauaacaaauccuauguaauau

SEQ ID NO: 2405 - RNA, 61 nt, Goatpox virus
guuagaaaauauaaauuguuuagauaauccaaauauaucugcaguauaugguaacuuuaau

SEQ ID NO: 2406 - RNA, 108 nt, Goatpox virus
guugaaugcauauauuggaagugcuaauauggauuggaggucucuuucucaaguuaaagaacuugguauagguauuuacaauucuucauguuugguaauggauuuaau

SEQ ID NO: 2407 - RNA, 90 nt, Goatpox virus
guuuaggaaucgaaacaaguguugguuuaaauccuacuauugauaauauagaugcuauuauuuguucuucguccgacauaacuucugaac

SEQ ID NO: 2408 - RNA, 64 nt, Goatpox virus
uaaaguuaaguuuaaaucuggcaaauguuuguaaaacggcaacagaauguaaauuccuucuuua

SEQ ID NO: 2409 - RNA, 71 nt, Goatpox virus
uaauacauugggaagaaggauuuuguuauuagguuuaagcuuuagugaaauuuuaacuaacuuguguauua

SEQ ID NO: 2410 - RNA, 100 nt, Goatpox virus
uacugcgauguaucaauauguuuuaaugaugugauuaaaauuaaaggccauaaaauaauuuuaucaaauucauccaaauacuuugauaccauguuuagua

SEQ ID NO: 2411 - RNA, 69 nt, Goatpox virus
uagauugcucagcuguaaaauuuagugaacauguaaauuauuuaaaaacgugcaguguugggaaauuug

SEQ ID NO: 2412 - RNA, 55 nt, Goatpox virus
uaucauguuguaagcguugauuguaauaaagaauuaaugccuauacgaacugaua

SEQ ID NO: 2413 - RNA, 69 nt, Goatpox virus
ucauauacugugacggcguugaugcagaauuugugaugugucaagaagcaaaaaaaauagcauauauga

SEQ ID NO: 2414 - RNA, 109 nt, Goatpox virus
ucauaucucccucuaaagaagagacgaugacuggcuuucuauguuuguuuuugguguuuugacauauccuagaccaguauacgguuucaacuuuaguaaaaucagauga

SEQ ID NO: 2415 - RNA, 61 nt, Goatpox virus
uccauacgcuauaauaaguaaagauguuguuuuacgauauaauacaacuauaaaauaugga

SEQ ID NO: 2416 - RNA, 86 nt, Goatpox virus
uccauauaacaauccuaaauugucgagaagaaaugcuauuaaaaaaaaaguauuaaacgaugguuaugaggaauucguuauaagga

SEQ ID NO: 2417 - RNA, 71 nt, Goatpox virus
ucugaguuaaauguuuauagaucauguaaagguauuguuuauagcggauacuguuacacuuuuaacuuaga

SEQ ID NO: 2418 - RNA, 127 nt, Goatpox virus
ugaaaauucaaaaaaauuacuuuagguaugcauuuuuaaacuuauuaguuaaaugguaucaaagauaucacauuccuacaaugagauuauuuccuacaccugaagcaauuccagauuuuguauuuca

SEQ ID NO: 2419 - RNA, 100 nt, Goatpox virus
ugaagaaacagaauauuucauuaaagaauauaauacuuaucuuuauuuaaaggaaaaggauccauauauuuuguauaauggaauguuaacaaauauauca

SEQ ID NO: 2420 - RNA, 91 nt, Goatpox virus
uggucaagguggguucgguuucauauuuuuagcauauucacaaaauaaugaagaauauguaguaaaaauugaaccuaagagcaauggacca

SEQ ID NO: 2421 - RNA, 58 nt, Goatpox virus
uguaaauggaacaaaugacgauaauggugucuuuguuauuggaauaaguuuauuuaca

SEQ ID NO: 2422 - RNA, 87 nt, Goatpox virus
ugugaaguuaacaauauuugauaaguuguuugauaaaacuuauauaaguuauugcacaacauguuauauaacagaaacaauaucgca

SEQ ID NO: 2423 - RNA, 87 nt, Goatpox virus
uguuuguuuauuucugcuucuaauuuauuauuugcaacaaauacagauacuaauguuucaggugauaaguuuccaaauaaacauaca

SEQ ID NO: 2424 - RNA, 60 nt, Goatpox virus
uuaauuuaacuugccaaucauuaguugaugcuacuucaucaauuggcacaguuguauugg

SEQ ID NO: 2425 - RNA, 68 nt, Goatpox virus
uuccauugauacguacuauaucuaguaaugauguguuuauaucuagacauaguagguugcauaaggaa

SEQ ID NO: 2426 - RNA, 62 nt, Goatpox virus
uuggguaucguagaugaaaaacuuacuauagaauccauagaaaauuauuauuuagaucccaa

SEQ ID NO: 2427 - RNA, 66 nt, Goatpox virus
uuguaaaaugaacgggaaaaagucucuuuuaacccgaacuuguuauuucuugugcuuauuuuucaa

SEQ ID NO: 2428 - RNA, 130 nt, Goatpox virus
uuucugauccauuagauuuaaacccaaacauugauacagaaacauaaucauugucaaguuugacacaucuccacuuuuguuuaguaucauaaaugucaucguuuggaucuuuuauaguucuaucaagaga

SEQ ID NO: 2429 - RNA, 86 nt, Mouse cytomegalovirus 1
aaggauaugguacuacugcugcugcugaggagaggagugacggucagagaugcucucgaagguacggcugugguagcgggguccuu

SEQ ID NO: 2430 - RNA, 131 nt, Mouse cytomegalovirus 1
aagguagccaagguucugccucuggccagcauacagguggucucuagauggucuuucauguuauuacacaucaucugacacacccugugauauuggugucucucauaggcaaucguuuccugcacugccuu

SEQ ID NO: 2431 - RNA, 56 nt, Mouse cytomegalovirus 1
aauuauaccagaguuugguauuuuuuuaaucugagaugcgucgucuggguauaguu

SEQ ID NO: 2432 - RNA, 74 nt, Mouse cytomegalovirus 1
acaaaagacauuguaauagauuugauauuauuacuuacuagauugaugaugaaauuuuaacagaguguccaugu

SEQ ID NO: 2433 - RNA, 62 nt, Mouse cytomegalovirus 1
acgagauucguggcguguuguauauguauccucaguacaacuacaguaucccaaucaaacgu

SEQ ID NO: 2434 - RNA, 85 nt, Mouse cytomegalovirus 1
acgcggaugucauagggagcgugaucgagggggguugguuuaacaaacccacggagaaugcgaucuauuuuacguucaaccgcgu

SEQ ID NO: 2435 - RNA, 62 nt, Mouse cytomegalovirus 1
acucguuccuggccgcggacgaagauacgaacggcgucuucgccgcggacuaaaagaugagu

SEQ ID NO: 2436 - RNA, 89 nt, Mouse cytomegalovirus 1
agaacaccaccuccauccuccccgacgggcauauuauccccagucucgucccaguaauacucgucgucuuuauuauggggugguggucu

SEQ ID NO: 2437 - RNA, 96 nt, Mouse cytomegalovirus 1
agaugaugaaucgagcggaggaucgcaagaggaugcuguccaaccagcugccuucgugcaucaaguccaagucgaucgccaacucguucaucuucu

SEQ ID NO: 2438 - RNA, 115 nt, Mouse cytomegalovirus 1
agcuccacgaugcgcuucguguucaucucgugccggcucguggucaccaccuugaucggguugguguucagcagcuggcagaucuucuuguggaugcgcagcucguugugucguu

SEQ ID NO: 2439 - RNA, 131 nt, Mouse cytomegalovirus 1
agcucgggguccuccagcggcggcgaaggcgacucgucggacucguccacgggugguucucggucccacaccgguucaccgacguuauccgacaggggcaacacgccgccgcugccgccaccgccaccguu

SEQ ID NO: 2440 - RNA, 66 nt, Mouse cytomegalovirus 1
aguguagcugcggcggaucgacgaaggacgccgccggaggcgccuucgcugccgccgcagaccgcu

SEQ ID NO: 2441 - RNA, 76 nt, Mouse cytomegalovirus 1
aucguaauuuguagaugaauaaaugugugauaaguuaacgaccgugucucuuguuauucguccauuaauugcgcgu

SEQ ID NO: 2442 - RNA, 97 nt, Mouse cytomegalovirus 1
aucgugcagcgguuggaacucgcucccguuguagcagcucgccagggccucgcggcacuuguguucgacgguggcguugaugggcucgcugcgcggu

SEQ ID NO: 2443 - RNA, 73 nt, Mouse cytomegalovirus 1
augucgacgagccggaccgaaaccccguccggccagcugaccggcaaggagguaccggcgcgcucggagacau

SEQ ID NO: 2444 - RNA, 104 nt, Mouse cytomegalovirus 1
caauguacuuggcuccaaugggacuuuccuguugacucacccccuauugaccuuauguacugggcaaaacccaauggaaagucccuauugagucaguguacuug

SEQ ID NO: 2445 - RNA, 91 nt, Mouse cytomegalovirus 1
cacguccaggcucaccgaggccgucagccuguugccgcggcugaacggccgccacgccagguucgacgccgccaccucuagguccagcgug

SEQ ID NO: 2446 - RNA, 119 nt, Mouse cytomegalovirus 1
caggaaaaguagcggcggacggacgcccgucgagagacugucgccuccuggauaucggggcagguacgauggggucgcaggucgccgugacggucguccgucugccgcgcgaccucuug

SEQ ID NO: 2447 - RNA, 108 nt, Mouse cytomegalovirus 1
caggcaacuuuaucuucuccagccauuugaguuagcguguuauuaggaagacucccaggaauacuaauagcaucuguugccacgaugauggcuggaugcgauggccug

SEQ ID NO: 2448 - RNA, 80 nt, Mouse cytomegalovirus 1
ccaagaagauguucgugccaaagcguuccgagaaguuccccuuuucugggaagauucuggcgggaacuuccccuuuuugg

SEQ ID NO: 2449 - RNA, 126 nt, Mouse cytomegalovirus 1
ccagaggcagaggaggacagagaagcuggccgcacguagccuggcgacuggcgauagcuguugaggaauugcuggaagcgccaucccggaucguuaguguccgccgccggaguccucugucucugg

SEQ ID NO: 2450 - RNA, 82 nt, Mouse cytomegalovirus 1
ccaggagaacuggaucacguucuggucuuggguaucguacaggaagaucuugaugggcucgggacgcggacgcuccuccugg

SEQ ID NO: 2451 - RNA, 81 nt, Mouse cytomegalovirus 1
cccugccgugauguguuuuuguuugaucuuuaaguguuauucucuaaguaaagcaguacgaggcggcaucgacgugcaggg

SEQ ID NO: 2452 - RNA, 113 nt, Mouse cytomegalovirus 1
ccgcagagggucuaggucgcugucggccgaggcacugcuccuuuugagcgguagugcaaaauuuagcagugccucgaccgucaguugaaaaagaugacguacucucccugugg

SEQ ID NO: 2453 - RNA, 131 nt, Mouse cytomegalovirus 1
ccguucaccccgaacagaucuguaccgaaaaauccgguaccguucuccauuuugaccguaacguuauccuuugcguaaauuguagaacgugcaccgagcgucgaguuuagcauccauaagaugguguaugg

SEQ ID NO: 2454 - RNA, 72 nt, Mouse cytomegalovirus 1
ccucccgcuggccgccgaccuggucucggaguuacgcaaguauaccgagaagucgcaggcggcgggcggagg

SEQ ID NO: 2455 - RNA, 72 nt, Mouse cytomegalovirus 1
ccugaagcaccauccgaucugacaccguuucgaucucgaaccacgggcggagguccggacuuggucuucggg

SEQ ID NO: 2456 - RNA, 79 nt, Mouse cytomegalovirus 1
ccuggacaccgugacggccgaggucuuccacggcgagccguacacguacgcucccgccgcgucgccgucgucggacagg

SEQ ID NO: 2457 - RNA, 65 nt, Mouse cytomegalovirus 1
cgagagaagagaauaaagucugacagaacuaugauuaaucaccguucgacguuauucuccucuug

SEQ ID NO: 2458 - RNA, 79 nt, Mouse cytomegalovirus 1
cgaucuuucucgggcagaagaccuuguagccguugucgaacgcgucgaagcgcugcaacgacuuguagggggaaugucg

SEQ ID NO: 2459 - RNA, 108 nt, Mouse cytomegalovirus 1
cgauuguaauggaccaggcauuugagggugcuggugaggucggagaagaggucgccgccggcggacccguucuccucgucaugacccgucucgucuuuuuuacgaucg

SEQ ID NO: 2460 - RNA, 129 nt, Mouse cytomegalovirus 1
cgcgccaagggguccacucccaacucguacaccuuccuccccuccuccagcauccgcuugccgaucuugcggcacauguuccaguuguugaaggagagccgguacagguuggggaugugcccgaggccg

SEQ ID NO: 2461 - RNA, 102 nt, Mouse cytomegalovirus 1
cggacacggucucagagggagagggacauucugugguguuaauagccaugccucgccgcgauucuccuguccccucucucacagagaguucuguucuguccg

SEQ ID NO: 2462 - RNA, 130 nt, Mouse cytomegalovirus 1
cggcugcaguggcaugcggcgcgagaagauggucaucgauggacuccaggagcccgucuacgugaugcgucuccuggccccccucauccccgucaagcuaggauucucgcccuacauguugccgccuaag

SEQ ID NO: 2463 - RNA, 115 nt, Mouse cytomegalovirus 1
cgggguuuauuuuuauugcauuggccaucugacucuuacacgcacacgcaaggcauuggcgacuuucguugcauguagaugagugccaguacagugagaauaaauaacaaaccug

SEQ ID NO: 2464 - RNA, 89 nt, Mouse cytomegalovirus 1
cguccaggccgaugccgcaccucucacggaguccgcgccggcagaagucggagaagccgcacuuggugagcaggugcagcacggggacg

SEQ ID NO: 2465 - RNA, 104 nt, Mouse cytomegalovirus 1
cgucugaugugggugcuggcggggcugucguuaguguggucagguacgggaugcucgucggcgggacggccgugaccgugcucggaacccgcgacgcgucagug

SEQ ID NO: 2466 - RNA, 90 nt, Mouse cytomegalovirus 1
cgucuggauaugaccgacccccugacaucggcggcgcgagauuuuuaugccgcagaagucgaugucggggucucggucgucuccguggcg

SEQ ID NO: 2467 - RNA, 62 nt, Mouse cytomegalovirus 1
cgugguggagcucacggucgaaggcgauuugcugcuguggugaccguuagacucgcgcugcg

SEQ ID NO: 2468 - RNA, 79 nt, Mouse cytomegalovirus 1
cugcguucuacgguggucagaccgaagacugcgacgguaccgacgcuggucgcgccucuuauacccacguagaacgcag

SEQ ID NO: 2469 - RNA, 112 nt, Mouse cytomegalovirus 1
cuuggugugguuguuacguagcagcacgagcacggacagcacgggcggugacacgucgaggcccaacacguucuccgugaacaggucggucguguaguucaaccgcaucagg

SEQ ID NO: 2470 - RNA, 129 nt, Mouse cytomegalovirus 1
gaauacaauggaaagucccuauugacucacccacauugaccuuauaugcuugccaacaauggaaaaacccauuggaaagucccuauugagucaguguacuuggcagcaauggguuuuucccauuggcuc

SEQ ID NO: 2471 - RNA, 87 nt, Mouse cytomegalovirus 1
gacaaucguagucauaucacaugauuucucgacagaucgacuacaccacgauaaucugucaggacaucauguguuuaacucgauguu

SEQ ID NO: 2472 - RNA, 83 nt, Mouse cytomegalovirus 1
gacgaggauacggagauggagauggaguucucuccgcguaacgcggcgcggagacugcuguugucucgcgcucuccgcucguc

SEQ ID NO: 2473 - RNA, 54 nt, Mouse cytomegalovirus 1
gacugaguugaccgugaaugagagauagucuuuggcuugcguguucucuuuuuc

SEQ ID NO: 2474 - RNA, 111 nt, Mouse cytomegalovirus 1
gagggcucguucgcgcgggugcucuucuacaucuggucgggcacgaacgugauguucaacacgacgcugacggaccuggcgaucaagaagagcaaggcgcugaaggcgcuc

SEQ ID NO: 2475 - RNA, 115 nt, Mouse cytomegalovirus 1
gaguuggcggguguugugugugagugagugagucccuucgaucgaucgaucgauugauuagaucgguuugaaguugaaacuccucuccggcgagcacauguacacggccaugauc

SEQ ID NO: 2476 - RNA, 105 nt, Mouse cytomegalovirus 1
gaucccgaugguggucaggcuggugucgcagucgucgucggaaucgucguccaccgaccucaugacgcugcgcauccccucgagcguggccuugaucacgggguc

SEQ ID NO: 2477 - RNA, 75 nt, Mouse cytomegalovirus 1
gcaccccgaucaacgaccacgagcagugcaacgcguccgacaccgcguuccagcaccgcuugaacucggggucgc

SEQ ID NO: 2478 - RNA, 71 nt, Mouse cytomegalovirus 1
gcacgucgucgccccguaccccaggcccaucuccaccguguugauguucuggcucacguggaacaccgugu

SEQ ID NO: 2479 - RNA, 111 nt, Mouse cytomegalovirus 1
gcauauaagauauacagagaaaggauuuugcugucuaacguccuauacagauguuagucguacacuguaucggcgcaucagauagaguucugucuguaaggauauauacgc

SEQ ID NO: 2480 - RNA, 74 nt, Mouse cytomegalovirus 1
gcgguguguacaacgaggcauccgaccaacugcggugcgaaaucgcacucguaugucacguugugaacagccgc

SEQ ID NO: 2481 - RNA, 74 nt, Mouse cytomegalovirus 1
gcuggcgcagaacucgcaccguucggugaacgugauguuauucaucacgaucaccgauccgcguucgcgguagc

SEQ ID NO: 2482 - RNA, 76 nt, Mouse cytomegalovirus 1
gcuggguuaucucgacguggcggagaagcugcgcaaggaauaccccaugugcaacgguccccucgagguucucggc

SEQ ID NO: 2483 - RNA, 71 nt, Mouse cytomegalovirus 1
ggaagccacuucgauguccguguaguaguccgcggacaaggcuaucgcacgggagucccggccggcgcucc

SEQ ID NO: 2484 - RNA, 104 nt, Mouse cytomegalovirus 1
ggacaugaauccgugcgguucuacggggagcagcggccucuuuugagccugccucgcuuucgaggccgcuaccaucuccucggagaaccgaagacggaccgucc

SEQ ID NO: 2485 - RNA, 97 nt, Mouse cytomegalovirus 1
ggagaaggagucgagggggcggggaggucccgaauacucacaaccgagaccguuugcugggaaguucgaacucgucguccccccgcacgucgucgcc

SEQ ID NO: 2486 - RNA, 63 nt, Mouse cytomegalovirus 1
ggaggucggucgaucacgucguuucguuaaauagauggcacgaauucguccucguccaccucc

SEQ ID NO: 2487 - RNA, 79 nt, Mouse cytomegalovirus 1
ggcgacgcaugcccuggaggugagccugcuggacuucucgacgcugauggcggcgcugcacccggaguacguguacgcc

SEQ ID NO: 2488 - RNA, 59 nt, Mouse cytomegalovirus 1
ggcuaucagugccgucguggugacggccgcgacuaucgccgcgauggcgccccgauacc

SEQ ID NO: 2489 - RNA, 130 nt, Mouse cytomegalovirus 1
gggcagcugguucucggccguguccaccaguuugaucuuguucuccgccgugcuguaggcccggccgcucggcacgugcaggccgaccggaaaguagaaggugagcucgacgucccgcuccagcgggucc

SEQ ID NO: 2490 - RNA, 95 nt, Mouse cytomegalovirus 1
gggguguuuggucuucugauuggcagggcgcugugugaggcaguaguuauaccugacauggaggccgcugcuguaacaauaucuauguucaucuc

SEQ ID NO: 2491 - RNA, 116 nt, Mouse cytomegalovirus 1
gguccugaucccgcgagggagccgccggggaggagguggaaguggaggucggcgaggcggccgcgggcugauucuuggccgcgcccccaccuccugcguaucuucgcgugagaacc

SEQ ID NO: 2492 - RNA, 106 nt, Mouse cytomegalovirus 1
guauggaugauauacuuacuguuguuguucacuuacuauuaucaccuauauaaaacuuguauucaugauacuuaccacugaaaaaauuguguaugucuuuuuauac

SEQ ID NO: 2493 - RNA, 65 nt, Mouse cytomegalovirus 1
gucgcugucaccggaguugaugcccagcaugaucgugcugcgcuuugaacuguguaacagucgac

SEQ ID NO: 2494 - RNA, 107 nt, Mouse cytomegalovirus 1
gugcuagcugcggaggcagaagcggcugcuggcgcuggugccgcgggcggagccggcgcggcgaccgucgucucguugccguucuugcccgcuugugcgguuugugc

SEQ ID NO: 2495 - RNA, 58 nt, Mouse cytomegalovirus 1
guucgguugcguguauguguugugaucaaaggucccaacaccggaagcgcggaagaac

SEQ ID NO: 2496 - RNA, 62 nt, Mouse cytomegalovirus 1
guucuaccgccccgaaacgacguuguuauauacggaaccuuuguuuccacccacgguggaac

SEQ ID NO: 2497 - RNA, 66 nt, Mouse cytomegalovirus 1
guuuccauaaccguacgcgaaacacgccccccagaucaacgucggcgaucgcgcauauauagacac

SEQ ID NO: 2498 - RNA, 65 nt, Mouse cytomegalovirus 1
uacuggccacaaaaguagcaguuaaacucuuggaaacaaaaugauagcuaguauuggugucagua

SEQ ID NO: 2499 - RNA, 119 nt, Mouse cytomegalovirus 1
ucaacguguucuuuucucguucuucuacgaugaugccguucugaaacauuagaucuguugucgcaaagugaugaaaugguguguauaggaugggucguuuugagcgauuaacacguuga

SEQ ID NO: 2500 - RNA, 58 nt, Mouse cytomegalovirus 1
ucgaagcucagguuguaccguucggggucguccccguaguacaggcgaaaguuguuga

SEQ ID NO: 2501 - RNA, 79 nt, Mouse cytomegalovirus 1
ucgguguccuggcugugcacguagcaacgaucuccgccgguguacaccgcgaucagaucgccgugacuccuggcaccga

SEQ ID NO: 2502 - RNA, 78 nt, Mouse cytomegalovirus 1
ucguagguaaauugcaguugagcauaggugauaucagucacgacaucaucuauaugauccaagcugcguuuccgacga

SEQ ID NO: 2503 - RNA, 61 nt, Mouse cytomegalovirus 1
ucucuuacaccccuauugccuaaaauuauggaaaaucguauauggaaaaggguagaugaga

SEQ ID NO: 2504 - RNA, 130 nt, Mouse cytomegalovirus 1
ucugaccccuccaagacgggaugaauuuuacaccaagaaugagucaccaaacacgaucgugaccacgcucaccgugauagugacucuucuuuuugucggacuccuucucguacugauuuacuuguacgga

SEQ ID NO: 2505 - RNA, 74 nt, Mouse cytomegalovirus 1
ucuugacggagcgcacgcacucaucgagcaucugauccuucgucggggucaucaugagcggcgucugcucgaga

SEQ ID NO: 2506 - RNA, 126 nt, Mouse cytomegalovirus 1
ugacggcuccuuaaauagccuaguuuuucgacgauccggucgaccgagggaaacugccuaggauccuauggguuucucggaaaucggagacguuucucgaaaacacgguaagaugaggcgccguca

SEQ ID NO: 2507 - RNA, 79 nt, Mouse cytomegalovirus 1
ugggcaacaguccagacagaccaaccguugaaaccgagccucuccguucaacggcaucucgugcgucuuaauuugccca

SEQ ID NO: 2508 - RNA, 93 nt, Mouse cytomegalovirus 1
ugguccucggguagcugcucgucggccgagcucauccggcgagggguggucgccggagguagcuggucggcguccugcggcggcucggggccg

SEQ ID NO: 2509 - RNA, 127 nt, Mouse cytomegalovirus 1
uguugagcuccucggugggggugauguuguaguugguccucgagcgggccggcgggucguuccugucgccgcugcugcccgcgccgacaccgaccuggggcauccgccggccgaggaucuccugaca

SEQ ID NO: 2510 - RNA, 118 nt, Mouse cytomegalovirus 1
uguuggugucucugaagacucagguaccaccugguugucacuugguccaggcugggacucaucuucuucagcuuccucaguggcuucaccagcagguuccucuugagugacaccacca

SEQ ID NO: 2511 - RNA, 106 nt, Mouse cytomegalovirus 1
uucaugcuagucguguaucccugcguggucaccguaguggcguuggggcuggagcucauacucgaagugaucaucggugucgugcuagguuucgaagauguaugaa

SEQ ID NO: 2512 - RNA, 103 nt, Mouse cytomegalovirus 1
uucccgaaccgaacgagaucaguagacacagacaugcacacucuguaaggauauuuaucuaugucaacagaaaccauguucuccgucucguucacgaagggaa

SEQ ID NO: 2513 - RNA, 131 nt, Mouse cytomegalovirus 1
uuuugguggaugacucgguuauggauugcugauugauguucuucccgacgugauggguuagaacugacucgguuggucuacgugucgcggacgaaaagaucgagugauuaucgguuggccggccgcggagg

SEQ ID NO: 2514 - RNA, 79 nt, Cowpox virus
ccgauaacgauauaagacuagauguuauucagugucugcuauccuugggugcugauauaacagccgucaauuguuuagg

SEQ ID NO: 2515 - RNA, 71 nt, Pepper ringspot virus
cgaagaucaucagcgaugugagagaacuucaugagauugauuacucgucuuauauguucaugaucaagucg

SEQ ID NO: 2516 - RNA, 131 nt, Pepper ringspot virus
gcgaacaauguuauuaaaacgaaguaugagaauuuccaaagcccaauugaugaacuuaagacuccucugauccgaaagucugagaauaucaaaggugcaaagaaagacagaagcguuuguaacuuguucgu

SEQ ID NO: 2517 - RNA, 118 nt, Pepper ringspot virus
uucgugcugggggaagagguuauccgaaugguuuagauguuugggaucuuaaguuuaagaaaugggugauugaaccuccaauucucaaccacucaaagguuuuuguuccagauuugaa

SEQ ID NO: 2518 - RNA, 81 nt, Rio Bravo virus
aacagugucaaugaucgaauuggcaagagugaagaguggauaguuaccaaugcuuggaaaaguuuggucauugcuauuguu

SEQ ID NO: 2519 - RNA, 85 nt, Rio Bravo virus
auuaggacccuggaaaaauggggcucuuguucuugaaagaggagaguguccuggaacaaaaguccaaauucuagaggauugugau

SEQ ID NO: 2520 - RNA, 88 nt, Rio Bravo virus
gauugaaccaaagggaacuacauuuuggacccuuccagugguuaguggauuaacaucacugguccgaggagauuucuuugguuugauu

SEQ ID NO: 2521 - RNA, 112 nt, Rio Bravo virus
ucaccacugacauuucggagaugggugccaauuuagauguugauaggguaauugauccaaggacaacucuuaaaccaauggaaaaaggcaauauuguggagguuagcgguga

SEQ ID NO: 2522 - RNA, 121 nt, pestivirus Reindeer-1
ccgcuacugaaggcuaucuuaauaaguugugugaguaguaaauggcaaugcuuuuaccuccuguaucuggucauagaacugucauauuaucuccauaaaaaaauaauagaaaaaauagcgg

SEQ ID NO: 2523 - RNA, 96 nt, pestivirus Reindeer-1
guguuaaucuugcccacauaugaacugaccaagcuguacuaucuaaaaggaguaaaacaagggauggaaagaaauugguuggggaagguaagcuac

SEQ ID NO: 2524 - RNA, 75 nt, pestivirus Reindeer-1
uacucaacgguagugcauuccaauuagugugcccauuuggguggguuggacgaguggaaugcacugcugugagua

SEQ ID NO: 2525 - RNA, 130 nt, pestivirus Giraffe-1
cuuguuccagccaguagccggggagaacaucacccaguggaauuugagugacaauggcacgucaggcauacaacacgccauguaucucagaggggugaacaggagcuuacacggaauauggccagaaaag

SEQ ID NO: 2526 - RNA, 130 nt, pestivirus Giraffe-1
uugugugagcaguuacuggcagaccuuuuaucuaauguaccuagcuauagaucuccuauauuauguccacaggaagauuauagaagagguagcaggggggacuaaucuggccucuagacuguuagcagca

SEQ ID NO: 2527 - RNA, 95 nt, Langat virus
aguuugggacgccucaugcagugaaaauggauguguucaaucugggagaccagacgggaguguuguugaagucacuggcuggggucccuguagcu

SEQ ID NO: 2528 - RNA, 130 nt, Langat virus
aucugguacauguggcugggcagucgguuccuggaguuugaggcccucgguuuccucaaugaggaucacugggcguccagggcuucuaguggagcuggaguggaaggaaucagccucaacuaccuggggu

SEQ ID NO: 2529 - RNA, 87 nt, Langat virus
augcacccaccuggaaaacagagacuucgucacuggggugcaggggacgacccgccucacauugguucucgagcuggggggcugcgu

SEQ ID NO: 2530 - RNA, 68 nt, Langat virus
augccaagguggugagaguggcuaggcccagccgugaggggggcugugucauggacaucauaacgcgu

SEQ ID NO: 2531 - RNA, 75 nt, Langat virus
ccauucuggcucuuuuggugacgggacuagucucuguggagagucuguuucguuaccuuguagcagucggucugg

SEQ ID NO: 2532 - RNA, 131 nt, Langat virus
cggucacauaucgcacugggacugauuguugguaugccauggagauuaggccgguacacacucaggguggccuggucagauccaugguaguggcugacaacggggcucuacucagugaagguggaguuccg

SEQ ID NO: 2533 - RNA, 119 nt, Langat virus
gucaguaggaugguguuggggacccuaguucucgccaccucacugaucuuccugugggccggagguguuggcuacgggaacauggcugggguggcacugguguuuuacacccuacugac

SEQ ID NO: 2534 - RNA, 65 nt, Saccharomyces cerevisiae virus L-A
acagcgauaaaagaacaacucgacaaacgugucacuaagauauucggaguuggugaugacguugu

SEQ ID NO: 2535 - RNA, 70 nt, Saccharomyces cerevisiae virus L-A
auguguguaguugagcugcucgcgaacuuacaaguagaucuugaagcagcaguagcuacuauucucgcau

SEQ ID NO: 2536 - RNA, 97 nt, Saccharomyces cerevisiae virus L-A
ggcagucucauacuaugcuaaccugagcaaauucaugaguauaccaccaauggcgaacauugaauuugggcaggcuagauaugcuaugcaagcagcc

SEQ ID NO: 2537 - RNA, 100 nt, Rice yellow stunt virus
agcaccuuuccgagcugugacggacauugauccucaaagaauggugcaagagaguacaguaacaaagggagacuaugaucacagaagaaagauggaugcu

SEQ ID NO: 2538 - RNA, 122 nt, rice ragged stunt virus
guucgcacaagagagugcugucagauaaagcgaucauaucaaccccaauuucuuaugagagacagagagccauugaguauauguuaucaucgcauggauuugauuacaauuuagugcugaau

SEQ ID NO: 2539 - RNA, 86 nt, rice ragged stunt virus
uggcuauuccaagauauccacuuuacagcuauuaugguaaugaugauauugaugauuaucauuuagcuguuguuaaucguaagcca

SEQ ID NO: 2540 - RNA, 95 nt, Plautia stali intestine virus
acguuagcugauauggaugguaaagauucuuauucuuauuauucuaucgaacgaaugauuuuugaggaucuucacaacccauaucuagguaaugu

SEQ ID NO: 2541 - RNA, 126 nt, Plautia stali intestine virus
auuuagcaacuuuugggcuugugguaacggccuuagguguuggcuacacuauauauagauguuucuuuaauggugagacuacaccacuggcaaaaucugaaauaguauuaccaaaauuuccugaau

SEQ ID NO: 2542 - RNA, 77 nt, Plautia stali intestine virus
uugcagacugcgucagguacauguggugccccuguuauuuuaauaggagccaaacaaggaccuggucgcaucugcgg

SEQ ID NO: 2543 - RNA, 103 nt, Himetobi P virus
acaugauauuagaucugauuauuuagaagauaagauagaaauuaaagauauaacuggaaucucaucgaauauaucccuaaauacugaaaaauccuuauccugu

SEQ ID NO: 2544 - RNA, 109 nt, Himetobi P virus
agguucugauaucuuggguaauguuuuaccgcagacuaagaguuuuaccaacccaguugcuaaaauuucagaugcugcguuugacauuauuuccaugauaccaggauuu

SEQ ID NO: 2545 - RNA, 68 nt, Himetobi P virus
agugcccuaacagcaccggcuggaugccaauacauaguauuacuccagccgcuacugguagggacacu

SEQ ID NO: 2546 - RNA, 120 nt, Himetobi P virus
gccuuaugcugggacuaccccuuucaaacgcauuagaccugaaaucaacccucuuuccucuucuggaauuaguguugaugauuucaauguguuugcaacggguguucuugguguaagagc

SEQ ID NO: 2547 - RNA, 62 nt, Himetobi P virus
ucgugauuugauuaagcgauuugguugguuuaagaaucaaucgguugcuuuuacaaauacga

SEQ ID NO: 2548 - RNA, 91 nt, Himetobi P virus
ugauuucgcugguaguaagauggaugaaaugucauuugauuauguuaaacgcauaccaaauuacauugauucauuuuccuauucgaauuca

SEQ ID NO: 2549 - RNA, 129 nt, Himetobi P virus
uuccgaucuagugaaucccacaacguaugcacgcaucacaaccaucagugaguacgcuacagcuuaugcuauggcugcugcugaugauuuugauugcggguuuuacuugggggcuccauuaucuuggaa

SEQ ID NO: 2550 - RNA, 104 nt, Triatoma virus
aaucucuaugcgauguauaugccugguguuagguugggacaugcucuuuuuauuaaaggguguguugcagccuuucccacgcauuuuauagcugcaaugaaguu

SEQ ID NO: 2551 - RNA, 108 nt, Triatoma virus
aaugggaaaaguucugauucaagcuaucguuauuuguguuaguguuuuaucugcaguuuuagcauauaauuacuuaccauuuaaggcuguuucaggauuuugccuauu

SEQ ID NO: 2552 - RNA, 126 nt, Triatoma virus
agaaauuuuaagcuuaaaagucuuagcgaauuugcucgcuuuauugcaauuguuccuagagcuauucagggaauugauuguauaggcgaguugauuagcaaagcuuuugaguucgcaagaaucucu

SEQ ID NO: 2553 - RNA, 123 nt, Triatoma virus
cauuagcaccuauuaggguagcauggucucauaaugauauuaccgaccuauuuguuucggcaagugagguuaguagaguuauagaaucuccugcuguguuaccucuaauuaugugugauaaug

SEQ ID NO: 2554 - RNA, 70 nt, Triatoma virus
ccucucaaugaaccaauaacuuggaaugauaauuuaucuauuccuggugaauuugguuuaguugggaagg

SEQ ID NO: 2555 - RNA, 97 nt, Triatoma virus
ggaacgguacaagaaugggcccuucuaugcuugcaucuaaauucuuuaaagaauuugguuuuguggcauauggagaugaccauauuugugccguucc

SEQ ID NO: 2556 - RNA, 68 nt, Triatoma virus
ggagauguuguaauguggggucaugcauugccuucugggcauuauuugaccgcuccuuauaacucucu

SEQ ID NO: 2557 - RNA, 85 nt, Triatoma virus
guaggacuacuauauuucaugauugggcagauacuagggcuuuuguacuagaugaucugucuccagaugagauauggaauccuac

SEQ ID NO: 2558 - RNA, 131 nt, Triatoma virus
gucguuuugaagacuuggaaaaugaagaagugguagcacagguaggguauuuaccuggcgaugauucaaaaucaaaaguuagguaccuaucuguugcaauuccuucuuuaauagaaucucauguuuccgac

SEQ ID NO: 2559 - RNA, 100 nt, Triatoma virus
gucuugugaaaaaguggaacaacgaccugugguaaaaugugaaucuugugaaaaggauacacaaagacccacaguacguugugaaacuucuacauuagau

SEQ ID NO: 2560 - RNA, 130 nt, Triatoma virus
gugaaguacaaaaauauuacaugaaauauuuggaaucucaacuuguauaugaugaaauuaauuucaauuuauuaggaucauuguaucaagaagguauuguaauguuaaauagucauauuuuuguaacagc

SEQ ID NO: 2561 - RNA, 131 nt, Triatoma virus
uauugauggggaugaaacuaucaauucuauaaaacguaaaucuucgccagguuucccuuggguuuuuaaaacuucuaguggaacugguaagaaacagauuuuuggaaaugauggugaauuccuauuugaua

SEQ ID NO: 2562 - RNA, 120 nt, Triatoma virus
uggcuagauaucuuaaauccaagucugaugguuuuguagcaggugauuuugagggauuugauuccucucaauuggugccuauacuacgagaaauuggaaauguuuuuaaugguauugcca

SEQ ID NO: 2563 - RNA, 119 nt, Triatoma virus
uuguuauugaucguuaugaaagauugagaggauauccaugggaaagugauaaaauuaguuauacuaauucuuugcuugaucuauguuuauuuucuucucuuucugagcgaucuuuacaa

SEQ ID NO: 2564 - RNA, 91 nt, Triatoma virus
uuuuauaaggugccuuuuucugaaaugauguacuguucuugcuuaaauugcgagaagacagaauaugauucggaaagaguauauuaugaaa

SEQ ID NO: 2565 - RNA, 130 nt, Triatoma virus
auacguuuagauuugucaaaacuaacuaucauucuggaagaguccaaauuacauuucaucccuuuguuggguaugaugauguuauggauucggaugguaagauaguuagagaugaauacgucuaucgugu

SEQ ID NO: 2566 - RNA, 87 nt, Triatoma virus
cagguacucgugauauccguucuucuuauguugaggggaaauuuauuccucaggauauaacuggaaugucuagaaaucaugaacuug

SEQ ID NO: 2567 - RNA, 130 nt, Triatoma virus
uagagaaaaauuaucugguuuuacaucuuuuagugcuaguaccgucuuucauauacaaguaaaugcucauccauuucaauguggaagauugguuuuagcugcuguaccuguuccagauauuuuaccucua

SEQ ID NO: 2568 - RNA, 75 nt, Triatoma virus
ucaagaauguauuggugaaagaaucuuaucuuuuucugaauugauuaagagaaauucuuggcgauacguuucuga

SEQ ID NO: 2569 - RNA, 126 nt, Triatoma virus
uuugagucuuaaauauggaaaugagguuauuuugaaaacaccuuuugccggaacaucuucugaugagguggcgcuggaguauguuuuaaaaauaccuaauuacuuuucuagauuuaaauacucgag

SEQ ID NO: 2570 - RNA, 63 nt, Satsuma dwarf virus
agcuuauugaaacgggcgauacuauuagugacuuguuaucuaauucgaccguuucguugagcu

SEQ ID NO: 2571 - RNA, 111 nt, Satsuma dwarf virus
gagcuuaauauagcuacugcucuaugugaggcuuucuuucaugguaaggaguauuuuuccuuucuagaggggaaaauuauagaagccaugcgcaagagcggcguagcucuc

SEQ ID NO: 2572 - RNA, 69 nt, Satsuma dwarf virus
gauuuuuugaagaggcaauuuguugcagacucuggauccacugcaauucuuuguccucugaagaaaauc

SEQ ID NO: 2573 - RNA, 74 nt, Satsuma dwarf virus
ggugcugagcuugaugcggcuauucuugauagguuuucaauaccuaucagugaaugucguaaagaacucacgcc

SEQ ID NO: 2574 - RNA, 63 nt, Satsuma dwarf virus
uacgaaaggcaagguuuauauuauggaguguuuagaacuuguuaaagccaaauugccuucgua

SEQ ID NO: 2575 - RNA, 75 nt, Apple latent spherical virus
auugaucugugguggcauguuauggaucguuaugugcguaauuacagagcuaccaaauaugucacuaaagacaau

SEQ ID NO: 2576 - RNA, 109 nt, Apple latent spherical virus
auugccacagugcacuuucucgagcugcccucuuugauaugcaaagaguuccucccuuuuggauacauuuguauucagagaauggcggcacaggaaaguccauggcaau

SEQ ID NO: 2577 - RNA, 75 nt, Apple latent spherical virus
cgagucuaggagcaguucuaggggucuuuucacucuuaagggugaagguuggacuccagcugcuuugaaagcucg

SEQ ID NO: 2578 - RNA, 121 nt, Apple latent spherical virus
gaaugcguuucaaaucucaaagauaaauguguugguaugauaaacgaucauuggcuugcuuuugcagcagguucaacacuuguuuugacccucauauuucuuuuugcgaugauuugcauuu

SEQ ID NO: 2579 - RNA, 62 nt, Apple latent spherical virus
ggaugagaaaguugauucuucuaaaguguacauaaaacaaaaaacucgacuuuuuacuaucc

SEQ ID NO: 2580 - RNA, 70 nt, Apple latent spherical virus
uauagauugggugaaggcugguuaucguaaauguaaagaauacuaugauaacaccuucuccaaauuugua

SEQ ID NO: 2581 - RNA, 103 nt, Apple latent spherical virus
ugguuuaacccggagucaaauugcaaaaauucuuaaugcaguuuuuggugguaaccccgaagucugccaaagaauuuuccaauuuuucucucaagucgagcca

SEQ ID NO: 2582 - RNA, 131 nt, Tobacco rattle virus
agaacacauaacgcgacugcuaauucgaugacggugaggaagauugugucuaaagaacagguuucuuugaagccuggugcucaguacauaacuuuccuucagucugagaagaaggaguugguaaauuuguu

SEQ ID NO: 2583 - RNA, 114 nt, Tobacco rattle virus
auggacuggugaaaaaacuaugugauauguuugauaucaaacggggggcccaugucuuagacguugagaauccgugccgcuauuaugauaucaacgauuucuuuagcagucugu

SEQ ID NO: 2584 - RNA, 130 nt, Tobacco rattle virus
ccuguuuguagagaaacaauucauggacaaguguuuggauuacauagcuagguuaucugaccagcagcugaccauaagcaauguuaaaucauauuugaguucaaauaauugggucuuauucauaaacggg

SEQ ID NO: 2585 - RNA, 131 nt, Obuda pepper virus
cgguggaugugacccauuucuuaaaucaauguuacgauggugcugucacgacaacuucuaaaacucagagaucuguagguuuggaagugguagguggugcugcuguaaugaauccggucacuaagccgcug

SEQ ID NO: 2586 - RNA, 130 nt, Obuda pepper virus
cugaaucacaucagaacauaucaggcuaaagcacuaacauacaauaauguuuuauccuucgucgaaucaauuagaucgaggguaaucauuaauggaguuacugcgagaucugaaugggauguagauaaag

SEQ ID NO: 2587 - RNA, 87 nt, Obuda pepper virus
gcgaugagguaguaugcaauaauacuuuccaaugcugugaaagcaacagguacaguucaggagguagaguuuaugcuauuuccuugc

SEQ ID NO: 2588 - RNA, 130 nt, Obuda pepper virus
gcugaaucaguuauuaguaacaagauggcaucgauaguauacuccggaccgcuacaagugcaacaaaugcaaaacuauguagacagucucgcagcaucucuaucggccacuguuucuaaucugaaaaagc

SEQ ID NO: 2589 - RNA, 91 nt, Sugarcane striate mosaic associated virus
cugcugcgugagguuuauucuuaaaaauucaaaacuucuucgcucugaugugaagaaguucuuuaaggacgggcuccagcuuacgcaguag

SEQ ID NO: 2590 - RNA, 131 nt, Sugarcane striate mosaic associated virus
gacuggagaguuugaugacuuucuucaacauaggggcugaaguccaggaaaauggucacaaguuuauuuugaacgagaauggcaguagggcucgaagcuucauucuggagaauaaucauauugaauuuguu

SEQ ID NO: 2591 - RNA, 64 nt, Salmon pancreas disease virus
ucguugauguguaugacgcucugccgauuucuguagagauuagcaccgucguaacaugcagcga

SEQ ID NO: 2592 - RNA, 131 nt, Salmon pancreas disease virus
uggugccguccccauguccaucaacauuccggacgcgaaguuuacccgcaaauuaaaggauccgaaaccaucggcccugaaaugcgugguggacagcugcgaguacgggguggacuacgggggcgccgcca

SEQ ID NO: 2593 - RNA, 70 nt, Ljungan virus
aaucaauggcgagugugcaugcaggacuaugaaguggcccugcaucgcaugcuacgcuauguuuuugauu

SEQ ID NO: 2594 - RNA, 129 nt, Ljungan virus
cagccuuucugaacaacugaugagauauggaguggaaauacuugccuacugucaugaacaaccagaggcuguaaugauucuucaugaaccuguuauaaacucucaacaccuugugauggaugaaaucug

SEQ ID NO: 2595 - RNA, 62 nt, Ljungan virus
gagcaaaugacacuuuguguacccuauuauucugagguuccauuaagauguguuaaagguuc

SEQ ID NO: 2596 - RNA, 69 nt, Ljungan virus
uuucuguuucauccccuuuggaugcugaauacuugguucagagugcagcccaaaauuuuggaauggaag

SEQ ID NO: 2597 - RNA, 99 nt, Equine rhinitis A virus
cuguuuccgccgggccugacuucucgcuccgacauccuguugacuugccugacaagcaggucacaaaugugggagaggauggcgagcccggugagacag

SEQ ID NO: 2598 - RNA, 80 nt, Equine rhinitis A virus
guacagaggaucauuaaauuuuaacuuuauuuucacuggagcugcagcuaccaaggcaaaauuuuugguugcuuuugugc

SEQ ID NO: 2599 - RNA, 64 nt, Equine rhinitis A virus
uucauugauuguuauuuuuugucugguguacucaauguaucagauuuuuaaaaccccagaugaa

SEQ ID NO: 2600 - RNA, 103 nt, Equine rhinitis B virus
cucgggagugaaaacuuaucaggaauucucgcgcaaacacaaaccugugcgccaaccgguguacaacgcgugggaagacuuugaugaggauugcauuuuugag

SEQ ID NO: 2601 - RNA, 98 nt, Equine rhinitis B virus
gaagauucaggugcagugcaaugccagccaguuccacaguggcugccuuuugguugccaugauuccugaguaccuuagcacugcacaacaggauuuuc

SEQ ID NO: 2602 - RNA, 88 nt, Equine rhinitis B virus
gcaguaugagaguagucagacaucccaugacagcgcgacgcgcccaacgcgucauugacaugggauacucugauuaugaaaccgcugu

SEQ ID NO: 2603 - RNA, 98 nt, Equine rhinitis B virus
gcugcgugccgcagcguaugaugucuucaccaauuacgaagagggcgaucucgcuuuucuuacguauggugaugauguacuacucugugcuaaucagc

SEQ ID NO: 2604 - RNA, 111 nt, Equine rhinitis B virus
guguugcauuccuuucuggcauucauggucgaaagcaauccauucuuaagaaaaucaaggagugguucgcggacggcgugcgugucagaaaucuucuuggagaugcagcau

SEQ ID NO: 2605 - RNA, 69 nt, Equine rhinitis B virus
uuuggcucaacuuucuuacaaaacuuuuuggcaauauuugaccaaaccuuuugcagaugcugggcugaa

SEQ ID NO: 2606 - RNA, 92 nt, Porcine enterovirus A (PEV8)
ggcaagucaggaagugauauuacaaaguuuaaagcuuuuaccuauuggagauuugauuuggauguuguaguaaugauacuggaagauaaacc

SEQ ID NO: 2607 - RNA, 107 nt, Porcine enterovirus A (PEV8)
guugauuugcaugaagccaucuuugcaaaauacaagggcaauguugaugccacacuuccagaagaggcccuuauagcaauagaccauuugguuuccaaauuuaaggc

SEQ ID NO: 2608 - RNA, 71 nt, Porcine enterovirus A (PEV8)
ugguuucuguggagcuggauuaauaucuaaagguaaacuguaugguauaguuacagcuaagacugaaagca

SEQ ID NO: 2609 - RNA, 77 nt, A-2 plaque virus
acaugccagaggcagcaaggccaugugaugaggagugcuacccuuguaauuuuaagagauguuguccacugguaugu

SEQ ID NO: 2610 - RNA, 68 nt, A-2 plaque virus
caguagucaaugcaguaaacuugguugacccagaaggagucaaucuugaaauuaccguauugacacug

SEQ ID NO: 2611 - RNA, 97 nt, A-2 plaque virus
ucaguauauggcagaagcaauugaugauuaugccaguaauuuauuaucauuaggaauaaauacugaaccaaauucaauggagcaggcuguauaugga

SEQ ID NO: 2612 - RNA, 78 nt, Avian encephalomyelitis virus
agaugaguuuccuaaagagaacauucuauguggaugagugguccaucugucauccgcguauuucugaggagacuguuu

SEQ ID NO: 2613 - RNA, 129 nt, Avian encephalomyelitis virus
caauguaguaggauauggaagacugaguuuguggaagagaagauaucuguggggucuaaaacgaaguaccacaaguccccuuuauaugauuuuuguccacaggagguuauuaaaugucccacuaaguug

SEQ ID NO: 2614 - RNA, 61 nt, Avian encephalomyelitis virus
cauugagagagcagggaccauuuacucgaccaacaugaagaugguccaaguuuuguucuug

SEQ ID NO: 2615 - RNA, 64 nt, Avian encephalomyelitis virus
ucacugacacaucuagcaaaacagugaugaauacauauuggcuugaugaugacgaguugguaga

SEQ ID NO: 2616 - RNA, 130 nt, Tamana bat virus
auaaacaggggccuguagggaacaucauguuggcauugggauuaauuuguuugcuuaccuauuacuuugaagugguagcagcugacaaguauguucuaaugguugauacugaugacauguccuugagugu

SEQ ID NO: 2617 - RNA, 95 nt, Tamana bat virus
auuauggcauguugccaggaaggccucguuccgauggggaagguuaaagagccuuugauuuggggcgaaccauggcuggacagcauggacauagu

SEQ ID NO: 2618 - RNA, 129 nt, Tamana bat virus
gacuuuuugccauauugagcauguugauagggguugggauaguggcuguuuuauauuuggcaaaggagaaguugucacuugugcagcaguaacuuacucgaaaccuuuuuaugcuuggaugguugauuc

SEQ ID NO: 2619 - RNA, 67 nt, Tamana bat virus
gucaauugucucaauaacaguguucuuuugcgggagcaugaagaauacguugguaacugcaacagac

SEQ ID NO: 2620 - RNA, 106 nt, Tamana bat virus
uggguugauuguaacacucaugauuaugaauuaagcuuuuggacaucagcauugaucacaacaaaaagccgaaguuaugaacauaaaccuugcaaaauucaaccua

SEQ ID NO: 2621 - RNA, 112 nt, Tamana bat virus
uuaaggaugugacugaaaaugucaugauacaugagaguggauuugagacauuuaagaaaguggcuaaaaugcucaccacuccaguagugggcuucuucaagagcauccuugg

SEQ ID NO: 2622 - RNA, 98 nt, sheeppox virus
uauaauugauauaauaaaaggaucuaaauauucacacccuucaaagauagaacauggcguuauuuuuaagauaucaccuguagauuuuaucgaauaua

SEQ ID NO: 2623 - RNA, 63 nt, Goatpox virus
uauucuaguagaggaacuaauguuuuuauaucuuuacuuauaaguaauuucuuuacaggaaug

SEQ ID NO: 2624 - RNA, 81 nt, Foot-and-mouth disease virus O
cgggaaagccgacggugacgcccuggucgugcuagcuagugcuggcaaagacuuugacuugcgucugccggucgacgcccg

SEQ ID NO: 2625 - RNA, 84 nt, Foot-and-mouth disease virus O
gcccccaccaauguucacgucgcgggugagcuccccucuaaagaggggauuuuccccguggcaugcagcgaugguuacgguggc

SEQ ID NO: 2626 - RNA, 65 nt, Foot-and-mouth disease virus O
ggccgcuguggcagcacgguccaaggacccaguccuuguggccaucaugcuggccgacaccggcc

SEQ ID NO: 2627 - RNA, 107 nt, Foot-and-mouth disease virus O
gucuggaacaucaagcacuugcucuacaccggaaucggcaccgcuucgcgacccagcgaggugugcaugguggacgguacagacaugugcuuggcugacuuccacgc

SEQ ID NO: 2628 - RNA, 70 nt, Foot-and-mouth disease virus O
uugaccacccguaacggccacacgaccucgacaacccagucuagcgucggggugacuuacggguacgcaa

SEQ ID NO: 2629 - RNA, 129 nt, Cowpea aphid-borne mosaic virus
cagaauucauagcaacagaggcagcuuuucuuucauuugcuuauggauugccagugaccacacaaaauguaaccaccaacauccuaaguaaaugcacuguacagcaagcaaagaaugcgcucaauuuug

SEQ ID NO: 2630 - RNA, 69 nt, Cowpea aphid-borne mosaic virus
gaauggggaggaagacucggaacuucauucacauguauggagucgagccugaaaauuauuccaccauuc

SEQ ID NO: 2631 - RNA, 98 nt, Cowpea aphid-borne mosaic virus
gccguauuuaucuugcgaauaagguagagcaguucucacauaggcuuauagguaguguguguaauauguuuuugagauuuguucguagguguuauggu

SEQ ID NO: 2632 - RNA, 72 nt, Cowpea aphid-borne mosaic virus
gggugaggguguggcaagaaaaccacugacaaaagcauguguuucgguucuugagaaaaacuuuguuuaccc

SEQ ID NO: 2633 - RNA, 78 nt, Cowpea aphid-borne mosaic virus
ucaggagagguuaguuuucuuugcuaauggugaugauaucauauuagccgcacaagaaaaggacauuggcauucuuga

SEQ ID NO: 2634 - RNA, 113 nt, Cowpea aphid-borne mosaic virus
ucuuagaauguucuuuauggaagauugguggguuggacaagagaugcuugaaaaucuauaugcagagauaguguucacacccauccuuacaccagauggaacuguuguuaaga

SEQ ID NO: 2635 - RNA, 70 nt, Cowpea aphid-borne mosaic virus
uuguuggaaaaauuuucaguaacauggcaauugaagagauuuucagauguuacggaaaauacuuugacaa

SEQ ID NO: 2636 - RNA, 93 nt, Trichomonas vaginalis virus 3
gaacaaggaaauggagcucgaacucuucccacuuaagaaggccccacaagccgaucuuaaagugaacuguuacgcgcgaaacguccuugcuuc

SEQ ID NO: 2637 - RNA, 83 nt, Trichomonas vaginalis virus 3
gauacccuacccuaugaauuaaacaagagcaaacagagcuuuggaccuaaugccgaguucuugcgcuugcauaggcgugcggg

SEQ ID NO: 2638 - RNA, 64 nt, Sorghum mosaic virus
aaccaauugugcaucauugagaaucacucgaacgaugugagacaauguauguaugcgauagguu

SEQ ID NO: 2639 - RNA, 71 nt, Sorghum mosaic virus
cuucaauuuagcacguuaugcuuuugauuucuacgagaucacaucacguacaacagcccgugcuaaggagg

SEQ ID NO: 2640 - RNA, 92 nt, Sorghum mosaic virus
gcagaguuaaucguacagcaaauguccauacuggagaaggccucaacacagcuuagauucgcaguaucagggauuagccauguugacccugc

SEQ ID NO: 2641 - RNA, 75 nt, Sorghum mosaic virus
gcagccguacaaaaagaauaugaacuugaugacacacaaaugacaguuguuaugagcggacuaaugguauggugc

SEQ ID NO: 2642 - RNA, 73 nt, Potato virus A
caagugucaaacuucuuaggauuagaaggacacuggaagaagucccuaaucacaaaggacuuguugauaguug

SEQ ID NO: 2643 - RNA, 114 nt, Potato virus A
cacuggaggagcaagacagcgucugugcauacggcguuaauggugaugaucugcuaauugcaauuaggccagauauggagcauaagcuagauggauuucaagcucuauuuagug

SEQ ID NO: 2644 - RNA, 67 nt, Potato virus A
gacuugucaaaugcuagagccacccacgaacaauuccaaaacugguaugauggcguuauggcaaguu

SEQ ID NO: 2645 - RNA, 77 nt, Potato virus A
gagaguauugugcagaagugguucuguuucaagcaaaggcgucugagcagguuaauuuugagcgcaucauagcuuuc

SEQ ID NO: 2646 - RNA, 69 nt, Potato virus A
gagauucgaguugaggaccaagugaguuuucaggacuucgucaaagcucaagggaauggaucgaaucuc

SEQ ID NO: 2647 - RNA, 79 nt, Potato virus A
gcgaacuucuagaaaaaacuuacuugagccuguuggaggauucauggcaagaguuaagcuauuuuggaagauuucaagc

SEQ ID NO: 2648 - RNA, 100 nt, Potato virus A
ugcugcuggagaggcacuucuugguuacuaaaguggauggucgaucuaugaagcuuggacaaguugagaucaucaccaagggcagugcuaacaaaaagca

SEQ ID NO: 2649 - RNA, 66 nt, Potato virus A
ugguaaaguucaucaauacaauguuagcuauaacaguggcacuacaauuguacauagcauuugcca

SEQ ID NO: 2650 - RNA, 120 nt, Cryphonectria parasitica mitovirus 1-NB631
guaaaucuguuaucucaagugaauuuacugaauuugcaaagaaguugaaaggucgaaauaauuucgacauuuucuaucggagcugguuuaguauuauucacuuugagaaacaaauauuac

SEQ ID NO: 2651 - RNA, 76 nt, Cryphonectria parasitica mitovirus 1-NB631
ucauggcguuccuuauuacguauuaaguacaaaagcccacaaggcuuucugacuuaugcgguagggcaacccaugg

SEQ ID NO: 2652 - RNA, 130 nt, Cryphonectria parasitica mitovirus 1-NB631
uucgguucauagaguauugccuacuaagguaguuccugauuauaguacuauuguugaucccuuuacagggguuucaaagacuauagaucagaagcuucuuaggaaagcaauacaucuauugaauaucaaa

SEQ ID NO: 2653 - RNA, 76 nt, Bean common mosaic necrosis virus
gagaugaggaauucugaaggguucuacaugccuagguauggacuucuucggaauuugagggauaaaagcuuggcuc

SEQ ID NO: 2654 - RNA, 121 nt, Bean common mosaic necrosis virus
ggguuuaaaaggaaaaugggauggaaagaaguucuuuaaugaugucgugguugccaucuucacauugauuggugguggcuggauguuaugggauuauuuccgucacuauaugcaagaaccu

SEQ ID NO: 2655 - RNA, 127 nt, Bean common mosaic necrosis virus
ggugaaucgauuaagagagaagaucugacgcuugcuugcguaucaaagcaggaugggaauuuuguauacccgugcuguugugucacgcaggaugauggcagaccguucuauucugaguugaagagcc

SEQ ID NO: 2656 - RNA, 130 nt, Bean common mosaic necrosis virus
guccgccuugccaaggacuauugccauuuuggaccacuuaauaagugaggaaaucaugaagaaaaaucauuuugacacaauuagcuccucacucacagggcauucauuuucauuggcuggcaucgcagau

SEQ ID NO: 2657 - RNA, 82 nt, Ophiostoma mitovirus 3a
aaugccuuguguacuuaaguuagagucaaucacagauccuuuuaaagggauuucugauacucuuccuaaguccgagaucauu

SEQ ID NO: 2658 - RNA, 77 nt, Ophiostoma mitovirus 3a
cugaauaguugagucuuuaguaaauuaaaggaccuuccaauggaugguacauuuaaucaacaagcuccacuaaacag

SEQ ID NO: 2659 - RNA, 80 nt, Ophiostoma mitovirus 3a
cuuacgaauaaugauuuaucuaauguuggauauauaacuaaacaguuauuuccucauugaauaagauuauuaguaugaag

SEQ ID NO: 2660 - RNA, 82 nt, Ophiostoma mitovirus 3a
cuucuucaccguuauacucuuucauaagagggcaguuuggaaacaaacuuuccgcucuugugcaagauaaaccggugagaag

SEQ ID NO: 2661 - RNA, 74 nt, Ophiostoma mitovirus 3a
gacucccuacuauaauaccgggaaccuuaagaacucuuuugagaucuaaggauucuaguacuauaaggggaguc

SEQ ID NO: 2662 - RNA, 65 nt, Ophiostoma mitovirus 3a
guaaguccguuauucccuacucuucuuucuuuuauaggaaggaugaauagagguaacguucuuau

SEQ ID NO: 2663 - RNA, 75 nt, Ophiostoma mitovirus 3a
ucaucauguaauuguacaaauagcugcaaugagaguugguaaacucccauucacuaauuaugcguuacuugguga

SEQ ID NO: 2664 - RNA, 75 nt, Ophiostoma novo-ulmi mitovirus 4-Ld
aaggaaucuuaacuaauauuagacauauucauguuguauauaugaauauauuuacauauuuacaaagaauuccuu

SEQ ID NO: 2665 - RNA, 81 nt, Ophiostoma novo-ulmi mitovirus 4-Ld
acugauaaugaucauuaucuaagcauaaaagguucuccaaauggaaaagcuucaaugucuagucuauauucaauuaucagu

SEQ ID NO: 2666 - RNA, 93 nt, Ophiostoma novo-ulmi mitovirus 4-Ld
agaaaaaguaaugguuuauuauacacuaucaaguauaugaaagcugcaaagcuucauauaacaagauauaugugugguaaaccauuauauucu

SEQ ID NO: 2667 - RNA, 86 nt, Ophiostoma novo-ulmi mitovirus 4-Ld
agucuaauaugaugucuagaauuugagauauggccuugucuuauaggacgaguccaaugucauauucuacacuaacauucgagacu

SEQ ID NO: 2668 - RNA, 86 nt, Ophiostoma novo-ulmi mitovirus 4-Ld
gauagauuuccaauauucuuacaacaaaaacuuauaucauuaauauuuaaugauuaugaguuugguaaaaauuggagaaaucuauu

SEQ ID NO: 2669 - RNA, 84 nt, Ophiostoma novo-ulmi mitovirus 4-Ld
guuuuauaugaugccuaguauuugagauauggccucgucuucaacaacgggaccaaagccauuuacuacugcaacauucaaaac

SEQ ID NO: 2670 - RNA, 96 nt, Ophiostoma novo-ulmi mitovirus 5-Ld
auaauccagaauuacaaugaaguagagaugaucauuauuugaguuuuaaaagcucgccuaauggucaaucuacauuacauaguagcuauggauuau

SEQ ID NO: 2671 - RNA, 87 nt, Ophiostoma novo-ulmi mitovirus 5-Ld
guuaagagguauuuuaaauaaucuaaauaacuauggaauuguauuccaagaauuauuuaaauuucauuauaaauacccacauuuaac

SEQ ID NO: 2672 - RNA, 101 nt, Ophiostoma novo-ulmi mitovirus 5-Ld
ugagaaagauaaauggucuuaaauucacaauuaaguauaugaaagcuguuaagcuucauauuacuaaauauauugcaaaugaaagauuauuaucgauuuca

SEQ ID NO: 2673 - RNA, 115 nt, Southern bean mosaic virus
cauagaaguucaaguaaaccccucauggauuagccucuuagguggcucucucaagauaaacggagaugacgccucuaaugagucugcuguguugggaagcuuuuauucuucugug

SEQ ID NO: 2674 - RNA, 119 nt, Southern bean mosaic virus
cugggaguugugggcugauguagagaugagaauuguucuggggggcuuuggccauaaacuggcuaaagccgcccagaauagguuuucguguuucaugaacucagucuuccagcucucgg

SEQ ID NO: 2675 - RNA, 74 nt, Southern bean mosaic virus
ucugcucugguugagcgcgucauucgcgacauaccuuuauaaguaugugagaacucggcugcucccagaggaga

SEQ ID NO: 2676 - RNA, 77 nt, Phthorimaea operculella granulovirus
auuuuuauauuguauugaauagcguguggguauauuguuauacggcgcuuaacaugaaauccauacaauaugaagau

SEQ ID NO: 2677 - RNA, 125 nt, Phthorimaea operculella granulovirus
gaauuugaauuuguaaauacauugggugagagaaugagucguucgcaaauauauggagauuacauuguauggccagauaugagcacuacuuuuaucggauggauguuauauuugcguuuaaauuu

SEQ ID NO: 2678 - RNA, 113 nt, Phthorimaea operculella granulovirus
gaguaugaucgauuaaacaaauugguacaaaauaauccgucuguguggcaagauuuauuguuggugugcacagaucgagacaauauguacacauggauggucagauuuuauuu

SEQ ID NO: 2679 - RNA, 61 nt, Phthorimaea operculella granulovirus
gcgauuuguuguuaauuguuuugcgcaaagaacagacguguuuacaguugauucaaaaugu

SEQ ID NO: 2680 - RNA, 93 nt, Phthorimaea operculella granulovirus
gcgugagggaguuuuuggcaaacguuuugcguuacaauugcgacgaugagggacaauugcgcuacaaacguuugcugaucgacgaccccacgu

SEQ ID NO: 2681 - RNA, 63 nt, Fringilla coelebs papillomavirus (FPV)
gcucuauagcuuaccauuaugcuauacaugcugagcaagauaauaaugccaagcuaugguugc

SEQ ID NO: 2682 - RNA, 79 nt, Paprika mild mottle virus
acgucgauccucuaaagauaaucucuaaguuaggugcuaagcauauaacagauagggagcaucuggaagaguuucgugu

SEQ ID NO: 2683 - RNA, 123 nt, Paprika mild mottle virus
aguaaucuucuuaaauauguuuguaaaacuuauuucccagcgucuaguagauauguauauaugaaggaauuucuaguaacuaggguaaauacuugguuuugcaaauucacuaaacuagauacu

SEQ ID NO: 2684 - RNA, 129 nt, Paprika mild mottle virus
cuuaaucacaucagaaccuaucaggccaaagcacugacauacaauaauguguuauccuucgucgaaucaauuagaucgaggguaaucauuaauggugucacagcgaggucagaaugggacguggauaag

SEQ ID NO: 2685 - RNA, 98 nt, Paprika mild mottle virus
gguuauucauagacgaagguuugauguugcauccaggcuguguuuacuuuuuaguaacucuaagucugugugaugaagccuuugucuuuggagauacc

SEQ ID NO: 2686 - RNA, 131 nt, La Crosse virus
aaccuucaaacucauauugcuuucaaaguccuuacaaagcauaaaagguauaucaacuuacacagaagcguucaaaucuuuaggaaaaaugauggauauuggagauaaggcuauugaguaugaagaauucu

SEQ ID NO: 2687 - RNA, 93 nt, La Crosse virus
gguguauuagaugcuccauugucaaugauuaguacaguuggauuggaaucugggaauuuauacuucuugauaaaguuguugagcaaauauacc

SEQ ID NO: 2688 - RNA, 81 nt, La Crosse virus
uucuagaugcagagauggacccuagugauauuaugggugagacaagcgacaugagagggaggucuauuuugacaccuagaa

SEQ ID NO: 2689 - RNA, 101 nt, Mamestra configurata nucleopolyhedrovirus B
cugagcuauaguaaaaacgaaacacccguugucaaauacaacaagagccauaacaacaauuguguguuugucgaggguggcaauaugcuacauauggccgg

SEQ ID NO: 2690 - RNA, 89 nt, Mamestra configurata nucleopolyhedrovirus B
uuuuucguauaccguacauguucuucaauaacacuccggacaacauuuucaaagaguuuauuaaaggcaacuauacgggacacgaaaaa

SEQ ID NO: 2691 - RNA, 127 nt, Heliothis zea virus 1 (HZV-1)
gauucguaauguucaaggcugugcuguacaagugcauucaacuggaccgacagacugcaucgauugacgaucgcauucucuccaaguuugagugcaucuuggacgaugccaccgagagcuacgauuc

SEQ ID NO: 2692 - RNA, 93 nt, Heliothis zea virus 1 (HZV-1)
augccgcguaccacugucuaaacucuagucaaaagguggccuuucagauuauacacaaacagauuagcgauagcuuuagauuggacacggcau

SEQ ID NO: 2693 - RNA, 109 nt, Heliothis zea virus 1 (HZV-1)
guacuguagacguaaagcgggaggcuccuuugaagcgguagcguugccucaaaacuacaaguuugcaccgcuacucguacucauacagggcuacucguacaucaaguac

SEQ ID NO: 2694 - RNA, 109 nt, Heliothis zea virus 1 (HZV-1)
cgaguccaauacuauuguugaaaauguugguguagagggugauuuuaacaaggagaaucuugcuccuuccgguaaagaguccaacauugaaacgguagcauugggcucg

SEQ ID NO: 2695 - RNA, 123 nt, Heliothis zea virus 1 (HZV-1)
gagcacgguaccaucaagacuccauccgaugguaaacugaauguaaucauuugucgcaauguguuggauuugaacaauauuacaucgguggaccaagugauggaugucuugauggacgaguuu

SEQ ID NO: 2696 - RNA, 88 nt, Heliothis zea virus 1 (HZV-1)
guuguucuuguuacgauaauguagaguccccggagcuuacaguagagacuccauccgagucuacaucuaauguaaaugcugagucgac

SEQ ID NO: 2697 - RNA, 123 nt, Chikungunya virus
gaucgucugacaaaauccgcgugcgcagccuucaucggcgacgacaacauaauacauggagucgucuccgaugaauugauggcagccagaugcgccacuuggaugaacauggaagugaagauc

SEQ ID NO: 2698 - RNA, 80 nt, Chikungunya virus
ucuggcaagucagcuauuaucaagaaccuaguuaccaggcaagaccuggugacuagcggaaagaaagaaaacugccaaga

SEQ ID NO: 2699 - RNA, 91 nt, Mammalian orthoreovirus 2
ccucacgaugagcgacucgggaaguuguaucaaucuuuccugccacuugcgaaggauuuacuggccccaguugcucggcauuuuuaugagg

SEQ ID NO: 2700 - RNA, 85 nt, Mammalian orthoreovirus 2
gauaggugcagugcuuccaaaaggaucuuucaaaucgacgauuaugcgcgugcuugaugagauggaagugcuuggugugcguauu

SEQ ID NO: 2701 - RNA, 95 nt, Mammalian orthoreovirus 2
uuugaugcaagauggguggugcgggugugaggacggauuuaucacguacguuguuauccgagcgccgaagcuggucuuagaggaguugcgugaga

SEQ ID NO: 2702 - RNA, 112 nt, Tacaribe virus
uuucugaugaugagaugacaggcuucauuagaagcugugcuaaaaggguuuuuaaugauauaaaaagaggcaaaguuuuugaggaaaaccugaucagucuuauugguagaga

SEQ ID NO: 2703 - RNA, 130 nt, Rachiplusia ou multiple nucleopolyhedrovirus
gauccggcuuucaacagaaauuuaaaugacgagcgauuccaaaacuugaggcaacaauacgacgaaaugucuaguaaauauucagcuuuggaaacgacuaaaauuaaagagauggagaauaucgcagauc

SEQ ID NO: 2704 - RNA, 76 nt, Rachiplusia ou multiple nucleopolyhedrovirus
gcagaauuguuagaaaauguugcugucacaagcgcuguaagcgcuuuaguacagcaauaugaacgaucagaaaagc

SEQ ID NO: 2705 - RNA, 131 nt, Aphid lethal paralysis virus
acacaucgcaaaccacucugacuuaacuggugcugcuuuaauauauuacguucgcaacggaauccccucaggaugcccugcaacugcuauauugaacaguaucguuaaucauuguugucuugcugauucgu

SEQ ID NO: 2706 - RNA, 130 nt, Aphid lethal paralysis virus
cacuuuguguuggagaauuguaguaaugcuaucucaccguugaucccaugcucgguuauucuugaacaagaaaaccauguuaaggauccucguagagacauugccauuguacaauuacccacaaauauug

SEQ ID NO: 2707 - RNA, 131 nt, Aphid lethal paralysis virus
cgugugucuguugacucguuucuaucaaggauuuaaaacagccgaucuuuaugauaugacuaagcaaauuaguaauacuuugccuucuaucaucaagaaucccgaacugaaacgacuaaucgacucacacg

SEQ ID NO: 2708 - RNA, 89 nt, Aphid lethal paralysis virus
cguguugaugcuguuuaugaagcaaugaguguauucuaccaacgugaauauauuaacucuccugcacauuauaaacugccauuaacgcg

SEQ ID NO: 2709 - RNA, 125 nt, Aphid lethal paralysis virus
cucgaauggugacaaaaauaggagcacaggccccgguauacgauaaccguguaacaauuaagaagaacacaaucuuagcugcacagaaucuauuacccgcuuuugccaaaauugaaccaaucgag

SEQ ID NO: 2710 - RNA, 83 nt, Aphid lethal paralysis virus
gcucuuggauccgcagguauugcuucuagucuuguugcacaacucguaacaucgcuuagagcauauuuuguggcaccaauagc

SEQ ID NO: 2711 - RNA, 128 nt, Aphid lethal paralysis virus
uacccgcauguaaaggaugugauaacugcucuccuaucgaugcucaacgaucuuugccugaacaagacaaagguucgauugucaucgcuagagacguaguuuaccgcaaucuuuucagauucacggug

SEQ ID NO: 2712 - RNA, 106 nt, Aphid lethal paralysis virus
uauggugaucaacguguaucuaacaaucacgagcuaucuguaucagauauggcugaaauuaucaaccaagucgcagauugugauuguaauacaugugauugcugua

SEQ ID NO: 2713 - RNA, 131 nt, Aphid lethal paralysis virus
ucagaaucgugguucuuauacauaucaugcuguaacuuucuucggugauugcggaucgauacuuauugcaucgaacgcugcuauuacucagaaaauuaugggcaugcauauugcaggaauuacgcauauga

SEQ ID NO: 2714 - RNA, 76 nt, Aphid lethal paralysis virus
cauauagcacgaacgccauguuuuaucaaaaaauuccaauggacuucuaaugguaaagcuggcgacguacuauaug

SEQ ID NO: 2715 - RNA, 61 nt, Aphid lethal paralysis virus
uugguauuagugcuauuaaugaguuggaaguaaauccugcauuaacucgcacugacaucga

SEQ ID NO: 2716 - RNA, 107 nt, Callitrichine herpesvirus 3
aaggcaccauguuuacuuuuuacuccgggcggccucuuucucaaaccagcgcuucacuguaaaagaucuggaagaggcccuucgagucuuggaaacuucauugccuu

SEQ ID NO: 2717 - RNA, 66 nt, Callitrichine herpesvirus 3
ccggcguucuuuuuuaugacuacaucuucgaggcguuacucugggaucaaucauacggaguuccgg

SEQ ID NO: 2718 - RNA, 79 nt, Callitrichine herpesvirus 3
ccgauggugaugacauagaauggucuaugcuuugucuaaauucaugccugacucagguucucucucauccuacuguugg

SEQ ID NO: 2719 - RNA, 60 nt, Broad bean necrosis virus
cauucugaagugcagaggagacaacaagaagcugugcugaaagaauugcgcuugagagug

SEQ ID NO: 2720 - RNA, 68 nt, Broad bean necrosis virus
gaccaaaggugcgaguuauuugacauuuacucaaaccgagaaagaugagaugaagcaguaucuugguu

SEQ ID NO: 2721 - RNA, 66 nt, Broad bean necrosis virus
guuuguugaugaugugugauacuacuuauuugaugaaugagaugauuaucuaucagaauugcaugc

SEQ ID NO: 2722 - RNA, 87 nt, Broad bean necrosis virus
ucuugaguauacgacugaugacuuugaagaaaaugcugcugauaacuuuguuggagcuuuugauaauauuauucagcuugcugaaga

SEQ ID NO: 2723 - RNA, 95 nt, Broad bean necrosis virus
uguauaugaagauuacgacaguguggagauugauuuuagaaaauuugacaaaucuaaggugucccuccauaucaaaguugugauugaauuguaca

SEQ ID NO: 2724 - RNA, 82 nt, Broad bean necrosis virus
uucuccgauuaguaauauugaagccucucagaggugguggcagaaucaaucugagcaggcgaagaaacaauugaucgcagaa

SEQ ID NO: 2725 - RNA, 111 nt, Broad bean necrosis virus
guuuuugaaugaucuugaguauacgacugaugacuuugaagaaaaugcugcugauaacuuuguuggagcuuuugauaauauuauucagcuugcugaagaagaagaaaaagc

SEQ ID NO: 2726 - RNA, 24 nt, Human herpesvirus 7
uggaaugaaauguaaauccguuac

SEQ ID NO: 2727 - RNA, 22 nt, Human herpesvirus 7
uuaguaguaauacaucgaaaag

SEQ ID NO: 2728 - RNA, 24 nt, ictalurid herpesvirus 1
ugauguacucgggggggaugccuu

SEQ ID NO: 2729 - RNA, 24 nt, Invertebrate iridescent virus 6
ugaggaaaaugaagauguauaccu

SEQ ID NO: 2730 - RNA, 24 nt, Invertebrate iridescent virus 6
uguuaugaaaaugaaauuuguaua

SEQ ID NO: 2731 - RNA, 24 nt, Invertebrate iridescent virus 6
ugagaaauauaauuuauaguugug

SEQ ID NO: 2732 - RNA, 24 nt, Invertebrate iridescent virus 6
ugagaauucuugaauaaugauauu

SEQ ID NO: 2733 - RNA, 24 nt, Invertebrate iridescent virus 6
uuggaugaaagaacagcuaauuua

SEQ ID NO: 2734 - RNA, 24 nt, Invertebrate iridescent virus 6
ugaaggacuaagaguagcuaaaga

SEQ ID NO: 2735 - RNA, 24 nt, Invertebrate iridescent virus 6
uucuaugcuugaaaguaauaauag

SEQ ID NO: 2736 - RNA, 24 nt, Invertebrate iridescent virus 6
uauaaagaaucaauugcauuugaa

SEQ ID NO: 2737 - RNA, 24 nt, Invertebrate iridescent virus 6
uauuggaauagguuuuggaauuaa

SEQ ID NO: 2738 - RNA, 24 nt, Invertebrate iridescent virus 6
ugacacaaaacgaaauuaaagauu

SEQ ID NO: 2739 - RNA, 21 nt, Invertebrate iridescent virus 6
uaaccagauaaaaauuuuucu

SEQ ID NO: 2740 - RNA, 22 nt, Invertebrate iridescent virus 6
uauuacccauacuaaaagaucu

SEQ ID NO: 2741 - RNA, 24 nt, Invertebrate iridescent virus 6
uuggugcugcugguacugguccug

SEQ ID NO: 2742 - RNA, 24 nt, Invertebrate iridescent virus 6
ucgggucuuguuaaacaucaguua

SEQ ID NO: 2743 - RNA, 22 nt, Invertebrate iridescent virus 6
uauuacaaucuuuaccgguuau

SEQ ID NO: 2744 - RNA, 24 nt, Invertebrate iridescent virus 6
uuggaugggauauuccuaacauuu

SEQ ID NO: 2745 - RNA, 24 nt, Invertebrate iridescent virus 6
uagcauggauucgagauaauaaac

SEQ ID NO: 2746 - RNA, 24 nt, Invertebrate iridescent virus 6
uugaauguguugaugguauagaaa

SEQ ID NO: 2747 - RNA, 24 nt, Invertebrate iridescent virus 6
uggaaugggaugaucauguugcuu

SEQ ID NO: 2748 - RNA, 24 nt, Invertebrate iridescent virus 6
uaagagauuuaacuuuaauuugca

SEQ ID NO: 2749 - RNA, 24 nt, Invertebrate iridescent virus 6
ucaguuaugggagauccgucaaua

SEQ ID NO: 2750 - RNA, 21 nt, Invertebrate iridescent virus 6
ucaaaugggauugugaaagug

SEQ ID NO: 2751 - RNA, 24 nt, Invertebrate iridescent virus 6
uggaauggcuugcgggauauuugg

SEQ ID NO: 2752 - RNA, 24 nt, Invertebrate iridescent virus 6
ugauggacuucuucucggugaugg

SEQ ID NO: 2753 - RNA, 24 nt, Invertebrate iridescent virus 6
uauuguuuguaaugggguucugaa

SEQ ID NO: 2754 - RNA, 24 nt, Invertebrate iridescent virus 6
uauuaccacagauugacgcacaug

SEQ ID NO: 2755 - RNA, 24 nt, Invertebrate iridescent virus 6
uuuaaauguuauuauuggaagggg

SEQ ID NO: 2756 - RNA, 24 nt, Invertebrate iridescent virus 6
uguacacaugaugaagauuguuua

SEQ ID NO: 2757 - RNA, 24 nt, Invertebrate iridescent virus 6
uacaagaucuaaguagauauccaa

SEQ ID NO: 2758 - RNA, 23 nt, Invertebrate iridescent virus 6
uaauacaaaauaccuccaauagc

SEQ ID NO: 2759 - RNA, 24 nt, Invertebrate iridescent virus 6
uuagguauuuuaacauuaggaugg

SEQ ID NO: 2760 - RNA, 24 nt, Invertebrate iridescent virus 6
uaucgcacccaauauaauuuucac

SEQ ID NO: 2761 - RNA, 24 nt, Invertebrate iridescent virus 6
uaacggaaaguggauauuuuugug

SEQ ID NO: 2762 - RNA, 24 nt, Invertebrate iridescent virus 6
ugccuucuaaaucuauuuucaagc

SEQ ID NO: 2763 - RNA, 24 nt, Invertebrate iridescent virus 6
uacgauguucaguagauauuuuug

SEQ ID NO: 2764 - RNA, 23 nt, Invertebrate iridescent virus 6
ucugacaccagaccugagacagc

SEQ ID NO: 2765 - RNA, 24 nt, Invertebrate iridescent virus 6
uuaggaauuuguuuauguuauggg

SEQ ID NO: 2766 - RNA, 24 nt, Invertebrate iridescent virus 6
aggaacagaaaaagaauuauugga

SEQ ID NO: 2767 - RNA, 24 nt, Invertebrate iridescent virus 6
cguaaugaauguauaccuugauua

SEQ ID NO: 2768 - RNA, 24 nt, Invertebrate iridescent virus 6
ugaaaaagaaagauauagaggugc

SEQ ID NO: 2769 - RNA, 24 nt, Invertebrate iridescent virus 6
ucaggaacuucucguguugcgcau

SEQ ID NO: 2770 - RNA, 24 nt, Invertebrate iridescent virus 6
uacaguuacgggaggaucgggagg

SEQ ID NO: 2771 - RNA, 24 nt, Invertebrate iridescent virus 6
uaugugaaguuucccauuguucaa

SEQ ID NO: 2772 - RNA, 24 nt, Invertebrate iridescent virus 6
uuuguugaaacaaaguccgaauau

SEQ ID NO: 2773 - RNA, 24 nt, Invertebrate iridescent virus 6
uggaagagccguuuauauuucuga

SEQ ID NO: 2774 - RNA, 24 nt, Invertebrate iridescent virus 6
ugagguccuaccaaagcauuauuu

SEQ ID NO: 2775 - RNA, 24 nt, Invertebrate iridescent virus 6
agcccauugucaguuccuccagga

SEQ ID NO: 2776 - RNA, 23 nt, Invertebrate iridescent virus 6
uuaaaccacuacguccgugacca

SEQ ID NO: 2777 - RNA, 23 nt, Invertebrate iridescent virus 6
aggaauugaauuucguuuuaaca

SEQ ID NO: 2778 - RNA, 24 nt, Invertebrate iridescent virus 6
ugugaaauaacaccauuacuuaaa

SEQ ID NO: 2779 - RNA, 24 nt, Invertebrate iridescent virus 6
uauuuuaaugcauuuucuaaauua

SEQ ID NO: 2780 - RNA, 24 nt, Invertebrate iridescent virus 6
uagguucaacagguuuuugauuaa

SEQ ID NO: 2781 - RNA, 24 nt, Invertebrate iridescent virus 6
uguaaacggucuuuuuacuaaaca

SEQ ID NO: 2782 - RNA, 24 nt, Invertebrate iridescent virus 6
gugaugaugaacaugaaacagaaa

SEQ ID NO: 2783 - RNA, 24 nt, Invertebrate iridescent virus 6
uggauugaaacaauggauuaauau

SEQ ID NO: 2784 - RNA, 24 nt, Invertebrate iridescent virus 6
uacaauaaauaagaaucuaaaaug

SEQ ID NO: 2785 - RNA, 24 nt, Invertebrate iridescent virus 6
ugaaaugacaggugagcuugcagu

SEQ ID NO: 2786 - RNA, 21 nt, Maize streak virus
uaucaaagaaccuugagucag

SEQ ID NO: 2787 - RNA, 24 nt, Murine adenovirus A
ugacguauugcgcaacugugcaac

SEQ ID NO: 2788 - RNA, 24 nt, Murine adenovirus A
uauuacuuaugcggagguguugcg

SEQ ID NO: 2789 - RNA, 24 nt, Plutella xylostella granulovirus
uaucauaauccauugauaaaguac

SEQ ID NO: 2790 - RNA, 24 nt, Plutella xylostella granulovirus
ugaguacaauucagaaccuaucga

SEQ ID NO: 2791 - RNA, 24 nt, Plutella xylostella granulovirus
uagcaagcuguuggcuaaaaacgg

SEQ ID NO: 2792 - RNA, 24 nt, Plutella xylostella granulovirus
uacuguaacuacuggaaacuugcu

SEQ ID NO: 2793 - RNA, 22 nt, Plutella xylostella granulovirus
uucacgucgagcgacacgagau

SEQ ID NO: 2794 - RNA, 24 nt, Plutella xylostella granulovirus
ucguuggcuucguaccuaaccauu

SEQ ID NO: 2795 - RNA, 24 nt, Plutella xylostella granulovirus
ugagcuaucaguaaguuguaaauu

SEQ ID NO: 2796 - RNA, 22 nt, Plutella xylostella granulovirus
uacacagacgacaugcuguccg

SEQ ID NO: 2797 - RNA, 24 nt, Plutella xylostella granulovirus
caggagccguuuacgcugauacuu

SEQ ID NO: 2798 - RNA, 24 nt, Plutella xylostella granulovirus
ucacucguuugugugacauggagc

SEQ ID NO: 2799 - RNA, 24 nt, Plutella xylostella granulovirus
ccuggcaaucuaaacuagccauau

SEQ ID NO: 2800 - RNA, 24 nt, Plutella xylostella granulovirus
gagguuaucgcagcuuaucuugaa

SEQ ID NO: 2801 - RNA, 21 nt, Plutella xylostella granulovirus
uuaaaauugauucugauuuuc

SEQ ID NO: 2802 - RNA, 24 nt, Plutella xylostella granulovirus
gagcuuaaacaacaugaacagcug

SEQ ID NO: 2803 - RNA, 24 nt, Plutella xylostella granulovirus
uuagcgcuguguuucucggguggc

SEQ ID NO: 2804 - RNA, 24 nt, Plutella xylostella granulovirus
agucuagaacaaauuauauccggg

SEQ ID NO: 2805 - RNA, 22 nt, Plutella xylostella granulovirus
ucacucguggugucacguggcc

SEQ ID NO: 2806 - RNA, 22 nt, Plutella xylostella granulovirus
uugcugcaacagagccaaaacc

SEQ ID NO: 2807 - RNA, 24 nt, Plutella xylostella granulovirus
uacugcagggaaucgggguucgcu

SEQ ID NO: 2808 - RNA, 24 nt, Plutella xylostella granulovirus
ugaggagauuaugauugaggucgc

SEQ ID NO: 2809 - RNA, 24 nt, Plutella xylostella granulovirus
aaaaauaucaaacauagcaugaau

SEQ ID NO: 2810 - RNA, 24 nt, Plutella xylostella granulovirus
ugcggcaaaucuugaguaaaagug

SEQ ID NO: 2811 - RNA, 24 nt, Plutella xylostella granulovirus
uguaaccguuuucgucuauuaucu

SEQ ID NO: 2812 - RNA, 21 nt, Plutella xylostella granulovirus
gauaacaguuaucuggaauua

SEQ ID NO: 2813 - RNA, 24 nt, Plutella xylostella granulovirus
aaucacgggcgccugauaaaaaug

SEQ ID NO: 2814 - RNA, 24 nt, Plutella xylostella granulovirus
aaagguaucucucugauggacauu

SEQ ID NO: 2815 - RNA, 24 nt, Plutella xylostella granulovirus
ugagggguagcgucguguuggguu

SEQ ID NO: 2816 - RNA, 24 nt, Plutella xylostella granulovirus
uuaccgcccaucagcaacgauaaa

SEQ ID NO: 2817 - RNA, 24 nt, Saimiriine herpesvirus 2
ugggagcaguaaauguacuaugac

SEQ ID NO: 2818 - RNA, 21 nt, Saimiriine herpesvirus 2
ggggaugauuguggucuacuc

SEQ ID NO: 2819 - RNA, 24 nt, Saimiriine herpesvirus 2
uaauacagcaguugggcuuacaug

SEQ ID NO: 2820 - RNA, 24 nt, Saimiriine herpesvirus 2
ugugcaagaaguuauacaagggca

SEQ ID NO: 2821 - RNA, 21 nt, shrimp white spot syndrome virus (white spot bacilliform virus)
uugccagauucucccaacuuu

SEQ ID NO: 2822 - RNA, 24 nt, shrimp white spot syndrome virus (white spot bacilliform virus)
aaaaauguccaggucaauuucuuc

SEQ ID NO: 2823 - RNA, 24 nt, shrimp white spot syndrome virus (white spot bacilliform virus)
uuucaaaggcuuauugugauuucu

SEQ ID NO: 2824 - RNA, 24 nt, shrimp white spot syndrome virus (white spot bacilliform virus)
aagcagcauuaaaaacugccgaag

SEQ ID NO: 2825 - RNA, 24 nt, shrimp white spot syndrome virus (white spot bacilliform virus)
uggguaagaagaucuggaucugga

SEQ ID NO: 2826 - RNA, 24 nt, shrimp white spot syndrome virus (white spot bacilliform virus)
uuacuuggacgagaaaagaaaugg

SEQ ID NO: 2827 - RNA, 24 nt, shrimp white spot syndrome virus (white spot bacilliform virus)
ugcauagcaaggagaaaucucggu

SEQ ID NO: 2828 - RNA, 24 nt, shrimp white spot syndrome virus (white spot bacilliform virus)
agcaguaguaucaauaacgaagau

SEQ ID NO: 2829 - RNA, 24 nt, shrimp white spot syndrome virus (white spot bacilliform virus)
uagauugucuagaugcaguagcaa

SEQ ID NO: 2830 - RNA, 24 nt, shrimp white spot syndrome virus (white spot bacilliform virus)
ucuacuguuuacacuucuguaaag

SEQ ID NO: 2831 - RNA, 24 nt, shrimp white spot syndrome virus (white spot bacilliform virus)
aaaagcaauggguaucaauacaga

SEQ ID NO: 2832 - RNA, 24 nt, shrimp white spot syndrome virus (white spot bacilliform virus)
uguggauaaaaaggugguaaaucu

SEQ ID NO: 2833 - RNA, 24 nt, shrimp white spot syndrome virus (white spot bacilliform virus)
uucaaagcuguacgcaugauacau

SEQ ID NO: 2834 - RNA, 24 nt, shrimp white spot syndrome virus (white spot bacilliform virus)
ucuaaaacggauagguuuuuacua

SEQ ID NO: 2835 - RNA, 22 nt, shrimp white spot syndrome virus (white spot bacilliform virus)
uguuauauguguaggaggagcu

SEQ ID NO: 2836 - RNA, 24 nt, shrimp white spot syndrome virus (white spot bacilliform virus)
caagguauuuugcccucccugucc

SEQ ID NO: 2837 - RNA, 24 nt, shrimp white spot syndrome virus (white spot bacilliform virus)
caggagugguucaagggauccuuc

SEQ ID NO: 2838 - RNA, 24 nt, shrimp white spot syndrome virus (white spot bacilliform virus)
uauuacauuuguuuguuuugacac

SEQ ID NO: 2839 - RNA, 24 nt, shrimp white spot syndrome virus (white spot bacilliform virus)
acgaagaagacgaaaaagauguca

SEQ ID NO: 2840 - RNA, 24 nt, shrimp white spot syndrome virus (white spot bacilliform virus)
ugucaggguuuucaccagaaauag

SEQ ID NO: 2841 - RNA, 24 nt, shrimp white spot syndrome virus (white spot bacilliform virus)
ugauaugucuggagcucugaugaa

SEQ ID NO: 2842 - RNA, 24 nt, shrimp white spot syndrome virus (white spot bacilliform virus)
aacagugccaauguaauggaagcu

SEQ ID NO: 2843 - RNA, 21 nt, shrimp white spot syndrome virus (white spot bacilliform virus)
ucagaggaugaaagggauaug

SEQ ID NO: 2844 - RNA, 24 nt, shrimp white spot syndrome virus (white spot bacilliform virus)
uaccagaaaacaacuucaagauug

SEQ ID NO: 2845 - RNA, 24 nt, shrimp white spot syndrome virus (white spot bacilliform virus)
caucagauggcucaagauauuugc

SEQ ID NO: 2846 - RNA, 24 nt, shrimp white spot syndrome virus (white spot bacilliform virus)
uaauaagauuguccacaucgacaa

SEQ ID NO: 2847 - RNA, 24 nt, shrimp white spot syndrome virus (white spot bacilliform virus)
cuggaacagacguuucugggcaua

SEQ ID NO: 2848 - RNA, 22 nt, shrimp white spot syndrome virus (white spot bacilliform virus)
uucaaugcaugggaaucgugug

SEQ ID NO: 2849 - RNA, 24 nt, shrimp white spot syndrome virus (white spot bacilliform virus)
ugcaaacguauggcgguauagaag

SEQ ID NO: 2850 - RNA, 24 nt, shrimp white spot syndrome virus (white spot bacilliform virus)
ucaccaauuccuuugaguaccggg

SEQ ID NO: 2851 - RNA, 21 nt, shrimp white spot syndrome virus (white spot bacilliform virus)
aucucauaaacacgacagaug

SEQ ID NO: 2852 - RNA, 24 nt, shrimp white spot syndrome virus (white spot bacilliform virus)
aguugguguccuacaucaacgcuc

SEQ ID NO: 2853 - RNA, 24 nt, shrimp white spot syndrome virus (white spot bacilliform virus)
uuuaaaggcaaauuuuggaaaauc

SEQ ID NO: 2854 - RNA, 24 nt, shrimp white spot syndrome virus (white spot bacilliform virus)
uguuauccuuccuacuucugaguu

SEQ ID NO: 2855 - RNA, 24 nt, shrimp white spot syndrome virus (white spot bacilliform virus)
caccugaggaugaagaagaggaug

SEQ ID NO: 2856 - RNA, 24 nt, shrimp white spot syndrome virus (white spot bacilliform virus)
auaggaaacauuuauguguuauua

SEQ ID NO: 2857 - RNA, 24 nt, shrimp white spot syndrome virus (white spot bacilliform virus)
ugaugucaaguucggaggguggac

SEQ ID NO: 2858 - RNA, 24 nt, shrimp white spot syndrome virus (white spot bacilliform virus)
ggacuagauaaggccucauguggc

SEQ ID NO: 2859 - RNA, 24 nt, shrimp white spot syndrome virus (white spot bacilliform virus)
uggcauggaugaugaugaugauga

SEQ ID NO: 2860 - RNA, 24 nt, shrimp white spot syndrome virus (white spot bacilliform virus)
ucguggagcugcuuuaaagguugu

SEQ ID NO: 2861 - RNA, 24 nt, shrimp white spot syndrome virus (white spot bacilliform virus)
gugcgcuuggacgugaaaagcgcg

SEQ ID NO: 2862 - RNA, 22 nt, shrimp white spot syndrome virus (white spot bacilliform virus)
ucuuacaaaacucguauccgag

SEQ ID NO: 2863 - RNA, 24 nt, shrimp white spot syndrome virus (white spot bacilliform virus)
ugaagaauaaggagaagguacagg

SEQ ID NO: 2864 - RNA, 24 nt, shrimp white spot syndrome virus (white spot bacilliform virus)
ugacuggauuacuuagcccugcgu

SEQ ID NO: 2865 - RNA, 24 nt, shrimp white spot syndrome virus (white spot bacilliform virus)
ggaggaacaacaacgacaccaacu

SEQ ID NO: 2866 - RNA, 24 nt, shrimp white spot syndrome virus (white spot bacilliform virus)
uggaaaggguuacaauuuauugua

SEQ ID NO: 2867 - RNA, 24 nt, shrimp white spot syndrome virus (white spot bacilliform virus)
caacagcugcagcauggaauacgu

SEQ ID NO: 2868 - RNA, 24 nt, shrimp white spot syndrome virus (white spot bacilliform virus)
uacggcaucugugaaaaaugugca

SEQ ID NO: 2869 - RNA, 24 nt, shrimp white spot syndrome virus (white spot bacilliform virus)
uuagugaugaugaggaugauauug

SEQ ID NO: 2870 - RNA, 24 nt, shrimp white spot syndrome virus (white spot bacilliform virus)
ucacugcacugcacuaguaguagu

SEQ ID NO: 2871 - RNA, 24 nt, shrimp white spot syndrome virus (white spot bacilliform virus)
uccccagugucgauuuugauagcu

SEQ ID NO: 2872 - RNA, 24 nt, shrimp white spot syndrome virus (white spot bacilliform virus)
gaaguuaugcaaguaauugguacu

SEQ ID NO: 2873 - RNA, 24 nt, shrimp white spot syndrome virus (white spot bacilliform virus)
uuuaaaguugggaaaauuacugug

SEQ ID NO: 2874 - RNA, 24 nt, shrimp white spot syndrome virus (white spot bacilliform virus)
gcgaaucuaugucuguaaagcaag

SEQ ID NO: 2875 - RNA, 24 nt, shrimp white spot syndrome virus (white spot bacilliform virus)
uaagguauacuguauuugucaaua

SEQ ID NO: 2876 - RNA, 24 nt, shrimp white spot syndrome virus (white spot bacilliform virus)
gaaggugcucguguaugguuggcc

SEQ ID NO: 2877 - RNA, 24 nt, shrimp white spot syndrome virus (white spot bacilliform virus)
uaggaucuguaucugccaucucug

SEQ ID NO: 2878 - RNA, 24 nt, shrimp white spot syndrome virus (white spot bacilliform virus)
ugggauauauugacaaguucuucc

SEQ ID NO: 2879 - RNA, 24 nt, shrimp white spot syndrome virus (white spot bacilliform virus)
uggguaaauagucccuauaauugg

SEQ ID NO: 2880 - RNA, 22 nt, shrimp white spot syndrome virus (white spot bacilliform virus)
uugacagguaucauaauugucc

SEQ ID NO: 2881 - RNA, 24 nt, shrimp white spot syndrome virus (white spot bacilliform virus)
ucauucuuuaaaaauuuaacaauu

SEQ ID NO: 2882 - RNA, 24 nt, shrimp white spot syndrome virus (white spot bacilliform virus)
ugggacgcuauuaugcccacagca

SEQ ID NO: 2883 - RNA, 24 nt, shrimp white spot syndrome virus (white spot bacilliform virus)
aagcagacaccuuucgucccaaaa

SEQ ID NO: 2884 - RNA, 24 nt, shrimp white spot syndrome virus (white spot bacilliform virus)
cuggaacagucauuucuggaaagg

SEQ ID NO: 2885 - RNA, 24 nt, shrimp white spot syndrome virus (white spot bacilliform virus)
ucgaaucuucuuuucgggaguucu

SEQ ID NO: 2886 - RNA, 24 nt, shrimp white spot syndrome virus (white spot bacilliform virus)
ggagggauuuguuuaggggcugga

SEQ ID NO: 2887 - RNA, 24 nt, shrimp white spot syndrome virus (white spot bacilliform virus)
agaggaacuuccuucagcaauauc

SEQ ID NO: 2888 - RNA, 23 nt, shrimp white spot syndrome virus (white spot bacilliform virus)
uagaaucuuguaacccucggauu

SEQ ID NO: 2889 - RNA, 24 nt, shrimp white spot syndrome virus (white spot bacilliform virus)
aaaagaagggcgguggugguggug

SEQ ID NO: 2890 - RNA, 24 nt, shrimp white spot syndrome virus (white spot bacilliform virus)
uguacacuggagaaggaaaaaggg

SEQ ID NO: 2891 - RNA, 24 nt, shrimp white spot syndrome virus (white spot bacilliform virus)
cagcauuauguauaguaaaaagca

SEQ ID NO: 2892 - RNA, 24 nt, shrimp white spot syndrome virus (white spot bacilliform virus)
uggaaauugcccuugacguauuga

SEQ ID NO: 2893 - RNA, 24 nt, shrimp white spot syndrome virus (white spot bacilliform virus)
uauacuggaaaggguauugaucaa

SEQ ID NO: 2894 - RNA, 24 nt, shrimp white spot syndrome virus (white spot bacilliform virus)
uaguagcuuccgucguuuuuacaa

SEQ ID NO: 2895 - RNA, 24 nt, shrimp white spot syndrome virus (white spot bacilliform virus)
ugaguaguacuuccaaugguauuu

SEQ ID NO: 2896 - RNA, 24 nt, shrimp white spot syndrome virus (white spot bacilliform virus)
ugucacauauggcaacuacgcaga

SEQ ID NO: 2897 - RNA, 24 nt, shrimp white spot syndrome virus (white spot bacilliform virus)
uuguauuuuguauauagagaaaag

SEQ ID NO: 2898 - RNA, 24 nt, shrimp white spot syndrome virus (white spot bacilliform virus)
uagcguguauacaacugcagcauu

SEQ ID NO: 2899 - RNA, 24 nt, shrimp white spot syndrome virus (white spot bacilliform virus)
uugacagauaacccuauuguagau

SEQ ID NO: 2900 - RNA, 24 nt, shrimp white spot syndrome virus (white spot bacilliform virus)
ucagaagaaucacuauuucuuaga

SEQ ID NO: 2901 - RNA, 24 nt, shrimp white spot syndrome virus (white spot bacilliform virus)
ucaaaugucugauuguaaugcaau

SEQ ID NO: 2902 - RNA, 22 nt, shrimp white spot syndrome virus (white spot bacilliform virus)
agaaauguuucuauuagacaua

SEQ ID NO: 2903 - RNA, 24 nt, shrimp white spot syndrome virus (white spot bacilliform virus)
uuggaugaagauacuguacauccu

SEQ ID NO: 2904 - RNA, 24 nt, shrimp white spot syndrome virus (white spot bacilliform virus)
aagaagcagagucguaugaccauu

SEQ ID NO: 2905 - RNA, 24 nt, shrimp white spot syndrome virus (white spot bacilliform virus)
uucacaguauuugucccuucuggu

SEQ ID NO: 2906 - RNA, 24 nt, shrimp white spot syndrome virus (white spot bacilliform virus)
uaguguaccaagggcaauaucuua

SEQ ID NO: 2907 - RNA, 24 nt, shrimp white spot syndrome virus (white spot bacilliform virus)
uuagaggaucaacaacuguagaac

SEQ ID NO: 2908 - RNA, 24 nt, shrimp white spot syndrome virus (white spot bacilliform virus)
ugacgcacacauuuauaauaccca

SEQ ID NO: 2909 - RNA, 24 nt, shrimp white spot syndrome virus (white spot bacilliform virus)
gauaaacuuaaaucaauuaaaucc

SEQ ID NO: 2910 - RNA, 23 nt, shrimp white spot syndrome virus (white spot bacilliform virus)
uucaccgagugguggccgaguua

SEQ ID NO: 2911 - RNA, 22 nt, shrimp white spot syndrome virus (white spot bacilliform virus)
cuggaacaggcguuucugggca

SEQ ID NO: 2912 - RNA, 24 nt, shrimp white spot syndrome virus (white spot bacilliform virus)
ucaguggagauuacggaugguuuu

SEQ ID NO: 2913 - RNA, 24 nt, shrimp white spot syndrome virus (white spot bacilliform virus)
ugagaggcguauuuuauucacaau

SEQ ID NO: 2914 - RNA, 24 nt, shrimp white spot syndrome virus (white spot bacilliform virus)
ugaccagcuuagaauuucuccagu

SEQ ID NO: 2915 - RNA, 24 nt, shrimp white spot syndrome virus (white spot bacilliform virus)
ugucguauccagaaaaauugauca

SEQ ID NO: 2916 - RNA, 24 nt, shrimp white spot syndrome virus (white spot bacilliform virus)
ucaaauuaauuggaguaacuuugg

SEQ ID NO: 2917 - RNA, 21 nt, shrimp white spot syndrome virus (white spot bacilliform virus)
cuggaacagucauuucuggaa

SEQ ID NO: 2918 - RNA, 24 nt, shrimp white spot syndrome virus (white spot bacilliform virus)
uuaaguacauagccaucguacgaa

SEQ ID NO: 2919 - RNA, 24 nt, shrimp white spot syndrome virus (white spot bacilliform virus)
uguaagaagaguugcggaauucug

SEQ ID NO: 2920 - RNA, 24 nt, shrimp white spot syndrome virus (white spot bacilliform virus)
ugacuugacuaccuuauuccaacg

SEQ ID NO: 2921 - RNA, 24 nt, shrimp white spot syndrome virus (white spot bacilliform virus)
ucucuaacaccaguccaugaagau

SEQ ID NO: 2922 - RNA, 24 nt, Simian virus 40
agaaguaugcaaagcaugcaucuc

SEQ ID NO: 2923 - RNA, 24 nt, Simian virus 40
ugucagcuuugcacaagggcccaa

SEQ ID NO: 2924 - RNA, 24 nt, Simian virus 40
uaagguaaauauaaaauuuuuaag

SEQ ID NO: 2925 - RNA, 24 nt, Autographa californica nucleopolyhedrovirus
uuuggcggugaaucguuuguuugg

SEQ ID NO: 2926 - RNA, 24 nt, Autographa californica nucleopolyhedrovirus
uuaaagagauugaaagcgcguacg

SEQ ID NO: 2927 - RNA, 24 nt, Avian leukosis virus
uccccgggacauuaucaggcgcag

SEQ ID NO: 2928 - RNA, 24 nt, Avian leukosis virus
cagcuuagcaccacugcugccuug

SEQ ID NO: 2929 - RNA, 24 nt, Bovine leukemia virus
ucagucauuuuuuauagccgauug

SEQ ID NO: 2930 - RNA, 24 nt, Bovine leukemia virus
aacgcugacgggggcgauuucuug

SEQ ID NO: 2931 - RNA, 24 nt, Callitrichine herpesvirus 3
ugcaaacucuucgcauguuucuug

SEQ ID NO: 2932 - RNA, 24 nt, Callitrichine herpesvirus 3
ucagaggagccaucacauacauga

SEQ ID NO: 2933 - RNA, 23 nt, Callitrichine herpesvirus 3
uacuaugauacauaucuaaaugu

SEQ ID NO: 2934 - RNA, 24 nt, Callitrichine herpesvirus 3
guuggcaccaacaaacguugccca

SEQ ID NO: 2935 - RNA, 24 nt, Callitrichine herpesvirus 3
uaaaguaaucaauaacgguaagau

SEQ ID NO: 2936 - RNA, 24 nt, Callitrichine herpesvirus 3
uuaguuaaagcagaacgauuuauu

SEQ ID NO: 2937 - RNA, 24 nt, Callitrichine herpesvirus 3
uggcauauauuagagggacccggu

SEQ ID NO: 2938 - RNA, 24 nt, Callitrichine herpesvirus 3
uuugacacgcuauuugaaauaaua

SEQ ID NO: 2939 - RNA, 24 nt, Callitrichine herpesvirus 3
ucuacugucuacauacagaagggu

SEQ ID NO: 2940 - RNA, 24 nt, Callitrichine herpesvirus 3
uaagccaaaaaucauuacuuccuc

SEQ ID NO: 2941 - RNA, 24 nt, Callitrichine herpesvirus 3
uaggacaggagguaucaaugacau

SEQ ID NO: 2942 - RNA, 24 nt, Callitrichine herpesvirus 3
uaggugaacacccacugacaguaa

SEQ ID NO: 2943 - RNA, 24 nt, Callitrichine herpesvirus 3
uccccgaaacccccaaggggcggc

SEQ ID NO: 2944 - RNA, 21 nt, Callitrichine herpesvirus 3
uaagacaagguguuuccacgg

SEQ ID NO: 2945 - RNA, 24 nt, Callitrichine herpesvirus 3
cagcacacacccaacacaauuaca

SEQ ID NO: 2946 - RNA, 24 nt, Callitrichine herpesvirus 3
ugacuguuguacucgcgauggcaa

SEQ ID NO: 2947 - RNA, 24 nt, Callitrichine herpesvirus 3
ugaccagccguauucaugcaucuu

SEQ ID NO: 2948 - RNA, 24 nt, Callitrichine herpesvirus 3
uggcggauucucuggcugcggcug

SEQ ID NO: 2949 - RNA, 24 nt, Callitrichine herpesvirus 3
uugacaguuuugugaauucuccgc

SEQ ID NO: 2950 - RNA, 23 nt, Callitrichine herpesvirus 3
uggcucaaccugucauacacguu

SEQ ID NO: 2951 - RNA, 24 nt, Callitrichine herpesvirus 3
ugcgugauuuccuugauguugaca

SEQ ID NO: 2952 - RNA, 24 nt, Callitrichine herpesvirus 3
uguggcagaggggacuuuaguuua

SEQ ID NO: 2953 - RNA, 24 nt, Callitrichine herpesvirus 3
ugagguuuggugaaggucuggagg

SEQ ID NO: 2954 - RNA, 24 nt, Callitrichine herpesvirus 3
agagguggcugauuuuauugguau

SEQ ID NO: 2955 - RNA, 24 nt, Callitrichine herpesvirus 3
gggaaaguaaucaagaucccuagu

SEQ ID NO: 2956 - RNA, 24 nt, Callitrichine herpesvirus 3
cgagguaggagauugauccaaagu

SEQ ID NO: 2957 - RNA, 24 nt, Callitrichine herpesvirus 3
uggcgcgguagccuuagugggaga

SEQ ID NO: 2958 - RNA, 22 nt, Callitrichine herpesvirus 3
uggcaaaguuuucaccccgccc

SEQ ID NO: 2959 - RNA, 24 nt, Callitrichine herpesvirus 3
uggaauggcuguagagcacaucau

SEQ ID NO: 2960 - RNA, 24 nt, Callitrichine herpesvirus 3
uagacuauuagguggggcaucugc

SEQ ID NO: 2961 - RNA, 24 nt, Callitrichine herpesvirus 3
ccuacagguuaauccuccugguuc

SEQ ID NO: 2962 - RNA, 23 nt, Callitrichine herpesvirus 3
ugccuugguggaguucaacuacu

SEQ ID NO: 2963 - RNA, 24 nt, Callitrichine herpesvirus 3
uaagguuuugcgaguugaacucug

SEQ ID NO: 2964 - RNA, 24 nt, Callitrichine herpesvirus 3
uagccgauguggugcuugccgcca

SEQ ID NO: 2965 - RNA, 24 nt, Callitrichine herpesvirus 3
ugugauguagcacguggcuauaau

SEQ ID NO: 2966 - RNA, 22 nt, Callitrichine herpesvirus 3
uauugcauauagauuguaguua

SEQ ID NO: 2967 - RNA, 24 nt, Callitrichine herpesvirus 3
uguaguagaaggugauacuacaca

SEQ ID NO: 2968 - RNA, 24 nt, Callitrichine herpesvirus 3
auugguugccucuaguucauagga

SEQ ID NO: 2969 - RNA, 24 nt, Callitrichine herpesvirus 3
ugaaauguuugaucugaugccugc

SEQ ID NO: 2970 - RNA, 22 nt, Callitrichine herpesvirus 3
aagcuccgcccuguggguugua

SEQ ID NO: 2971 - RNA, 24 nt, Callitrichine herpesvirus 3
uaucuuaugaucugaccaacagaa

SEQ ID NO: 2972 - RNA, 24 nt, Callitrichine herpesvirus 3
ugggauggggccucucuuaguagg

SEQ ID NO: 2973 - RNA, 24 nt, Callitrichine herpesvirus 3
acacccgauaugcguauuuuggug

SEQ ID NO: 2974 - RNA, 24 nt, Callitrichine herpesvirus 3
uuaaagacagccauaacuuauccu

SEQ ID NO: 2975 - RNA, 24 nt, Callitrichine herpesvirus 3
uucccugcuacaucacccuggaca

SEQ ID NO: 2976 - RNA, 24 nt, Callitrichine herpesvirus 3
uaccauaucuauguagaaguuuua

SEQ ID NO: 2977 - RNA, 22 nt, Epiphyas postvittana nucleopolyhedrovirus
ugccaugaaguuuacguuguuu

SEQ ID NO: 2978 - RNA, 24 nt, Epiphyas postvittana nucleopolyhedrovirus
uucguugugugugcgacgacgggu

SEQ ID NO: 2979 - RNA, 24 nt, Epiphyas postvittana nucleopolyhedrovirus
uucaucaaaccguucgugaaacgc

SEQ ID NO: 2980 - RNA, 24 nt, Epiphyas postvittana nucleopolyhedrovirus
ucaaauaagcguagacuaguuugc

SEQ ID NO: 2981 - RNA, 24 nt, Epiphyas postvittana nucleopolyhedrovirus
uugaauggacaauuuugcuagaac

SEQ ID NO: 2982 - RNA, 21 nt, Epiphyas postvittana nucleopolyhedrovirus
ugucucgacugcuuuaagaug

SEQ ID NO: 2983 - RNA, 24 nt, Epiphyas postvittana nucleopolyhedrovirus
aauugcagcgugaauuugcucagc

SEQ ID NO: 2984 - RNA, 24 nt, Epiphyas postvittana nucleopolyhedrovirus
gguaaacgcuucauugugcuuugc

SEQ ID NO: 2985 - RNA, 24 nt, Epiphyas postvittana nucleopolyhedrovirus
ugaaauuggcguugacaaauuauu

SEQ ID NO: 2986 - RNA, 24 nt, Epiphyas postvittana nucleopolyhedrovirus
aagaauguuuaggcgacgcgucgu

SEQ ID NO: 2987 - RNA, 21 nt, Epiphyas postvittana nucleopolyhedrovirus
uaaaacacgugugggaugaug

SEQ ID NO: 2988 - RNA, 24 nt, Epiphyas postvittana nucleopolyhedrovirus
uguuguacaaauugcugcucaaau

SEQ ID NO: 2989 - RNA, 24 nt, Epiphyas postvittana nucleopolyhedrovirus
ucacuggcaaauguucgaagcgua

SEQ ID NO: 2990 - RNA, 23 nt, Epiphyas postvittana nucleopolyhedrovirus
accagcagauuaaugccaacacg

SEQ ID NO: 2991 - RNA, 24 nt, Epiphyas postvittana nucleopolyhedrovirus
ugucggagccgagcacuagcggga

SEQ ID NO: 2992 - RNA, 24 nt, Epiphyas postvittana nucleopolyhedrovirus
ucaaugcucucuuaguuuaacaca

SEQ ID NO: 2993 - RNA, 24 nt, Epiphyas postvittana nucleopolyhedrovirus
uggcaaagugaaacccgacguguu

SEQ ID NO: 2994 - RNA, 24 nt, Epiphyas postvittana nucleopolyhedrovirus
uucaucgugucgggcuugacguug

SEQ ID NO: 2995 - RNA, 24 nt, Epiphyas postvittana nucleopolyhedrovirus
ugucacgcacaucaucgcagucgu

SEQ ID NO: 2996 - RNA, 24 nt, Epiphyas postvittana nucleopolyhedrovirus
aacgcguuuguauugacgggugac

SEQ ID NO: 2997 - RNA, 24 nt, Epiphyas postvittana nucleopolyhedrovirus
ucgacacauuugauacaauuuugu

SEQ ID NO: 2998 - RNA, 24 nt, Epiphyas postvittana nucleopolyhedrovirus
uaagcuaaucauauaaauuaaacc

SEQ ID NO: 2999 - RNA, 24 nt, Epiphyas postvittana nucleopolyhedrovirus
aaaguuguccugaccaugcucacc

SEQ ID NO: 3000 - RNA, 24 nt, Epiphyas postvittana nucleopolyhedrovirus
gcuacauuuguacauugacuuauc

SEQ ID NO: 3001 - RNA, 24 nt, Epiphyas postvittana nucleopolyhedrovirus
uguaguagugauaguagcuuuacu

SEQ ID NO: 3002 - RNA, 24 nt, Epiphyas postvittana nucleopolyhedrovirus
uuacaggccuuuauauacccaugu

SEQ ID NO: 3003 - RNA, 24 nt, Epiphyas postvittana nucleopolyhedrovirus
aaaaagcuuuuauuuagugauaac

SEQ ID NO: 3004 - RNA, 24 nt, Epiphyas postvittana nucleopolyhedrovirus
caugacaaagagcgcguuugugaa

SEQ ID NO: 3005 - RNA, 24 nt, Epiphyas postvittana nucleopolyhedrovirus
uguuaacuuuuacgaauugcugua

SEQ ID NO: 3006 - RNA, 24 nt, Epiphyas postvittana nucleopolyhedrovirus
ucaccacucuuguuuacauuguug

SEQ ID NO: 3007 - RNA, 24 nt, Epiphyas postvittana nucleopolyhedrovirus
auaacauuuauuugcguuuguuuu

SEQ ID NO: 3008 - RNA, 24 nt, Epiphyas postvittana nucleopolyhedrovirus
uucagagcacaugagucaccgagc

SEQ ID NO: 3009 - RNA, 24 nt, Epiphyas postvittana nucleopolyhedrovirus
aaaagcaaaucgcaaaaagcguuu

SEQ ID NO: 3010 - RNA, 23 nt, Epiphyas postvittana nucleopolyhedrovirus
caucacagccgauauuggcgaca

SEQ ID NO: 3011 - RNA, 24 nt, Epiphyas postvittana nucleopolyhedrovirus
ugaggcggcuacgcgcggucaaag

SEQ ID NO: 3012 - RNA, 24 nt, Epiphyas postvittana nucleopolyhedrovirus
ucaauuggccaacagcgcgacuug

SEQ ID NO: 3013 - RNA, 23 nt, Epiphyas postvittana nucleopolyhedrovirus
ugauauuguuaaacaaggcaaca

SEQ ID NO: 3014 - RNA, 24 nt, Epiphyas postvittana nucleopolyhedrovirus
ucaugugcuucgcgaacuagcuuu

SEQ ID NO: 3015 - RNA, 24 nt, Equine herpesvirus 4
uauggugaguugucgguuggggga

SEQ ID NO: 3016 - RNA, 24 nt, Equine herpesvirus 4
ugagggggguugaguuuucggggg

SEQ ID NO: 3017 - RNA, 24 nt, Equine herpesvirus 4
uagcguagagaguagcauccacaa

SEQ ID NO: 3018 - RNA, 23 nt, Human adenovirus E
uuuacaguaagugugauuaaguu

SEQ ID NO: 3019 - RNA, 21 nt, Paramecium bursaria Chlorella virus 1
uaaucggaacgucgaguggug

SEQ ID NO: 3020 - RNA, 24 nt, Human herpesvirus 6
ugacuggaccuggcauucuagaga

SEQ ID NO: 3021 - RNA, 24 nt, Pothos latent virus
ugucagggcuauagccaaaguggg

SEQ ID NO: 3022 - RNA, 24 nt, Pothos latent virus
uugaacgugaccugaugaauugga

SEQ ID NO: 3023 - RNA, 24 nt, Pothos latent virus
uugaaucacgaagggaugguggua

SEQ ID NO: 3024 - RNA, 24 nt, porcine enteric calicivirus
uggcaaggagguuuguucagaguc

SEQ ID NO: 3025 - RNA, 24 nt, Murine adenovirus A
uggcaagcaguguaccuucuugcc

SEQ ID NO: 3026 - RNA, 24 nt, Cryphonectria hypovirus 3
uggcuugcacaggaugauugaggc

SEQ ID NO: 3027 - RNA, 24 nt, Cryphonectria hypovirus 3
aagaagcuacggaaaaaagguuuc

SEQ ID NO: 3028 - RNA, 24 nt, Cryphonectria hypovirus 3
cuagcaaauauagaucugauggug

SEQ ID NO: 3029 - RNA, 24 nt, Cryphonectria hypovirus 3
uuugucaugcuucugaagauguua

SEQ ID NO: 3030 - RNA, 23 nt, Myxoma virus
ugugaucaacccaaacaucguau

SEQ ID NO: 3031 - RNA, 24 nt, Myxoma virus
ugauucuuucguucuucgucagcg

SEQ ID NO: 3032 - RNA, 24 nt, Myxoma virus
auaaagcuaagcaauuauacagcu

SEQ ID NO: 3033 - RNA, 24 nt, Myxoma virus
uacccgucaauacaaacaccguaa

SEQ ID NO: 3034 - RNA, 21 nt, Myxoma virus
uguuaucaaacggggcagaua

SEQ ID NO: 3035 - RNA, 24 nt, Rabbit fibroma virus
uaauacuagccguuagugccuugu

SEQ ID NO: 3036 - RNA, 24 nt, Rabbit fibroma virus
ucacugguguuccaacuaucauaa

SEQ ID NO: 3037 - RNA, 24 nt, Rabbit fibroma virus
aaaaaggcagauaaaguggauccg

SEQ ID NO: 3038 - RNA, 24 nt, Rabbit fibroma virus
uggcaaguucccuaacauaacgua

SEQ ID NO: 3039 - RNA, 24 nt, Rabbit fibroma virus
gugcauuggauaugauuauccugu

SEQ ID NO: 3040 - RNA, 24 nt, Rabbit fibroma virus
aaaagagugcaaugcccagcagaa

SEQ ID NO: 3041 - RNA, 24 nt, Human herpesvirus 5
cgucacagaaacaaaggagucgua

SEQ ID NO: 3042 - RNA, 24 nt, Human herpesvirus 5
uggcaucaugagacgcgcgaaaac

SEQ ID NO: 3043 - RNA, 22 nt, Human herpesvirus 3
uagccguucuaacgccuaucga

SEQ ID NO: 3044 - RNA, 24 nt, Human herpesvirus 3
uagcugccuuaacccuggaguuau

SEQ ID NO: 3045 - RNA, 24 nt, Human herpesvirus 3
ugauguaauuuuuacggcacuuaa

SEQ ID NO: 3046 - RNA, 24 nt, Saimiriine herpesvirus 2
agaggaauuaacauuuucuacaga

SEQ ID NO: 3047 - RNA, 24 nt, Saimiriine herpesvirus 2
ugagguaaaagcagcugcucagcu

SEQ ID NO: 3048 - RNA, 24 nt, Saimiriine herpesvirus 2
ugccaugcauaagcauugcagaga

SEQ ID NO: 3049 - RNA, 24 nt, Saimiriine herpesvirus 2
ucuuuaggaacgugcucagcuguu

SEQ ID NO: 3050 - RNA, 24 nt, Saimiriine herpesvirus 2
uauuaggcaaaagcuugcugaaug

SEQ ID NO: 3051 - RNA, 24 nt, Tobacco mosaic virus
cauggcaagauccugacuuuuacc

SEQ ID NO: 3052 - RNA, 24 nt, Tobacco mosaic virus
uuucaugaugaauuuugggaaaag

SEQ ID NO: 3053 - RNA, 24 nt, Tobacco mosaic virus
agagaucuagagaaacuuagcucg

SEQ ID NO: 3054 - RNA, 24 nt, Tobacco mosaic virus
ugaggcgaauguugcgcuagcuuu

SEQ ID NO: 3055 - RNA, 24 nt, Tobacco mosaic virus
uagcaucacuaucugcugcggugu

SEQ ID NO: 3056 - RNA, 24 nt, Human adenovirus C
uggaaucaggcuguagacagcuau

SEQ ID NO: 3057 - RNA, 24 nt, Black beetle virus
uggcaagaagguagugucaccaau

SEQ ID NO: 3058 - RNA, 24 nt, Black beetle virus
ugagaucgccgacgguguuuguga

SEQ ID NO: 3059 - RNA, 24 nt, Human enterovirus C
ugagguacaaagaucugaagauug

SEQ ID NO: 3060 - RNA, 24 nt, Human enterovirus C
gugcauccagugaugccaaugaaa

SEQ ID NO: 3061 - RNA, 21 nt, Avian infectious bronchitis virus
ucaccgaaaccuucuguguuu

SEQ ID NO: 3062 - RNA, 24 nt, Avian infectious bronchitis virus
uuaaagcuuaugcaaccacuguuu

SEQ ID NO: 3063 - RNA, 24 nt, Avian infectious bronchitis virus
uuuacagccgaugauguugaggac

SEQ ID NO: 3064 - RNA, 24 nt, Avian infectious bronchitis virus
ugucuaguauaauaucuguagaua

SEQ ID NO: 3065 - RNA, 24 nt, Avian infectious bronchitis virus
uucaccccauguaugauguaaacu

SEQ ID NO: 3066 - RNA, 24 nt, Avian infectious bronchitis virus
ugaaauuuuugaccccacugaaau

SEQ ID NO: 3067 - RNA, 21 nt, Avian infectious bronchitis virus
aacucuggcuauaacuuuugu

SEQ ID NO: 3068 - RNA, 24 nt, Avian infectious bronchitis virus
ucuucauuuacugaaaagucuuuu

SEQ ID NO: 3069 - RNA, 24 nt, Avian infectious bronchitis virus
uuaaugcuguaucaguuugugaag

SEQ ID NO: 3070 - RNA, 24 nt, Avian infectious bronchitis virus
uacaguuguaggacucuacccugu

SEQ ID NO: 3071 - RNA, 24 nt, Avian infectious bronchitis virus
ugcuauaucuaauguuguugucuu

SEQ ID NO: 3072 - RNA, 24 nt, Avian infectious bronchitis virus
uauuaugcgcaauaucuguguaag

SEQ ID NO: 3073 - RNA, 24 nt, Avian infectious bronchitis virus
gcgcaaauaauacggaugaaguaa

SEQ ID NO: 3074 - RNA, 24 nt, Avian infectious bronchitis virus
ucuacacaaguaacccaguaaugu

SEQ ID NO: 3075 - RNA, 24 nt, Avian infectious bronchitis virus
ugagugaguauugugaugacauac

SEQ ID NO: 3076 - RNA, 24 nt, Avian infectious bronchitis virus
ugugaccgacucagcuguuaguua

SEQ ID NO: 3077 - RNA, 22 nt, Avian infectious bronchitis virus
uaccgcaaaaugcaccuaaugg

SEQ ID NO: 3078 - RNA, 24 nt, Avian infectious bronchitis virus
ugaguacauacaaacgcguaugga

SEQ ID NO: 3079 - RNA, 21 nt, Avian infectious bronchitis virus
uaacugguagauugucaucac

SEQ ID NO: 3080 - RNA, 24 nt, Avian infectious bronchitis virus
cagagagcuuaccguaugcuugga

SEQ ID NO: 3081 - RNA, 24 nt, Avian infectious bronchitis virus
ugagggacuuguagauacuucaau

SEQ ID NO: 3082 - RNA, 24 nt, Avian infectious bronchitis virus
agagcuaagcgugguauacuaguu

SEQ ID NO: 3083 - RNA, 24 nt, Avian infectious bronchitis virus
uaaguggugcuaauauagcauggc

SEQ ID NO: 3084 - RNA, 24 nt, Avian infectious bronchitis virus
uuaaaccugguggcacuagcagug

SEQ ID NO: 3085 - RNA, 21 nt, Avian infectious bronchitis virus
uaacaggccuaccauguuuga

SEQ ID NO: 3086 - RNA, 24 nt, Avian infectious bronchitis virus
uauuguagacuaugugucugaugc

SEQ ID NO: 3087 - RNA, 24 nt, Eggplant mosaic virus
ugucaaugccccccaccgccccca

SEQ ID NO: 3088 - RNA, 23 nt, Eggplant mosaic virus
uggaaucaugucuucucucacug

SEQ ID NO: 3089 - RNA, 24 nt, Feline immunodeficiency virus
ugguggaaucaaauggccuauuau

SEQ ID NO: 3090 - RNA, 24 nt, Feline immunodeficiency virus
uauuguacagacccauuacaaauc

SEQ ID NO: 3091 - RNA, 24 nt, Feline immunodeficiency virus
uggaaucauggaaauauaacuuug

SEQ ID NO: 3092 - RNA, 24 nt, Feline immunodeficiency virus
aaaagugggaagauuggguaggau

SEQ ID NO: 3093 - RNA, 24 nt, Hepatitis A virus
ugauauguugaauguuaauuuagc

SEQ ID NO: 3094 - RNA, 23 nt, Hepatitis A virus
ugauuagagaagcagguagaauc

SEQ ID NO: 3095 - RNA, 24 nt, Hepatitis A virus
guaauguuguuauucaaucuuugg

SEQ ID NO: 3096 - RNA, 24 nt, Hepatitis A virus
uugagagucaugaauuaugcagau

SEQ ID NO: 3097 - RNA, 24 nt, Hepatitis A virus
uagcaucauugacuguuuauccuc

SEQ ID NO: 3098 - RNA, 24 nt, Equine herpesvirus 1
uccgcgggcggcgaucguaaaugu

SEQ ID NO: 3099 - RNA, 24 nt, Equine herpesvirus 1
cgcgguagcgacuacaccgcagag

SEQ ID NO: 3100 - RNA, 24 nt, Equine herpesvirus 1
ugccucgugcgacgcggaugaauc

SEQ ID NO: 3101 - RNA, 23 nt, Equine herpesvirus 1
uggccggcucuagguaugagcgc

SEQ ID NO: 3102 - RNA, 24 nt, Equine herpesvirus 1
ugaggugguuagauugagggcacg

SEQ ID NO: 3103 - RNA, 24 nt, Equine herpesvirus 1
uacccguuuguggaggagcuggcg

SEQ ID NO: 3104 - RNA, 24 nt, Cryphonectria hypovirus 1
cuucacacucuaugugccguaccu

SEQ ID NO: 3105 - RNA, 24 nt, Cryphonectria hypovirus 1
ucugaccaacccggcaaggcucag

SEQ ID NO: 3106 - RNA, 24 nt, Cryphonectria hypovirus 1
uaaggugcgcaucuaccaaggcau

SEQ ID NO: 3107 - RNA, 24 nt, Cryphonectria hypovirus 1
uugaagcuuccugacuccuauguu

SEQ ID NO: 3108 - RNA, 24 nt, Cryphonectria hypovirus 1
uguggaggcaaggguuugauguua

SEQ ID NO: 3109 - RNA, 24 nt, Cryphonectria hypovirus 1
ugagggguuacaaagccgcguuca

SEQ ID NO: 3110 - RNA, 23 nt, Cryphonectria hypovirus 1
ugacucuuugcugucgacaccuu

SEQ ID NO: 3111 - RNA, 24 nt, Cryphonectria hypovirus 1
gcagucugauuaugacaauuaugg

SEQ ID NO: 3112 - RNA, 24 nt, Cryphonectria hypovirus 1
ugagaucagcaugcacccgaagaa

SEQ ID NO: 3113 - RNA, 24 nt, Cryphonectria hypovirus 1
uggcaacugggccaaguuaauaga

SEQ ID NO: 3114 - RNA, 24 nt, Cryphonectria hypovirus 1
uaggaugaagaugcagguuauaaa

SEQ ID NO: 3115 - RNA, 24 nt, Cryphonectria hypovirus 1
uugaagccuggggaguaugaagug

SEQ ID NO: 3116 - RNA, 24 nt, Cryphonectria hypovirus 1
ugagaacgagccugacauccucgu

SEQ ID NO: 3117 - RNA, 24 nt, Cryphonectria hypovirus 1
ugaggaacacgggcauccaugggc

SEQ ID NO: 3118 - RNA, 24 nt, Melon necrotic spot virus
uggcaggaggcgcacgauuuauga

SEQ ID NO: 3119 - RNA, 24 nt, Melon necrotic spot virus
uugguuaucuugggguuaggauug

SEQ ID NO: 3120 - RNA, 24 nt, Melon necrotic spot virus
gaggagcucgcuggguucuguacu

SEQ ID NO: 3121 - RNA, 24 nt, O'nyong-nyong virus
ugagaucaaagagcaacuacuacu

SEQ ID NO: 3122 - RNA, 24 nt, Igbo Ora virus
uagugcaagcuuuuaaagaagaua

SEQ ID NO: 3123 - RNA, 22 nt, O'nyong-nyong virus
uaucacuaagaucccagguaga

SEQ ID NO: 3124 - RNA, 23 nt, Pepper mottle virus
uggaaagaguauguugaauaagg

SEQ ID NO: 3125 - RNA, 24 nt, Pepper mottle virus
aaggguguucucaacuuggcucau

SEQ ID NO: 3126 - RNA, 22 nt, Pepper mottle virus
uagcacaugggguucacuauuu

SEQ ID NO: 3127 - RNA, 24 nt, Pepper mottle virus
ucagauccacggcuuucgcaaaug

SEQ ID NO: 3128 - RNA, 24 nt, Pepper mottle virus
ugagcuucaggucuuaccucaagu

SEQ ID NO: 3129 - RNA, 24 nt, Pepper mottle virus
uggguucgcuuugcauuucuuugc

SEQ ID NO: 3130 - RNA, 21 nt, Pepper mottle virus
uuggaugcuugaagucuugaa

SEQ ID NO: 3131 - RNA, 24 nt, Human papillomavirus type 39
aacacauauuuagauacugcauuu

SEQ ID NO: 3132 - RNA, 24 nt, Human papillomavirus type 39
uugcugacaaaauuuuacagugga

SEQ ID NO: 3133 - RNA, 24 nt, canine parvovirus
uggcuaacuauacacaucauuggg

SEQ ID NO: 3134 - RNA, 24 nt, canine parvovirus
uagaaugcacggauggaauuggau

SEQ ID NO: 3135 - RNA, 24 nt, Rabies virus
auaaugcauuuggaagguaucuug

SEQ ID NO: 3136 - RNA, 24 nt, Rabies virus
uaauguucauguggugaagagagc

SEQ ID NO: 3137 - RNA, 24 nt, Rabies virus
ucacgcuaggaaauagagggcuga

SEQ ID NO: 3138 - RNA, 24 nt, Rabies virus
uaacagacaauugcuccaggucuu

SEQ ID NO: 3139 - RNA, 24 nt, Rabies virus
gugcuuagcaagcgaccuagccag

SEQ ID NO: 3140 - RNA, 24 nt, Rabbit hemorrhagic disease virus
aagcugcguucaacacucuagacc

SEQ ID NO: 3141 - RNA, 24 nt, Rabbit hemorrhagic disease virus
cagugcaaguuacucugggagcaa

SEQ ID NO: 3142 - RNA, 24 nt, Rabbit hemorrhagic disease virus
ugcggaacccagaccucccguuag

SEQ ID NO: 3143 - RNA, 24 nt, Rabbit hemorrhagic disease virus
uggcguaugacgguugcacacaga

SEQ ID NO: 3144 - RNA, 24 nt, Rabbit hemorrhagic disease virus
uugcucaagaggcuguuugacaca

SEQ ID NO: 3145 - RNA, 24 nt, Sendai virus
uggcccaugcaucaacuauuauaa

SEQ ID NO: 3146 - RNA, 24 nt, Sendai virus
uaggguaaugaaucaagagccugg

SEQ ID NO: 3147 - RNA, 24 nt, Sendai virus
uggaaugaacuacagaauaauucg

SEQ ID NO: 3148 - RNA, 24 nt, Tomato bushy stunt virus
guacauuguucucuugguugccag

SEQ ID NO: 3149 - RNA, 24 nt, Tomato bushy stunt virus
gaucacaaacuuaucgacuugggu

SEQ ID NO: 3150 - RNA, 24 nt, Tomato bushy stunt virus
uggcaggacgucuggcucugucac

SEQ ID NO: 3151 - RNA, 24 nt, Vaccinia virus
ugguauggaaucccgaggcaccua

SEQ ID NO: 3152 - RNA, 24 nt, Vaccinia virus
uguaaacauuugggccauuauacc

SEQ ID NO: 3153 - RNA, 24 nt, Vaccinia virus
gaugacaauauuauuaugaagacu

SEQ ID NO: 3154 - RNA, 24 nt, Vaccinia virus
ucuccugccuauuauauguuaaaa

SEQ ID NO: 3155 - RNA, 24 nt, Vaccinia virus
ugagauguuuguuagaagucaguc

SEQ ID NO: 3156 - RNA, 22 nt, Human papillomavirus type 17
uacagcacaguaugaauuuucu

SEQ ID NO: 3157 - RNA, 24 nt, Human papillomavirus type 17
uucgcugcaaguuuuguuuaaaga

SEQ ID NO: 3158 - RNA, 24 nt, Human papillomavirus type 40
uggagugggguuuggagaccuggu

SEQ ID NO: 3159 - RNA, 24 nt, Human papillomavirus type 40
uggaaugagccugaugcacuuuau

SEQ ID NO: 3160 - RNA, 23 nt, Human papillomavirus type 7
uucauagugauccacuguccagu

SEQ ID NO: 3161 - RNA, 24 nt, Cardamine chlorotic fleck virus
uaccggaguuucucgcccacaagc

SEQ ID NO: 3162 - RNA, 24 nt, Cardamine chlorotic fleck virus
ugugcaauuuguccgcuaggggug

SEQ ID NO: 3163 - RNA, 24 nt, Cardamine chlorotic fleck virus
uacuaugauaaucuggcguuagaa

SEQ ID NO: 3164 - RNA, 24 nt, Borna disease virus
gugagcccguugaagacggaguua

SEQ ID NO: 3165 - RNA, 24 nt, Borna disease virus
cagguuagagucaguuuguuaugc

SEQ ID NO: 3166 - RNA, 24 nt, Borna disease virus
ucacgggugacggauucuacugga

SEQ ID NO: 3167 - RNA, 24 nt, Variola virus
uaaguguacuauaguugacaguau

SEQ ID NO: 3168 - RNA, 24 nt, Variola virus
ugaugaauauuacaagauuagaag

SEQ ID NO: 3169 - RNA, 21 nt, Camelpox virus
ucgcaugauuuauaugauuac

SEQ ID NO: 3170 - RNA, 24 nt, Ectromelia virus
cgaaugaaauauauacaucuauaa

SEQ ID NO: 3171 - RNA, 24 nt, Variola virus
ucuccugccuauuauauguuaaaa

SEQ ID NO: 3172 - RNA, 24 nt, Variola virus
uagaacgcucuuucgaugauaauu

SEQ ID NO: 3173 - RNA, 24 nt, Variola virus
ugaauagcgagagugagagugaua

SEQ ID NO: 3174 - RNA, 24 nt, Variola virus
aaugacgcggaacacauaucucag

SEQ ID NO: 3175 - RNA, 21 nt, Variola virus
uuauuuggcaaagucaaauga

SEQ ID NO: 3176 - RNA, 24 nt, Variola virus
ucucagaauccgcuaauggaaacg

SEQ ID NO: 3177 - RNA, 24 nt, Autographa californica nucleopolyhedrovirus
uacaguagcuuugcccacaaauag

SEQ ID NO: 3178 - RNA, 24 nt, Autographa californica nucleopolyhedrovirus
uuugcaagcucuucaacuugacga

SEQ ID NO: 3179 - RNA, 24 nt, Equine herpesvirus 2
ugccaaguugauaggggacguggu

SEQ ID NO: 3180 - RNA, 24 nt, Equine herpesvirus 2
uggcccagcuccagaucaccgccg

SEQ ID NO: 3181 - RNA, 24 nt, African swine fever virus
uaucauggauguauuuuacgagac

SEQ ID NO: 3182 - RNA, 24 nt, Human herpesvirus 6
uggguuagugaaaaagguggcauc

SEQ ID NO: 3183 - RNA, 24 nt, Tick-borne encephalitis virus
ugcgggagcaauacagcgaaaccu

SEQ ID NO: 3184 - RNA, 24 nt, Tick-borne encephalitis virus
ucaccggggugcggcuggaguguc

SEQ ID NO: 3185 - RNA, 24 nt, Tick-borne encephalitis virus
uaacagaggcuucagcagugggac

SEQ ID NO: 3186 - RNA, 21 nt, Tick-borne encephalitis virus
ugugggaaacaggaaggcuca

SEQ ID NO: 3187 - RNA, 24 nt, Tick-borne encephalitis virus
cagccuugggagcuuggucagaug

SEQ ID NO: 3188 - RNA, 24 nt, Hepatitis G virus
ugagguacaggugggguaugucug

SEQ ID NO: 3189 - RNA, 24 nt, Hepatitis G virus
ugagcgaccucaagcucccuggcu

SEQ ID NO: 3190 - RNA, 24 nt, Hepatitis G virus
ucacugacuccccccugacguauu

SEQ ID NO: 3191 - RNA, 24 nt, Hepatitis G virus
uggccaguucuccgcuaggggggu

SEQ ID NO: 3192 - RNA, 24 nt, Hepatitis G virus
ggagaucuuggugucccggcccuc

SEQ ID NO: 3193 - RNA, 24 nt, Hepatitis G virus
ugucaaggagcgccuguuggaaug

SEQ ID NO: 3194 - RNA, 24 nt, Hepatitis G virus
ugauaucggagaagccgcgguguu

SEQ ID NO: 3195 - RNA, 24 nt, Hepatitis G virus
cauugcggggaggggugguccggg

SEQ ID NO: 3196 - RNA, 24 nt, Hepatitis G virus
aguggucgcgacucgaagauagau

SEQ ID NO: 3197 - RNA, 24 nt, Hepatitis G virus
aggguuacguccgcugcgacgcug

SEQ ID NO: 3198 - RNA, 24 nt, Hepatitis G virus
cugcucaucguagcccucuucggg

SEQ ID NO: 3199 - RNA, 24 nt, Hepatitis G virus
ugcuaugguggugggugaaccagc

SEQ ID NO: 3200 - RNA, 22 nt, Hepatitis G virus
uauugcagauccucgggugucc

SEQ ID NO: 3201 - RNA, 24 nt, Hepatitis G virus
ugggauccugggccugggugaggu

SEQ ID NO: 3202 - RNA, 24 nt, Hepatitis G virus
ucggugcggcguggggccucggcu

SEQ ID NO: 3203 - RNA, 23 nt, Hepatitis G virus
ccggauccccuaugacgcagcac

SEQ ID NO: 3204 - RNA, 24 nt, Hepatitis G virus
uccacagagcgacgcgaccaggaa

SEQ ID NO: 3205 - RNA, 24 nt, Hepatitis G virus
ugcaaagacgaggacgcacgggua

SEQ ID NO: 3206 - RNA, 24 nt, Hepatitis G virus
ucaucggcgucuuccaggauguga

SEQ ID NO: 3207 - RNA, 24 nt, Human herpesvirus 7
ucaggaaaaacgguguuguaauaa

SEQ ID NO: 3208 - RNA, 24 nt, Human herpesvirus 7
aucacaaauauuuuucaacagcaa

SEQ ID NO: 3209 - RNA, 24 nt, Human herpesvirus 7
uggaaugaguacugaagaaaguga

SEQ ID NO: 3210 - RNA, 22 nt, Strawberry vein banding virus (SVBV)
uauguugaugacaucaucgucu

SEQ ID NO: 3211 - RNA, 24 nt, Strawberry vein banding virus (SVBV)
uuuggcagguacgccuugcuccag

SEQ ID NO: 3212 - RNA, 24 nt, Carrot mottle mimic virus
uaugacaaucuuaagagaccaggu

SEQ ID NO: 3213 - RNA, 24 nt, Carrot mottle mimic virus
aguguuuggcaguuuuuaccguug

SEQ ID NO: 3214 - RNA, 24 nt, Molluscum contagiosum virus
ugacaagcgagugcugcaaugucc

SEQ ID NO: 3215 - RNA, 24 nt, Molluscum contagiosum virus
agcgggugcucuugucccgcggag

SEQ ID NO: 3216 - RNA, 24 nt, Molluscum contagiosum virus
uacgucuuccuggacuuucgcaac

SEQ ID NO: 3217 - RNA, 23 nt, Saguaro cactus virus
uaucgcagaggaaccagucuaug

SEQ ID NO: 3218 - RNA, 24 nt, Saguaro cactus virus
ugagauuuccgaugcugccagauu

SEQ ID NO: 3219 - RNA, 24 nt, Saguaro cactus virus
uaucacaaugcucgcuuaucucuu

SEQ ID NO: 3220 - RNA, 24 nt, Papaya ringspot virus
ugaaaggaguuagcuccgcuccua

SEQ ID NO: 3221 - RNA, 24 nt, Papaya ringspot virus
ucaccagucuuuagaugacauucg

SEQ ID NO: 3222 - RNA, 24 nt, Cucumber green mottle mosaic virus
uuaaaucugccguagaaggacuag

SEQ ID NO: 3223 - RNA, 24 nt, Cucumber green mottle mosaic virus
uggcaagugacgauaccacucgca

SEQ ID NO: 3224 - RNA, 24 nt, Cucumber green mottle mosaic virus
uugguuccacgcuggguaaucugg

SEQ ID NO: 3225 - RNA, 24 nt, Cucumber green mottle mosaic virus
ugggguaacaguaacgggucuggg

SEQ ID NO: 3226 - RNA, 24 nt, Cucumber green mottle mosaic virus
uacugcaagauuuccaagccggga

SEQ ID NO: 3227 - RNA, 24 nt, Galinsoga mosaic virus
uggcagggugggguuguacuucga

SEQ ID NO: 3228 - RNA, 24 nt, Galinsoga mosaic virus
gcacuggcaccaguacuacucuua

SEQ ID NO: 3229 - RNA, 24 nt, Lymphocystis disease virus 1
ugaaguaaaaugguuguuccugaa

SEQ ID NO: 3230 - RNA, 24 nt, Lymphocystis disease virus 1
uuacaagaugagcaauuucuacag

SEQ ID NO: 3231 - RNA, 24 nt, Lymphocystis disease virus 1
uaguacaacguuuaagcuuaaaca

SEQ ID NO: 3232 - RNA, 24 nt, Lymphocystis disease virus 1
uuaaaaacaauugcgcgauuuaac

SEQ ID NO: 3233 - RNA, 24 nt, Lymphocystis disease virus 1
auaacguucgauguuuaaucuaca

SEQ ID NO: 3234 - RNA, 22 nt, murid herpesvirus 4
ugagauaaauccagauucaauu

SEQ ID NO: 3235 - RNA, 24 nt, murid herpesvirus 4
uggcauauacucacaagcuugguu

SEQ ID NO: 3236 - RNA, 24 nt, murid herpesvirus 4
uaacacacugcgauguuagcccuu

SEQ ID NO: 3237 - RNA, 24 nt, murid herpesvirus 4
uucguugugccuuuucuaagauug

SEQ ID NO: 3238 - RNA, 24 nt, murid herpesvirus 4
uggauagauauggaggucugcuug

SEQ ID NO: 3239 - RNA, 24 nt, murid herpesvirus 4
ugauguacaccaccucuaagcuca

SEQ ID NO: 3240 - RNA, 24 nt, murid herpesvirus 4
uagcugacaggugccugaguacag

SEQ ID NO: 3241 - RNA, 24 nt, Common chimpanzee papillomavirus 1
uaucacagacuaagggacaugagg

SEQ ID NO: 3242 - RNA, 24 nt, Equine herpesvirus 4
uggaaugugugaugagcgaucaaa

SEQ ID NO: 3243 - RNA, 24 nt, Murine hepatitis virus
agaggcagucauagcuauggccgu

SEQ ID NO: 3244 - RNA, 24 nt, Turnip vein-clearing virus
agagaucuugccgaaggcucuaac

SEQ ID NO: 3245 - RNA, 24 nt, Orgyia pseudotsugata single capsid nuclear polyhedrosis virus
uggcgagcacuuuaaccccacccg

SEQ ID NO: 3246 - RNA, 24 nt, Hendra virus
ugagguauuggauaggggugauaa

SEQ ID NO: 3247 - RNA, 24 nt, Ateline herpesvirus 3
uagcauacgguaucgaaguuacau

SEQ ID NO: 3248 - RNA, 24 nt, Ateline herpesvirus 3
uagcuuugcggggccgcuucuguu

SEQ ID NO: 3249 - RNA, 23 nt, Ateline herpesvirus 3
uaaaacaaaacagcgaucacagc

SEQ ID NO: 3250 - RNA, 24 nt, Bovine respiratory syncytial virus
uaucauaugggugguauagaaggu

SEQ ID NO: 3251 - RNA, 24 nt, Bovine respiratory syncytial virus
uacaauggccauauaaguauagau

SEQ ID NO: 3252 - RNA, 24 nt, Bovine respiratory syncytial virus
ucauauauuaaauuuucgaucucu

SEQ ID NO: 3253 - RNA, 24 nt, Melanoplus sanguinipes entomopoxvirus
uguaauggugauaauacaaaaucu

SEQ ID NO: 3254 - RNA, 24 nt, Melanoplus sanguinipes entomopoxvirus
uaucacaauaucaagaauuaucag

SEQ ID NO: 3255 - RNA, 24 nt, infectious spleen and kidney necrosis virus
uauaacaugacauuuuuuggcugg

SEQ ID NO: 3256 - RNA, 24 nt, Melanoplus sanguinipes entomopoxvirus
uaaauuagaugauucauuuccauu

SEQ ID NO: 3257 - RNA, 24 nt, Peanut stunt virus
uacaucagaauguuauuucgaauc

SEQ ID NO: 3258 - RNA, 24 nt, Peanut stunt virus
uagcuaugagguguuacaaugaua

SEQ ID NO: 3259 - RNA, 24 nt, tomato leaf curl virus
uggauggacgagaacaucaagcuc

SEQ ID NO: 3260 - RNA, 24 nt, Leishmania RNA virus 1-1
cugcauugguucaucuuucugauc

SEQ ID NO: 3261 - RNA, 24 nt, Leishmania RNA virus 2-1
ucaguccuucaaguaugcgcguca

SEQ ID NO: 3262 - RNA, 24 nt, Leishmania RNA virus 2-1
ugugugcucgagcaguggcggaau

SEQ ID NO: 3263 - RNA, 24 nt, Human adenovirus D
ccaccgggauaagaccggagacac

SEQ ID NO: 3264 - RNA, 24 nt, Bovine parainfluenza virus 3
ugucaagauauagggaaaucuuac

SEQ ID NO: 3265 - RNA, 23 nt, Spodoptera exigua nucleopolyhedrovirus
ucacccgaccauuugcuccacau

SEQ ID NO: 3266 - RNA, 23 nt, Spodoptera exigua nucleopolyhedrovirus
uaagaucgacaacgugaugaguc

SEQ ID NO: 3267 - RNA, 23 nt, Spodoptera exigua nucleopolyhedrovirus
ccaccggcaacucgggcggucgc

SEQ ID NO: 3268 - RNA, 24 nt, Spodoptera exigua nucleopolyhedrovirus
ugaugugcgucgacgccgaaccgu

SEQ ID NO: 3269 - RNA, 22 nt, Spodoptera exigua nucleopolyhedrovirus
ugcaaaguucgagugaaaaaga

SEQ ID NO: 3270 - RNA, 24 nt, Fowlpox virus
uaucaugcuguagaacaagaaaac

SEQ ID NO: 3271 - RNA, 24 nt, Fowlpox virus
uauuacacacuuuagcagcguguu

SEQ ID NO: 3272 - RNA, 24 nt, Fowlpox virus
uugguuaauaucuaugucaagcgg

SEQ ID NO: 3273 - RNA, 23 nt, Fowlpox virus
ugaaacaauaagcgauaaauuau

SEQ ID NO: 3274 - RNA, 24 nt, Fowlpox virus
uuaguuguaggagauguuaguuuu

SEQ ID NO: 3275 - RNA, 24 nt, Fowlpox virus
aacacauauuaauaucauucgaua

SEQ ID NO: 3276 - RNA, 24 nt, Fowlpox virus
uaaaguagauuacagacuaccuaa

SEQ ID NO: 3277 - RNA, 24 nt, Fowlpox virus
aacaguaaacaccggcaguuauuu

SEQ ID NO: 3278 - RNA, 24 nt, Fowlpox virus
ugaaguauuacuuacuaaguacaa

SEQ ID NO: 3279 - RNA, 24 nt, Fowlpox virus
uaaguuacgcggcuuauaucaagc

SEQ ID NO: 3280 - RNA, 24 nt, Fowlpox virus
uuauuggaaauuucuccauuaagg

SEQ ID NO: 3281 - RNA, 24 nt, Fowlpox virus
uauuucauccugugaaaaucgugu

SEQ ID NO: 3282 - RNA, 22 nt, Fowlpox virus
uucaaggacauucuaaauuuug

SEQ ID NO: 3283 - RNA, 24 nt, Fowlpox virus
ugccuuggcggucuaggaaaugug

SEQ ID NO: 3284 - RNA, 24 nt, Fowlpox virus
ugauguaugaauucgacaugaaua

SEQ ID NO: 3285 - RNA, 24 nt, Fowlpox virus
ugagagcuaacaugcuaauauaua

SEQ ID NO: 3286 - RNA, 23 nt, Fowlpox virus
uacccguuuuaaaaguaaagaac

SEQ ID NO: 3287 - RNA, 24 nt, Fowlpox virus
ugacugaauggucuccuacucuuc

SEQ ID NO: 3288 - RNA, 24 nt, Fowlpox virus
uaagugcuuuaaagcgcgcuacau

SEQ ID NO: 3289 - RNA, 24 nt, Fowlpox virus
aagaguacuacccuauuucuuacc

SEQ ID NO: 3290 - RNA, 24 nt, Fowlpox virus
uagguuacggaaauaaaaacccuc

SEQ ID NO: 3291 - RNA, 24 nt, Fowlpox virus
uagguaagaugauauacaacguag

SEQ ID NO: 3292 - RNA, 24 nt, Fowlpox virus
uaucauaacuacauauuuccuaca

SEQ ID NO: 3293 - RNA, 24 nt, Fowlpox virus
uguuaugccauguaucuaggauau

SEQ ID NO: 3294 - RNA, 24 nt, Fowlpox virus
uguuaacagcuaucaaaauaggau

SEQ ID NO: 3295 - RNA, 24 nt, Fowlpox virus
auagguauguauucuccuaauaca

SEQ ID NO: 3296 - RNA, 24 nt, Gallid herpesvirus 2
uggccaggguauauauaacuccgu

SEQ ID NO: 3297 - RNA, 24 nt, Gallid herpesvirus 2
ugagguuucaauuuccuacucgaa

SEQ ID NO: 3298 - RNA, 24 nt, Gallid herpesvirus 2
uaagguagcagaaaauguuuuugu

SEQ ID NO: 3299 - RNA, 24 nt, Gallid herpesvirus 2
uaugugacgaacauaugaagcaug

SEQ ID NO: 3300 - RNA, 21 nt, Gallid herpesvirus 2
uggaaugugcagcccaucgca

SEQ ID NO: 3301 - RNA, 24 nt, Gallid herpesvirus 2
uaacugcugcgauaguuuggguau

SEQ ID NO: 3302 - RNA, 24 nt, Gallid herpesvirus 2
uacgguagaucaaaugcuuagaau

SEQ ID NO: 3303 - RNA, 24 nt, Gallid herpesvirus 2
gugcaguuuucucuuacacaaccc

SEQ ID NO: 3304 - RNA, 24 nt, Gallid herpesvirus 2
ugggccaaaggcgaauguaauccu

SEQ ID NO: 3305 - RNA, 24 nt, Northern cereal mosaic virus
uggcagacggaucuuacaacccca

SEQ ID NO: 3306 - RNA, 21 nt, Northern cereal mosaic virus
uacucugaaucaaucucuuca

SEQ ID NO: 3307 - RNA, 24 nt, Northern cereal mosaic virus
ugagauagcugaauugauucaaug

SEQ ID NO: 3308 - RNA, 24 nt, Transmissible gastroenteritis virus
uuagugcuaaauugauugguguug

SEQ ID NO: 3309 - RNA, 24 nt, Transmissible gastroenteritis virus
uuucauguguucauaacacuuaua

SEQ ID NO: 3310 - RNA, 24 nt, Transmissible gastroenteritis virus
ugccuaaaguuaaagucaaaccac

SEQ ID NO: 3311 - RNA, 24 nt, Transmissible gastroenteritis virus
uuucauugugcauaagcagacuga

SEQ ID NO: 3312 - RNA, 24 nt, Transmissible gastroenteritis virus
ugagaauacuaacacuauguuuuu

SEQ ID NO: 3313 - RNA, 22 nt, Transmissible gastroenteritis virus
uguaaugccaucugcuuuugua

SEQ ID NO: 3314 - RNA, 24 nt, Transmissible gastroenteritis virus
uauuauaccuauugaacuugaagc

SEQ ID NO: 3315 - RNA, 24 nt, Transmissible gastroenteritis virus
ugaaaugucuagugugagacuuca

SEQ ID NO: 3316 - RNA, 24 nt, Transmissible gastroenteritis virus
uuaaugcugcuaauggugaucuua

SEQ ID NO: 3317 - RNA, 24 nt, Transmissible gastroenteritis virus
acggugcuguacaggcauauaaaa

SEQ ID NO: 3318 - RNA, 24 nt, Rice grassy stunt virus
ugacauagaucuaccuagcaugau

SEQ ID NO: 3319 - RNA, 24 nt, Rice grassy stunt virus
aagcuaaauacuguaggagagaca

SEQ ID NO: 3320 - RNA, 24 nt, Rice grassy stunt virus
uguaaaaagugguuugccagugac

SEQ ID NO: 3321 - RNA, 24 nt, Rice grassy stunt virus
ugauaucauucucaacuaaaucua

SEQ ID NO: 3322 - RNA, 24 nt, Xestia c-nigrum granulovirus
uauagugugcacguauaacgucug

SEQ ID NO: 3323 - RNA, 24 nt, Xestia c-nigrum granulovirus
ugauauggcgccugguaccacgcu

SEQ ID NO: 3324 - RNA, 24 nt, Xestia c-nigrum granulovirus
ugucacguucgugcgauucuacuu

SEQ ID NO: 3325 - RNA, 24 nt, Xestia c-nigrum granulovirus
uacgaagauuuuuacacguugggu

SEQ ID NO: 3326 - RNA, 24 nt, Xestia c-nigrum granulovirus
aaugguggcggguguaaaagcggg

SEQ ID NO: 3327 - RNA, 24 nt, Xestia c-nigrum granulovirus
uacacuguaaaacaaugugucaag

SEQ ID NO: 3328 - RNA, 24 nt, Xestia c-nigrum granulovirus
agaguuaauuuuuagagauaaauu

SEQ ID NO: 3329 - RNA, 24 nt, rabbit oral papillomavirus
ggagguaccgauacccagacauau

SEQ ID NO: 3330 - RNA, 24 nt, Hepatitis GB virus C
uagccguccaccgcaagaaggccg

SEQ ID NO: 3331 - RNA, 24 nt, Hepatitis GB virus C
uuggggacggcuaccucgcgcagc

SEQ ID NO: 3332 - RNA, 24 nt, Hepatitis GB virus C
uacgggcccuugucggucucggcu

SEQ ID NO: 3333 - RNA, 24 nt, Hepatitis GB virus C
ugagguccaggugggguacgucug

SEQ ID NO: 3334 - RNA, 24 nt, Hepatitis GB virus C
uggcaccugugugagggacugcug

SEQ ID NO: 3335 - RNA, 22 nt, Hepatitis GB virus C
ugauuugccaucaaaaguggcc

SEQ ID NO: 3336 - RNA, 24 nt, Hepatitis GB virus C
caaaguguuaccauugauggggag

SEQ ID NO: 3337 - RNA, 24 nt, Hepatitis GB virus C
ucagagguauuggguggggcgggc

SEQ ID NO: 3338 - RNA, 24 nt, Hepatitis GB virus C
ucggaucgcgacacagugguugag

SEQ ID NO: 3339 - RNA, 24 nt, Hepatitis GB virus C
ugagguccugauuggggucuuuca

SEQ ID NO: 3340 - RNA, 24 nt, Hepatitis GB virus C
gaccguggcugacguggcuagccu

SEQ ID NO: 3341 - RNA, 24 nt, Hepatitis GB virus C
ugaggacuggucgccaccuuguau

SEQ ID NO: 3342 - RNA, 24 nt, Ovine astrovirus
caugacauacucuguggccacucg

SEQ ID NO: 3343 - RNA, 24 nt, Ovine astrovirus
uggggugcccaagaagacauggca

SEQ ID NO: 3344 - RNA, 24 nt, Turkey astrovirus
uaagguaucacaugcagcuauuuu

SEQ ID NO: 3345 - RNA, 24 nt, Turkey astrovirus
aaaagugagucaacacaagugaaa

SEQ ID NO: 3346 - RNA, 24 nt, Cherry mottle leaf virus
uuuaacaggcuuguaacuucaagg

SEQ ID NO: 3347 - RNA, 24 nt, Cherry mottle leaf virus
uugguugcuagcaugauagagaaa

SEQ ID NO: 3348 - RNA, 24 nt, Frog adenovirus 1
uuaaagcuguaacagaauuuuauu

SEQ ID NO: 3349 - RNA, 24 nt, Turnip mosaic virus
aagcacacgagugggucaagcacu

SEQ ID NO: 3350 - RNA, 24 nt, Turnip mosaic virus
uaauguaacgguaaagcaggcacg

SEQ ID NO: 3351 - RNA, 24 nt, Turnip mosaic virus
cuaggacuccaauacgugcgagag

SEQ ID NO: 3352 - RNA, 24 nt, Rat cytomegalovirus
ugcgauccugccgccgccgaagau

SEQ ID NO: 3353 - RNA, 24 nt, Rat cytomegalovirus
uggcggacaacggccuguucacgc

SEQ ID NO: 3354 - RNA, 23 nt, Rat cytomegalovirus
ggagaucgacgcguggguccgcc

SEQ ID NO: 3355 - RNA, 24 nt, Parvovirus H1
ucacucuggucgguuacucacucu

SEQ ID NO: 3356 - RNA, 24 nt, Parvovirus H1
ucacuagcguuucacaugguuggu

SEQ ID NO: 3357 - RNA, 24 nt, Lactate dehydrogenase-elevating virus
uggcuuguugcugagcgguacuga

SEQ ID NO: 3358 - RNA, 24 nt, acute bee paralysis virus
uuagugaaugguucaacauggaaa

SEQ ID NO: 3359 - RNA, 22 nt, acute bee paralysis virus
caccggguuucccauggauacg

SEQ ID NO: 3360 - RNA, 24 nt, acute bee paralysis virus
ugagagaagaccaauugaaaaagu

SEQ ID NO: 3361 - RNA, 24 nt, Saimiriine herpesvirus 2
aaaaguuuaaguaagauacuuauu

SEQ ID NO: 3362 - RNA, 24 nt, Meleagrid herpesvirus 1
uggcaagcauagauaaguauuugc

SEQ ID NO: 3363 - RNA, 24 nt, Meleagrid herpesvirus 1
gaucacagaaugugguaaacgagu

SEQ ID NO: 3364 - RNA, 24 nt, Meleagrid herpesvirus 1
ugggaugcaggugccaaucaguuu

SEQ ID NO: 3365 - RNA, 24 nt, Meleagrid herpesvirus 1
ugaaggaagcaauagcagauauua

SEQ ID NO: 3366 - RNA, 24 nt, Meleagrid herpesvirus 1
ugaccagauuacuuucuucccugu

SEQ ID NO: 3367 - RNA, 22 nt, Meleagrid herpesvirus 1
gagaauggugcacagacuguua

SEQ ID NO: 3368 - RNA, 24 nt, Meleagrid herpesvirus 1
ugaaauaaaaucggaauuugaugc

SEQ ID NO: 3369 - RNA, 24 nt, Meleagrid herpesvirus 1
uaguuuguuggaggaggccaguau

SEQ ID NO: 3370 - RNA, 24 nt, Meleagrid herpesvirus 1
ugauaugaggcucaaagugguaac

SEQ ID NO: 3371 - RNA, 24 nt, Meleagrid herpesvirus 1
ucgauaauagcgaaauggauaugg

SEQ ID NO: 3372 - RNA, 21 nt, Heliothis zea virus 1 (HZV-1)
uacccguuauuuuacaagugu

SEQ ID NO: 3373 - RNA, 24 nt, Vaccinia virus
ugaaguaauuaauuuuucugccuc

SEQ ID NO: 3374 - RNA, 22 nt, Rachiplusia ou multiple nucleopolyhedrovirus
ugagauaagauuaaaagcacgu

SEQ ID NO: 3375 - RNA, 24 nt, Rachiplusia ou multiple nucleopolyhedrovirus
augacaucauuuauauaaugacau

SEQ ID NO: 3376 - RNA, 22 nt, Rachiplusia ou multiple nucleopolyhedrovirus
augacauagccuaugagucaua

SEQ ID NO: 3377 - RNA, 24 nt, Yaba-like disease virus
uaacguaauagaaauacuaucugu

SEQ ID NO: 3378 - RNA, 24 nt, Fowlpox virus
uaugauauaucuacuauaauuagu

SEQ ID NO: 3379 - RNA, 24 nt, Fowlpox virus
uauuuugcuaacuauguaguacaa

SEQ ID NO: 3380 - RNA, 24 nt, Yaba-like disease virus
uauaaugauagugcuuuuuuuugg

SEQ ID NO: 3381 - RNA, 24 nt, Yaba-like disease virus
aucagauguugcuguuuaugauau

SEQ ID NO: 3382 - RNA, 24 nt, Yaba-like disease virus
ugggauguuuuaacuuggauaucu

SEQ ID NO: 3383 - RNA, 24 nt, Yaba-like disease virus
uaugucaaaauuacgacauuuuac

SEQ ID NO: 3384 - RNA, 24 nt, Human coronavirus 229E
gauuacgguucugauacgguuacu

SEQ ID NO: 3385 - RNA, 24 nt, Human coronavirus 229E
uaugcuacuuugugcaauuucuaa

SEQ ID NO: 3386 - RNA, 24 nt, Human coronavirus 229E
aaaggcaaguggguacaagugccu

SEQ ID NO: 3387 - RNA, 24 nt, Human coronavirus 229E
uucacagaacauaaggagguuuug

SEQ ID NO: 3388 - RNA, 24 nt, Human coronavirus 229E
uaaggaagaauuuguuguuaaaga

SEQ ID NO: 3389 - RNA, 24 nt, Human coronavirus 229E
uuacuagagcaaagaaagguauuu

SEQ ID NO: 3390 - RNA, 24 nt, Human coronavirus 229E
uaagucuauuugcaauucagcugu

SEQ ID NO: 3391 - RNA, 24 nt, Human coronavirus 229E
uggccgauguugaugauccuaaau

SEQ ID NO: 3392 - RNA, 24 nt, Human coronavirus 229E
uguacacaccuccgacugucaguu

SEQ ID NO: 3393 - RNA, 24 nt, Human coronavirus 229E
uuugguaaagaucuuaaugcuaau

SEQ ID NO: 3394 - RNA, 23 nt, Human coronavirus 229E
uacgucugaguaaaaugggcauc

SEQ ID NO: 3395 - RNA, 24 nt, Human coronavirus 229E
agaggauguuuguacuuguuacga

SEQ ID NO: 3396 - RNA, 24 nt, Human coronavirus 229E
uuaauacugucgcuggcauuccau

SEQ ID NO: 3397 - RNA, 24 nt, Human coronavirus 229E
uacuaugacuacaagacaguuuca

SEQ ID NO: 3398 - RNA, 24 nt, Human coronavirus 229E
uaacauuaauugcguuuugagcgu

SEQ ID NO: 3399 - RNA, 24 nt, Human coronavirus 229E
uuuggcguuacaacuuugauauaa

SEQ ID NO: 3400 - RNA, 24 nt, Human coronavirus 229E
uggaaugcuuaaugguaaugcaau

SEQ ID NO: 3401 - RNA, 24 nt, Human coronavirus 229E
ucgaacagcuugaaccgugugcuc

SEQ ID NO: 3402 - RNA, 24 nt, Human coronavirus 229E
uauuggacaagcucgcguagcaua

SEQ ID NO: 3403 - RNA, 24 nt, Human coronavirus 229E
uaauaugcaaccuuucauugucau

SEQ ID NO: 3404 - RNA, 24 nt, Human coronavirus 229E
uauuaaggauuguguugacauaaa

SEQ ID NO: 3405 - RNA, 24 nt, Human coronavirus 229E
guucauuuauuaauggugcgugug

SEQ ID NO: 3406 - RNA, 24 nt, Human coronavirus 229E
caugccaauugcagacccuacaca

SEQ ID NO: 3407 - RNA, 24 nt, Human coronavirus 229E
uaugaugccuguuauggguaugac

SEQ ID NO: 3408 - RNA, 24 nt, Human coronavirus 229E
uuaaugacaaaauuacugaauucc

SEQ ID NO: 3409 - RNA, 24 nt, Human coronavirus 229E
ugacuugucugugauuaaccagcg

SEQ ID NO: 3410 - RNA, 24 nt, Human coronavirus 229E
ugaaguaaaagacauugaaccugu

SEQ ID NO: 3411 - RNA, 23 nt, Human coronavirus 229E
uuaaugguauuagaguguuaaaa

SEQ ID NO: 3412 - RNA, 24 nt, Human coronavirus 229E
uuaauggcuaucgcuauuucacuu

SEQ ID NO: 3413 - RNA, 24 nt, Human coronavirus 229E
uugcauugcagacugauguuuuac

SEQ ID NO: 3414 - RNA, 24 nt, Human coronavirus 229E
agauguuagugagaugcucacuuu

SEQ ID NO: 3415 - RNA, 22 nt, Human coronavirus 229E
acacgggaaauugcccuuuuuc

SEQ ID NO: 3416 - RNA, 24 nt, Human coronavirus 229E
aucacaucucgcauaauguuugaa

SEQ ID NO: 3417 - RNA, 24 nt, Human coronavirus 229E
uaagacgcugcaagaauuaaguua

SEQ ID NO: 3418 - RNA, 21 nt, Invertebrate iridescent virus 6
uauaacaaauaaucuccggcc

SEQ ID NO: 3419 - RNA, 23 nt, Potato virus V
ugagguaaacucauugauuucaa

SEQ ID NO: 3420 - RNA, 24 nt, Helicoverpa armigera nuclear polyhedrosis virus
ucagcggcaauacagugaauguug

SEQ ID NO: 3421 - RNA, 24 nt, pestivirus type 2
ggagggaccaacuucaucucaaga

SEQ ID NO: 3422 - RNA, 24 nt, pestivirus type 2
ugagggauuuaaccagggucugga

SEQ ID NO: 3423 - RNA, 24 nt, pestivirus type 2
ugcccguucgauacgaguccuguu

SEQ ID NO: 3424 - RNA, 24 nt, Bovine herpesvirus 4
acuccaucaagaaacaucagcaga

SEQ ID NO: 3425 - RNA, 24 nt, Bovine herpesvirus 4
uagcaugagaacugaaaauaaauc

SEQ ID NO: 3426 - RNA, 24 nt, Cercopithecine herpesvirus 7
uuacccgacuugucgucugaaauu

SEQ ID NO: 3427 - RNA, 24 nt, Cercopithecine herpesvirus 7
uugguccugcguccggaguuuccu

SEQ ID NO: 3428 - RNA, 24 nt, Cercopithecine herpesvirus 7
uggcagauuuugucggacuuagau

SEQ ID NO: 3429 - RNA, 24 nt, Cercopithecine herpesvirus 7
augcauuguauucguuaagaguua

SEQ ID NO: 3430 - RNA, 24 nt, Ectocarpus siliculosus virus
gugcgcaacggagccgaguguacg

SEQ ID NO: 3431 - RNA, 24 nt, Ectocarpus siliculosus virus
uggaguacauucuccguccggugg

SEQ ID NO: 3432 - RNA, 24 nt, Tomato mosaic virus
ugaggaaauguacaaugcacuguc

SEQ ID NO: 3433 - RNA, 24 nt, Tomato mosaic virus
ugucacuuuccaugauagguuagu

SEQ ID NO: 3434 - RNA, 24 nt, Tomato mosaic virus
ugcgggaagacaaaggaaauucuu

SEQ ID NO: 3435 - RNA, 24 nt, Tomato mosaic virus
uagaacggguuaguaguuacuuau

SEQ ID NO: 3436 - RNA, 24 nt, Tomato mosaic virus
uaaaaggagccuucugcggagaug

SEQ ID NO: 3437 - RNA, 22 nt, Tomato mosaic virus
uagaacggguuaguaguuacuu

SEQ ID NO: 3438 - RNA, 24 nt, Aconitum latent virus
auaaagcucaaaccggcguauugc

SEQ ID NO: 3439 - RNA, 24 nt, Aconitum latent virus
uacaaugcuucggguacgcuucgg

SEQ ID NO: 3440 - RNA, 24 nt, Cydia pomonella granulovirus
uaugaugauuaagcggagcgguca

SEQ ID NO: 3441 - RNA, 24 nt, Cydia pomonella granulovirus
ugaggcagcaguguaauguguggu

SEQ ID NO: 3442 - RNA, 24 nt, Cydia pomonella granulovirus
aaaagugguuugaguacaugguga

SEQ ID NO: 3443 - RNA, 24 nt, Cydia pomonella granulovirus
uauugguugacggauaugacaggg

SEQ ID NO: 3444 - RNA, 24 nt, Barley yellow mosaic virus
uaacaacucaguugcacucgaauc

SEQ ID NO: 3445 - RNA, 24 nt, Barley yellow mosaic virus
uucaacaugaacuguuacuucuac

SEQ ID NO: 3446 - RNA, 24 nt, Barley yellow mosaic virus
guacauacuuuggcgaacauguug

SEQ ID NO: 3447 - RNA, 24 nt, Barley yellow mosaic virus
agagggauauggaugaagccguug

SEQ ID NO: 3448 - RNA, 24 nt, Barley yellow mosaic virus
aagcagcuaggaaauauccuuuac

SEQ ID NO: 3449 - RNA, 24 nt, Barley yellow mosaic virus
cugacaaacugcgcucuuuucucg

SEQ ID NO: 3450 - RNA, 24 nt, Taura syndrome virus
uauuguaauaugugaaaugggaaa

SEQ ID NO: 3451 - RNA, 24 nt, Taura syndrome virus
ugacguaaagcgaauuuugaaugc

SEQ ID NO: 3452 - RNA, 24 nt, Taura syndrome virus
caggcgcguauguccccaagucua

SEQ ID NO: 3453 - RNA, 24 nt, Taura syndrome virus
auguagccuauuaguuguugcuga

SEQ ID NO: 3454 - RNA, 21 nt, Invertebrate iridescent virus 6
uaucaaaagacggaacuagac

SEQ ID NO: 3455 - RNA, 24 nt, Bovine coronavirus
ugcgaacaagacuugugugauuuu

SEQ ID NO: 3456 - RNA, 24 nt, Bovine coronavirus
ugcaaugcucugcaacagauauac

SEQ ID NO: 3457 - RNA, 24 nt, Bovine coronavirus
ugacacuacuguucagucaaaaga

SEQ ID NO: 3458 - RNA, 24 nt, Bovine coronavirus
uaguuuauuuuggagguugugugu

SEQ ID NO: 3459 - RNA, 24 nt, Bovine coronavirus
uucaugcuuugguguaacgaugag

SEQ ID NO: 3460 - RNA, 24 nt, Bovine coronavirus
aacccgguaaugucggugguaaug

SEQ ID NO: 3461 - RNA, 24 nt, Bovine coronavirus
uauugcuggugcuauacuugcugu

SEQ ID NO: 3462 - RNA, 24 nt, Bovine coronavirus
ugaguaauaugcaguuguuugaag

SEQ ID NO: 3463 - RNA, 24 nt, Bovine coronavirus
aacgcgugcgugcuuggguuggcu

SEQ ID NO: 3464 - RNA, 24 nt, Bovine coronavirus
ugguaucaaguuacaaucaaagcg

SEQ ID NO: 3465 - RNA, 24 nt, Bovine coronavirus
uggcuaaugucucuguuuuaacua

SEQ ID NO: 3466 - RNA, 24 nt, Bovine coronavirus
uuaaagcccaauuuaaaacauuug

SEQ ID NO: 3467 - RNA, 24 nt, Bovine coronavirus
uuggauagcuacaguguuauuuua

SEQ ID NO: 3468 - RNA, 24 nt, Bovine coronavirus
guggauugucgccgacuucuuaaa

SEQ ID NO: 3469 - RNA, 24 nt, Bovine coronavirus
uguccugccaacacuuacucaaau

SEQ ID NO: 3470 - RNA, 24 nt, Bovine coronavirus
uuuuaugcacagucuuuguuuaga

SEQ ID NO: 3471 - RNA, 24 nt, Bovine coronavirus
uuagugcuaagaauagagcccgca

SEQ ID NO: 3472 - RNA, 24 nt, Bovine coronavirus
guacauugagucgugaagaucuug

SEQ ID NO: 3473 - RNA, 24 nt, Bovine coronavirus
ugugauuggcaguguguugcauac

SEQ ID NO: 3474 - RNA, 24 nt, Bovine coronavirus
cauaguguuacaugugauuacuug

SEQ ID NO: 3475 - RNA, 24 nt, Bovine coronavirus
ugugguacauggguucuaacuuag

SEQ ID NO: 3476 - RNA, 24 nt, Bovine coronavirus
uugauacuaaguguuuagcugauu

SEQ ID NO: 3477 - RNA, 24 nt, Bovine coronavirus
uguaguagaccaggaucuuggcuc

SEQ ID NO: 3478 - RNA, 24 nt, Bovine coronavirus
uuaaauggcuuuuugucuuauuau

SEQ ID NO: 3479 - RNA, 24 nt, Bovine coronavirus
ugugcaaauuacgcggcaaguuug

SEQ ID NO: 3480 - RNA, 24 nt, Bovine coronavirus
ugaaugguaugguuuuuggucuau

SEQ ID NO: 3481 - RNA, 24 nt, Bovine coronavirus
ugacacuacuguucagucaaaaga

SEQ ID NO: 3482 - RNA, 24 nt, Bovine coronavirus
uuacuggccaagguauuuuuguug

SEQ ID NO: 3483 - RNA, 24 nt, Bovine coronavirus
uugauuguaagagugauuuuauga

SEQ ID NO: 3484 - RNA, 24 nt, Bovine coronavirus
uuauagugugguaguacaaccaca

SEQ ID NO: 3485 - RNA, 24 nt, Bovine coronavirus
uguuauaggagauuuaaaguguac

SEQ ID NO: 3486 - RNA, 24 nt, Bovine coronavirus
ucggugcccucuccauuaaauugg

SEQ ID NO: 3487 - RNA, 24 nt, Culex nigripalpus baculovirus
uggcgguucagucggcaauauucc

SEQ ID NO: 3488 - RNA, 24 nt, Culex nigripalpus baculovirus
uguacacaauacgaauugcaggua

SEQ ID NO: 3489 - RNA, 24 nt, Culex nigripalpus baculovirus
ugugaugccaaacugucggugaag

SEQ ID NO: 3490 - RNA, 24 nt, Spodoptera litura nucleopolyhedrovirus
uaugacuauuuuggauuuaaaacg

SEQ ID NO: 3491 - RNA, 24 nt, Spodoptera litura nucleopolyhedrovirus
uucaacguaaacaauucgaucaac

SEQ ID NO: 3492 - RNA, 24 nt, deer tick virus
ugagguggccggacacuuucguuu

SEQ ID NO: 3493 - RNA, 24 nt, deer tick virus
ugagggagggcgagucaugggggc

SEQ ID NO: 3494 - RNA, 24 nt, deer tick virus
ggucauguuuaugacucaacaaaa

SEQ ID NO: 3495 - RNA, 24 nt, deer tick virus
uuuggcuuggcucaugcuggauag

SEQ ID NO: 3496 - RNA, 24 nt, Zucchini yellow mosaic virus
aacccgucacuguuaaucaauugg

SEQ ID NO: 3497 - RNA, 24 nt, Zucchini yellow mosaic virus
ucaggugagaagacaguagcagcu

SEQ ID NO: 3498 - RNA, 24 nt, Zucchini yellow mosaic virus
uaauacuguacgcaacaugauagc

SEQ ID NO: 3499 - RNA, 24 nt, Zucchini yellow mosaic virus
uaggaugcgucauuuugagcgagg

SEQ ID NO: 3500 - RNA, 24 nt, shrimp white spot syndrome virus (white spot bacilliform virus)
ucagugccucauuuacgccguaaa

SEQ ID NO: 3501 - RNA, 24 nt, shrimp white spot syndrome virus (white spot bacilliform virus)
ucagcgguuuucgugacauuuugg

SEQ ID NO: 3502 - RNA, 24 nt, shrimp white spot syndrome virus (white spot bacilliform virus)
aaggagaauguggaucuugggcaa

SEQ ID NO: 3503 - RNA, 24 nt, shrimp white spot syndrome virus (white spot bacilliform virus)
uguggaaaauucuguaucgucugc

SEQ ID NO: 3504 - RNA, 24 nt, shrimp white spot syndrome virus (white spot bacilliform virus)
ugguaucuucacugaaguaauugu

SEQ ID NO: 3505 - RNA, 24 nt, shrimp white spot syndrome virus (white spot bacilliform virus)
agcaguaguaucaauaacgaagau

SEQ ID NO: 3506 - RNA, 24 nt, shrimp white spot syndrome virus (white spot bacilliform virus)
ugauaugcaugaaggaagaaacaa

SEQ ID NO: 3507 - RNA, 24 nt, shrimp white spot syndrome virus (white spot bacilliform virus)
uauaauuguacucuauguugucua

SEQ ID NO: 3508 - RNA, 24 nt, shrimp white spot syndrome virus (white spot bacilliform virus)
ugaggcaaaguuugugccuauacc

SEQ ID NO: 3509 - RNA, 24 nt, shrimp white spot syndrome virus (white spot bacilliform virus)
uauuguauugggaaaaucaaacaa

SEQ ID NO: 3510 - RNA, 24 nt, shrimp white spot syndrome virus (white spot bacilliform virus)
uggauaguauuucuaguuguucuu

SEQ ID NO: 3511 - RNA, 24 nt, shrimp white spot syndrome virus (white spot bacilliform virus)
ugucaaacguauaagcuuggucaa

SEQ ID NO: 3512 - RNA, 24 nt, murid herpesvirus 4
uagcaugugccguccucuuuguuu

SEQ ID NO: 3513 - RNA, 22 nt, murid herpesvirus 4
gugagcaggaguugcgcuuuuc

SEQ ID NO: 3514 - RNA, 24 nt, murid herpesvirus 4
ggaaguggguccaacuuuaucccu

SEQ ID NO: 3515 - RNA, 24 nt, shrimp white spot syndrome virus (white spot bacilliform virus)
ucccugguuacauauggggagaaa

SEQ ID NO: 3516 - RNA, 24 nt, Feline immunodeficiency virus
ggaggaaugaugaaguaucucaga

SEQ ID NO: 3517 - RNA, 24 nt, shrimp white spot syndrome virus (white spot bacilliform virus)
ucuccaguaaauuucugguagcgc

SEQ ID NO: 3518 - RNA, 24 nt, Equine herpesvirus 2
uagcggcgagcgcguuucuccuga

SEQ ID NO: 3519 - RNA, 24 nt, Equine herpesvirus 2
ugagguagacgaugucccuggcgc

SEQ ID NO: 3520 - RNA, 24 nt, Equine herpesvirus 2
ugaggugcccgccgagggucuggc

SEQ ID NO: 3521 - RNA, 24 nt, Amsacta moorei entomopoxvirus
ucaauaguaacaucuguuguauua

SEQ ID NO: 3522 - RNA, 24 nt, Melanoplus sanguinipes entomopoxvirus
ugauguauauaaugcauguguucu

SEQ ID NO: 3523 - RNA, 24 nt, murid herpesvirus 4
ucacugauaaaaucuucaaccacg

SEQ ID NO: 3524 - RNA, 24 nt, murid herpesvirus 4
ugauguaguucccuuuuuccauuu

SEQ ID NO: 3525 - RNA, 24 nt, murid herpesvirus 4
ugagguguuuaguaaaaauggugg

SEQ ID NO: 3526 - RNA, 24 nt, Macaca mulatta rhadinovirus
ugugacauucggauagguuaaugg

SEQ ID NO: 3527 - RNA, 22 nt, Macaca mulatta rhadinovirus
ucuccguuaaacuccacagaca

SEQ ID NO: 3528 - RNA, 24 nt, Monkeypox virus
ugguauggaauccugaggcaccua

SEQ ID NO: 3529 - RNA, 24 nt, Monkeypox virus
ucaccguuuggguauucguuuucu

SEQ ID NO: 3530 - RNA, 24 nt, Ateline herpesvirus 3
uuaaugccaugcguagucuccaaa

SEQ ID NO: 3531 - RNA, 24 nt, Saimiriine herpesvirus 2
uuaaagcaaauucauggcuuuggu

SEQ ID NO: 3532 - RNA, 24 nt, Human herpesvirus 6
aaaagugcauguaucaauuuuagu

SEQ ID NO: 3533 - RNA, 24 nt, Human herpesvirus 6
aagcagccgcgaacucguuaauag

SEQ ID NO: 3534 - RNA, 24 nt, African swine fever virus
uucguuugacucgcuauuuccaug

SEQ ID NO: 3535 - RNA, 24 nt, African swine fever virus
uaucaugauucuuuuguuuugcua

SEQ ID NO: 3536 - RNA, 23 nt, Monkeypox virus
uaucgcauuuucuaacgugaugg

SEQ ID NO: 3537 - RNA, 24 nt, Bovine herpesvirus 4
uggguucuuguauucugagacuga

SEQ ID NO: 3538 - RNA, 24 nt, Bovine herpesvirus 4
aacacuguugugcuaucagaaaaa

SEQ ID NO: 3539 - RNA, 24 nt, African swine fever virus
uaaguuauaaauugguuccaaaac

SEQ ID NO: 3540 - RNA, 24 nt, African swine fever virus
uagaugauuucuacgacugaaaua

SEQ ID NO: 3541 - RNA, 24 nt, African swine fever virus
aaaggcauacauaugaucaauauc

SEQ ID NO: 3542 - RNA, 24 nt, Human herpesvirus 6B
ugacgugcgucggaaucggaagca

SEQ ID NO: 3543 - RNA, 24 nt, Human herpesvirus 6B
ugagugaucugauucgacaaauca

SEQ ID NO: 3544 - RNA, 24 nt, Monkeypox virus
ggaaauggauaugacaacccuaau

SEQ ID NO: 3545 - RNA, 21 nt, Monkeypox virus
uuucuuagauguuaucgacuc

SEQ ID NO: 3546 - RNA, 24 nt, Monkeypox virus
uacccaucagugauaugcaacuac

SEQ ID NO: 3547 - RNA, 24 nt, Monkeypox virus
uuagaucugacgucuaaggaagua

SEQ ID NO: 3548 - RNA, 24 nt, Monkeypox virus
uaauaaguacgcuggcuuaauguc

SEQ ID NO: 3549 - RNA, 24 nt, Monkeypox virus
agaagagcaagcucuggagucaua

SEQ ID NO: 3550 - RNA, 21 nt, Fowlpox virus
ugacuagauaugguaguccua

SEQ ID NO: 3551 - RNA, 24 nt, ictalurid herpesvirus 1
uacacaacuuccgaauccacggag

SEQ ID NO: 3552 - RNA, 24 nt, Equine herpesvirus 2
uuucacacuguaaagaguggcaua

SEQ ID NO: 3553 - RNA, 24 nt, Equine herpesvirus 2
caacacacaacuuuacauuacagc

SEQ ID NO: 3554 - RNA, 24 nt, Monkeypox virus
uaucgcauagaaauaguaaaguuu

SEQ ID NO: 3555 - RNA, 24 nt, Monkeypox virus
uuaguuacggauccuaaugaguua

SEQ ID NO: 3556 - RNA, 24 nt, Gallid herpesvirus 2
uugcauaauacggaggguucugau

SEQ ID NO: 3557 - RNA, 24 nt, Gallid herpesvirus 2
uucacauuuuuaaguuguauguag

SEQ ID NO: 3558 - RNA, 24 nt, Gallid herpesvirus 2
ugacagcaugaccuuucuggggga

SEQ ID NO: 3559 - RNA, 24 nt, Gallid herpesvirus 2
aaagaaaguuguauucugcccggu

SEQ ID NO: 3560 - RNA, 21 nt, Lymphocystis disease virus 1
aucauaccacagguaccuuuu

SEQ ID NO: 3561 - RNA, 21 nt, Lymphocystis disease virus 1
uaaaaugggaucacagaagcc

SEQ ID NO: 3562 - RNA, 22 nt, Lymphocystis disease virus 1
uaaugcuguauuuaauacaacu

SEQ ID NO: 3563 - RNA, 24 nt, Molluscum contagiosum virus
ugagguccgcguagagcgacuugg

SEQ ID NO: 3564 - RNA, 24 nt, Ectromelia virus
uauaaugucuuaucucguauauau

SEQ ID NO: 3565 - RNA, 24 nt, Amsacta moorei entomopoxvirus
caauacguuugaccaaagcaggau

SEQ ID NO: 3566 - RNA, 24 nt, African swine fever virus
ucgcaggaacucgguguuguuucu

SEQ ID NO: 3567 - RNA, 24 nt, African swine fever virus
cgaggcaauguuuacauaguccug

SEQ ID NO: 3568 - RNA, 24 nt, Ectromelia virus
uuuaaacuguuaaauguugguaua

SEQ ID NO: 3569 - RNA, 24 nt, Ectromelia virus
uaugguaaaauuaaauaguaguac

SEQ ID NO: 3570 - RNA, 21 nt, Camelpox virus
uaucacaugcgccggcaguca

SEQ ID NO: 3571 - RNA, 24 nt, Camelpox virus
uaugguaaaauuaaauaguaguac

SEQ ID NO: 3572 - RNA, 24 nt, ictalurid herpesvirus 1
ugcccggccguuaucgaaaaaaca

SEQ ID NO: 3573 - RNA, 23 nt, ictalurid herpesvirus 1
uggcacacgugaacggugaagug

SEQ ID NO: 3574 - RNA, 24 nt, ictalurid herpesvirus 1
ugaccuauucucggcauuucuccu

SEQ ID NO: 3575 - RNA, 24 nt, ictalurid herpesvirus 1
ugauaucgaugacauuguggaacg

SEQ ID NO: 3576 - RNA, 24 nt, Swinepox virus
aacggcaaaucuaaugguauagua

SEQ ID NO: 3577 - RNA, 24 nt, Swinepox virus
uauuauugggcuaugcauucgaua

SEQ ID NO: 3578 - RNA, 24 nt, turkey adenovirus 3
ugaacuccguacuaaugaaguuuu

SEQ ID NO: 3579 - RNA, 24 nt, turkey adenovirus 3
ugugaaaguauuucacuuuuauua

SEQ ID NO: 3580 - RNA, 24 nt, Fowlpox virus
aaagggauuucguuuacuaccugu

SEQ ID NO: 3581 - RNA, 24 nt, Fowlpox virus
uaagaaaauauagcuaccaaagau

SEQ ID NO: 3582 - RNA, 24 nt, Fowlpox virus
uaguuuauagucgugauaaacgua

SEQ ID NO: 3583 - RNA, 24 nt, Fowlpox virus
uuaugugguccgcgaugaagauuu

SEQ ID NO: 3584 - RNA, 22 nt, Fowlpox virus
aaucacacaaaccauaguuaga

SEQ ID NO: 3585 - RNA, 21 nt, Swinepox virus
uaucugacaccguaugguacu

SEQ ID NO: 3586 - RNA, 24 nt, Human herpesvirus 5
uggccagacgcugugcaucccguc

SEQ ID NO: 3587 - RNA, 24 nt, Human herpesvirus 5
uggccugcguugaugcgcacguaa

SEQ ID NO: 3588 - RNA, 24 nt, Human herpesvirus 5
ucaccagaaugcuaguuuguagag

SEQ ID NO: 3589 - RNA, 24 nt, Swinepox virus
ugagaucguaugaugcuacagaua

SEQ ID NO: 3590 - RNA, 24 nt, Amsacta moorei entomopoxvirus
gagcauuuuccaaagaauuuauau

SEQ ID NO: 3591 - RNA, 24 nt, Gallid herpesvirus 3
uacaauguuucgaugcaacugaaa

SEQ ID NO: 3592 - RNA, 24 nt, Gallid herpesvirus 3
ugauauguucccaguagguauguc

SEQ ID NO: 3593 - RNA, 24 nt, Meleagrid herpesvirus 1
ugaaaugcaugacggaucacuaau

SEQ ID NO: 3594 - RNA, 24 nt, Gallid herpesvirus 3
uggaguggucggggagggcaggcg

SEQ ID NO: 3595 - RNA, 24 nt, Rat cytomegalovirus
ugaaguaguucuuguacagggcgu

SEQ ID NO: 3596 - RNA, 24 nt, Human adenovirus E
ucgcagccccccugcucccagagc

SEQ ID NO: 3597 - RNA, 24 nt, Vaccinia virus
ucaccacguguguuucaggaucau

SEQ ID NO: 3598 - RNA, 24 nt, Vaccinia virus
ucuggcggcuagaauggcauaauc

SEQ ID NO: 3599 - RNA, 24 nt, Human herpesvirus 4
uagcauaugcuacccagauauaga

SEQ ID NO: 3600 - RNA, 24 nt, Human herpesvirus 4
agcuguaaaaauagaacgcccugg

SEQ ID NO: 3601 - RNA, 24 nt, Human herpesvirus 4
ugaggaccaacaacccugugcuug

SEQ ID NO: 3602 - RNA, 24 nt, Human herpesvirus 4
uagcauaugcuacccagauauaga

SEQ ID NO: 3603 - RNA, 24 nt, Periplaneta fuliginosa densovirus
uaagguaccggcgaaaagguccga

SEQ ID NO: 3604 - RNA, 24 nt, Periplaneta fuliginosa densovirus
uagcuucgcuauaccccaccacaa

SEQ ID NO: 3605 - RNA, 22 nt, Periplaneta fuliginosa densovirus
uucagaaauaucugccaacaca

SEQ ID NO: 3606 - RNA, 24 nt, Gallid herpesvirus 2
uugcauagauguguuuuauuaugu

SEQ ID NO: 3607 - RNA, 24 nt, Gallid herpesvirus 2
ugagguuguauuuugcgucuaauc

SEQ ID NO: 3608 - RNA, 24 nt, Gallid herpesvirus 2
ucgacaacaaugaguguaccuacc

SEQ ID NO: 3609 - RNA, 24 nt, Cowpea mottle virus
gugcagugcucguuugcuggccau

SEQ ID NO: 3610 - RNA, 24 nt, Human herpesvirus 2
ugggauguaaagcagcugcccggg

SEQ ID NO: 3611 - RNA, 24 nt, Human herpesvirus 5
ugagggagcucacccaacaccguc

SEQ ID NO: 3612 - RNA, 24 nt, Sulfolobus virus SIRV-1
ucugcaggauauuuaacuuuaaag

SEQ ID NO: 3613 - RNA, 24 nt, Sulfolobus virus SIRV-1
aaaagugauauaaugcauuuuugu

SEQ ID NO: 3614 - RNA, 24 nt, Melanoplus sanguinipes entomopoxvirus
uaucaaauaaauuuuuuaauccuu

SEQ ID NO: 3615 - RNA, 24 nt, Melanoplus sanguinipes entomopoxvirus
uauugugauauauauucccaaugu

SEQ ID NO: 3616 - RNA, 22 nt, Saimiriine herpesvirus 2
ggcaaugacagaaagguaacau

SEQ ID NO: 3617 - RNA, 24 nt, Saimiriine herpesvirus 2
uaugaaauuuucauuugugucugc

SEQ ID NO: 3618 - RNA, 24 nt, Saimiriine herpesvirus 2
ugguaagcauacugcauaagcuaa

SEQ ID NO: 3619 - RNA, 24 nt, Saimiriine herpesvirus 2
cagcagcuucucgcacucugucug

SEQ ID NO: 3620 - RNA, 22 nt, Alcelaphine herpesvirus 1
uccagagaaacaccaaaaauuc

SEQ ID NO: 3621 - RNA, 24 nt, Alcelaphine herpesvirus 1
ugaaaaggcuucaaaguccucugc

SEQ ID NO: 3622 - RNA, 24 nt, Human herpesvirus 8
uagguaacacuggaagaggacgca

SEQ ID NO: 3623 - RNA, 24 nt, Human herpesvirus 8
ugagggacguuugcagauagauag

SEQ ID NO: 3624 - RNA, 24 nt, Pothos latent virus
ccgaaugccaaccaaaaacuauaa

SEQ ID NO: 3625 - RNA, 24 nt, Pothos latent virus
uacccggucugcagguucaacauc

SEQ ID NO: 3626 - RNA, 24 nt, Trichoplusia ni cytoplasmic polyhedrosis virus 15
uaagacagcagaauuaguuaauga

SEQ ID NO: 3627 - RNA, 24 nt, Trichoplusia ni cytoplasmic polyhedrosis virus 15
ugaguauauauuuguugaagauuu

SEQ ID NO: 3628 - RNA, 23 nt, Vaccinia virus
uauccagagauaucuuguaaugg

SEQ ID NO: 3629 - RNA, 24 nt, Vaccinia virus
ugagaccaucgaaggagacuccau

SEQ ID NO: 3630 - RNA, 24 nt, Vaccinia virus
uaauauuuuugugagaccaucgaa

SEQ ID NO: 3631 - RNA, 24 nt, Vaccinia virus
uaauauuuuugugagaccaucgaa

SEQ ID NO: 3632 - RNA, 24 nt, Peanut clump virus
uccacaguaggcgauccagaccau

SEQ ID NO: 3633 - RNA, 24 nt, Peanut clump virus
ucccugaacaaaaaccauaccaaa

SEQ ID NO: 3634 - RNA, 24 nt, Peanut clump virus
ugaaguaagagaauugacuucgua

SEQ ID NO: 3635 - RNA, 24 nt, infectious spleen and kidney necrosis virus
ucauaucgaauagauccaccacau

SEQ ID NO: 3636 - RNA, 24 nt, infectious spleen and kidney necrosis virus
gagcugcguggggccauaggguga

SEQ ID NO: 3637 - RNA, 24 nt, infectious spleen and kidney necrosis virus
uguacaccggcugccaguggauug

SEQ ID NO: 3638 - RNA, 22 nt, infectious spleen and kidney necrosis virus
uguaaugccaaaugccaagucc

SEQ ID NO: 3639 - RNA, 24 nt, infectious spleen and kidney necrosis virus
uugaaugccgccaccgggaccaug

SEQ ID NO: 3640 - RNA, 24 nt, infectious spleen and kidney necrosis virus
uaugacacggccgcaaaaugagcu

SEQ ID NO: 3641 - RNA, 24 nt, Amsacta moorei entomopoxvirus
aaaggauuauugcauuuauuaagu

SEQ ID NO: 3642 - RNA, 24 nt, African swine fever virus
ucaccagaauuucaaugguuucug

SEQ ID NO: 3643 - RNA, 24 nt, Human herpesvirus 4
ugucauucucuuggacuaacgagg

SEQ ID NO: 3644 - RNA, 24 nt, Human herpesvirus 4
uggcucgagggccugucgcagcuc

SEQ ID NO: 3645 - RNA, 24 nt, Human herpesvirus 4
ggaggugaucacagcgcgucaugu

SEQ ID NO: 3646 - RNA, 24 nt, Melanoplus sanguinipes entomopoxvirus
uuauaacuaaaaaauccuacuaaa

SEQ ID NO: 3647 - RNA, 24 nt, Melanoplus sanguinipes entomopoxvirus
uucauauaauuuuaauauuucaga

SEQ ID NO: 3648 - RNA, 24 nt, Melanoplus sanguinipes entomopoxvirus
uaacaaauuuuguaauuccuuuag

SEQ ID NO: 3649 - RNA, 24 nt, beet soil-borne mosaic virus
agcagcauuuaauugcuaauuggu

SEQ ID NO: 3650 - RNA, 23 nt, beet soil-borne mosaic virus
uucccgggcauacgcucaaccuc

SEQ ID NO: 3651 - RNA, 24 nt, beet soil-borne mosaic virus
uacccauccuccaccaauguuuuc

SEQ ID NO: 3652 - RNA, 23 nt, infectious spleen and kidney necrosis virus
ugaccgggcucauuuuucuucug

SEQ ID NO: 3653 - RNA, 24 nt, infectious spleen and kidney necrosis virus
uagcuuacaggauagggaagccug

SEQ ID NO: 3654 - RNA, 24 nt, infectious spleen and kidney necrosis virus
uggccagcugcugaagcuuguuca

SEQ ID NO: 3655 - RNA, 24 nt, Human herpesvirus 7
agagguauuuuuuuguuaggucug

SEQ ID NO: 3656 - RNA, 24 nt, Human herpesvirus 7
ucagcuaaaacuuugcaacaagca

SEQ ID NO: 3657 - RNA, 21 nt, Human herpesvirus 6
uggcucgaguucgauauguuc

SEQ ID NO: 3658 - RNA, 24 nt, Human herpesvirus 6
uuacuagaugguaaagcguuguua

SEQ ID NO: 3659 - RNA, 24 nt, Carnation Italian ringspot virus
uaucccacuucucccgaaaaauug

SEQ ID NO: 3660 - RNA, 24 nt, Carnation Italian ringspot virus
aacacagucauccccacaguuugc

SEQ ID NO: 3661 - RNA, 24 nt, Tomato bushy stunt virus
ucacaaaaucucuuaaucuuaucg

SEQ ID NO: 3662 - RNA, 24 nt, Tomato bushy stunt virus
ugucccauuuagcccggaaaauug

SEQ ID NO: 3663 - RNA, 24 nt, Tomato bushy stunt virus
uucaacggguuaagcuguaacaaa

SEQ ID NO: 3664 - RNA, 24 nt, Tomato spotted wilt virus
uagcuuuguugaucuauuucccua

SEQ ID NO: 3665 - RNA, 24 nt, Tomato spotted wilt virus
uaagaugagaauucuaaaacuacu

SEQ ID NO: 3666 - RNA, 24 nt, Tomato spotted wilt virus
ggaggaaaauucuucauuucagaa

SEQ ID NO: 3667 - RNA, 24 nt, Tomato spotted wilt virus
uggaaugguuccaucuaauaguga

SEQ ID NO: 3668 - RNA, 24 nt, Tomato spotted wilt virus
uccaagaauacaugacacuaccaa

SEQ ID NO: 3669 - RNA, 21 nt, Tomato spotted wilt virus
aagaagcuugguguuuugcaa

SEQ ID NO: 3670 - RNA, 24 nt, lumpy skin disease virus
uauguuguaacuaauauacuuugu

SEQ ID NO: 3671 - RNA, 24 nt, lumpy skin disease virus
uuaaaggcuuguuucuauacgaua

SEQ ID NO: 3672 - RNA, 24 nt, Goatpox virus
uaaauuaauauaugugcgcuuaau

SEQ ID NO: 3673 - RNA, 24 nt, Meleagrid herpesvirus 1
ucacgggucgcuucguagccgucu

SEQ ID NO: 3674 - RNA, 24 nt, Meleagrid herpesvirus 1
ucagucuauuagcgcuuucauuac

SEQ ID NO: 3675 - RNA, 24 nt, Meleagrid herpesvirus 1
aaggaucuauacugcaauuauucc

SEQ ID NO: 3676 - RNA, 24 nt, Meleagrid herpesvirus 1
aaggauauuguggguuuaauguau

SEQ ID NO: 3677 - RNA, 24 nt, Meleagrid herpesvirus 1
uggaaugcauuaucggacacaugc

SEQ ID NO: 3678 - RNA, 24 nt, sheeppox virus
ucaauaguucguuuugucgauuuu

SEQ ID NO: 3679 - RNA, 23 nt, sheeppox virus
uucgauaaaaucuacaggugaua

SEQ ID NO: 3680 - RNA, 24 nt, Goatpox virus
uaauaauacauuuauaucaauugu

SEQ ID NO: 3681 - RNA, 24 nt, sheeppox virus
uaaauuaauauaugugcacuuaau

SEQ ID NO: 3682 - RNA, 24 nt, Melanoplus sanguinipes entomopoxvirus
uaauacaaauuuaauauuuuggcc

SEQ ID NO: 3683 - RNA, 24 nt, Melanoplus sanguinipes entomopoxvirus
uggaaaaacaaguuuuaaguguuu

SEQ ID NO: 3684 - RNA, 24 nt, Equine herpesvirus 1
uaucucaucgugcgcaacaccggg

SEQ ID NO: 3685 - RNA, 22 nt, Melanoplus sanguinipes entomopoxvirus
uggcuuguaauagauccuuggu

SEQ ID NO: 3686 - RNA, 24 nt, Variola virus
uucaucaucgaauuuaagagaucc

SEQ ID NO: 3687 - RNA, 24 nt, Camelpox virus
uguaaugucuuucauguuauaagu

SEQ ID NO: 3688 - RNA, 23 nt, Variola virus
ucgucggagcuguacaccauagc

SEQ ID NO: 3689 - RNA, 24 nt, Ectromelia virus
uauaauuauuuuguaagaugaugu

SEQ ID NO: 3690 - RNA, 24 nt, Camelpox virus
uaggauauacucaauagaauuugu

SEQ ID NO: 3691 - RNA, 24 nt, Ectromelia virus
uguaaugucuuucauguuauaagu

SEQ ID NO: 3692 - RNA, 24 nt, Cowpox virus
uauauuaauaaaguacucauuagg

SEQ ID NO: 3693 - RNA, 24 nt, Ectromelia virus
guggauuaguauacucucuucccu

SEQ ID NO: 3694 - RNA, 21 nt, Ectromelia virus
uuuaacauaugauauucguuc

SEQ ID NO: 3695 - RNA, 24 nt, Cowpox virus
uccacguuuuuuaauuuuguuaua

SEQ ID NO: 3696 - RNA, 24 nt, Human herpesvirus 3
uacccgcaacgauucauccccucu

SEQ ID NO: 3697 - RNA, 24 nt, Leishmania RNA virus 1-4
uaucagccauuuugcucaagaauu

SEQ ID NO: 3698 - RNA, 24 nt, Leishmania RNA virus 1-4
ugaguuacaacuccgacgacuugg

SEQ ID NO: 3699 - RNA, 24 nt, Leishmania RNA virus 1-4
aacccgggccguagcagccgcaag

SEQ ID NO: 3700 - RNA, 24 nt, Leishmania RNA virus 1-4
ugucacagaaucggguugcgcugu

SEQ ID NO: 3701 - RNA, 22 nt, Leishmania RNA virus 1-4
uauaacaacuccaccacaagga

SEQ ID NO: 3702 - RNA, 24 nt, Leishmania RNA virus 1-1
uccaagaauuguauacucagggua

SEQ ID NO: 3703 - RNA, 22 nt, Leishmania RNA virus 1-1
ucacacgcgaguaacagccucg

SEQ ID NO: 3704 - RNA, 24 nt, Leishmania RNA virus 1-1
ggagguaguuucucuucagaucuc

SEQ ID NO: 3705 - RNA, 24 nt, Leishmania RNA virus 1-1
ugagauuagcuaucaaguuaucag

SEQ ID NO: 3706 - RNA, 21 nt, Leishmania RNA virus 1-1
uucaucaaugccuccugcuga

SEQ ID NO: 3707 - RNA, 24 nt, Leishmania RNA virus 1-1
uguaugcuuguccuucuuuccuug

SEQ ID NO: 3708 - RNA, 24 nt, Cowpox virus
uauguuaauaauuaugguguggug

SEQ ID NO: 3709 - RNA, 24 nt, Cowpox virus
ugacguaaccaagaaguguaucua

SEQ ID NO: 3710 - RNA, 24 nt, Cowpox virus
uguaaugucuuucauguuauaagu

SEQ ID NO: 3711 - RNA, 24 nt, Cowpox virus
agagauguaacgggaacuggguuu

SEQ ID NO: 3712 - RNA, 24 nt, Cowpox virus
guggauuaguguacucucuucccu

SEQ ID NO: 3713 - RNA, 24 nt, Chimpanzee cytomegalovirus
ugccgagcgugaguacgagauacc

SEQ ID NO: 3714 - RNA, 24 nt, Chimpanzee cytomegalovirus
uuugggaugaaaucuagguccggg

SEQ ID NO: 3715 - RNA, 24 nt, Chimpanzee cytomegalovirus
uauggccaacccaauucccauacu

SEQ ID NO: 3716 - RNA, 24 nt, Chimpanzee cytomegalovirus
cagcagcacgaaaugcggcgcgcg

SEQ ID NO: 3717 - RNA, 24 nt, Chimpanzee cytomegalovirus
ugaggccggggcggaaggcggguc

SEQ ID NO: 3718 - RNA, 24 nt, Chimpanzee cytomegalovirus
gaaaguauagccccccuccuccgc

SEQ ID NO: 3719 - RNA, 24 nt, Chimpanzee cytomegalovirus
ugacguagacgguguauguugcaa

SEQ ID NO: 3720 - RNA, 24 nt, Equine herpesvirus 4
ucaggugcccacugauauaacgcg

SEQ ID NO: 3721 - RNA, 24 nt, Equine herpesvirus 4
uggcgcggaugucugcgugccagg

SEQ ID NO: 3722 - RNA, 24 nt, Equine herpesvirus 4
caaagugguagugccuguugcacg

SEQ ID NO: 3723 - RNA, 24 nt, Equine herpesvirus 1
uguaaaggguauguuuuuauuuac

SEQ ID NO: 3724 - RNA, 24 nt, Equine herpesvirus 1
ugaaaucuggaugccgcccauguu

SEQ ID NO: 3725 - RNA, 24 nt, Rana tigrina ranavirus
ugagagagauuacaucuuaagaug

SEQ ID NO: 3726 - RNA, 22 nt, Broad bean necrosis virus
uucguagaggccaaguaaguca

SEQ ID NO: 3727 - RNA, 24 nt, Broad bean necrosis virus
ugagaggcuucaauauuacuaauc

SEQ ID NO: 3728 - RNA, 23 nt, Beet western yellows virus
uaugacaagucaaaucuccaucu

SEQ ID NO: 3729 - RNA, 24 nt, Beet western yellows virus
ugagggcgcugagcgcgucguguu

SEQ ID NO: 3730 - RNA, 22 nt, Beet western yellows virus
uggaauauccgggguucacauc

SEQ ID NO: 3731 - RNA, 24 nt, Cereal yellow dwarf virus - RPV
ugucucgccacggcccccuccucc

SEQ ID NO: 3732 - RNA, 24 nt, Cereal yellow dwarf virus - RPV
gagguuaguucugcgguggcgcca

SEQ ID NO: 3733 - RNA, 24 nt, Cereal yellow dwarf virus - RPV
ucaauccgaaagucaucccaguuc

SEQ ID NO: 3734 - RNA, 22 nt, Cereal yellow dwarf virus - RPV
ucuuauacucaugguaggccuu

SEQ ID NO: 3735 - RNA, 24 nt, Cereal yellow dwarf virus - RPV
ugagagaggcgaccuguaaguagu

SEQ ID NO: 3736 - RNA, 22 nt, Cereal yellow dwarf virus - RPV
accacauaugcaauaacgcgca

SEQ ID NO: 3737 - RNA, 24 nt, Cereal yellow dwarf virus - RPV
ugagacaucccagaagggacacuu

SEQ ID NO: 3738 - RNA, 22 nt, ictalurid herpesvirus 1
gcacggguacggacgccgcgcg

SEQ ID NO: 3739 - RNA, 24 nt, ictalurid herpesvirus 1
ugauguacucgggggggaugccuu

SEQ ID NO: 3740 - RNA, 23 nt, Barley yellow dwarf virus - PAV
ugugcaggguauguuuuacagua

SEQ ID NO: 3741 - RNA, 24 nt, Beet mild yellowing virus
ugucucgcucgaaccuguuccucu

SEQ ID NO: 3742 - RNA, 24 nt, Beet mild yellowing virus
agugguaagcggccaucacucgaa

SEQ ID NO: 3743 - RNA, 23 nt, Cercopithecine herpesvirus 7
ugaggacgacgaugacgaggagg

SEQ ID NO: 3744 - RNA, 24 nt, Cercopithecine herpesvirus 7
ggagguagacgggucgcaggggcg

SEQ ID NO: 3745 - RNA, 24 nt, Cercopithecine herpesvirus 7
gcgaaagauguggcgggcggguuu

SEQ ID NO: 3746 - RNA, 24 nt, Cercopithecine herpesvirus 7
ucacccgguagggggucguauauu

SEQ ID NO: 3747 - RNA, 24 nt, Cercopithecine herpesvirus 7
ugucacagaacuguuuauccaaua

SEQ ID NO: 3748 - RNA, 24 nt, Molluscum contagiosum virus
uguggaagucgucauaggccuggu

SEQ ID NO: 3749 - RNA, 24 nt, Molluscum contagiosum virus
agagguaguccaggcccucgccgu

SEQ ID NO: 3750 - RNA, 24 nt, Molluscum contagiosum virus
cucgcgcacguccucuaccaccgc

SEQ ID NO: 3751 - RNA, 24 nt, Molluscum contagiosum virus
uguccuggcgagagcgcgcuucuu

SEQ ID NO: 3752 - RNA, 24 nt, White clover mosaic virus
ugucaagugggacagugguuggcu

SEQ ID NO: 3753 - RNA, 24 nt, White clover mosaic virus
ugacugaggcaacguaaucgaugg

SEQ ID NO: 3754 - RNA, 21 nt, White clover mosaic virus
ugagauuucaauggaagcucc

SEQ ID NO: 3755 - RNA, 24 nt, Human herpesvirus 8
cagccuaagggccaugugccuugg

SEQ ID NO: 3756 - RNA, 24 nt, Sulfolobus virus SIRV-1
ucuaaaaaucaaaaauucuaugac

SEQ ID NO: 3757 - RNA, 24 nt, Human herpesvirus 8
uguguaacgacccuaccugugccu

SEQ ID NO: 3758 - RNA, 24 nt, Strawberry mild yellow edge virus
uagcuaauugcagggaggcguaga

SEQ ID NO: 3759 - RNA, 24 nt, Strawberry mild yellow edge virus
uugaccaugugugucaguugcauu

SEQ ID NO: 3760 - RNA, 24 nt, Strawberry mild yellow edge virus
uugguuccgucggaauacuucccu

SEQ ID NO: 3761 - RNA, 24 nt, Meleagrid herpesvirus 1
ugaaaugcuaucucggucauuucu

SEQ ID NO: 3762 - RNA, 24 nt, Meleagrid herpesvirus 1
uucauuaacuuagauuuccggaca

SEQ ID NO: 3763 - RNA, 24 nt, Meleagrid herpesvirus 1
ucagcagguaagguggugggacgg

SEQ ID NO: 3764 - RNA, 24 nt, Meleagrid herpesvirus 1
uggagugcgagguugaaaucguca

SEQ ID NO: 3765 - RNA, 24 nt, Melanoplus sanguinipes entomopoxvirus
uauauuacacguuuuugagcaacu

SEQ ID NO: 3766 - RNA, 24 nt, Mayaro virus
ucgccgacagcgccuucacaagau

SEQ ID NO: 3767 - RNA, 24 nt, Mayaro virus
ucaacgccuuggacaccguucgau

SEQ ID NO: 3768 - RNA, 24 nt, murid herpesvirus 4
uugguuacgcccaaaaauccgacc

SEQ ID NO: 3769 - RNA, 24 nt, murid herpesvirus 4
uccacugaaaugucauaauugccc

SEQ ID NO: 3770 - RNA, 23 nt, murid herpesvirus 4
gcaccagagggucaguuuucaga

SEQ ID NO: 3771 - RNA, 24 nt, Potato mop-top virus
ugugaaacugaccauaaauaaaau

SEQ ID NO: 3772 - RNA, 24 nt, Canine adenovirus type 1
ucacacuuuugcauuggggaaaug

SEQ ID NO: 3773 - RNA, 24 nt, Canine adenovirus type 1
uaaguuaacagaguuuuuuauaaa

SEQ ID NO: 3774 - RNA, 24 nt, Tulip virus X
uaggauacguggaguggggaaggg

SEQ ID NO: 3775 - RNA, 24 nt, Tulip virus X
ucacaguuaaucaugauguuguug

SEQ ID NO: 3776 - RNA, 24 nt, Tulip virus X
ugaagagccuugaucaguuucgug

SEQ ID NO: 3777 - RNA, 24 nt, Tulip virus X
ugagauccucgguuuggacgcagu

SEQ ID NO: 3778 - RNA, 24 nt, porcine epidemic diarrhea virus
uacaacacuccuuauaaaacuuac

SEQ ID NO: 3779 - RNA, 24 nt, porcine epidemic diarrhea virus
gagcacauguugagcauccaucua

SEQ ID NO: 3780 - RNA, 24 nt, porcine epidemic diarrhea virus
ugagugcaacccugaagguuugau

SEQ ID NO: 3781 - RNA, 24 nt, porcine epidemic diarrhea virus
ugaguacugcaacaguguuauuug

SEQ ID NO: 3782 - RNA, 24 nt, porcine epidemic diarrhea virus
uuuacaauuacaguuugcuagauu

SEQ ID NO: 3783 - RNA, 24 nt, porcine epidemic diarrhea virus
uucacacucaagcauaagacauug

SEQ ID NO: 3784 - RNA, 24 nt, porcine epidemic diarrhea virus
uuugguauguugagacguuuggau

SEQ ID NO: 3785 - RNA, 24 nt, porcine epidemic diarrhea virus
uaugauggaacacuauacuauccc

SEQ ID NO: 3786 - RNA, 24 nt, porcine epidemic diarrhea virus
ugacucgcugucuggccauacaug

SEQ ID NO: 3787 - RNA, 24 nt, porcine epidemic diarrhea virus
ugagucuggugacuacauuaaacc

SEQ ID NO: 3788 - RNA, 24 nt, porcine epidemic diarrhea virus
uacaacaacauguuccugcgccau

SEQ ID NO: 3789 - RNA, 22 nt, porcine epidemic diarrhea virus
uggcaaguuuucugaugaaguc

SEQ ID NO: 3790 - RNA, 24 nt, porcine epidemic diarrhea virus
ucagagcagacggcuguugugauu

SEQ ID NO: 3791 - RNA, 24 nt, porcine epidemic diarrhea virus
uacccguuaucuaagcaugaaaac

SEQ ID NO: 3792 - RNA, 24 nt, porcine epidemic diarrhea virus
aagcagcgcuccauuaaggcagaa

SEQ ID NO: 3793 - RNA, 24 nt, porcine epidemic diarrhea virus
ucauugcgucuauuugcagcggaa

SEQ ID NO: 3794 - RNA, 24 nt, porcine epidemic diarrhea virus
uaagacagcacucuucaacaagua

SEQ ID NO: 3795 - RNA, 24 nt, porcine epidemic diarrhea virus
uaucaaggacaaugauggcaaggu

SEQ ID NO: 3796 - RNA, 24 nt, porcine epidemic diarrhea virus
ugauacgcaugauuucagccauga

SEQ ID NO: 3797 - RNA, 24 nt, porcine epidemic diarrhea virus
gugcauugguuguacuggcuuacu

SEQ ID NO: 3798 - RNA, 24 nt, porcine epidemic diarrhea virus
ucaauguaggaaaaccuguagugg

SEQ ID NO: 3799 - RNA, 24 nt, porcine epidemic diarrhea virus
ggauguaacccucaacaccacugg

SEQ ID NO: 3800 - RNA, 24 nt, porcine epidemic diarrhea virus
ugaaguagacuccucugcaccuga

SEQ ID NO: 3801 - RNA, 24 nt, porcine epidemic diarrhea virus
ucacuggucuuaauacaauguggg

SEQ ID NO: 3802 - RNA, 24 nt, Poinsettia mosaic virus
uggcacgucgaagcugacgaaguc

SEQ ID NO: 3803 - RNA, 24 nt, Poinsettia mosaic virus
uggauagguuguugaaagcgucuu

SEQ ID NO: 3804 - RNA, 24 nt, Poinsettia mosaic virus
ugcgagcaagcgagggugaugucc

SEQ ID NO: 3805 - RNA, 24 nt, Poinsettia mosaic virus
cgacgugguuggauucgagcuguu

SEQ ID NO: 3806 - RNA, 24 nt, Poinsettia mosaic virus
uguuggacugugugcgaacaaagc

SEQ ID NO: 3807 - RNA, 24 nt, Strawberry mottle virus
ugagauuuuacccuuccacuauaa

SEQ ID NO: 3808 - RNA, 24 nt, Strawberry mottle virus
uuacacaggcuuagccauguugac

SEQ ID NO: 3809 - RNA, 24 nt, Strawberry mottle virus
uaagguaggccucaacguuuacag

SEQ ID NO: 3810 - RNA, 24 nt, African swine fever virus
uucaaugaauuguuauucaugucg

SEQ ID NO: 3811 - RNA, 24 nt, Strawberry mottle virus
uggguucuuuauuccggacaaggu

SEQ ID NO: 3812 - RNA, 24 nt, African swine fever virus
ugaggccguuugucucggccucgc

SEQ ID NO: 3813 - RNA, 24 nt, African swine fever virus
uaucacaacgugcccuaagaugug

SEQ ID NO: 3814 - RNA, 24 nt, Strawberry mottle virus
ucacugagaaacuagcuuucuggg

SEQ ID NO: 3815 - RNA, 24 nt, Human herpesvirus 2
uggcggucucguccccgacggcgu

SEQ ID NO: 3816 - RNA, 24 nt, Human herpesvirus 2
ugccacgucagcuggcaggugaag

SEQ ID NO: 3817 - RNA, 24 nt, Human herpesvirus 2
ugugguucggggggcggaugcguu

SEQ ID NO: 3818 - RNA, 22 nt, Porcine adenovirus C
ugugcaacacuaccaggacuga

SEQ ID NO: 3819 - RNA, 24 nt, Chimpanzee cytomegalovirus
ugacguagaaggccgacuccgaga

SEQ ID NO: 3820 - RNA, 24 nt, Chimpanzee cytomegalovirus
cggcgagccgcccagacggaucuu

SEQ ID NO: 3821 - RNA, 23 nt, Duck adenovirus 1
uacuuugcccccgguuucuacgc

SEQ ID NO: 3822 - RNA, 24 nt, Camelpox virus
auaggaacaugauauuuucuguac

SEQ ID NO: 3823 - RNA, 24 nt, Camelpox virus
uuuacggagaugaaauauccucua

SEQ ID NO: 3824 - RNA, 21 nt, Camelpox virus
aacaauaacacgcuucuguuc

SEQ ID NO: 3825 - RNA, 24 nt, Camelpox virus
gaucucauggauuuuauuacauuu

SEQ ID NO: 3826 - RNA, 24 nt, Camelpox virus
uggcggucucuagcugcuggauga

SEQ ID NO: 3827 - RNA, 24 nt, Monkeypox virus
ucaguguccuaugaucaaugacga

SEQ ID NO: 3828 - RNA, 24 nt, Monkeypox virus
uauuauauguuugaguuuguuuag

SEQ ID NO: 3829 - RNA, 21 nt, Monkeypox virus
uuuaacauaugauauucguuc

SEQ ID NO: 3830 - RNA, 24 nt, Camelpox virus
agagauguaacgggaacaggguuu

SEQ ID NO: 3831 - RNA, 24 nt, Monkeypox virus
uuaggaacuauguucaugguaucc

SEQ ID NO: 3832 - RNA, 24 nt, Saimiriine herpesvirus 2
uuacauggucgaucugaaguuuua

SEQ ID NO: 3833 - RNA, 24 nt, Saimiriine herpesvirus 2
ugacaugauugaguccagaagcua

SEQ ID NO: 3834 - RNA, 21 nt, Saimiriine herpesvirus 2
uguguucagcaacaacuucau

SEQ ID NO: 3835 - RNA, 24 nt, Saimiriine herpesvirus 2
ucugaugccguaaauguuuaaguu

SEQ ID NO: 3836 - RNA, 24 nt, Saimiriine herpesvirus 2
uaaauuguuuuugcuuuugugggc

SEQ ID NO: 3837 - RNA, 21 nt, Ononis yellow mosaic virus
aggagcagagauggaggguug

SEQ ID NO: 3838 - RNA, 24 nt, Barley stripe mosaic virus
ugugguuuguuccaaauacucucu

SEQ ID NO: 3839 - RNA, 24 nt, Barley stripe mosaic virus
uucucagauaaaguggccguucca

SEQ ID NO: 3840 - RNA, 24 nt, Barley stripe mosaic virus
ugaaggaccuuguguaccgcaagc

SEQ ID NO: 3841 - RNA, 24 nt, Barley stripe mosaic virus
uaaggaauuuuacaaaguuaaagg

SEQ ID NO: 3842 - RNA, 24 nt, Barley stripe mosaic virus
uuggucagagcgcuguguagaccu

SEQ ID NO: 3843 - RNA, 24 nt, Barley stripe mosaic virus
ugcuguauugauaggucagaagga

SEQ ID NO: 3844 - RNA, 24 nt, maize rayado fino virus
uaacaggcccgcccacggugaucu

SEQ ID NO: 3845 - RNA, 24 nt, maize rayado fino virus
ugcgcaaacucguugagguugaug

SEQ ID NO: 3846 - RNA, 24 nt, maize rayado fino virus
uggaaugggagacgaggccagaac

SEQ ID NO: 3847 - RNA, 24 nt, Beet mild yellowing virus
uaugacgaauggccgagaugcugg

SEQ ID NO: 3848 - RNA, 24 nt, Beet mild yellowing virus
ugagauccgaucaagaacucguug

SEQ ID NO: 3849 - RNA, 24 nt, Beet mild yellowing virus
ugagcuccccaaguuuuacuucuc

SEQ ID NO: 3850 - RNA, 24 nt, Chayote mosaic tymovirus
ucaguguugucgucauaggugccg

SEQ ID NO: 3851 - RNA, 24 nt, Chayote mosaic tymovirus
uagcugccggcgugauggcuuucg

SEQ ID NO: 3852 - RNA, 24 nt, Chayote mosaic tymovirus
cgggauccgagacgcgaaggguuc

SEQ ID NO: 3853 - RNA, 22 nt, Bamboo mosaic virus
uggcuagguaguaggugaccuu

SEQ ID NO: 3854 - RNA, 24 nt, Bamboo mosaic virus
uucgguaguugcugcgucugugua

SEQ ID NO: 3855 - RNA, 24 nt, Bamboo mosaic virus
uggcgagcagggucucuaguugug

SEQ ID NO: 3856 - RNA, 24 nt, Bamboo mosaic virus
uuucacauggugggggcagaugcu

SEQ ID NO: 3857 - RNA, 21 nt, Fowlpox virus
agguaugaaaacaauucauac

SEQ ID NO: 3858 - RNA, 24 nt, Fowlpox virus
uacuauaucuucuauagcgaaugu

SEQ ID NO: 3859 - RNA, 24 nt, Cercopithecine herpesvirus 7
uuaaaugugauuccaauguccaag

SEQ ID NO: 3860 - RNA, 24 nt, Cercopithecine herpesvirus 7
ucguuuaaauugauacucuguguc

SEQ ID NO: 3861 - RNA, 22 nt, Cercopithecine herpesvirus 7
guuguuguggaauuguuaacgg

SEQ ID NO: 3862 - RNA, 24 nt, Cowpox virus
ugagaccauugaagagagaaagag

SEQ ID NO: 3863 - RNA, 24 nt, Cowpox virus
agcagcaauagcaauauauaugac

SEQ ID NO: 3864 - RNA, 24 nt, Cowpox virus
ugaauaggguuaucgauucagaca

SEQ ID NO: 3865 - RNA, 24 nt, Cowpox virus
uaaaaacuugugugaaauuuugua

SEQ ID NO: 3866 - RNA, 21 nt, Cowpox virus
uuggaucuaacuguaguacuc

SEQ ID NO: 3867 - RNA, 24 nt, Camelpox virus
uauccagagauaucuuguaauggc

SEQ ID NO: 3868 - RNA, 24 nt, Camelpox virus
ugauauacucacaaauuuucuuuu

SEQ ID NO: 3869 - RNA, 23 nt, Swinepox virus
uaugauacaccaaaggauuaaua

SEQ ID NO: 3870 - RNA, 24 nt, Meleagrid herpesvirus 1
uauccuagcauugugaaguagaac

SEQ ID NO: 3871 - RNA, 24 nt, Meleagrid herpesvirus 1
ugccaugaauuacggcuucgauga

SEQ ID NO: 3872 - RNA, 24 nt, Meleagrid herpesvirus 1
gugcaaugcaccaucgaacguucu

SEQ ID NO: 3873 - RNA, 24 nt, Ectromelia virus
uguagugcucaaauacucaucaga

SEQ ID NO: 3874 - RNA, 23 nt, Ectromelia virus
uauccagagauaucuuguaaugg

SEQ ID NO: 3875 - RNA, 24 nt, Camelpox virus
ugauauacucacaaauuuucuuuu

SEQ ID NO: 3876 - RNA, 24 nt, Ectromelia virus
ugaaaucuuuacuugaucaggaua

SEQ ID NO: 3877 - RNA, 24 nt, Cucumber green mottle mosaic virus
ugagaucuuuaacgcaaaauuaag

SEQ ID NO: 3878 - RNA, 24 nt, Cucumber green mottle mosaic virus
uggcaacaauaaccacuugcacuu

SEQ ID NO: 3879 - RNA, 24 nt, Rana tigrina ranavirus
uacaaucuuaaguuucuuuauacu

SEQ ID NO: 3880 - RNA, 24 nt, Rana tigrina ranavirus
uggcaaucaccagccuccuccccc

SEQ ID NO: 3881 - RNA, 24 nt, Melanoplus sanguinipes entomopoxvirus
ugaguaaccaguaauaacuucaug

SEQ ID NO: 3882 - RNA, 24 nt, Cucumber fruit mottle mosaic virus
uggaaacaucuagcucuagaaucu

SEQ ID NO: 3883 - RNA, 24 nt, Cucumber fruit mottle mosaic virus
uaagacaucuugauuaugaacuua

SEQ ID NO: 3884 - RNA, 24 nt, Cucumber fruit mottle mosaic virus
acaccagaaauccuaacaaacaaa

SEQ ID NO: 3885 - RNA, 24 nt, Rift Valley fever virus
uagcuuauagcucucacuguaugg

SEQ ID NO: 3886 - RNA, 24 nt, Rift Valley fever virus
ucguaagggccacuaacauccaac

SEQ ID NO: 3887 - RNA, 22 nt, Rift Valley fever virus
aacuugcagcucugaccugaga

SEQ ID NO: 3888 - RNA, 24 nt, Odontoglossum ringspot virus
gagcuuccauuggcaccgucgagu

SEQ ID NO: 3889 - RNA, 24 nt, Odontoglossum ringspot virus
agauguaugauaagagccaagugu

SEQ ID NO: 3890 - RNA, 24 nt, Odontoglossum ringspot virus
aauaguguaagacauauucaauac

SEQ ID NO: 3891 - RNA, 24 nt, Odontoglossum ringspot virus
uaaagggaauuuguucaguaucac

SEQ ID NO: 3892 - RNA, 23 nt, Odontoglossum ringspot virus
uucaaaggcugauaaauuaauaa

SEQ ID NO: 3893 - RNA, 24 nt, Human herpesvirus 4
ugaccagcugguugcucccauucu

SEQ ID NO: 3894 - RNA, 24 nt, Cactus virus X
ucaaagcaguaauuaacuauuucu

SEQ ID NO: 3895 - RNA, 22 nt, Cactus virus X
ucgcgaguuggaagauggcuuc

SEQ ID NO: 3896 - RNA, 24 nt, Cactus virus X
ugagaaaacacggccuccaccugc

SEQ ID NO: 3897 - RNA, 24 nt, Human adenovirus C
uagguuuuucucccaccauaagca

SEQ ID NO: 3898 - RNA, 24 nt, Human adenovirus C
gcagugccggcggcgccugaggag

SEQ ID NO: 3899 - RNA, 24 nt, Human adenovirus C
ugaaaugucccguccggacggaga

SEQ ID NO: 3900 - RNA, 24 nt, Botrytis virus F
aagcugcagggggguugggcgggg

SEQ ID NO: 3901 - RNA, 24 nt, Botrytis virus F
aggcagucauugcgggugggauau

SEQ ID NO: 3902 - RNA, 24 nt, Botrytis virus F
ugugaucccagugggcagcuacga

SEQ ID NO: 3903 - RNA, 24 nt, Cowpox virus
uaguuuauaccauucaauauaauc

SEQ ID NO: 3904 - RNA, 24 nt, Vaccinia virus
uuagauacauggucucagaaguag

SEQ ID NO: 3905 - RNA, 21 nt, Camelpox virus
uaugaaguaaaguaucuacga

SEQ ID NO: 3906 - RNA, 24 nt, Equine herpesvirus 1
uggcagcucgccguuuccuaggua

SEQ ID NO: 3907 - RNA, 24 nt, Equine herpesvirus 1
uuugguaucagcgagagcagcaca

SEQ ID NO: 3908 - RNA, 24 nt, Equine herpesvirus 1
ugagguacaaucggguuucucuug

SEQ ID NO: 3909 - RNA, 24 nt, Equine herpesvirus 1
uacagcaguuaccgcgcgagaaug

SEQ ID NO: 3910 - RNA, 24 nt, Avian nephritis virus
uaccacguagugccagauugguuu

SEQ ID NO: 3911 - RNA, 21 nt, Avian nephritis virus
gucacaguuugaccaccagua

SEQ ID NO: 3912 - RNA, 24 nt, Avian nephritis virus
ucaagugcaguagcugcaacuuug

SEQ ID NO: 3913 - RNA, 24 nt, Avian nephritis virus
uggguugccuuucuugacaugagu

SEQ ID NO: 3914 - RNA, 24 nt, Scallion virus X
uggcacacguggaauuagcagugg

SEQ ID NO: 3915 - RNA, 24 nt, Scallion virus X
ugagguggugggaggcgaaauuga

SEQ ID NO: 3916 - RNA, 22 nt, Scallion virus X
ugagcuggcucguuggugguca

SEQ ID NO: 3917 - RNA, 24 nt, Clover yellow mosaic virus
ugacguacaugaauaguugcauga

SEQ ID NO: 3918 - RNA, 24 nt, Clover yellow mosaic virus
ugagcuguauaacucccuuucgug

SEQ ID NO: 3919 - RNA, 24 nt, Clover yellow mosaic virus
uaccugcuggccucuuugaguugu

SEQ ID NO: 3920 - RNA, 24 nt, Clover yellow mosaic virus
uggcuggugguuuugaugaagugg

SEQ ID NO: 3921 - RNA, 24 nt, Camelpox virus
uauccagagauaucuuguaauggc

SEQ ID NO: 3922 - RNA, 24 nt, Camelpox virus
agagguuggaauaucaacuaguug

SEQ ID NO: 3923 - RNA, 24 nt, Camelpox virus
ucuauaguuuguaauauggagcuu

SEQ ID NO: 3924 - RNA, 24 nt, Strawberry mottle virus
uaaagugauaagcaaaccuauugu

SEQ ID NO: 3925 - RNA, 24 nt, Tupaia herpesvirus
aaaggugggcccggucagcuggac

SEQ ID NO: 3926 - RNA, 24 nt, Tupaia herpesvirus
uggaguggugacuuucuguggacu

SEQ ID NO: 3927 - RNA, 21 nt, Tupaia herpesvirus
ucugaucaaaacucaguggac

SEQ ID NO: 3928 - RNA, 24 nt, Tupaia herpesvirus
uccaggggcuccuguugggauacc

SEQ ID NO: 3929 - RNA, 24 nt, Fowlpox virus
uucaaagucuugcguuaucguacu

SEQ ID NO: 3930 - RNA, 24 nt, Fowlpox virus
uuaaugcguucuugaucuaacagu

SEQ ID NO: 3931 - RNA, 24 nt, Fowl adenovirus D
uggaagggagcgucggucucuucc

SEQ ID NO: 3932 - RNA, 22 nt, Fowl adenovirus D
ugccaugguaacaaugguucgu

SEQ ID NO: 3933 - RNA, 24 nt, Fowl adenovirus D
ugacgagauucagaaugaccgugg

SEQ ID NO: 3934 - RNA, 24 nt, Equine herpesvirus 2
agauggaggcgguccuguugcucu

SEQ ID NO: 3935 - RNA, 24 nt, Equine herpesvirus 2
cgagguauuaaggggaaaaaagga

SEQ ID NO: 3936 - RNA, 24 nt, Human herpesvirus 1
uggcauccagagggcgcugaagau

SEQ ID NO: 3937 - RNA, 24 nt, Tacaribe virus
ugaggucaggcaucacacuuguuc

SEQ ID NO: 3938 - RNA, 24 nt, Tacaribe virus
ugaaguucuuagauguuugcauag

SEQ ID NO: 3939 - RNA, 24 nt, Tacaribe virus
ugagaugacaggcuucauuagaag

SEQ ID NO: 3940 - RNA, 24 nt, Tacaribe virus
aacacugauuaagacauugcaguc

SEQ ID NO: 3941 - RNA, 24 nt, Equine herpesvirus 2
uuaaacacuaacuggcugguuuua

SEQ ID NO: 3942 - RNA, 24 nt, Equine herpesvirus 2
aagcaccagcauuaaucuuuugac

SEQ ID NO: 3943 - RNA, 24 nt, Equine herpesvirus 2
uaagggagcgagcuguuggauuau

SEQ ID NO: 3944 - RNA, 24 nt, Equine herpesvirus 2
ccagaaccugaucacaccucucuu

SEQ ID NO: 3945 - RNA, 24 nt, Equine herpesvirus 2
ugaggucggguaugcuaaugggac

SEQ ID NO: 3946 - RNA, 24 nt, Bovine herpesvirus 4
ucaaauguggauccugccaggguc

SEQ ID NO: 3947 - RNA, 24 nt, Bovine herpesvirus 4
uaaaauguuuuuuucaaaguguag

SEQ ID NO: 3948 - RNA, 24 nt, Bovine herpesvirus 4
uaugguggcaagaugucucccauc

SEQ ID NO: 3949 - RNA, 23 nt, Bovine herpesvirus 4
uagccaggcucaggcuuccuguu

SEQ ID NO: 3950 - RNA, 24 nt, Bovine herpesvirus 4
uuuauuguuuaccugcuagaagau

SEQ ID NO: 3951 - RNA, 24 nt, Bovine herpesvirus 4
accacaucuuugugucauuuuuaa

SEQ ID NO: 3952 - RNA, 24 nt, Gallid herpesvirus 3
ugacgugcgcauaguugagcgacg

SEQ ID NO: 3953 - RNA, 24 nt, Gallid herpesvirus 3
ugaagugcauagugaagauggacu

SEQ ID NO: 3954 - RNA, 24 nt, turkey adenovirus 3
uaagcaaauugaguuacaugcuuc

SEQ ID NO: 3955 - RNA, 24 nt, turkey adenovirus 3
uacuacacgcucagauucuuggcu

SEQ ID NO: 3956 - RNA, 24 nt, turkey adenovirus 3
cagcucacuauauuacuucucgcu

SEQ ID NO: 3957 - RNA, 24 nt, turkey adenovirus 3
guaaaggaguugugguuaaagcca

SEQ ID NO: 3958 - RNA, 24 nt, Monkeypox virus
ugagauuuuuguuuaauguguuca

SEQ ID NO: 3959 - RNA, 24 nt, Monkeypox virus
uauccagagauaucuuguaauggc

SEQ ID NO: 3960 - RNA, 24 nt, Monkeypox virus
uguagugcucagauacucaucaga

SEQ ID NO: 3961 - RNA, 24 nt, Camelpox virus
uaccuuuguacgacauuaaugcua

SEQ ID NO: 3962 - RNA, 23 nt, Monkeypox virus
uucaucaugugccaacgucucaa

SEQ ID NO: 3963 - RNA, 24 nt, Human adenovirus D
uggcaaaggagccauagagggcgu

SEQ ID NO: 3964 - RNA, 24 nt, Human adenovirus D
cauugcaugagcccguagcugcgc

SEQ ID NO: 3965 - RNA, 24 nt, Human adenovirus D
ugagcucggcgaugguggcgcgca

SEQ ID NO: 3966 - RNA, 24 nt, Human adenovirus D
agggguagcggucguuguccacca

SEQ ID NO: 3967 - RNA, 24 nt, Human adenovirus D
uagcaggggcgcugggcguggugc

SEQ ID NO: 3968 - RNA, 24 nt, Yaba-like disease virus
uaaaguguagauacaguccuuaaa

SEQ ID NO: 3969 - RNA, 24 nt, Yaba-like disease virus
uuaaaaguuuuuuccucuauauug

SEQ ID NO: 3970 - RNA, 24 nt, Blackcurrant reversion virus
ugucuuggaaugggccaccuuccu

SEQ ID NO: 3971 - RNA, 24 nt, Blackcurrant reversion virus
cacccguggugagaggcugcgacu

SEQ ID NO: 3972 - RNA, 24 nt, Blackcurrant reversion virus
uuaauguuauggacacacguauug

SEQ ID NO: 3973 - RNA, 24 nt, Blackcurrant reversion virus
ugacgagacucgaaucaucuacgu

SEQ ID NO: 3974 - RNA, 24 nt, beet soil-borne mosaic virus
uaagagagcuugagguugagcgua

SEQ ID NO: 3975 - RNA, 24 nt, beet soil-borne mosaic virus
ugaccacgaucaauuugaucucaa

SEQ ID NO: 3976 - RNA, 24 nt, beet soil-borne mosaic virus
aagcuuaccuguuauuaaggccaa

SEQ ID NO: 3977 - RNA, 24 nt, beet soil-borne mosaic virus
uaaagagucuaugguuuucuaggg

SEQ ID NO: 3978 - RNA, 24 nt, beet soil-borne mosaic virus
cgacuagagaauuuguuacugugu

SEQ ID NO: 3979 - RNA, 24 nt, Grapevine virus A
uaucucaacagccugcucgccgau

SEQ ID NO: 3980 - RNA, 24 nt, Grapevine virus A
uagcaugguucaucaucugcgugg

SEQ ID NO: 3981 - RNA, 24 nt, Grapevine virus A
uggaauguaguaaucaaauagucc

SEQ ID NO: 3982 - RNA, 24 nt, Grapevine virus A
uacccgaagagaguguucagguac

SEQ ID NO: 3983 - RNA, 24 nt, Grapevine virus A
aacaguguuuaaguaugguuuggc

SEQ ID NO: 3984 - RNA, 24 nt, A-2 plaque virus
caagcacuugccgacugguacuga

SEQ ID NO: 3985 - RNA, 24 nt, A-2 plaque virus
uacgguaauuucaagauugacucc

SEQ ID NO: 3986 - RNA, 24 nt, A-2 plaque virus
agagauugcagauggggcuggugu

SEQ ID NO: 3987 - RNA, 24 nt, A-2 plaque virus
uugaauauacuggucccugagcau

SEQ ID NO: 3988 - RNA, 24 nt, Human enterovirus C
ucaccggggaaacagaagugcuug

SEQ ID NO: 3989 - RNA, 24 nt, Human enterovirus C
uaauuuagaauuucacccaacaug

SEQ ID NO: 3990 - RNA, 24 nt, Human enterovirus C
uagcuuccaccaccauccccuuga

SEQ ID NO: 3991 - RNA, 22 nt, Human enterovirus C
uacacaugggugcgauggucac

SEQ ID NO: 3992 - RNA, 24 nt, Beet virus Q
ugacguaaaagacaaaguuccuca

SEQ ID NO: 3993 - RNA, 24 nt, Beet virus Q
uaggucaccauuggauguugccgc

SEQ ID NO: 3994 - RNA, 24 nt, Beet virus Q
agagauggagaaauacuugggcaa

SEQ ID NO: 3995 - RNA, 24 nt, Human enterovirus A
uggcaucagagucggacaccguug

SEQ ID NO: 3996 - RNA, 24 nt, Beet virus Q
uugggcaacacacgcuaugagaag

SEQ ID NO: 3997 - RNA, 24 nt, Human enterovirus A
uacccugcaaaucuccaacagauu

SEQ ID NO: 3998 - RNA, 24 nt, Beet virus Q
ugaaagagaaucaauuaaaugugg

SEQ ID NO: 3999 - RNA, 24 nt, Saimiriine herpesvirus 2
ugagcuacugauccaaaaaggcua

SEQ ID NO: 4000 - RNA, 24 nt, Saimiriine herpesvirus 2
ugagguacacuguuauuagguaac

SEQ ID NO: 4001 - RNA, 24 nt, Grapevine fleck virus
ggagguacuggguguagaggaugg

SEQ ID NO: 4002 - RNA, 24 nt, Swinepox virus
caucacauaaucuauuaucaaugg

SEQ ID NO: 4003 - RNA, 24 nt, Swinepox virus
uaugugaucaccucuauccguuaa

SEQ ID NO: 4004 - RNA, 24 nt, Swinepox virus
uauuaaaauguuuagcuaguuuuu

SEQ ID NO: 4005 - RNA, 24 nt, Vaccinia virus
uaucaaacauggagacgccugaua

SEQ ID NO: 4006 - RNA, 24 nt, Vaccinia virus
augcagaaguaaugaagaaaagua

SEQ ID NO: 4007 - RNA, 24 nt, Vaccinia virus
uaacaccacgaacaugucgcagua

SEQ ID NO: 4008 - RNA, 24 nt, Yaba-like disease virus
uaagguaauaauuccaaggaaaua

SEQ ID NO: 4009 - RNA, 24 nt, Yaba-like disease virus
uguaacagucuuuuuguaguagau

SEQ ID NO: 4010 - RNA, 24 nt, Yaba-like disease virus
uuaauucgugcggacuuaaguuga

SEQ ID NO: 4011 - RNA, 24 nt, Yaba-like disease virus
uguuaggaaccaaaauguaaacuu

SEQ ID NO: 4012 - RNA, 24 nt, Yaba-like disease virus
uauaacauugucguuguaauuaag

SEQ ID NO: 4013 - RNA, 23 nt, Human herpesvirus 5
uuaaauccgagauaauugcccgg

SEQ ID NO: 4014 - RNA, 24 nt, Human herpesvirus 5
agcagcaacccgaacgcgaccagg

SEQ ID NO: 4015 - RNA, 24 nt, Human herpesvirus 5
ugacgugauaguuacggugauugu

SEQ ID NO: 4016 - RNA, 21 nt, Foot-and-mouth disease virus SAT 2 (FMDV-SAT2)
uucagagaacguggcuuucgg

SEQ ID NO: 4017 - RNA, 24 nt, Foot-and-mouth disease virus SAT 2 (FMDV-SAT2)
ugcaaugaugaccuugcuguugaa

SEQ ID NO: 4018 - RNA, 24 nt, Foot-and-mouth disease virus SAT 2 (FMDV-SAT2)
ugacgaggcacgagauaggcagua

SEQ ID NO: 4019 - RNA, 24 nt, Foot-and-mouth disease virus SAT 2 (FMDV-SAT2)
ugagaagggcacaaucauacugga

SEQ ID NO: 4020 - RNA, 21 nt, Human adenovirus D
ucugacacuacaaccucauac

SEQ ID NO: 4021 - RNA, 24 nt, Human adenovirus D
gcagguacgcggaaguccacaacc

SEQ ID NO: 4022 - RNA, 24 nt, Foot-and-mouth disease virus C
uguacacuuguuguuucagccuug

SEQ ID NO: 4023 - RNA, 24 nt, Foot-and-mouth disease virus C
ggaaaagugcuauuaccucuuuga

SEQ ID NO: 4024 - RNA, 24 nt, Foot-and-mouth disease virus C
aaagugaaaccuccgguucagagc

SEQ ID NO: 4025 - RNA, 22 nt, Foot-and-mouth disease virus C
uggcaaggaucagcuugaccag

SEQ ID NO: 4026 - RNA, 22 nt, Foot-and-mouth disease virus C
uggcaagcaaacuuguauucuc

SEQ ID NO: 4027 - RNA, 22 nt, Foot-and-mouth disease virus C
ucaccgggcccuugugguaggc

SEQ ID NO: 4028 - RNA, 24 nt, Foot-and-mouth disease virus O
ucaccguuguaaagugugaauucc

SEQ ID NO: 4029 - RNA, 24 nt, Foot-and-mouth disease virus O
uggaauccgaacuccgugcggaac

SEQ ID NO: 4030 - RNA, 24 nt, Foot-and-mouth disease virus O
ugacgaggcacgagguaggcagug

SEQ ID NO: 4031 - RNA, 22 nt, Melanoplus sanguinipes entomopoxvirus
uauaauuaauguuuccaaauuu

SEQ ID NO: 4032 - RNA, 24 nt, Melanoplus sanguinipes entomopoxvirus
ucaauguauuuuuuacauguuuua

SEQ ID NO: 4033 - RNA, 22 nt, Garlic latent virus
agagaucuggguagaccaagau

SEQ ID NO: 4034 - RNA, 24 nt, Garlic latent virus
ucagugcagaucccauggaacuua

SEQ ID NO: 4035 - RNA, 24 nt, Garlic latent virus
uugcucacuuuuuuuuccucaaaa

SEQ ID NO: 4036 - RNA, 24 nt, Garlic latent virus
ucacuguggaguggauccccgagu

SEQ ID NO: 4037 - RNA, 24 nt, Myxoma virus
uaacugcugcaacaaagugaaacu

SEQ ID NO: 4038 - RNA, 24 nt, Myxoma virus
ucgauaaacuccuuguccgcggag

SEQ ID NO: 4039 - RNA, 24 nt, Myxoma virus
uaaaguguacguuuacauaccgcc

SEQ ID NO: 4040 - RNA, 24 nt, Garlic virus C
ucccugggcagacguggccugguu

SEQ ID NO: 4041 - RNA, 24 nt, Human adenovirus A
uggaaaaauuuguacuacucuuaa

SEQ ID NO: 4042 - RNA, 24 nt, Human adenovirus A
uagcaguauuugguuacgccgggc

SEQ ID NO: 4043 - RNA, 23 nt, Human adenovirus A
uaguauuuccuugaucuuuuucc

SEQ ID NO: 4044 - RNA, 24 nt, Human adenovirus A
uauugcaaaccaaagaacgguggg

SEQ ID NO: 4045 - RNA, 24 nt, Human adenovirus A
cauaaacccagccuauguaguuug

SEQ ID NO: 4046 - RNA, 24 nt, Human adenovirus A
uuaaagcuuuuaguaauaccugaa

SEQ ID NO: 4047 - RNA, 24 nt, sheeppox virus
uaaguuuaaaucuggcaaauguuc

SEQ ID NO: 4048 - RNA, 24 nt, sheeppox virus
uuacguaaauaaaaucuuuaacaa

SEQ ID NO: 4049 - RNA, 24 nt, Variola virus
uuacuuguuuaauaucuauauccg

SEQ ID NO: 4050 - RNA, 24 nt, Fowlpox virus
uuaauguuguuuucuuacuaacgg

SEQ ID NO: 4051 - RNA, 24 nt, Garlic virus A
ucacugggugugacgcgaaguuca

SEQ ID NO: 4052 - RNA, 24 nt, Garlic virus A
ugacggggaguugauuggauuuaa

SEQ ID NO: 4053 - RNA, 24 nt, Garlic virus A
ucaguguauggugagaaaugggcc

SEQ ID NO: 4054 - RNA, 24 nt, Garlic virus A
ugaagucgaaguuucggagguuug

SEQ ID NO: 4055 - RNA, 24 nt, Macaca mulatta rhadinovirus
ucaccgcggcgcauauugggucuc

SEQ ID NO: 4056 - RNA, 24 nt, Bovine herpesvirus 1
ugagcucgaggauggggauggaca

SEQ ID NO: 4057 - RNA, 24 nt, Fowlpox virus
uuagauaagauuccugaacucacu

SEQ ID NO: 4058 - RNA, 22 nt, Fowlpox virus
ugucacguauagaggcaucggc

SEQ ID NO: 4059 - RNA, 24 nt, Fowlpox virus
cagccaaaugcaaggguguuugau

SEQ ID NO: 4060 - RNA, 24 nt, Fowlpox virus
uaccaugguaguguuauuuaggcu

SEQ ID NO: 4061 - RNA, 24 nt, Fowlpox virus
cauuauaggauaguaauaguuuua

SEQ ID NO: 4062 - RNA, 24 nt, Fowlpox virus
uacuauaccauaaucuauuaggua

SEQ ID NO: 4063 - RNA, 24 nt, Fowlpox virus
ugaaaauaauuuauaagcuauuaa

SEQ ID NO: 4064 - RNA, 22 nt, Fowlpox virus
uaccguguuauaauauuaagaa

SEQ ID NO: 4065 - RNA, 24 nt, Triatoma virus
ugaaauguaauuuggacucuucca

SEQ ID NO: 4066 - RNA, 24 nt, Triatoma virus
uucacauuuuaccacaggucguug

SEQ ID NO: 4067 - RNA, 24 nt, Triatoma virus
uaagauucuuucaccaauacauuc

SEQ ID NO: 4068 - RNA, 24 nt, Triatoma virus
agaaaaguaauuagguauuuuuaa

SEQ ID NO: 4069 - RNA, 24 nt, Triatoma virus
uagcagaggaucccguaaaguuau

SEQ ID NO: 4070 - RNA, 24 nt, Triatoma virus
uaagauaguguacuuuugcccaca

SEQ ID NO: 4071 - RNA, 24 nt, Triatoma virus
ugacauaagugcaucagguaauuu

SEQ ID NO: 4072 - RNA, 24 nt, Triatoma virus
ucaucuggagacagaucaucuagu

SEQ ID NO: 4073 - RNA, 24 nt, Duck adenovirus 1
acagguaauaccucugccggauau

SEQ ID NO: 4074 - RNA, 24 nt, Duck adenovirus 1
ugguuugaaagaugguccucuguc

SEQ ID NO: 4075 - RNA, 24 nt, Duck adenovirus 1
ugaaguuuuugugaccggucagug

SEQ ID NO: 4076 - RNA, 24 nt, Duck adenovirus 1
aaaaguguuagaauuuguaaaugg

SEQ ID NO: 4077 - RNA, 24 nt, Human herpesvirus 6
uguggaaacaguacugucuucaga

SEQ ID NO: 4078 - RNA, 24 nt, Human herpesvirus 6
ucgaaugaaaguuuuguuauaugg

SEQ ID NO: 4079 - RNA, 24 nt, Human herpesvirus 6
ggagguaguugguauacgcguuua

SEQ ID NO: 4080 - RNA, 24 nt, Human herpesvirus 6
ucgaaugugcgugcucugaggaca

SEQ ID NO: 4081 - RNA, 24 nt, Human herpesvirus 6
gaagguaucuuucauaaguuuggc

SEQ ID NO: 4082 - RNA, 24 nt, Human herpesvirus 6
guccaguugaaauuagauuucauu

SEQ ID NO: 4083 - RNA, 24 nt, Alcelaphine herpesvirus 1
ugaggcaggccacuugcacuugca

SEQ ID NO: 4084 - RNA, 24 nt, Alcelaphine herpesvirus 1
cggaaaagcuauuuucaaauacau

SEQ ID NO: 4085 - RNA, 24 nt, Alcelaphine herpesvirus 1
ucaguuaaagcccggaauguuuuu

SEQ ID NO: 4086 - RNA, 24 nt, Alcelaphine herpesvirus 1
ugagcaacacucccugccccagcu

SEQ ID NO: 4087 - RNA, 24 nt, Alcelaphine herpesvirus 1
agacucgccugaccacuagcccgg

SEQ ID NO: 4088 - RNA, 24 nt, Alcelaphine herpesvirus 1
uuuguccagacuagccuaacacga

SEQ ID NO: 4089 - RNA, 24 nt, Human herpesvirus 1
uccccgggggaaaacaggauagcu

SEQ ID NO: 4090 - RNA, 24 nt, Human herpesvirus 1
uggcggcgagauugaugcccaucg

SEQ ID NO: 4091 - RNA, 24 nt, Himetobi P virus
uaacacauaguauaagucgauuua

SEQ ID NO: 4092 - RNA, 24 nt, Himetobi P virus
uuagggauauauucgaugagauuc

SEQ ID NO: 4093 - RNA, 24 nt, Himetobi P virus
agcagcaagaaagugaugaggcau

SEQ ID NO: 4094 - RNA, 24 nt, Himetobi P virus
cagaguagggggagauauauggua

SEQ ID NO: 4095 - RNA, 24 nt, Himetobi P virus
aacaccauuaccuauccuggaaac

SEQ ID NO: 4096 - RNA, 24 nt, Himetobi P virus
uuauacggcucaccaagcuccucc

SEQ ID NO: 4097 - RNA, 24 nt, Himetobi P virus
ugugaugcgugcauacguuguggg

SEQ ID NO: 4098 - RNA, 24 nt, Himetobi P virus
augacauuucauccaucuuacuac

SEQ ID NO: 4099 - RNA, 24 nt, Cercopithecine herpesvirus 7
uuacaugcgaagaguuguauuuug

SEQ ID NO: 4100 - RNA, 24 nt, Cercopithecine herpesvirus 7
uugcauuuaaagauccaaguucug

SEQ ID NO: 4101 - RNA, 24 nt, Cercopithecine herpesvirus 7
uguaauauauaugccgucuaaacu

SEQ ID NO: 4102 - RNA, 24 nt, Wheat streak mosaic virus
uggaaucccacaacuuuuaggucu

SEQ ID NO: 4103 - RNA, 24 nt, Wheat streak mosaic virus
ugcaaacagcuuguucuguauucc

SEQ ID NO: 4104 - RNA, 24 nt, Wheat streak mosaic virus
uguuaacuugaugagcuugcccuc

SEQ ID NO: 4105 - RNA, 23 nt, Wheat streak mosaic virus
uaccauaugguguuggcacgugc

SEQ ID NO: 4106 - RNA, 24 nt, Cowpea aphid-borne mosaic virus
ugagagagaaauugcccagcacuu

SEQ ID NO: 4107 - RNA, 24 nt, Cowpea aphid-borne mosaic virus
ugagaucauccaggcccugaacgc

SEQ ID NO: 4108 - RNA, 24 nt, Cowpea aphid-borne mosaic virus
uaggacaguucaacaguaaugagu

SEQ ID NO: 4109 - RNA, 22 nt, Perina nuda picorna-like virus
ucaaaaguaggaagcucggggu

SEQ ID NO: 4110 - RNA, 24 nt, Perina nuda picorna-like virus
cugcagucugcauaacucguaguu

SEQ ID NO: 4111 - RNA, 24 nt, Perina nuda picorna-like virus
uuuaauggugugacaucaaacgag

SEQ ID NO: 4112 - RNA, 24 nt, Perina nuda picorna-like virus
uuacagguucaauagcuuuaccca

SEQ ID NO: 4113 - RNA, 24 nt, Perina nuda picorna-like virus
ugugguaaaguaauugaccauguu

SEQ ID NO: 4114 - RNA, 24 nt, Perina nuda picorna-like virus
ugaggugccagaacgaaauuugag

SEQ ID NO: 4115 - RNA, 24 nt, Perina nuda picorna-like virus
uaacaccagauuuaucccuauuga

SEQ ID NO: 4116 - RNA, 24 nt, Perina nuda picorna-like virus
cggcacaugaaaaacggucacauu

SEQ ID NO: 4117 - RNA, 24 nt, Perina nuda picorna-like virus
guguauuuggugcuuccgucuucu

SEQ ID NO: 4118 - RNA, 24 nt, acute bee paralysis virus
ugucugaacaacaguccccacauu

SEQ ID NO: 4119 - RNA, 24 nt, acute bee paralysis virus
ugauauccaaacaaucuccagugg

SEQ ID NO: 4120 - RNA, 24 nt, acute bee paralysis virus
aagaagcuuauaauuauaagcccu

SEQ ID NO: 4121 - RNA, 21 nt, acute bee paralysis virus
uaacugagucaaguccgggga

SEQ ID NO: 4122 - RNA, 24 nt, acute bee paralysis virus
uggcuaguuuaaaugcuaaugaug

SEQ ID NO: 4123 - RNA, 24 nt, Bean yellow mosaic virus
ugagaaguuccuucgccacauaau

SEQ ID NO: 4124 - RNA, 24 nt, Bean yellow mosaic virus
uaugacaaacuuauacucuuucau

SEQ ID NO: 4125 - RNA, 23 nt, Bean yellow mosaic virus
uuaaauccaaauuaacguggguc

SEQ ID NO: 4126 - RNA, 24 nt, Bean yellow mosaic virus
ugauuuaggucuguuggucuauug

SEQ ID NO: 4127 - RNA, 22 nt, Ryegrass mosaic virus
ugauaucguacgucgacuugcu

SEQ ID NO: 4128 - RNA, 24 nt, Ryegrass mosaic virus
ugcgauguuguugcuaagucgacc

SEQ ID NO: 4129 - RNA, 24 nt, Ryegrass mosaic virus
ugucguacaucaauuccucaaauu

SEQ ID NO: 4130 - RNA, 21 nt, Ryegrass mosaic virus
uuucauaguucguccaucaac

SEQ ID NO: 4131 - RNA, 24 nt, Hepatitis GB virus A
ucaccggcuggaauuucuguuucc

SEQ ID NO: 4132 - RNA, 23 nt, Hepatitis GB virus A
ugcgauaccaccuaagcuucacc

SEQ ID NO: 4133 - RNA, 24 nt, Hepatitis GB virus A
gaugccacccugugccucgcccac

SEQ ID NO: 4134 - RNA, 24 nt, Hepatitis GB virus A
aaucaaagcaaguggcauccacag

SEQ ID NO: 4135 - RNA, 24 nt, Clover yellow vein virus
uuaaauggagucucuguaagugau

SEQ ID NO: 4136 - RNA, 24 nt, Clover yellow vein virus
uugagccauauuuugagaaaguug

SEQ ID NO: 4137 - RNA, 24 nt, Clover yellow vein virus
gugcuuggucaagaacccauaaau

SEQ ID NO: 4138 - RNA, 22 nt, Clover yellow vein virus
uuggucuagauaccacucauga

SEQ ID NO: 4139 - RNA, 22 nt, Clover yellow vein virus
ucgaauguaccuaguaauuuca

SEQ ID NO: 4140 - RNA, 24 nt, Clover yellow vein virus
uaaaguggcaguuuggaacuguuu

SEQ ID NO: 4141 - RNA, 24 nt, Clover yellow vein virus
ugagguauaagugcuguuugucaa

SEQ ID NO: 4142 - RNA, 24 nt, Potato virus A
uugguccucaacucgaaucucuac

SEQ ID NO: 4143 - RNA, 21 nt, Potato virus A
uaugauggauguuaccagcug

SEQ ID NO: 4144 - RNA, 24 nt, Potato virus A
ugucaucuagacuuugaaacugaa

SEQ ID NO: 4145 - RNA, 24 nt, Potato virus A
uaggguagcccuguugauuugcca

SEQ ID NO: 4146 - RNA, 24 nt, Potato virus A
cagcugugaauguucgagucuugu

SEQ ID NO: 4147 - RNA, 24 nt, Potato virus A
ugggauguuucugacaccauacuu

SEQ ID NO: 4148 - RNA, 24 nt, Potato virus A
uuuaaacugaauuuggguguuuga

SEQ ID NO: 4149 - RNA, 24 nt, Bean common mosaic necrosis virus
uuucauguucaaugagucauagau

SEQ ID NO: 4150 - RNA, 24 nt, Bean common mosaic necrosis virus
uaacauuuucagcaagaggacgug

SEQ ID NO: 4151 - RNA, 24 nt, Bean common mosaic necrosis virus
ugagugaggagcuaauugugucaa

SEQ ID NO: 4152 - RNA, 24 nt, Bean common mosaic necrosis virus
uuacuauuaaauucaaggaguugc

SEQ ID NO: 4153 - RNA, 21 nt, Bean common mosaic necrosis virus
uuaaaagccucuuuguugagc

SEQ ID NO: 4154 - RNA, 24 nt, Pepper mottle virus
uaggcuaucuucaaccacuaauuu

SEQ ID NO: 4155 - RNA, 24 nt, Pepper mottle virus
ugacugguaaauuguacgcaaagc

SEQ ID NO: 4156 - RNA, 24 nt, Pepper mottle virus
caucgcgaacaaugagugauuuau

SEQ ID NO: 4157 - RNA, 24 nt, Pepper mottle virus
ugaaaugcccaaacaccuugcguc

SEQ ID NO: 4158 - RNA, 21 nt, Pepper mottle virus
uuuguuggaagaaguucagga

SEQ ID NO: 4159 - RNA, 24 nt, Pepper mottle virus
ugauuuauuccucguccgagauga

SEQ ID NO: 4160 - RNA, 24 nt, Equine herpesvirus 2
uaguuuaggcacuugaauucugcc

SEQ ID NO: 4161 - RNA, 24 nt, Equine herpesvirus 2
uguguuaguagccuagaggcguuu

SEQ ID NO: 4162 - RNA, 24 nt, Equine herpesvirus 2
uacagcagcgcaucggcgccuuau

SEQ ID NO: 4163 - RNA, 24 nt, Equine herpesvirus 2
uggcucugcagcgaacucuacccg

SEQ ID NO: 4164 - RNA, 24 nt, Equine herpesvirus 2
uggcuucccaaacacucuguuugg

SEQ ID NO: 4165 - RNA, 24 nt, Equine herpesvirus 2
ucagacuccgcucggugcucugga

SEQ ID NO: 4166 - RNA, 24 nt, Equine herpesvirus 2
uaauacuucagaagucuccggacg

SEQ ID NO: 4167 - RNA, 24 nt, Equine herpesvirus 2
agaagagauugggaacuucugucg

SEQ ID NO: 4168 - RNA, 24 nt, Equine herpesvirus 2
uaagguuuacgaggaacgugguuu

SEQ ID NO: 4169 - RNA, 23 nt, Equine herpesvirus 2
ugagaucuugugcaguguuuugu

SEQ ID NO: 4170 - RNA, 24 nt, Equine herpesvirus 2
uaagauagaaaggguuggcuaugu

SEQ ID NO: 4171 - RNA, 24 nt, Equine herpesvirus 2
ugagauauuagggaaccuggaccg

SEQ ID NO: 4172 - RNA, 24 nt, Equine herpesvirus 2
uuaacgcuuuuugaaagccgauac

SEQ ID NO: 4173 - RNA, 24 nt, Equine herpesvirus 2
uauuucaacaccaccccucguuca

SEQ ID NO: 4174 - RNA, 24 nt, Equine herpesvirus 2
ucaguacggauguguggugucuau

SEQ ID NO: 4175 - RNA, 24 nt, Equine herpesvirus 2
cgagguagugaucugcugaaggcu

SEQ ID NO: 4176 - RNA, 24 nt, Equine herpesvirus 2
uggaucaacccugacgaugcacag

SEQ ID NO: 4177 - RNA, 21 nt, Equine herpesvirus 2
guucacagacucuuaggacca

SEQ ID NO: 4178 - RNA, 24 nt, Equine herpesvirus 2
agaggagaggaggacuugcgauua

SEQ ID NO: 4179 - RNA, 21 nt, Infectious flacherie virus
uucaaaagcguaggauuacgu

SEQ ID NO: 4180 - RNA, 24 nt, Infectious flacherie virus
ucaguuuucauaaguguaaacggu

SEQ ID NO: 4181 - RNA, 24 nt, Cocksfoot streak virus (CSV)
uguuaucaaccauuuguucgcgaa

SEQ ID NO: 4182 - RNA, 24 nt, Cocksfoot streak virus (CSV)
ugaagcguucugagugacgacagg

SEQ ID NO: 4183 - RNA, 22 nt, Cocksfoot streak virus (CSV)
uaucagcaguuuaccgagggcg

SEQ ID NO: 4184 - RNA, 24 nt, Cocksfoot streak virus (CSV)
uugaaaggcuccauuccuaauagc

SEQ ID NO: 4185 - RNA, 24 nt, Cocksfoot streak virus (CSV)
ugacguguuucaaccuuaaacacg

SEQ ID NO: 4186 - RNA, 21 nt, Cocksfoot streak virus (CSV)
caucgcaguugauuuaagcgc

SEQ ID NO: 4187 - RNA, 24 nt, Cocksfoot streak virus (CSV)
uaaggaaaccuucuccaucggacg

SEQ ID NO: 4188 - RNA, 24 nt, Cocksfoot streak virus (CSV)
aagcuuagaagaaguuugauguug

SEQ ID NO: 4189 - RNA, 24 nt, Brome streak mosaic virus
ucagugauaucgucucgcuccaug

SEQ ID NO: 4190 - RNA, 24 nt, Brome streak mosaic virus
uucguuguccugguuaaguuuuuc

SEQ ID NO: 4191 - RNA, 24 nt, Brome streak mosaic virus
aaaaguggcgaaacacgcgcccug

SEQ ID NO: 4192 - RNA, 24 nt, Brome streak mosaic virus
ucagaucguagauuuccacugugu

SEQ ID NO: 4193 - RNA, 24 nt, Brome streak mosaic virus
uagaaggcuuugugugaguuugug

SEQ ID NO: 4194 - RNA, 24 nt, Brome streak mosaic virus
ugaugugaauguucucgucuuguu

SEQ ID NO: 4195 - RNA, 24 nt, Gallid herpesvirus 2
ucgauuagaucgagcuuugaaaag

SEQ ID NO: 4196 - RNA, 24 nt, Gallid herpesvirus 2
ucaacaguuugcgaguccaacucu

SEQ ID NO: 4197 - RNA, 24 nt, Gallid herpesvirus 2
uuuacagauggaauuauaauagag

SEQ ID NO: 4198 - RNA, 24 nt, Gallid herpesvirus 2
ugucauaacuucauaaauagucuu

SEQ ID NO: 4199 - RNA, 24 nt, Plum pox virus
aaaacugauuauugaagucaucaa

SEQ ID NO: 4200 - RNA, 24 nt, Plum pox virus
agagauaguuucgaagucauugcc

SEQ ID NO: 4201 - RNA, 24 nt, Plum pox virus
uucacaaauuugcguguuuucguu

SEQ ID NO: 4202 - RNA, 24 nt, Plum pox virus
uugaauucuagcaacugagacuuc

SEQ ID NO: 4203 - RNA, 24 nt, Johnsongrass mosaic virus
uaagugagccaaaagugucaacua

SEQ ID NO: 4204 - RNA, 22 nt, Johnsongrass mosaic virus
ugagaugauucugguagaacug

SEQ ID NO: 4205 - RNA, 24 nt, Johnsongrass mosaic virus
uaucuugaggaccagcuucuuuac

SEQ ID NO: 4206 - RNA, 24 nt, Johnsongrass mosaic virus
ugauaugcuuuggaaaugacuaug

SEQ ID NO: 4207 - RNA, 24 nt, Alcelaphine herpesvirus 1
acaagugcauguuaauuaguuugu

SEQ ID NO: 4208 - RNA, 24 nt, Alcelaphine herpesvirus 1
uagcugagccacgaggucacagau

SEQ ID NO: 4209 - RNA, 23 nt, Alcelaphine herpesvirus 1
ugaguaggagggcuccuguguac

SEQ ID NO: 4210 - RNA, 24 nt, Alcelaphine herpesvirus 1
uguuauuguuuugguuggaguuuc

SEQ ID NO: 4211 - RNA, 24 nt, Aphid lethal paralysis virus
auaaagaucggcuguuuuaaaucc

SEQ ID NO: 4212 - RNA, 24 nt, Aphid lethal paralysis virus
uaauuuauuaauauaaagcguauu

SEQ ID NO: 4213 - RNA, 24 nt, Aphid lethal paralysis virus
uagcauuagucaaaucugcaaaca

SEQ ID NO: 4214 - RNA, 24 nt, Aphid lethal paralysis virus
ugaaaucaucgcccacagcucuau

SEQ ID NO: 4215 - RNA, 24 nt, Aphid lethal paralysis virus
ugaguacguacaaccuaccaacag

SEQ ID NO: 4216 - RNA, 24 nt, Aphid lethal paralysis virus
ucaccaggaacaaauaaaauccua

SEQ ID NO: 4217 - RNA, 24 nt, Aphid lethal paralysis virus
agcuguucuagucucaucgaugac

SEQ ID NO: 4218 - RNA, 24 nt, Aphid lethal paralysis virus
ugagauagcauuacuacaauucuc

SEQ ID NO: 4219 - RNA, 24 nt, Potato virus V
aaagagcugucgaacugagauccg

SEQ ID NO: 4220 - RNA, 24 nt, Potato virus V
uuaagugcaagcucaguaauguau

SEQ ID NO: 4221 - RNA, 24 nt, Potato virus V
ugagaucgcacuaugaguguucca

SEQ ID NO: 4222 - RNA, 24 nt, Potato virus V
ugugguaugcauguaucagacuuc

SEQ ID NO: 4223 - RNA, 24 nt, Parsnip yellow fleck virus
uuuguccaaggcucuucucucauc

SEQ ID NO: 4224 - RNA, 22 nt, Parsnip yellow fleck virus
uguaaucgaugcaauugcuuuu

SEQ ID NO: 4225 - RNA, 22 nt, Parsnip yellow fleck virus
ucaguuuaaagccaugaagggc

SEQ ID NO: 4226 - RNA, 24 nt, Parsnip yellow fleck virus
ugaguauuaggauugugccaaacu

SEQ ID NO: 4227 - RNA, 24 nt, Parsnip yellow fleck virus
ugaguuacuaucaugcgcagaaac

SEQ ID NO: 4228 - RNA, 24 nt, Pea seed-borne mosaic virus
uaagcuaugugucuucucaauggu

SEQ ID NO: 4229 - RNA, 24 nt, Pea seed-borne mosaic virus
ugaaaugcgccauuaucugucuga

SEQ ID NO: 4230 - RNA, 24 nt, Pea seed-borne mosaic virus
uaucagagccaaacaucauugcca

SEQ ID NO: 4231 - RNA, 22 nt, Ectromelia virus
cagaaugucggugauucguguu

SEQ ID NO: 4232 - RNA, 24 nt, Ectromelia virus
uaucauaagcuugacuacauuugg

SEQ ID NO: 4233 - RNA, 24 nt, Ectromelia virus
uaauaccauuggaugcaccauugg

SEQ ID NO: 4234 - RNA, 24 nt, Cowpox virus
ucaggaauccaaagagcuauaaau

SEQ ID NO: 4235 - RNA, 24 nt, Cowpox virus
ugagaucuucuauuuuaucauuuu

SEQ ID NO: 4236 - RNA, 22 nt, Camelpox virus
uaauaucgacaauuucauacgc

SEQ ID NO: 4237 - RNA, 24 nt, Ectromelia virus
uaaucguucgaacucgucucccca

SEQ ID NO: 4238 - RNA, 24 nt, Camelpox virus
uagguuauugacauuguaugguuu

SEQ ID NO: 4239 - RNA, 24 nt, Ectromelia virus
ucuggcggcuagaauggcauaauc

SEQ ID NO: 4240 - RNA, 24 nt, Ectromelia virus
ugauuuaucgaugguauuaagaau

SEQ ID NO: 4241 - RNA, 24 nt, Ectromelia virus
ugacguacguagcguacaaaauga

SEQ ID NO: 4242 - RNA, 24 nt, Ectromelia virus
uggcugauagugucacugcacaag

SEQ ID NO: 4243 - RNA, 24 nt, Cowpox virus
uagcgcaucuuuaacucgucaguu

SEQ ID NO: 4244 - RNA, 22 nt, Cowpox virus
ucaccacguguguuucaggauc

SEQ ID NO: 4245 - RNA, 24 nt, Cowpox virus
uaaaauggcauaaucuggauguug

SEQ ID NO: 4246 - RNA, 24 nt, Cowpox virus
uuucaacgaucuuguuauuuauuu

SEQ ID NO: 4247 - RNA, 24 nt, Cowpox virus
ugauuuaucgaugguauuaagaau

SEQ ID NO: 4248 - RNA, 24 nt, Cowpox virus
ugacuagauaaacuaucaguaagu

SEQ ID NO: 4249 - RNA, 24 nt, Monkeypox virus
uaagugauacaaaacuaucucgac

SEQ ID NO: 4250 - RNA, 24 nt, Monkeypox virus
ugauuuaucgaugguauuaagaau

SEQ ID NO: 4251 - RNA, 24 nt, Monkeypox virus
ugacuagauaaacuaucaguaagu

SEQ ID NO: 4252 - RNA, 24 nt, Monkeypox virus
ucaggaauccaaagagcuauaaau

SEQ ID NO: 4253 - RNA, 23 nt, Variola virus
uuaguauuuuuauuaauccuuug

SEQ ID NO: 4254 - RNA, 24 nt, Vaccinia virus
ucaggaauccaaagagcuauaaau

SEQ ID NO: 4255 - RNA, 24 nt, Variola virus
uguaaacuugacaaaaauugugac

SEQ ID NO: 4256 - RNA, 24 nt, Variola virus
uuagagauuucagcuucuggaaua

SEQ ID NO: 4257 - RNA, 24 nt, Variola virus
aaccaauuccuuuuugccuguauc

SEQ ID NO: 4258 - RNA, 24 nt, Vaccinia virus
ugacuagauaaacuaucaguaagu

SEQ ID NO: 4259 - RNA, 22 nt, Macaca mulatta rhadinovirus
uggguuccgggggcguuacgau

SEQ ID NO: 4260 - RNA, 24 nt, Macaca mulatta rhadinovirus
uuaaauaccagggauacaggcugu

SEQ ID NO: 4261 - RNA, 24 nt, Macaca mulatta rhadinovirus
uggaaaaauuaaggcuuugcguua

SEQ ID NO: 4262 - RNA, 24 nt, Macaca mulatta rhadinovirus
ugggucccuuccacgucgcaauga

SEQ ID NO: 4263 - RNA, 24 nt, Macaca mulatta rhadinovirus
cggccaacgcgccagcguccaacc

SEQ ID NO: 4264 - RNA, 24 nt, Macaca mulatta rhadinovirus
uaaacugcgaaagggcguacaucg

SEQ ID NO: 4265 - RNA, 24 nt, Macaca mulatta rhadinovirus
ugcgaucgcggggucugacccacc

SEQ ID NO: 4266 - RNA, 24 nt, Macaca mulatta rhadinovirus
ugauauguucugaugaccgccgcc

SEQ ID NO: 4267 - RNA, 24 nt, Macaca mulatta rhadinovirus
uugggcagcgaaucagugucuguc

SEQ ID NO: 4268 - RNA, 24 nt, Macaca mulatta rhadinovirus
uuagggaaucuaaaaacgaaaucc

SEQ ID NO: 4269 - RNA, 22 nt, Bean common mosaic virus
uugaaucuccugcaccacggcu

SEQ ID NO: 4270 - RNA, 22 nt, Bean common mosaic virus
ugugcauuguugacaucauuug

SEQ ID NO: 4271 - RNA, 24 nt, Bean common mosaic virus
ugaaauaagcuugaauuccagguu

SEQ ID NO: 4272 - RNA, 24 nt, Bean common mosaic virus
ugagauuuugaauucuucuuuugg

SEQ ID NO: 4273 - RNA, 23 nt, Bean common mosaic virus
uucagaauacauugguguuccau

SEQ ID NO: 4274 - RNA, 22 nt, Bean common mosaic virus
aucaaaagcguagcgagcuaga

SEQ ID NO: 4275 - RNA, 24 nt, Human herpesvirus 5
ugagguagaagacaaacucgcgua

SEQ ID NO: 4276 - RNA, 21 nt, Human herpesvirus 5
uacaauagugacgugggaucc

SEQ ID NO: 4277 - RNA, 24 nt, Human herpesvirus 5
cacccgucucgugguacgaaguag

SEQ ID NO: 4278 - RNA, 24 nt, Human herpesvirus 5
ugagauugagaucccgggagcguu

SEQ ID NO: 4279 - RNA, 24 nt, Human herpesvirus 5
uaucggaacugacgaaagagcuca

SEQ ID NO: 4280 - RNA, 24 nt, Human herpesvirus 5
uugguccaagugguuuagcgaggc

SEQ ID NO: 4281 - RNA, 24 nt, Human herpesvirus 5
uagcugcaggccgccuagcgcuuc

SEQ ID NO: 4282 - RNA, 24 nt, Rhopalosiphum padi virus
agccguaauuccuaaugagcagca

SEQ ID NO: 4283 - RNA, 24 nt, Rhopalosiphum padi virus
uguaaagcguaacaauggcauuuu

SEQ ID NO: 4284 - RNA, 24 nt, Rhopalosiphum padi virus
gcgagcacaaacacaaacacacgg

SEQ ID NO: 4285 - RNA, 24 nt, Rhopalosiphum padi virus
uagaauaagcuucagacuggcgag

SEQ ID NO: 4286 - RNA, 22 nt, Rhopalosiphum padi virus
uucaaagguacaauaguucggg

SEQ ID NO: 4287 - RNA, 24 nt, Rhopalosiphum padi virus
uaacgaaaaagcaccaauugcagc

SEQ ID NO: 4288 - RNA, 24 nt, Rhopalosiphum padi virus
uguaaacguuguaaauuagaaguc

SEQ ID NO: 4289 - RNA, 21 nt, Rhopalosiphum padi virus
ugagauugguaucguauagcc

SEQ ID NO: 4290 - RNA, 24 nt, Rhopalosiphum padi virus
cgggguuauggcacuaaaacgcuu

SEQ ID NO: 4291 - RNA, 24 nt, Rhopalosiphum padi virus
uauccgaaccaucugaauuacaca

SEQ ID NO: 4292 - RNA, 24 nt, Saimiriine herpesvirus 2
uugaaucagauguguuugcaggau

SEQ ID NO: 4293 - RNA, 24 nt, Saimiriine herpesvirus 2
ucagugccuggaguuguucuuuca

SEQ ID NO: 4294 - RNA, 24 nt, Saimiriine herpesvirus 2
ugacauauuugauaugaugucuuc

SEQ ID NO: 4295 - RNA, 24 nt, Saimiriine herpesvirus 2
ugauaugucuguuuuaucuuguuu

SEQ ID NO: 4296 - RNA, 24 nt, Saimiriine herpesvirus 2
ugacucaauguuucacuuucuaua

SEQ ID NO: 4297 - RNA, 21 nt, Saimiriine herpesvirus 2
uauuuugagcugacucuaguu

SEQ ID NO: 4298 - RNA, 24 nt, Saimiriine herpesvirus 2
uagcauuuuguaaaacugaaagau

SEQ ID NO: 4299 - RNA, 21 nt, Saimiriine herpesvirus 2
uguguaguuucaguaucuagg

SEQ ID NO: 4300 - RNA, 24 nt, Ateline herpesvirus 3
ugauauguuaucuagcaaggcuuu

SEQ ID NO: 4301 - RNA, 24 nt, Ateline herpesvirus 3
uauaacagugguguuucugcaaua

SEQ ID NO: 4302 - RNA, 24 nt, Ateline herpesvirus 3
uacacaggguuuggguucccuggc

SEQ ID NO: 4303 - RNA, 24 nt, Ateline herpesvirus 3
ucauucauaauuaucuuuauuaug

SEQ ID NO: 4304 - RNA, 24 nt, Ateline herpesvirus 3
uaagaucuuuuguagguauugaaa

SEQ ID NO: 4305 - RNA, 24 nt, Leek yellow stripe potyvirus
caaaguguuuauaaggugguugua

SEQ ID NO: 4306 - RNA, 24 nt, Leek yellow stripe potyvirus
uacugcaacuggugcgccuguuug

SEQ ID NO: 4307 - RNA, 24 nt, Leek yellow stripe potyvirus
ugggauccgcaucuguuaaguuga

SEQ ID NO: 4308 - RNA, 24 nt, Leek yellow stripe potyvirus
gagcguaguuaaaagaugaacagg

SEQ ID NO: 4309 - RNA, 24 nt, Human adenovirus E
uuugacaguuuggugauggaucag

SEQ ID NO: 4310 - RNA, 24 nt, Human adenovirus E
uccacagacccuugaguucuucug

SEQ ID NO: 4311 - RNA, 24 nt, Human adenovirus E
ugggacggccgcgucggagguggc

SEQ ID NO: 4312 - RNA, 24 nt, Human adenovirus E
uaagguaagcuuuauguuuccauc

SEQ ID NO: 4313 - RNA, 24 nt, Human adenovirus E
ugagguacuucuuguggggcuuac

SEQ ID NO: 4314 - RNA, 22 nt, Taura syndrome virus
ugggauucaacuacagcacuuu

SEQ ID NO: 4315 - RNA, 23 nt, Taura syndrome virus
ugaauugcgugccuccuugaguc

SEQ ID NO: 4316 - RNA, 24 nt, Taura syndrome virus
uaaguggauugagaacggaaauga

SEQ ID NO: 4317 - RNA, 24 nt, Taura syndrome virus
uacuacauuugccaccgcaccaac

SEQ ID NO: 4318 - RNA, 24 nt, Taura syndrome virus
uggaaugugugauuuguagcgucg

SEQ ID NO: 4319 - RNA, 24 nt, Taura syndrome virus
uuagauccagcuacgaugcgugca

SEQ ID NO: 4320 - RNA, 24 nt, Chimpanzee cytomegalovirus
uaaugggucuggugguaacuguau

SEQ ID NO: 4321 - RNA, 24 nt, Chimpanzee cytomegalovirus
cgggauccucauguggcucugggu

SEQ ID NO: 4322 - RNA, 24 nt, Chimpanzee cytomegalovirus
uacauagacacugacgcgcgcuag

SEQ ID NO: 4323 - RNA, 24 nt, Chimpanzee cytomegalovirus
ucauugaacugaauaauaccugcg

SEQ ID NO: 4324 - RNA, 24 nt, Chimpanzee cytomegalovirus
ugagcgaaccgccggcggcggugg

SEQ ID NO: 4325 - RNA, 21 nt, Chimpanzee cytomegalovirus
cgucaugaccgucaaugagcg

SEQ ID NO: 4326 - RNA, 21 nt, Chimpanzee cytomegalovirus
ucucauggcgguguagcggcg

SEQ ID NO: 4327 - RNA, 24 nt, Chimpanzee cytomegalovirus
uaguauguguauauaugguuauag

SEQ ID NO: 4328 - RNA, 24 nt, Fowl adenovirus D
ucgaagacgguauacgucucgaug

SEQ ID NO: 4329 - RNA, 24 nt, Fowl adenovirus D
ucggaaaagccguucgaugagcgc

SEQ ID NO: 4330 - RNA, 24 nt, Fowl adenovirus D
ugagggacucggguuccucguagg

SEQ ID NO: 4331 - RNA, 24 nt, Fowl adenovirus D
cgugcaugccgaguucgucuuuga

SEQ ID NO: 4332 - RNA, 24 nt, Fowl adenovirus D
ugagauggccauugggaagcagga

SEQ ID NO: 4333 - RNA, 24 nt, Bovine herpesvirus 4
uaggaugaguucuuuaauuuucaa

SEQ ID NO: 4334 - RNA, 24 nt, Bovine herpesvirus 4
uaauguaucuauuaguucaucuau

SEQ ID NO: 4335 - RNA, 24 nt, Bovine herpesvirus 4
ugaggugcuucucauuuucuauga

SEQ ID NO: 4336 - RNA, 24 nt, Bovine herpesvirus 4
uucucaguuuuagggauucaauau

SEQ ID NO: 4337 - RNA, 24 nt, Bovine herpesvirus 4
ucauuggguggugguaugccaagg

SEQ ID NO: 4338 - RNA, 24 nt, Bovine herpesvirus 4
uagcaugggugucauaucagcagu

SEQ ID NO: 4339 - RNA, 24 nt, Bovine herpesvirus 4
ugggaacuauauauaggaauguac

SEQ ID NO: 4340 - RNA, 24 nt, Bovine herpesvirus 4
ucacaacuauagguguuguugggg

SEQ ID NO: 4341 - RNA, 24 nt, Bovine herpesvirus 4
uuacauugagauauuccaugaaug

SEQ ID NO: 4342 - RNA, 21 nt, Bovine herpesvirus 4
uaucaauaaauguaauuaagg

SEQ ID NO: 4343 - RNA, 24 nt, Bovine herpesvirus 4
uugggcaucuauuuguuuuuugga

SEQ ID NO: 4344 - RNA, 24 nt, Bovine herpesvirus 4
ugaggucuaggaugagauuuucag

SEQ ID NO: 4345 - RNA, 24 nt, Bovine herpesvirus 4
uaugguauccucuggaguuggggg

SEQ ID NO: 4346 - RNA, 24 nt, Human herpesvirus 8
ucagaucgacccggacuacaguua

SEQ ID NO: 4347 - RNA, 24 nt, Human herpesvirus 8
ccaccugaguaccccauugguuua

SEQ ID NO: 4348 - RNA, 24 nt, Human herpesvirus 8
ugcgaccugcacgaaacagacauu

SEQ ID NO: 4349 - RNA, 24 nt, Human herpesvirus 8
guguauuaucuccuggugggcuac

SEQ ID NO: 4350 - RNA, 24 nt, Human herpesvirus 8
uagaguacugcgguuuagcuaguu

SEQ ID NO: 4351 - RNA, 24 nt, Human herpesvirus 8
ucagugccacaauuucauuaacaa

SEQ ID NO: 4352 - RNA, 24 nt, Cell fusing agent virus
ugccguauuuugaguguguucgug

SEQ ID NO: 4353 - RNA, 24 nt, Cell fusing agent virus
uguaaucguccuguugacccgccg

SEQ ID NO: 4354 - RNA, 24 nt, Cell fusing agent virus
agcgguaugucgccaaccaucugu

SEQ ID NO: 4355 - RNA, 24 nt, Dengue virus
uggaaugaugcugaggagacagca

SEQ ID NO: 4356 - RNA, 24 nt, Dengue virus
uuugguaucuuauuggaaguccuc

SEQ ID NO: 4357 - RNA, 24 nt, Dengue virus
ugucaacaugucuuccgucgucau

SEQ ID NO: 4358 - RNA, 24 nt, Human herpesvirus 8
ugcgguagugguuugcgauguagu

SEQ ID NO: 4359 - RNA, 24 nt, Human herpesvirus 8
ugcgugucgggagggcgccggccu

SEQ ID NO: 4360 - RNA, 24 nt, Human herpesvirus 8
uggcauaccuguccgcauccgugc

SEQ ID NO: 4361 - RNA, 24 nt, Human herpesvirus 8
ugcgguguuccgggcagaccccgu

SEQ ID NO: 4362 - RNA, 24 nt, Human herpesvirus 8
ucaccugcgccucaaccaggguca

SEQ ID NO: 4363 - RNA, 24 nt, Yellow fever virus
cucacagaccucuggaggaaaagc

SEQ ID NO: 4364 - RNA, 24 nt, Yellow fever virus
uaauguagcugucuccaaaaggug

SEQ ID NO: 4365 - RNA, 24 nt, Yellow fever virus
ugacuauugucauugccucaggca

SEQ ID NO: 4366 - RNA, 24 nt, Yellow fever virus
ucagcgauguaacuguuaccaaag

SEQ ID NO: 4367 - RNA, 24 nt, Molluscum contagiosum virus
cggcauggucuccaggcuggucag

SEQ ID NO: 4368 - RNA, 24 nt, Molluscum contagiosum virus
ugcccguagcuacacauacgcgcg

SEQ ID NO: 4369 - RNA, 24 nt, Molluscum contagiosum virus
uccacggaaacaagagaguucacg

SEQ ID NO: 4370 - RNA, 24 nt, Molluscum contagiosum virus
uacgcagugccggauggcggggaa

SEQ ID NO: 4371 - RNA, 24 nt, Molluscum contagiosum virus
uaacuuuuguccgagguucuuccg

SEQ ID NO: 4372 - RNA, 24 nt, Cercopithecine herpesvirus 7
uucuucgccguuguuuacccgcug

SEQ ID NO: 4373 - RNA, 24 nt, Cercopithecine herpesvirus 7
uaauacaguuaauauugauggcac

SEQ ID NO: 4374 - RNA, 21 nt, Cercopithecine herpesvirus 7
ugucgucuauguaagcgugcg

SEQ ID NO: 4375 - RNA, 21 nt, Cercopithecine herpesvirus 7
uugccgauagucccgugggga

SEQ ID NO: 4376 - RNA, 24 nt, infectious spleen and kidney necrosis virus
ugcaaguacaggccggcgcacugg

SEQ ID NO: 4377 - RNA, 24 nt, infectious spleen and kidney necrosis virus
ugcacagugaccugcgggucaggc

SEQ ID NO: 4378 - RNA, 24 nt, infectious spleen and kidney necrosis virus
ugucauggaccaucguggcuacgg

SEQ ID NO: 4379 - RNA, 24 nt, Human adenovirus D
ugagacagcggucgggcgaagagg

SEQ ID NO: 4380 - RNA, 24 nt, Human adenovirus D
ugucauaaucuuuagguugcugcc

SEQ ID NO: 4381 - RNA, 24 nt, Human adenovirus D
uaucacagcacacggauuaaagga

SEQ ID NO: 4382 - RNA, 24 nt, Human adenovirus D
cccccuguggguguuuucuagcca

SEQ ID NO: 4383 - RNA, 24 nt, Tick-borne encephalitis virus
ugaguuaauggcaagcccgagcgu

SEQ ID NO: 4384 - RNA, 24 nt, Tick-borne encephalitis virus
ugucggaagugcuuucuuuucucu

SEQ ID NO: 4385 - RNA, 24 nt, Tick-borne encephalitis virus
ucaagugaaaguuacccaucgcgu

SEQ ID NO: 4386 - RNA, 24 nt, Viral hemorrhagic septicemia virus
ugaccuguugucuuugggggcguu

SEQ ID NO: 4387 - RNA, 24 nt, Viral hemorrhagic septicemia virus
ugaaagggguauucccacccuuuc

SEQ ID NO: 4388 - RNA, 24 nt, Viral hemorrhagic septicemia virus
ucuggcagauggccgugagcagga

SEQ ID NO: 4389 - RNA, 24 nt, Viral hemorrhagic septicemia virus
uucccagucuccugauuuuagucc

SEQ ID NO: 4390 - RNA, 24 nt, Viral hemorrhagic septicemia virus
ugagacgggagugccuuuuaguca

SEQ ID NO: 4391 - RNA, 24 nt, Viral hemorrhagic septicemia virus
ugaacggaggugagguugcacacg

SEQ ID NO: 4392 - RNA, 24 nt, Vesicular stomatitis Indiana virus
agaguuauggacaguggggcauau

SEQ ID NO: 4393 - RNA, 24 nt, Vesicular stomatitis Indiana virus
uggguucaucgauuaauuucuuca

SEQ ID NO: 4394 - RNA, 23 nt, Vesicular stomatitis Indiana virus
uagaaaaccuauacaucugccga

SEQ ID NO: 4395 - RNA, 24 nt, Vesicular stomatitis Indiana virus
uugcauaucgguuccaccauuuua

SEQ ID NO: 4396 - RNA, 24 nt, Vesicular stomatitis Indiana virus
ugggauuggcuugacaugauguua

SEQ ID NO: 4397 - RNA, 24 nt, Vesicular stomatitis Indiana virus
ucucaggccgagcaggauggccuc

SEQ ID NO: 4398 - RNA, 22 nt, Chimpanzee cytomegalovirus
ucaacgguguugauguucugcg

SEQ ID NO: 4399 - RNA, 24 nt, Chimpanzee cytomegalovirus
uacagcgugagcgacgacagcguc

SEQ ID NO: 4400 - RNA, 24 nt, Chimpanzee cytomegalovirus
ugccaggcgcgcagcucguggaag

SEQ ID NO: 4401 - RNA, 24 nt, Ectocarpus siliculosus virus
uuucuugccacaucacacgauuug

SEQ ID NO: 4402 - RNA, 24 nt, Ectocarpus siliculosus virus
ucagauacucaaguaccaaacaug

SEQ ID NO: 4403 - RNA, 24 nt, Ectocarpus siliculosus virus
gcagcacgauuuagugagcuacgc

SEQ ID NO: 4404 - RNA, 24 nt, Ectocarpus siliculosus virus
cagcacgauaaaucguauuacguu

SEQ ID NO: 4405 - RNA, 24 nt, Ectocarpus siliculosus virus
cagcacgauaaaucguauuacguu

SEQ ID NO: 4406 - RNA, 24 nt, Ectocarpus siliculosus virus
cagcacgauaaaucguauuacguu

SEQ ID NO: 4407 - RNA, 24 nt, Ectocarpus siliculosus virus
gcagcacgauuuagugagcugcac

SEQ ID NO: 4408 - RNA, 24 nt, Ectocarpus siliculosus virus
cagcacgauaaaucguauuacguu

SEQ ID NO: 4409 - RNA, 24 nt, Ectocarpus siliculosus virus
aucguauuacguugcagcacgauu

SEQ ID NO: 4410 - RNA, 24 nt, Ectocarpus siliculosus virus
cagcacgauaaaucguguuacguu

SEQ ID NO: 4411 - RNA, 24 nt, Ectocarpus siliculosus virus
aagcacaauaaaucguguuacguu

SEQ ID NO: 4412 - RNA, 24 nt, Ectocarpus siliculosus virus
cagcacgauuuagugagcugcaca

SEQ ID NO: 4413 - RNA, 23 nt, Ectocarpus siliculosus virus
gcagcacgauuuagugagcuacg

SEQ ID NO: 4414 - RNA, 24 nt, Ectocarpus siliculosus virus
aagcacgauaaaucguguuacguu

SEQ ID NO: 4415 - RNA, 23 nt, Ectocarpus siliculosus virus
gcagcacgauuuagugagcugca

SEQ ID NO: 4416 - RNA, 24 nt, Ectocarpus siliculosus virus
gcagcacgauuuagugagcuaugc

SEQ ID NO: 4417 - RNA, 23 nt, Ectocarpus siliculosus virus
gcagcacgauuuagugagcugca

SEQ ID NO: 4418 - RNA, 24 nt, Ectocarpus siliculosus virus
ugagggaagaagcggggccgugga

SEQ ID NO: 4419 - RNA, 24 nt, Bovine adenovirus B
agucaguggccgcuaaacaaaaaa

SEQ ID NO: 4420 - RNA, 24 nt, Semliki forest virus
ucaauggcuuccuggauuuucuuc

SEQ ID NO: 4421 - RNA, 24 nt, Semliki forest virus
agagguguauaacagguccucuca

SEQ ID NO: 4422 - RNA, 21 nt, Semliki forest virus
uaggauggugcacacccggcc

SEQ ID NO: 4423 - RNA, 24 nt, Sindbis virus
uagcuaagccuucuacacgguccu

SEQ ID NO: 4424 - RNA, 24 nt, Sindbis virus
ugccucacuucucauguugacugg

SEQ ID NO: 4425 - RNA, 24 nt, Sindbis virus
ugguguacacaggauggcgauggu

SEQ ID NO: 4426 - RNA, 24 nt, Sindbis virus
ugagauccuugcuagucaaggagg

SEQ ID NO: 4427 - RNA, 24 nt, Sindbis virus
caaggaauuuuuuuaccgugaacg

SEQ ID NO: 4428 - RNA, 23 nt, Molluscum contagiosum virus
ucccgugcacgcuggcgcaugug

SEQ ID NO: 4429 - RNA, 21 nt, Molluscum contagiosum virus
uggccagcacgccgucgcggu

SEQ ID NO: 4430 - RNA, 24 nt, Rat cytomegalovirus
cgagaucugccggaucaucaccag

SEQ ID NO: 4431 - RNA, 24 nt, Rat cytomegalovirus
ucccagccgcucuuugcuccgcgc

SEQ ID NO: 4432 - RNA, 24 nt, Myxoma virus
ucagucuggcccaagacacgacgu

SEQ ID NO: 4433 - RNA, 24 nt, Myxoma virus
ugagagaaggcagauaagaguacg

SEQ ID NO: 4434 - RNA, 24 nt, Myxoma virus
ugacuucguacgcacgacgugucg

SEQ ID NO: 4435 - RNA, 24 nt, Rabies virus
ucccuagucucggauucucgggca

SEQ ID NO: 4436 - RNA, 24 nt, Rabies virus
ugaggaacugucgugccuaccacu

SEQ ID NO: 4437 - RNA, 24 nt, Rabies virus
ucaagaggucuauuaauauugaua

SEQ ID NO: 4438 - RNA, 24 nt, Rabies virus
uagauucuuuuaacgauagagcuc

SEQ ID NO: 4439 - RNA, 24 nt, Rabies virus
ugucaucaggaaaauuaucaacau

SEQ ID NO: 4440 - RNA, 24 nt, Rabies virus
uuuaaggugguaggaucuucuaga

SEQ ID NO: 4441 - RNA, 24 nt, Rabies virus
uaccacuuggaguacuuaucaaaa

SEQ ID NO: 4442 - RNA, 24 nt, Rabies virus
gugcauccuucguccuccacuacc

SEQ ID NO: 4443 - RNA, 24 nt, Rabies virus
ugagggauagaaaauaucucuucu

SEQ ID NO: 4444 - RNA, 24 nt, Human herpesvirus 3
uguaaaaacugucguugccccggu

SEQ ID NO: 4445 - RNA, 24 nt, Human herpesvirus 3
ugaccgguaauaacaguauccaac

SEQ ID NO: 4446 - RNA, 24 nt, Human herpesvirus 3
uauuacauugugaaguuaaaaccg

SEQ ID NO: 4447 - RNA, 24 nt, Human herpesvirus 3
uccacaggcaauaaaaaaaauucg

SEQ ID NO: 4448 - RNA, 24 nt, Human herpesvirus 3
uaagagcagauaguuuugugcgau

SEQ ID NO: 4449 - RNA, 24 nt, Human herpesvirus 3
ggagguaaucucaaguauugguuu

SEQ ID NO: 4450 - RNA, 24 nt, Human herpesvirus 3
cacccuaucuuuauaaguaugcag

SEQ ID NO: 4451 - RNA, 22 nt, Human herpesvirus 3
uuggaucauuggaucacuuaaa

SEQ ID NO: 4452 - RNA, 24 nt, Cercopithecine herpesvirus 7
ugaggucaauauccccaaaagagg

SEQ ID NO: 4453 - RNA, 24 nt, Cercopithecine herpesvirus 7
uaucggaagguuugagugacugaa

SEQ ID NO: 4454 - RNA, 24 nt, Cercopithecine herpesvirus 7
agggguauuggcuaaagguuugcu

SEQ ID NO: 4455 - RNA, 24 nt, Cercopithecine herpesvirus 7
ucacaugcagauauagauuggcgc

SEQ ID NO: 4456 - RNA, 24 nt, Cercopithecine herpesvirus 7
uuaaugcuggaaccgacgauacua

SEQ ID NO: 4457 - RNA, 24 nt, Cercopithecine herpesvirus 7
ugauauuuucacaguuuuccaguc

SEQ ID NO: 4458 - RNA, 24 nt, Camelpox virus
uucacggucuuaguauuuuuagau

SEQ ID NO: 4459 - RNA, 22 nt, Camelpox virus
uaauauuuuugugagaccaucg

SEQ ID NO: 4460 - RNA, 24 nt, Camelpox virus
uacaacauacuguuuagaugauag

SEQ ID NO: 4461 - RNA, 24 nt, Camelpox virus
uaauauuuuugugagaccaucgaa

SEQ ID NO: 4462 - RNA, 24 nt, Camelpox virus
uaauauuuuugugagaccaucgaa

SEQ ID NO: 4463 - RNA, 24 nt, Camelpox virus
auaacaucgauucccauaugaugu

SEQ ID NO: 4464 - RNA, 24 nt, Camelpox virus
ugaauagaguuaucgauucagaca

SEQ ID NO: 4465 - RNA, 23 nt, Camelpox virus
ucagagcaagaaacacugcagua

SEQ ID NO: 4466 - RNA, 24 nt, Camelpox virus
uucacgccguuguguaacaauauc

SEQ ID NO: 4467 - RNA, 24 nt, Camelpox virus
ugauguagugguuauagucucugg

SEQ ID NO: 4468 - RNA, 24 nt, Camelpox virus
ugaccuguugcacaaucauucuuu

SEQ ID NO: 4469 - RNA, 24 nt, Camelpox virus
uaauauuuuugugagaccaucgaa

SEQ ID NO: 4470 - RNA, 24 nt, Bovine viral diarrhea virus genotype 2 (BVDV-2)
uaaagugcuuagugcauuggaggu

SEQ ID NO: 4471 - RNA, 24 nt, Bovine viral diarrhea virus genotype 2 (BVDV-2)
ugccaagcuuuuguagagugcugu

SEQ ID NO: 4472 - RNA, 24 nt, Bovine viral diarrhea virus genotype 2 (BVDV-2)
uggccacugucaucagcaucaccc

SEQ ID NO: 4473 - RNA, 24 nt, Bovine viral diarrhea virus genotype 2 (BVDV-2)
uggcauauuggaagcccucuuugc

SEQ ID NO: 4474 - RNA, 24 nt, Bovine viral diarrhea virus genotype 2 (BVDV-2)
auuccaugaguacaucaaaaggaa

SEQ ID NO: 4475 - RNA, 23 nt, Bovine viral diarrhea virus genotype 2 (BVDV-2)
uagcaaugauacaaucaguggua

SEQ ID NO: 4476 - RNA, 24 nt, Bovine viral diarrhea virus genotype 2 (BVDV-2)
uguugugguuuuccucuuaauugg

SEQ ID NO: 4477 - RNA, 24 nt, Bovine viral diarrhea virus genotype 2 (BVDV-2)
ugucacacacuaguagauccuuuc

SEQ ID NO: 4478 - RNA, 24 nt, Rabbit fibroma virus
uauuccacgaagucaucgaccucc

SEQ ID NO: 4479 - RNA, 24 nt, Rabbit fibroma virus
ugucaucaucgaguaguucgccgu

SEQ ID NO: 4480 - RNA, 24 nt, Rabbit fibroma virus
ucuccgguagaaguagaaaauaga

SEQ ID NO: 4481 - RNA, 24 nt, Rabbit fibroma virus
agaugugacugugaggaaccaaau

SEQ ID NO: 4482 - RNA, 24 nt, pestivirus type 1
uaucugccacccaagagggcuacu

SEQ ID NO: 4483 - RNA, 24 nt, pestivirus type 1
uuagguacauuacacuagcuguuu

SEQ ID NO: 4484 - RNA, 24 nt, Cryphonectria hypovirus 1
uacgcgaauacaaaaccuagugca

SEQ ID NO: 4485 - RNA, 23 nt, Cryphonectria hypovirus 1
acucaugaagaugguugguccuu

SEQ ID NO: 4486 - RNA, 24 nt, Cryphonectria hypovirus 1
uagcagccuaagauagucugccac

SEQ ID NO: 4487 - RNA, 24 nt, Cryphonectria hypovirus 1
agucaugccuugguagaugcgcac

SEQ ID NO: 4488 - RNA, 24 nt, Cryphonectria hypovirus 1
ccagguaguccuuucccggguucc

SEQ ID NO: 4489 - RNA, 22 nt, Cryphonectria hypovirus 1
uggaacggaggcaucgccaucg

SEQ ID NO: 4490 - RNA, 24 nt, Cryphonectria hypovirus 1
ugaccgaacccagucugcauuagc

SEQ ID NO: 4491 - RNA, 24 nt, Cryphonectria hypovirus 1
ugguaugcguuccuuuucguccug

SEQ ID NO: 4492 - RNA, 21 nt, Cryphonectria hypovirus 1
cugguugugagugugccacgg

SEQ ID NO: 4493 - RNA, 24 nt, Cryphonectria hypovirus 1
uguacagugcgggcuggaaugccg

SEQ ID NO: 4494 - RNA, 24 nt, Fowlpox virus
uaaguaagcuacauuagaagaugu

SEQ ID NO: 4495 - RNA, 24 nt, Fowlpox virus
uucuaugauauaguucuguaucau

SEQ ID NO: 4496 - RNA, 24 nt, Fowlpox virus
uaauacuuuacuugcuuuauuaag

SEQ ID NO: 4497 - RNA, 24 nt, Fowlpox virus
uaaaauaacaauuauuauacuuga

SEQ ID NO: 4498 - RNA, 24 nt, Fowlpox virus
uaagguaaguuuucuuuauguuua

SEQ ID NO: 4499 - RNA, 24 nt, Fowlpox virus
uaugucaguuauccuaccaaaacg

SEQ ID NO: 4500 - RNA, 24 nt, Fowlpox virus
uauuagagaauaagaaugaucgca

SEQ ID NO: 4501 - RNA, 24 nt, Rana tigrina ranavirus
uauuaucuuaauauauagucuuua

SEQ ID NO: 4502 - RNA, 24 nt, Rana tigrina ranavirus
caggaggcucggcggaguguggcu

SEQ ID NO: 4503 - RNA, 24 nt, Rana tigrina ranavirus
ugacgugguucucgaaaaaguuug

SEQ ID NO: 4504 - RNA, 21 nt, Rana tigrina ranavirus
ugaggugcuggcgcaaggacg

SEQ ID NO: 4505 - RNA, 24 nt, Rana tigrina ranavirus
ugaggcacacggcagccguccugg

SEQ ID NO: 4506 - RNA, 24 nt, Rana tigrina ranavirus
uauauuaagaguacuacuaucuug

SEQ ID NO: 4507 - RNA, 24 nt, Rana tigrina ranavirus
uuaaaguugguggaacaguaggcg

SEQ ID NO: 4508 - RNA, 23 nt, Rana tigrina ranavirus
ucucacaauaauaguuucaggac

SEQ ID NO: 4509 - RNA, 24 nt, Rana tigrina ranavirus
ugaaagaguaucuuacuauaguag

SEQ ID NO: 4510 - RNA, 24 nt, Tupaia herpesvirus
uaagacgauacgacacgggcggau

SEQ ID NO: 4511 - RNA, 23 nt, Tupaia herpesvirus
cgacuaguuuagcguagcuacuc

SEQ ID NO: 4512 - RNA, 24 nt, Tupaia herpesvirus
acuccguuagcggucuucgcugua

SEQ ID NO: 4513 - RNA, 24 nt, Tupaia herpesvirus
cgauaucggagaaaguaccguuug

SEQ ID NO: 4514 - RNA, 24 nt, Tupaia herpesvirus
ugacgauauuaacuguccguaguc

SEQ ID NO: 4515 - RNA, 24 nt, Tupaia herpesvirus
ccgccaaucauccguauaaguuga

SEQ ID NO: 4516 - RNA, 24 nt, Tupaia herpesvirus
acaccauuuauccuccacuugaau

SEQ ID NO: 4517 - RNA, 24 nt, Tupaia herpesvirus
uacaacaaacacacgacucgaaaa

SEQ ID NO: 4518 - RNA, 24 nt, Rana tigrina ranavirus
uaauauccuaagaugucguuacac

SEQ ID NO: 4519 - RNA, 23 nt, Rana tigrina ranavirus
uggcaucugccauguuuaggacu

SEQ ID NO: 4520 - RNA, 24 nt, Rana tigrina ranavirus
ugagauauuuuacgcugacauuuu

SEQ ID NO: 4521 - RNA, 24 nt, Equine herpesvirus 1
ugaguccaugaaucaugccacagg

SEQ ID NO: 4522 - RNA, 24 nt, Equine herpesvirus 1
ugugcagacuuuuucaguuccuuc

SEQ ID NO: 4523 - RNA, 24 nt, Equine herpesvirus 1
ucgcaguagcuguggugguuuccg

SEQ ID NO: 4524 - RNA, 24 nt, Equine herpesvirus 1
ugguacggcugccgcgaucucagg

SEQ ID NO: 4525 - RNA, 24 nt, Equine herpesvirus 1
uagcuuacaucuauggguggaucu

SEQ ID NO: 4526 - RNA, 24 nt, Equine herpesvirus 1
ucgccggcgacuagauucgugggg

SEQ ID NO: 4527 - RNA, 24 nt, Camelpox virus
uaacuaauggcaaauguauaaaac

SEQ ID NO: 4528 - RNA, 24 nt, Variola virus
ugagcuaauuuuuguaaauaacua

SEQ ID NO: 4529 - RNA, 24 nt, Variola virus
uuugguaauaaaauuauucacuau

SEQ ID NO: 4530 - RNA, 24 nt, Cryphonectria hypovirus
ugacgaguaccagaagaggaucga

SEQ ID NO: 4531 - RNA, 23 nt, Cryphonectria hypovirus
uaugacagcaagugcaagccugc

SEQ ID NO: 4532 - RNA, 24 nt, Variola virus
uagaaugcgagcagcgauuuuggc

SEQ ID NO: 4533 - RNA, 24 nt, Cryphonectria hypovirus
uguaauccaaacgaauccuaacug

SEQ ID NO: 4534 - RNA, 24 nt, Cryphonectria hypovirus
ugucucaucauugccuggacguuc

SEQ ID NO: 4535 - RNA, 24 nt, Cryphonectria hypovirus
uagcggccggucguucaauguauc

SEQ ID NO: 4536 - RNA, 24 nt, Vaccinia virus
ugaguuaauauucauguugaacau

SEQ ID NO: 4537 - RNA, 24 nt, Variola virus
caagauagagagcuccuuugguga

SEQ ID NO: 4538 - RNA, 24 nt, Rabbit fibroma virus
uaauacaaguaauguuauucguag

SEQ ID NO: 4539 - RNA, 24 nt, Rabbit fibroma virus
uagcagauuguguccauauacguc

SEQ ID NO: 4540 - RNA, 24 nt, Rabbit fibroma virus
uaagaacuuacaugauccauagug

SEQ ID NO: 4541 - RNA, 24 nt, Camelpox virus
uuugguaaugaaauuauucacuau

SEQ ID NO: 4542 - RNA, 24 nt, Camelpox virus
uagaaugcgagcagcgauuuuggc

SEQ ID NO: 4543 - RNA, 24 nt, Camelpox virus
gggcggagccgaacauucuccaau

SEQ ID NO: 4544 - RNA, 24 nt, Camelpox virus
uguaaaccacaauuugcuuccgcc

SEQ ID NO: 4545 - RNA, 24 nt, Camelpox virus
ugucaugauauugaauuggaaaaa

SEQ ID NO: 4546 - RNA, 24 nt, Fowlpox virus
uagaauaucggcguaucguugauu

SEQ ID NO: 4547 - RNA, 24 nt, Fowlpox virus
uaauagcuauuuuuaucuauuuua

SEQ ID NO: 4548 - RNA, 24 nt, Fowlpox virus
uaagcaaagaaguaaaaucuucgu

SEQ ID NO: 4549 - RNA, 24 nt, Fowlpox virus
ucgaauaauuuuauuuuauuaggc

SEQ ID NO: 4550 - RNA, 24 nt, Fowlpox virus
agauguaaccgaguaugcgauugc

SEQ ID NO: 4551 - RNA, 24 nt, Cowpea mottle virus
uaucauggcaggaggaacacaauc

SEQ ID NO: 4552 - RNA, 24 nt, Cowpea mottle virus
ugacaugcugaucacgccuaggac

SEQ ID NO: 4553 - RNA, 24 nt, Chimpanzee cytomegalovirus
ugagguaguuguugaucacucguc

SEQ ID NO: 4554 - RNA, 21 nt, Chimpanzee cytomegalovirus
ugggauacguaggcaaaacag

SEQ ID NO: 4555 - RNA, 24 nt, Chimpanzee cytomegalovirus
ucacuguaaaauuacgaaucuccg

SEQ ID NO: 4556 - RNA, 24 nt, Chimpanzee cytomegalovirus
ugaggcaggugaaacccgugaugc

SEQ ID NO: 4557 - RNA, 24 nt, Chimpanzee cytomegalovirus
uuaguuaccggcucuuguggccuc

SEQ ID NO: 4558 - RNA, 24 nt, Sonchus yellow net virus
uugaaccaucacggugagcaaguc

SEQ ID NO: 4559 - RNA, 24 nt, Sonchus yellow net virus
ugugacaccaacguucgaauugcu

SEQ ID NO: 4560 - RNA, 24 nt, Cowpea chlorotic mottle virus
uaacuuggugucugugccugaucc

SEQ ID NO: 4561 - RNA, 24 nt, Sonchus yellow net virus
uauggcauauauauuuaacgguga

SEQ ID NO: 4562 - RNA, 24 nt, Sonchus yellow net virus
caucagagcuucuucugcaucaua

SEQ ID NO: 4563 - RNA, 24 nt, Sonchus yellow net virus
uagcauacuaugcagcucuuccau

SEQ ID NO: 4564 - RNA, 22 nt, Sonchus yellow net virus
uauugcaucuugaaauagcacc

SEQ ID NO: 4565 - RNA, 24 nt, Cowpea chlorotic mottle virus
ugauauuaaaccaguugucucgga

SEQ ID NO: 4566 - RNA, 24 nt, Sonchus yellow net virus
uauauagaucagguugguugauuc

SEQ ID NO: 4567 - RNA, 23 nt, Rice yellow stunt virus
ugagauaauaaauauuaugauau

SEQ ID NO: 4568 - RNA, 22 nt, Rice yellow stunt virus
uugcaugucgagcaaauuagag

SEQ ID NO: 4569 - RNA, 24 nt, Rice yellow stunt virus
uaucccugcacaaauuguugcagc

SEQ ID NO: 4570 - RNA, 21 nt, Rice yellow stunt virus
uaaaacauugauaaauacaua

SEQ ID NO: 4571 - RNA, 24 nt, Rice yellow stunt virus
ugagaucuagaauauagcccugga

SEQ ID NO: 4572 - RNA, 24 nt, Rice yellow stunt virus
uuagauauccucaccguuauguga

SEQ ID NO: 4573 - RNA, 21 nt, Lactate dehydrogenase-elevating virus
ucacuggcagaaucucauuca

SEQ ID NO: 4574 - RNA, 24 nt, Callitrichine herpesvirus 3
ugaggggacuaaguggaggccuga

SEQ ID NO: 4575 - RNA, 24 nt, Callitrichine herpesvirus 3
uccccagaacccccaagggguggc

SEQ ID NO: 4576 - RNA, 24 nt, Callitrichine herpesvirus 3
uguggaaaccugcccagugacguc

SEQ ID NO: 4577 - RNA, 24 nt, Callitrichine herpesvirus 3
ugggggagguccgaaugggggucu

SEQ ID NO: 4578 - RNA, 24 nt, Callitrichine herpesvirus 3
ugagaccccaggcuucuucccuua

SEQ ID NO: 4579 - RNA, 24 nt, Callitrichine herpesvirus 3
uagcugaugacagacaaagcaugu

SEQ ID NO: 4580 - RNA, 24 nt, Equine herpesvirus 2
uggccgggcgaggcgccccgcccg

SEQ ID NO: 4581 - RNA, 21 nt, Fowlpox virus
uucaucguucgauucauuauu

SEQ ID NO: 4582 - RNA, 24 nt, Fowlpox virus
uauaacagcuuuuacauauuuggu

SEQ ID NO: 4583 - RNA, 24 nt, Fowlpox virus
uuugauauuuaacaaaguaaaaau

SEQ ID NO: 4584 - RNA, 24 nt, Fowlpox virus
uaggcaaaaaauauguuuacaacu

SEQ ID NO: 4585 - RNA, 24 nt, Fowlpox virus
ucuggcauaugucgaggcuggguu

SEQ ID NO: 4586 - RNA, 24 nt, Fowlpox virus
uguaguauauauagaccacagaua

SEQ ID NO: 4587 - RNA, 21 nt, Fowlpox virus
uauuacucagaauagauauag

SEQ ID NO: 4588 - RNA, 21 nt, Fowlpox virus
acgcuacccuaugauguauaa

SEQ ID NO: 4589 - RNA, 24 nt, Bovine respiratory syncytial virus
uggcggauagaacuuuugaaugua

SEQ ID NO: 4590 - RNA, 24 nt, Bovine respiratory syncytial virus
uauuauauggagguguguuguuag

SEQ ID NO: 4591 - RNA, 24 nt, Bovine respiratory syncytial virus
uauuacauuacauauaaucauggu

SEQ ID NO: 4592 - RNA, 24 nt, Bovine respiratory syncytial virus
uaugacuaaaaugacauuuuuuac

SEQ ID NO: 4593 - RNA, 24 nt, Bovine respiratory syncytial virus
uaauugauuugaauauuuagcuaa

SEQ ID NO: 4594 - RNA, 24 nt, Bovine respiratory syncytial virus
cauaaauugcauaucacgggauau

SEQ ID NO: 4595 - RNA, 24 nt, Bovine respiratory syncytial virus
auaacaucauuuucauucuuaauu

SEQ ID NO: 4596 - RNA, 24 nt, Newcastle disease virus
caauguggcuucauucuguuuccc

SEQ ID NO: 4597 - RNA, 24 nt, Newcastle disease virus
uugcuuguucaccaucaagcauug

SEQ ID NO: 4598 - RNA, 24 nt, Newcastle disease virus
agagguaaccucguggucagcggu

SEQ ID NO: 4599 - RNA, 24 nt, Newcastle disease virus
uauaagacaauauugucuaggccu

SEQ ID NO: 4600 - RNA, 24 nt, Newcastle disease virus
ucgcacucgagauucacaccuucu

SEQ ID NO: 4601 - RNA, 24 nt, Newcastle disease virus
uaggaugucugucacacgcugccg

SEQ ID NO: 4602 - RNA, 24 nt, Newcastle disease virus
uaggauaaucugaugcucugcccu

SEQ ID NO: 4603 - RNA, 24 nt, Newcastle disease virus
uacagaaaggagaugggaugccuu

SEQ ID NO: 4604 - RNA, 24 nt, Newcastle disease virus
uggcucugcuuugaucggagacca

SEQ ID NO: 4605 - RNA, 24 nt, respiratory syncytial virus
uagaguaacuuugcugucuaacua

SEQ ID NO: 4606 - RNA, 24 nt, Garlic latent virus
ugaggaacucuuugagaaaaauag

SEQ ID NO: 4607 - RNA, 24 nt, respiratory syncytial virus
uuggugaaugcuauguauugacuc

SEQ ID NO: 4608 - RNA, 24 nt, Garlic latent virus
uaacaugcuuuucacguuuuugag

SEQ ID NO: 4609 - RNA, 24 nt, Garlic latent virus
uaaaugggacaaucgcuuucgauc

SEQ ID NO: 4610 - RNA, 22 nt, respiratory syncytial virus
uaucaugauauuuaugguggau

SEQ ID NO: 4611 - RNA, 22 nt, respiratory syncytial virus
uugaaucacuuaguuuuuugga

SEQ ID NO: 4612 - RNA, 24 nt, respiratory syncytial virus
cuaggaauuugguagcucuguugu

SEQ ID NO: 4613 - RNA, 24 nt, respiratory syncytial virus
uaaguaaugacugaaaauaaguag

SEQ ID NO: 4614 - RNA, 24 nt, respiratory syncytial virus
ucacagacaaaaagacugauaggu

SEQ ID NO: 4615 - RNA, 24 nt, respiratory syncytial virus
ugugguaagcauuaggauugagug

SEQ ID NO: 4616 - RNA, 24 nt, Sendai virus
ugauguugccacuccaagugcuau

SEQ ID NO: 4617 - RNA, 24 nt, Sendai virus
uaguauucucaaaccuaucuaaua

SEQ ID NO: 4618 - RNA, 24 nt, Human parainfluenza virus 3
uuagaucauugguauuauccgaug

SEQ ID NO: 4619 - RNA, 24 nt, Human parainfluenza virus 3
uagaguaugucagauacagugcca

SEQ ID NO: 4620 - RNA, 24 nt, Human parainfluenza virus 3
uaaagggagucugacuuggagggu

SEQ ID NO: 4621 - RNA, 24 nt, Human parainfluenza virus 3
auaccagguauauauaauuugaac

SEQ ID NO: 4622 - RNA, 24 nt, Human parainfluenza virus 3
uugcauggcucuauuuuguacaac

SEQ ID NO: 4623 - RNA, 24 nt, Human parainfluenza virus 3
uaucucaucauuaccaaaugccca

SEQ ID NO: 4624 - RNA, 24 nt, Human parainfluenza virus 3
uucaucguuuccuggucuugauag

SEQ ID NO: 4625 - RNA, 24 nt, Human parainfluenza virus 3
aagaaucugugucacauuuccuaa

SEQ ID NO: 4626 - RNA, 24 nt, Human parainfluenza virus 3
ugagauaaaaaaagaagagcuaau

SEQ ID NO: 4627 - RNA, 24 nt, Human parainfluenza virus 1 strain Washington/1964
uauccuccugauuuucccgaugcu

SEQ ID NO: 4628 - RNA, 24 nt, Human parainfluenza virus 1 strain Washington/1964
uaauacaauuuuuugugucuacua

SEQ ID NO: 4629 - RNA, 24 nt, Human parainfluenza virus 1 strain Washington/1964
uuuggcacuuucguucauggagga

SEQ ID NO: 4630 - RNA, 24 nt, Equine herpesvirus 1
uggaauagguaaacgcuugggggu

SEQ ID NO: 4631 - RNA, 24 nt, Canine distemper virus
ucaagugagauguccgcucucugu

SEQ ID NO: 4632 - RNA, 24 nt, Canine distemper virus
uaccugauccugacaugcaaaguu

SEQ ID NO: 4633 - RNA, 24 nt, Canine distemper virus
uaagagggguucuaucacaucccg

SEQ ID NO: 4634 - RNA, 24 nt, Canine distemper virus
uagucgagugaugcucauauauac

SEQ ID NO: 4635 - RNA, 24 nt, Canine distemper virus
aaaagugauuugggauugcuuagg

SEQ ID NO: 4636 - RNA, 23 nt, Canine distemper virus
caccugcaaguaccacuccugca

SEQ ID NO: 4637 - RNA, 24 nt, Canine distemper virus
uauguuaaguugaaggucaacacu

SEQ ID NO: 4638 - RNA, 24 nt, Canine distemper virus
ugaggucaauaauacauacaaggu

SEQ ID NO: 4639 - RNA, 24 nt, Canine distemper virus
ugacugggccuagucaugaucuug

SEQ ID NO: 4640 - RNA, 24 nt, Simian hemorrhagic fever virus
aagguuaaggcagcuaugaagagg

SEQ ID NO: 4641 - RNA, 24 nt, Human herpesvirus 4
uaggcaauugcgugccuagaacau

SEQ ID NO: 4642 - RNA, 24 nt, Human herpesvirus 4
uagcaccgcuauccacuaugucuc

SEQ ID NO: 4643 - RNA, 24 nt, Human herpesvirus 4
aggaagugguugcgcaugcgggcc

SEQ ID NO: 4644 - RNA, 21 nt, Human herpesvirus 4
uugcagccacguggccacgug

SEQ ID NO: 4645 - RNA, 24 nt, Human herpesvirus 4
aguuguacucccggaagaugcccu

SEQ ID NO: 4646 - RNA, 24 nt, Human herpesvirus 4
agaugugccuggcucuguccagaa

SEQ ID NO: 4647 - RNA, 24 nt, Human herpesvirus 4
agguggagugggacacaguuagag

SEQ ID NO: 4648 - RNA, 23 nt, Human herpesvirus 4
ucacuggcagcgugacaaccgga

SEQ ID NO: 4649 - RNA, 24 nt, Human herpesvirus 4
ucagugguuuuguuuccuugauag

SEQ ID NO: 4650 - RNA, 24 nt, Measles virus
ugagaucugucauaacuaaauaag

SEQ ID NO: 4651 - RNA, 24 nt, Variola virus
uuaguguuuaauaaaaauauggga

SEQ ID NO: 4652 - RNA, 22 nt, Variola virus
uuuguuggaucagucucuaagu

SEQ ID NO: 4653 - RNA, 24 nt, Variola virus
gugaauugauuccggaagaucgcu

SEQ ID NO: 4654 - RNA, 24 nt, Variola virus
ugaauauauuaaaguuauuuaugu

SEQ ID NO: 4655 - RNA, 24 nt, Variola virus
uagcguagugaggacacaagugaa

SEQ ID NO: 4656 - RNA, 24 nt, Variola virus
uauuaucagauucuauauauucga

SEQ ID NO: 4657 - RNA, 24 nt, Variola virus
ucaacggacacaaaguagcuaaca

SEQ ID NO: 4658 - RNA, 24 nt, Variola virus
uaauauagaggcguuuuaugcugu

SEQ ID NO: 4659 - RNA, 24 nt, Avian paramyxovirus 6
ucaguggagauggcucccuuggcu

SEQ ID NO: 4660 - RNA, 24 nt, Avian paramyxovirus 6
uuagugaugaacggauuuaauuug

SEQ ID NO: 4661 - RNA, 24 nt, Avian paramyxovirus 6
ugugcaguauauuggucauaaccc

SEQ ID NO: 4662 - RNA, 24 nt, Avian paramyxovirus 6
uggccagauuccacaacaaacuga

SEQ ID NO: 4663 - RNA, 24 nt, Avian paramyxovirus 6
ugacaucccuuugauuguugucag

SEQ ID NO: 4664 - RNA, 22 nt, Avian paramyxovirus 6
ugcgauguaagaaggucaauga

SEQ ID NO: 4665 - RNA, 24 nt, Avian paramyxovirus 6
uuagugccauuaguguucuugcuu

SEQ ID NO: 4666 - RNA, 24 nt, Macaca mulatta rhadinovirus
uauaaacugcguguacccaaagag

SEQ ID NO: 4667 - RNA, 24 nt, Macaca mulatta rhadinovirus
agaguucgccgguggccgaggcgc

SEQ ID NO: 4668 - RNA, 24 nt, Macaca mulatta rhadinovirus
cacgacaugccuuuuccauuuacu

SEQ ID NO: 4669 - RNA, 24 nt, Macaca mulatta rhadinovirus
gggccaggcggucgcgguucaggu

SEQ ID NO: 4670 - RNA, 24 nt, Macaca mulatta rhadinovirus
uucgcaggucuuccgucgucaggg

SEQ ID NO: 4671 - RNA, 24 nt, Macaca mulatta rhadinovirus
uugaaagaacgucacggagcaauc

SEQ ID NO: 4672 - RNA, 21 nt, Camelpox virus
uuaacgauuuauuauauaugu

SEQ ID NO: 4673 - RNA, 24 nt, Camelpox virus
uuaaacaauacuaaaauaucuuua

SEQ ID NO: 4674 - RNA, 24 nt, Camelpox virus
uauuaucagauucuauauauucga

SEQ ID NO: 4675 - RNA, 24 nt, Rana tigrina ranavirus
ugaucuguaaaacuuuaggauaag

SEQ ID NO: 4676 - RNA, 24 nt, Rana tigrina ranavirus
uaguuucauguugggguccauuua

SEQ ID NO: 4677 - RNA, 24 nt, Rana tigrina ranavirus
caucuuaagauucuuucuauauca

SEQ ID NO: 4678 - RNA, 23 nt, Rana tigrina ranavirus
ugccguguuaaaggacugggcgc

SEQ ID NO: 4679 - RNA, 24 nt, Rana tigrina ranavirus
ugacgaaggcucucuugaagcugc

SEQ ID NO: 4680 - RNA, 24 nt, Rana tigrina ranavirus
cuagcccggugacgugagccauca

SEQ ID NO: 4681 - RNA, 24 nt, Rana tigrina ranavirus
ucagaucgagguagcacuggacua

SEQ ID NO: 4682 - RNA, 24 nt, Rana tigrina ranavirus
ugagcuggcuagaaaacuuccacc

SEQ ID NO: 4683 - RNA, 24 nt, Bovine herpesvirus 4
ugagguuugagaucucuaagauau

SEQ ID NO: 4684 - RNA, 22 nt, Bovine herpesvirus 4
uauugucuuaucacaagugggg

SEQ ID NO: 4685 - RNA, 24 nt, Bovine herpesvirus 4
ugucuucuaaaaaacauauuuuau

SEQ ID NO: 4686 - RNA, 24 nt, Bovine herpesvirus 4
agagggaugggagauauauuccuc

SEQ ID NO: 4687 - RNA, 24 nt, Bovine herpesvirus 4
uaaaaacaacaaaaaccacaacua

SEQ ID NO: 4688 - RNA, 24 nt, Bovine herpesvirus 4
uaagguaugaaauuuuauauauuu

SEQ ID NO: 4689 - RNA, 23 nt, Bovine herpesvirus 4
uagcacauccggccuuaaggaca

SEQ ID NO: 4690 - RNA, 24 nt, Bovine herpesvirus 4
ugaauaguucuccagaggaagaug

SEQ ID NO: 4691 - RNA, 24 nt, Bovine herpesvirus 4
uagagcaucaaugagaaguuuaag

SEQ ID NO: 4692 - RNA, 24 nt, Hendra virus
uacaaagagucauaugaucucugu

SEQ ID NO: 4693 - RNA, 24 nt, Hendra virus
uaauuuaaccuaucagugucaugg

SEQ ID NO: 4694 - RNA, 24 nt, Hendra virus
ugagguauacuagaagauugaaag

SEQ ID NO: 4695 - RNA, 24 nt, Hendra virus
ugauuauguuuccuagaacaacug

SEQ ID NO: 4696 - RNA, 24 nt, Hendra virus
acgaugcccaucaauacugacucc

SEQ ID NO: 4697 - RNA, 24 nt, Hendra virus
uaagacacuggccauuaugaugug

SEQ ID NO: 4698 - RNA, 24 nt, Hendra virus
uaucagagauagauaauucaugag

SEQ ID NO: 4699 - RNA, 24 nt, Hendra virus
uagauuguuggaaguugagacagg

SEQ ID NO: 4700 - RNA, 24 nt, Hendra virus
uagccuuugcagcuaaucuggauc

SEQ ID NO: 4701 - RNA, 24 nt, Nipah virus
ugagauauagccuguauagucauu

SEQ ID NO: 4702 - RNA, 24 nt, Nipah virus
ugauguguaaucacuccacccucu

SEQ ID NO: 4703 - RNA, 24 nt, Nipah virus
uaagauucggauuuaggauuauuu

SEQ ID NO: 4704 - RNA, 24 nt, Nipah virus
uguuauuuuugaugugauaaaguu

SEQ ID NO: 4705 - RNA, 24 nt, Nipah virus
uauuagaugggaauguucuacuag

SEQ ID NO: 4706 - RNA, 24 nt, Nipah virus
ucaccucugucuaguaccucucca

SEQ ID NO: 4707 - RNA, 24 nt, Nipah virus
uaucauaauccaauuugaauccuu

SEQ ID NO: 4708 - RNA, 24 nt, Nipah virus
uagaauauuggaaauagacgucac

SEQ ID NO: 4709 - RNA, 24 nt, Nipah virus
ucagccuuuguuauaaucucaaga

SEQ ID NO: 4710 - RNA, 24 nt, Nipah virus
uaucaaguuugcuagucaugccuu

SEQ ID NO: 4711 - RNA, 24 nt, Nipah virus
uaaaguguacauauaaagaauuga

SEQ ID NO: 4712 - RNA, 24 nt, Nipah virus
uuggauccuaaguuuuucuuaaug

SEQ ID NO: 4713 - RNA, 24 nt, Nipah virus
cagccagucuugaucugagguuua

SEQ ID NO: 4714 - RNA, 24 nt, Nipah virus
ugagaggcacucuuaccaacaccc

SEQ ID NO: 4715 - RNA, 24 nt, Chimpanzee cytomegalovirus
uugcacacguccagucuccggcgg

SEQ ID NO: 4716 - RNA, 24 nt, Chimpanzee cytomegalovirus
uacgguacgcugcccguggcgccc

SEQ ID NO: 4717 - RNA, 24 nt, Chimpanzee cytomegalovirus
uggaggaccaggcucaugggauag

SEQ ID NO: 4718 - RNA, 24 nt, Reston Ebola virus (REBOV)
uagguaauuuggggagguaagaaa

SEQ ID NO: 4719 - RNA, 24 nt, Reston Ebola virus (REBOV)
cggcaguguugcuacagguguauc

SEQ ID NO: 4720 - RNA, 22 nt, Reston Ebola virus (REBOV)
uauuuugugaaaaucucuaauc

SEQ ID NO: 4721 - RNA, 24 nt, Reston Ebola virus (REBOV)
uagcauacugugcgaugugacuca

SEQ ID NO: 4722 - RNA, 24 nt, Reston Ebola virus (REBOV)
ugagguuccaucuaagguuguggc

SEQ ID NO: 4723 - RNA, 23 nt, Reston Ebola virus (REBOV)
uacuguuuaauauuuugauucau

SEQ ID NO: 4724 - RNA, 24 nt, Reston Ebola virus (REBOV)
aauagugcuuggcaauauuguacu

SEQ ID NO: 4725 - RNA, 21 nt, Reston Ebola virus (REBOV)
uucaaagacugcaucccaaca

SEQ ID NO: 4726 - RNA, 24 nt, Kyuri green mottle mosaic virus
uaugaucaagcgacagccaaaguc

SEQ ID NO: 4727 - RNA, 24 nt, Kyuri green mottle mosaic virus
ugaagcauucgaaggaugcaaugc

SEQ ID NO: 4728 - RNA, 21 nt, Zaire Ebola virus (ZEBOV)
gugagcacgauuauauuggau

SEQ ID NO: 4729 - RNA, 24 nt, Zaire Ebola virus (ZEBOV)
ugacaugcauauaacacuguggga

SEQ ID NO: 4730 - RNA, 24 nt, Kyuri green mottle mosaic virus
uagcugacaacgaguuuaaccugc

SEQ ID NO: 4731 - RNA, 24 nt, Zaire Ebola virus (ZEBOV)
aagcuccaguguauuauauuauca

SEQ ID NO: 4732 - RNA, 24 nt, Zaire Ebola virus (ZEBOV)
uaagaacuguuggcaccgcggcuc

SEQ ID NO: 4733 - RNA, 24 nt, Zaire Ebola virus (ZEBOV)
uuaaugaaaaaacacucucucagc

SEQ ID NO: 4734 - RNA, 24 nt, Zaire Ebola virus (ZEBOV)
uggcuuacagugaggauuuaucug

SEQ ID NO: 4735 - RNA, 23 nt, Kyuri green mottle mosaic virus
ugauaucggaggaaacuauuccc

SEQ ID NO: 4736 - RNA, 24 nt, Kyuri green mottle mosaic virus
ugagauguuaaucugggaaagauu

SEQ ID NO: 4737 - RNA, 23 nt, Zaire Ebola virus (ZEBOV)
uaaucuguauguuaauaaccaac

SEQ ID NO: 4738 - RNA, 24 nt, Kyuri green mottle mosaic virus
uaaguuaguuaaugcgguuuucgg

SEQ ID NO: 4739 - RNA, 24 nt, Zaire Ebola virus (ZEBOV)
uggcuuaaguauucgcaaugagcg

SEQ ID NO: 4740 - RNA, 24 nt, Zaire Ebola virus (ZEBOV)
uguaagaucaauuuauauacagcu

SEQ ID NO: 4741 - RNA, 24 nt, Zaire Ebola virus (ZEBOV)
uauagggcguaaugcuuuuagcac

SEQ ID NO: 4742 - RNA, 24 nt, Zaire Ebola virus (ZEBOV)
ugaagaaugccucuuggggccuaa

SEQ ID NO: 4743 - RNA, 24 nt, Kyuri green mottle mosaic virus
uacgauagguaaucucgagcggau

SEQ ID NO: 4744 - RNA, 24 nt, Zaire Ebola virus (ZEBOV)
uaguguaugaagcaagcaugaugg

SEQ ID NO: 4745 - RNA, 24 nt, Kyuri green mottle mosaic virus
ucgagaagcgguacacaagcaaac

SEQ ID NO: 4746 - RNA, 24 nt, Zaire Ebola virus (ZEBOV)
aacacuguaccaagauccuugacu

SEQ ID NO: 4747 - RNA, 24 nt, Marburg virus
uaugucaauuauugccucuaaagu

SEQ ID NO: 4748 - RNA, 24 nt, Marburg virus
uguaauaucuguaauuuggauagu

SEQ ID NO: 4749 - RNA, 24 nt, Kyuri green mottle mosaic virus
uacgauagguaaucucgagcggau

SEQ ID NO: 4750 - RNA, 21 nt, Marburg virus
aucagauggcuugaaggagag

SEQ ID NO: 4751 - RNA, 24 nt, Marburg virus
uauguuaguaaaucaaaguaaaac

SEQ ID NO: 4752 - RNA, 24 nt, Marburg virus
uagcuuaagaauauuuuaaucgag

SEQ ID NO: 4753 - RNA, 24 nt, Human herpesvirus 5
ugcgauggagcggcacgaugguga

SEQ ID NO: 4754 - RNA, 24 nt, Human herpesvirus 5
uagcauguagucuugcacgucacg

SEQ ID NO: 4755 - RNA, 24 nt, Human herpesvirus 5
ucgaacaugguaaagugcagacgc

SEQ ID NO: 4756 - RNA, 23 nt, Human herpesvirus 5
ugucguacaugaaugaggacggu

SEQ ID NO: 4757 - RNA, 24 nt, Human herpesvirus 5
uuucagcguguguccgcgggcgug

SEQ ID NO: 4758 - RNA, 24 nt, Human herpesvirus 5
uccaugaggcgggugaugcgcccg

SEQ ID NO: 4759 - RNA, 24 nt, Human herpesvirus 5
ugagaugagaaagcggcggugggu

SEQ ID NO: 4760 - RNA, 24 nt, Human herpesvirus 5
ugacaagccugacgagagcguuca

SEQ ID NO: 4761 - RNA, 24 nt, Ovine adenovirus A
uggggucauuuucgucauaauucu

SEQ ID NO: 4762 - RNA, 24 nt, Ovine adenovirus A
agaguuagcagaguguuaaugcug

SEQ ID NO: 4763 - RNA, 21 nt, Ovine adenovirus A
uuugcaagguggagaugguga

SEQ ID NO: 4764 - RNA, 24 nt, Ovine adenovirus A
uguaaugcugcaauuuaauucaac

SEQ ID NO: 4765 - RNA, 22 nt, Ectromelia virus
uugagugcuuugucuacgaguu

SEQ ID NO: 4766 - RNA, 24 nt, peanut bud necrosis virus
caaagugaaguccauuacaucaaa

SEQ ID NO: 4767 - RNA, 24 nt, peanut bud necrosis virus
uuccagucuaugauaacacaaauc

SEQ ID NO: 4768 - RNA, 24 nt, Ectromelia virus
uaucaaagaucuuguuaucgauug

SEQ ID NO: 4769 - RNA, 24 nt, peanut bud necrosis virus
agagggaaaucccuauaugugcug

SEQ ID NO: 4770 - RNA, 22 nt, Ectromelia virus
uaaucgcacaaugauauacguc

SEQ ID NO: 4771 - RNA, 24 nt, Ectromelia virus
agagauacuuucagucuguggugg

SEQ ID NO: 4772 - RNA, 24 nt, Ectromelia virus
uaaaaacugugugaaauuuuguac

SEQ ID NO: 4773 - RNA, 21 nt, peanut bud necrosis virus
uccgauguuuucuuaaaggac

SEQ ID NO: 4774 - RNA, 24 nt, Ectromelia virus
uagcuuauuaucuguuugugcuaa

SEQ ID NO: 4775 - RNA, 24 nt, peanut bud necrosis virus
uggaaucucuagaaaaauuagguc

SEQ ID NO: 4776 - RNA, 22 nt, Ectromelia virus
uaucagaauugucuuccauagg

SEQ ID NO: 4777 - RNA, 24 nt, Ectromelia virus
uauuaaacauggaaucaguugaaa

SEQ ID NO: 4778 - RNA, 24 nt, Ectromelia virus
uaaguggacauauagacgcagaag

SEQ ID NO: 4779 - RNA, 24 nt, Monkeypox virus
cuugcacuuaaagucuacauugua

SEQ ID NO: 4780 - RNA, 24 nt, Monkeypox virus
uaagauaguggucaguucauccuu

SEQ ID NO: 4781 - RNA, 24 nt, Monkeypox virus
uacccguugaaauagaaaauucua

SEQ ID NO: 4782 - RNA, 24 nt, Monkeypox virus
cggaaugggaggaucagcaucugg

SEQ ID NO: 4783 - RNA, 21 nt, Ectromelia virus
uaucauauucgucucuaguau

SEQ ID NO: 4784 - RNA, 24 nt, Monkeypox virus
agagcucguucucaucaucagaau

SEQ ID NO: 4785 - RNA, 24 nt, Monkeypox virus
auagauauuaaugucguauuugaa

SEQ ID NO: 4786 - RNA, 24 nt, Variola virus
uugcugcuaaaccacaugucaauc

SEQ ID NO: 4787 - RNA, 24 nt, Variola virus
ugaacuagucccuguuagcauuau

SEQ ID NO: 4788 - RNA, 24 nt, Variola virus
uuuacagauuuaaauguauaguug

SEQ ID NO: 4789 - RNA, 24 nt, Variola virus
uauuuuacacaacuguuuaauaga

SEQ ID NO: 4790 - RNA, 24 nt, Variola virus
auuaaccuaugguacauacauaug

SEQ ID NO: 4791 - RNA, 24 nt, Variola virus
uaccacauacgacuccagagguug

SEQ ID NO: 4792 - RNA, 24 nt, Variola virus
ugugaugucuguuccauuuaaaga

SEQ ID NO: 4793 - RNA, 24 nt, Variola virus
ugauggagucacuuuuaguucuuc

SEQ ID NO: 4794 - RNA, 24 nt, Camelpox virus
uaacuuaccacaccauuuuuuaaa

SEQ ID NO: 4795 - RNA, 24 nt, Variola virus
uauuggaauuuacuguauuaauua

SEQ ID NO: 4796 - RNA, 24 nt, Fowlpox virus
uauucuacagcggguguaauuuuu

SEQ ID NO: 4797 - RNA, 24 nt, Fowlpox virus
uguuaucauaaguucugaaccuac

SEQ ID NO: 4798 - RNA, 24 nt, Fowlpox virus
ggaaguacugguuuauuuccuaaa

SEQ ID NO: 4799 - RNA, 24 nt, Fowlpox virus
uucuaugucucuucuuauaucaaa

SEQ ID NO: 4800 - RNA, 24 nt, Fowlpox virus
uaauacuacuguaguacuaauaga

SEQ ID NO: 4801 - RNA, 24 nt, Fowlpox virus
uacaguaauuuaacuagaaaagcu

SEQ ID NO: 4802 - RNA, 24 nt, Fowlpox virus
cauuaugcuauuuggugguguuuc

SEQ ID NO: 4803 - RNA, 24 nt, Fowlpox virus
ucggaucuuauaggaauucuagga

SEQ ID NO: 4804 - RNA, 24 nt, Camelpox virus
uguuuuguauuuacgugaacguuu

SEQ ID NO: 4805 - RNA, 24 nt, Camelpox virus
aucacauguaaauguaacuuucug

SEQ ID NO: 4806 - RNA, 24 nt, Camelpox virus
caucauaugcagguggauaauucc

SEQ ID NO: 4807 - RNA, 24 nt, Camelpox virus
uaugccauuaaguguaucuaucac

SEQ ID NO: 4808 - RNA, 22 nt, Camelpox virus
uaaccgguaguauaucugaaau

SEQ ID NO: 4809 - RNA, 24 nt, Camelpox virus
caucaaucuaucauacucguuaua

SEQ ID NO: 4810 - RNA, 24 nt, Camelpox virus
uaauauuuguauacaucuaguauu

SEQ ID NO: 4811 - RNA, 24 nt, Camelpox virus
uuaggcaaauauauaaaaucugga

SEQ ID NO: 4812 - RNA, 24 nt, Camelpox virus
cugguacauuuguauacauuguuu

SEQ ID NO: 4813 - RNA, 21 nt, Camelpox virus
uaucauagacaguaucauaua

SEQ ID NO: 4814 - RNA, 24 nt, Camelpox virus
uaaguaauuaaagcaauaaaacua

SEQ ID NO: 4815 - RNA, 24 nt, Camelpox virus
ugguaucccauaaauguaaucgau

SEQ ID NO: 4816 - RNA, 24 nt, grapevine chrome mosaic virus
ugaaugcguuugccaucaugugug

SEQ ID NO: 4817 - RNA, 24 nt, grapevine chrome mosaic virus
uugguuaaccucucuaacgguaga

SEQ ID NO: 4818 - RNA, 24 nt, grapevine chrome mosaic virus
gucaaagucuuaauuuuucugggc

SEQ ID NO: 4819 - RNA, 24 nt, grapevine chrome mosaic virus
uggcucaauaaauuuuccacuguc

SEQ ID NO: 4820 - RNA, 24 nt, Goatpox virus
uaucaaauaacgauauuaaacuug

SEQ ID NO: 4821 - RNA, 24 nt, grapevine chrome mosaic virus
uggcuccaccuuggaagccauggg

SEQ ID NO: 4822 - RNA, 22 nt, sheeppox virus
uucuuuguuugugauguuuuua

SEQ ID NO: 4823 - RNA, 24 nt, grapevine chrome mosaic virus
uagucuaaguucccaacuagagga

SEQ ID NO: 4824 - RNA, 24 nt, sheeppox virus
uuacugcuacuaacuguucuaaga

SEQ ID NO: 4825 - RNA, 24 nt, Cowpox virus
cgagaacuccuucaacucgcuacc

SEQ ID NO: 4826 - RNA, 22 nt, Cowpox virus
uaauacacguaucauugauuau

SEQ ID NO: 4827 - RNA, 24 nt, Cowpox virus
uugcugcuagaccacaugucaauc

SEQ ID NO: 4828 - RNA, 24 nt, Cowpox virus
uguuacauucauauuuuguguuau

SEQ ID NO: 4829 - RNA, 24 nt, Cowpox virus
ugaaacacauuaucacuccaugau

SEQ ID NO: 4830 - RNA, 24 nt, Cowpox virus
ugaacuagucccuguuagcauuag

SEQ ID NO: 4831 - RNA, 24 nt, Cowpox virus
uagcuuaagaaggcauuuacguau

SEQ ID NO: 4832 - RNA, 24 nt, Cowpox virus
uaucaaagaucuuguuaucgauug

SEQ ID NO: 4833 - RNA, 24 nt, Cowpox virus
ugacaggcgacacaaucguucuuu

SEQ ID NO: 4834 - RNA, 24 nt, Cowpox virus
uaucauaccacauacgacuccaga

SEQ ID NO: 4835 - RNA, 21 nt, Cowpox virus
ucaauagucauacuaacagca

SEQ ID NO: 4836 - RNA, 23 nt, Ateline herpesvirus 3
uucagaaauuucaacauguguuu

SEQ ID NO: 4837 - RNA, 24 nt, Ateline herpesvirus 3
uacccuauuguuuuaugauaaaac

SEQ ID NO: 4838 - RNA, 22 nt, Ateline herpesvirus 3
ugugauguuagcauauguagau

SEQ ID NO: 4839 - RNA, 24 nt, Ateline herpesvirus 3
gagcuuuauuugucauaguuaagc

SEQ ID NO: 4840 - RNA, 22 nt, Ateline herpesvirus 3
uggacugcuuuuacauuaaagg

SEQ ID NO: 4841 - RNA, 24 nt, Ateline herpesvirus 3
uauaaacucuuuauucaaagcaug

SEQ ID NO: 4842 - RNA, 24 nt, Ateline herpesvirus 3
ugacauaaaacaacuaucuuuugu

SEQ ID NO: 4843 - RNA, 24 nt, Ateline herpesvirus 3
ugguaagagcaucgugggcccaau

SEQ ID NO: 4844 - RNA, 24 nt, Ateline herpesvirus 3
uuuuucucucaaagaugcuucggu

SEQ ID NO: 4845 - RNA, 23 nt, Ateline herpesvirus 3
uguugcuuauugagaacaggcca

SEQ ID NO: 4846 - RNA, 24 nt, Ateline herpesvirus 3
uuggcacauggaaauccuuuuucg

SEQ ID NO: 4847 - RNA, 24 nt, Ectromelia virus
aaaggaaacaauaauguaguguga

SEQ ID NO: 4848 - RNA, 24 nt, Ectromelia virus
uaggauguugauuagaugaaugca

SEQ ID NO: 4849 - RNA, 24 nt, Ectromelia virus
uaauguaugguaacaugauaauca

SEQ ID NO: 4850 - RNA, 24 nt, Ectromelia virus
ucaugguguuguuuguuauuugac

SEQ ID NO: 4851 - RNA, 23 nt, Ectromelia virus
uaauacgguccuguaguaucuga

SEQ ID NO: 4852 - RNA, 24 nt, Ectromelia virus
uagcaguuuauggaaaucuuauca

SEQ ID NO: 4853 - RNA, 24 nt, Ectromelia virus
uuugguauacaaucucgacaaucu

SEQ ID NO: 4854 - RNA, 24 nt, Ectromelia virus
gagaguacugguuucauguuucua

SEQ ID NO: 4855 - RNA, 24 nt, Ectromelia virus
ugugguauauguaugagguaggca

SEQ ID NO: 4856 - RNA, 24 nt, Ectromelia virus
aguggauccguuagcuccauaaua

SEQ ID NO: 4857 - RNA, 24 nt, Rana tigrina ranavirus
uuagaucugggcccccguccucuu

SEQ ID NO: 4858 - RNA, 24 nt, Rana tigrina ranavirus
ucccugacugccgaggagcaggcc

SEQ ID NO: 4859 - RNA, 21 nt, Rana tigrina ranavirus
ugagagauaauacaucuuacu

SEQ ID NO: 4860 - RNA, 24 nt, Rana tigrina ranavirus
acagugcccauuggguucuuguag

SEQ ID NO: 4861 - RNA, 24 nt, Rana tigrina ranavirus
ugacauuguagucugaaggaucua

SEQ ID NO: 4862 - RNA, 24 nt, Rana tigrina ranavirus
gccacagccgccgucgccaucccc

SEQ ID NO: 4863 - RNA, 24 nt, Rana tigrina ranavirus
ucaccggcgauuggcccgacgcca

SEQ ID NO: 4864 - RNA, 22 nt, Rana tigrina ranavirus
ucagaacucccaggucguccac

SEQ ID NO: 4865 - RNA, 24 nt, Rana tigrina ranavirus
uagaaugucuugagauauaguaca

SEQ ID NO: 4866 - RNA, 24 nt, Monkeypox virus
ucuguguaucaauucugacacaug

SEQ ID NO: 4867 - RNA, 24 nt, Monkeypox virus
uuagauaucagauauccguaacac

SEQ ID NO: 4868 - RNA, 24 nt, Monkeypox virus
cgagguagucucaucaccagguuu

SEQ ID NO: 4869 - RNA, 21 nt, Monkeypox virus
uauuauguaauaugguguuac

SEQ ID NO: 4870 - RNA, 24 nt, Monkeypox virus
gagaguacugguuucauguuucua

SEQ ID NO: 4871 - RNA, 24 nt, Monkeypox virus
uuacugaauuuaauauauguauga

SEQ ID NO: 4872 - RNA, 24 nt, Camelpox virus
uagguaauauauaucuuuugccgu

SEQ ID NO: 4873 - RNA, 24 nt, Camelpox virus
uugcugcuaaaccacaugucaauc

SEQ ID NO: 4874 - RNA, 24 nt, Camelpox virus
uuucauauaauuucugaagguagu

SEQ ID NO: 4875 - RNA, 24 nt, Parsnip yellow fleck virus
cggcagugaaaugugaugaucuug

SEQ ID NO: 4876 - RNA, 24 nt, Camelpox virus
uauccauaugucucuauauucuau

SEQ ID NO: 4877 - RNA, 24 nt, Camelpox virus
uacauuuccauguaucuaucuaac

SEQ ID NO: 4878 - RNA, 24 nt, Parsnip yellow fleck virus
ugaguauuaugagccauugaauau

SEQ ID NO: 4879 - RNA, 24 nt, Parsnip yellow fleck virus
ugugaaaguuucuggucuuacugg

SEQ ID NO: 4880 - RNA, 24 nt, Camelpox virus
uaucacauucuuaucuacgauaua

SEQ ID NO: 4881 - RNA, 24 nt, Parsnip yellow fleck virus
uugcuuaaagaagccaccaagaac

SEQ ID NO: 4882 - RNA, 24 nt, Parsnip yellow fleck virus
ugagguucacauugcuaaauccuu

SEQ ID NO: 4883 - RNA, 24 nt, Parsnip yellow fleck virus
ugaggaaauaauggccaccacuuu

SEQ ID NO: 4884 - RNA, 24 nt, Parsnip yellow fleck virus
gggaaagugagggguguccuuucu

SEQ ID NO: 4885 - RNA, 24 nt, Rabbit fibroma virus
ucaccggauuguguuuucuuaaua

SEQ ID NO: 4886 - RNA, 24 nt, Rabbit fibroma virus
caugacaaaauuccuacuguauua

SEQ ID NO: 4887 - RNA, 24 nt, Rabbit fibroma virus
cacggggaacuuauucaucgucaa

SEQ ID NO: 4888 - RNA, 24 nt, Rabbit fibroma virus
aacacgguuauaauuacaccucgg

SEQ ID NO: 4889 - RNA, 24 nt, Rabbit fibroma virus
ugagugauuuauuaaagagacgug

SEQ ID NO: 4890 - RNA, 24 nt, Rabbit fibroma virus
ugaugaauuccaauauaacgucuu

SEQ ID NO: 4891 - RNA, 24 nt, Yaba-like disease virus
uaaguaacguuguuuauacccuuu

SEQ ID NO: 4892 - RNA, 23 nt, Yaba-like disease virus
ucacagagguucuucuaguguuc

SEQ ID NO: 4893 - RNA, 24 nt, Yaba-like disease virus
ugagauacccaaccauguuuugau

SEQ ID NO: 4894 - RNA, 24 nt, Yaba-like disease virus
uuauagugaugauguuuuguugug

SEQ ID NO: 4895 - RNA, 24 nt, Monkeypox virus
uuucauagacacaacgaauuugua

SEQ ID NO: 4896 - RNA, 24 nt, Camelpox virus
uugcugcuaaaccacaugucaauc

SEQ ID NO: 4897 - RNA, 24 nt, Monkeypox virus
uugcauaucacugauggguaccuc

SEQ ID NO: 4898 - RNA, 22 nt, Monkeypox virus
uaauagcacuuacguuuuuauc

SEQ ID NO: 4899 - RNA, 24 nt, Monkeypox virus
ucaaugccuuugcuaaucuguuua

SEQ ID NO: 4900 - RNA, 24 nt, Monkeypox virus
auauguacaaauagucgauuauau

SEQ ID NO: 4901 - RNA, 24 nt, Monkeypox virus
ugaacuaguuccuguuagcauuag

SEQ ID NO: 4902 - RNA, 24 nt, Monkeypox virus
ugaauagaguuaucgauucagaca

SEQ ID NO: 4903 - RNA, 24 nt, Monkeypox virus
uaucacaucuuccguuacaacuua

SEQ ID NO: 4904 - RNA, 24 nt, Cowpox virus
uaauggaaguuuugauaggagauu

SEQ ID NO: 4905 - RNA, 24 nt, Monkeypox virus
uaaaaacuugugugaaauuaugua

SEQ ID NO: 4906 - RNA, 24 nt, Yaba-like disease virus
uuaggucuguuaauuauaaguucg

SEQ ID NO: 4907 - RNA, 24 nt, Yaba-like disease virus
uuggguaacuuuuuuuaaaaauau

SEQ ID NO: 4908 - RNA, 24 nt, Yaba-like disease virus
ucaacuccuucuucaaucaaaaag

SEQ ID NO: 4909 - RNA, 24 nt, Yaba-like disease virus
uaaccuuaacaccucuauuaauag

SEQ ID NO: 4910 - RNA, 24 nt, Yaba-like disease virus
uugauacuaugcuuauuauaucau

SEQ ID NO: 4911 - RNA, 24 nt, Cowpox virus
uuaaaugacgaacuauauguucau

SEQ ID NO: 4912 - RNA, 24 nt, Cowpox virus
uaggacacguaacaguaucauucc

SEQ ID NO: 4913 - RNA, 24 nt, Camelpox virus
uauuuuagcucugguauaucauau

SEQ ID NO: 4914 - RNA, 24 nt, Cowpox virus
gagaguacugguuucauguuucua

SEQ ID NO: 4915 - RNA, 24 nt, Cowpox virus
uaugauacacaaauuguuaguuau

SEQ ID NO: 4916 - RNA, 24 nt, Cowpox virus
ucuacauauuucaauguguggaaa

SEQ ID NO: 4917 - RNA, 24 nt, Cowpox virus
ugcuaugguaucuaggaaaugauu

SEQ ID NO: 4918 - RNA, 24 nt, Myxoma virus
uaucucgucguugguauaaaaaaa

SEQ ID NO: 4919 - RNA, 24 nt, Myxoma virus
ugucacguacgaauuuugccgcgu

SEQ ID NO: 4920 - RNA, 24 nt, Myxoma virus
ugugguaaguacuuccgaucacga

SEQ ID NO: 4921 - RNA, 24 nt, Myxoma virus
ucgccuauggcgcguuuacguaug

SEQ ID NO: 4922 - RNA, 24 nt, Myxoma virus
aucaccugguucguaguagucaga

SEQ ID NO: 4923 - RNA, 23 nt, Myxoma virus
cgauaucucgacacgcgcacgac

SEQ ID NO: 4924 - RNA, 24 nt, Myxoma virus
cgagguaaagucuccauuaaacag

SEQ ID NO: 4925 - RNA, 24 nt, Myxoma virus
cacggaaacagucgaucgcaguaa

SEQ ID NO: 4926 - RNA, 22 nt, Ectromelia virus
ucaaugccuuugcuaaucuguu

SEQ ID NO: 4927 - RNA, 22 nt, Ectromelia virus
uauugcaucgggcauaucaggu

SEQ ID NO: 4928 - RNA, 21 nt, Ectromelia virus
ugaccaguuaguaacauugcg

SEQ ID NO: 4929 - RNA, 24 nt, Ectromelia virus
ucaccguuuuuaacacgucuauua

SEQ ID NO: 4930 - RNA, 24 nt, Ectromelia virus
uuauaugguuagucagugagcaua

SEQ ID NO: 4931 - RNA, 24 nt, Ectromelia virus
ugaacuagucccuguuagcauuag

SEQ ID NO: 4932 - RNA, 24 nt, Equine herpesvirus 2
uuucacacuguaaagaauggggua

SEQ ID NO: 4933 - RNA, 24 nt, Equine herpesvirus 2
uuaauccauaaauaaauuauguaa

SEQ ID NO: 4934 - RNA, 24 nt, Equine herpesvirus 2
ugcaguacuauuacucuuuacuuu

SEQ ID NO: 4935 - RNA, 24 nt, Equine herpesvirus 2
uugcacaacccucaucuuuuuagg

SEQ ID NO: 4936 - RNA, 24 nt, Equine herpesvirus 2
aaagaaauagcaagucagauauug

SEQ ID NO: 4937 - RNA, 24 nt, Equine herpesvirus 2
cuugcacaguuuauucuuuuuguu

SEQ ID NO: 4938 - RNA, 24 nt, Equine herpesvirus 2
uauuccaaaaacacauuccacaca

SEQ ID NO: 4939 - RNA, 24 nt, Equine herpesvirus 2
uaagaauaauuccuaaaagacaag

SEQ ID NO: 4940 - RNA, 24 nt, Potato aucuba mosaic virus
uuagauccuuuaagaaagauaguc

SEQ ID NO: 4941 - RNA, 22 nt, Potato aucuba mosaic virus
uugcuagacauuuggguaccac

SEQ ID NO: 4942 - RNA, 23 nt, Potato aucuba mosaic virus
ugaguugugucaaugaucaucaa

SEQ ID NO: 4943 - RNA, 24 nt, porcine epidemic diarrhea virus
ucaccucucacuacgcagcuguaa

SEQ ID NO: 4944 - RNA, 24 nt, porcine epidemic diarrhea virus
ugugcaaaagagaguguggugguu

SEQ ID NO: 4945 - RNA, 24 nt, porcine epidemic diarrhea virus
uucaugcuuagauaacggguaggc

SEQ ID NO: 4946 - RNA, 24 nt, porcine epidemic diarrhea virus
uaaaauagccaucaggauaguccu

SEQ ID NO: 4947 - RNA, 24 nt, porcine epidemic diarrhea virus
ugccaagcaauuguagcugcacca

SEQ ID NO: 4948 - RNA, 24 nt, porcine epidemic diarrhea virus
aagcaggagguguguuagguucaa

SEQ ID NO: 4949 - RNA, 22 nt, porcine epidemic diarrhea virus
ucaaaacccaaugugcucuugc

SEQ ID NO: 4950 - RNA, 23 nt, porcine epidemic diarrhea virus
uaucagagguaacaauguuaagc

SEQ ID NO: 4951 - RNA, 24 nt, porcine epidemic diarrhea virus
uagcucacgaacagccacauuacc

SEQ ID NO: 4952 - RNA, 24 nt, porcine epidemic diarrhea virus
uaagacacggauuuucaacaccau

SEQ ID NO: 4953 - RNA, 24 nt, porcine epidemic diarrhea virus
uucaagcacugcuggacacugugg

SEQ ID NO: 4954 - RNA, 24 nt, porcine epidemic diarrhea virus
ugaaguuguggauaaaaugucugg

SEQ ID NO: 4955 - RNA, 24 nt, porcine epidemic diarrhea virus
ugaguuguaaugcugacucuaugg

SEQ ID NO: 4956 - RNA, 24 nt, porcine epidemic diarrhea virus
auggagcgcugcuucagcuuacca

SEQ ID NO: 4957 - RNA, 24 nt, porcine epidemic diarrhea virus
gucacauggaaguuuaacaagguc

SEQ ID NO: 4958 - RNA, 24 nt, Transmissible gastroenteritis virus
aucacguacaauuucgucacagau

SEQ ID NO: 4959 - RNA, 24 nt, Transmissible gastroenteritis virus
ugcguucuuaggugcagaaagguu

SEQ ID NO: 4960 - RNA, 24 nt, Transmissible gastroenteritis virus
aaauguagaaaaugaaacauuaag

SEQ ID NO: 4961 - RNA, 24 nt, Transmissible gastroenteritis virus
uaaagcacggucacacuuaggaua

SEQ ID NO: 4962 - RNA, 24 nt, Transmissible gastroenteritis virus
aacauugacagggauagaacaaga

SEQ ID NO: 4963 - RNA, 24 nt, Transmissible gastroenteritis virus
ucacuagcaauaacaugucuaggg

SEQ ID NO: 4964 - RNA, 22 nt, Transmissible gastroenteritis virus
uaacaggugcaauuucuugaac

SEQ ID NO: 4965 - RNA, 24 nt, Transmissible gastroenteritis virus
cagucauaauaggguagaagaaag

SEQ ID NO: 4966 - RNA, 24 nt, Transmissible gastroenteritis virus
ugcauagcagaaacaaucuuugac

SEQ ID NO: 4967 - RNA, 24 nt, Oat chlorotic stunt virus
ucagugcaggccgguguuugaugg

SEQ ID NO: 4968 - RNA, 24 nt, Oat chlorotic stunt virus
uagcacgccgagccgcaagaggaa

SEQ ID NO: 4969 - RNA, 21 nt, Oat chlorotic stunt virus
uucaacauggccaucgaggag

SEQ ID NO: 4970 - RNA, 24 nt, Alcelaphine herpesvirus 1
cgagagcuccugaguucauauuca

SEQ ID NO: 4971 - RNA, 24 nt, Alcelaphine herpesvirus 1
aaagcuauguuucaaauacguuug

SEQ ID NO: 4972 - RNA, 24 nt, Alcelaphine herpesvirus 1
uaacagcaggccaacugccacugg

SEQ ID NO: 4973 - RNA, 24 nt, Alcelaphine herpesvirus 1
agugguugccauaccaguaaaagu

SEQ ID NO: 4974 - RNA, 24 nt, Alcelaphine herpesvirus 1
uagcuuguguguugugucugugga

SEQ ID NO: 4975 - RNA, 24 nt, Alcelaphine herpesvirus 1
ucucucagcaugguauugaauguc

SEQ ID NO: 4976 - RNA, 24 nt, Alcelaphine herpesvirus 1
uaguuugggggaggccuuuguuuu

SEQ ID NO: 4977 - RNA, 24 nt, Alcelaphine herpesvirus 1
ucaguuacagcaggaauuguuaau

SEQ ID NO: 4978 - RNA, 24 nt, Alcelaphine herpesvirus 1
uuaccaguuuuuguaccaguacga

SEQ ID NO: 4979 - RNA, 24 nt, Alcelaphine herpesvirus 1
ugacagugcaaguaugcgugaaaa

SEQ ID NO: 4980 - RNA, 24 nt, Alcelaphine herpesvirus 1
ugaaagcgugcgaacugagggaaa

SEQ ID NO: 4981 - RNA, 24 nt, Alcelaphine herpesvirus 1
guuggcaccuggguuauuacaugu

SEQ ID NO: 4982 - RNA, 24 nt, Alcelaphine herpesvirus 1
uuaaagcaggcuaucucucaccug

SEQ ID NO: 4983 - RNA, 24 nt, Alcelaphine herpesvirus 1
uugacacccaauuggcccuuguag

SEQ ID NO: 4984 - RNA, 24 nt, Alcelaphine herpesvirus 1
uagauuggguuaggaucugugugu

SEQ ID NO: 4985 - RNA, 24 nt, Alcelaphine herpesvirus 1
uuacuggucauuuuuaagggacug

SEQ ID NO: 4986 - RNA, 24 nt, Alcelaphine herpesvirus 1
uguagacagacagugagcgggugc

SEQ ID NO: 4987 - RNA, 21 nt, Alcelaphine herpesvirus 1
ugcacggcuaccugguaggga

SEQ ID NO: 4988 - RNA, 24 nt, Alcelaphine herpesvirus 1
ugccaaguacucugguaggagacu

SEQ ID NO: 4989 - RNA, 24 nt, Alcelaphine herpesvirus 1
uauaacggaacaccugcaucggca

SEQ ID NO: 4990 - RNA, 24 nt, Alcelaphine herpesvirus 1
uguagacaacuucuugagauucuu

SEQ ID NO: 4991 - RNA, 24 nt, Alcelaphine herpesvirus 1
uaggcuagucuggacaaaacacug

SEQ ID NO: 4992 - RNA, 24 nt, Murine hepatitis virus
cgugcaaccccuucugcggagaau

SEQ ID NO: 4993 - RNA, 22 nt, Murine hepatitis virus
ugacaacacaggagguaauacu

SEQ ID NO: 4994 - RNA, 24 nt, Murine hepatitis virus
gcaccguuugaauucacaagcugg

SEQ ID NO: 4995 - RNA, 24 nt, Murine hepatitis virus
uuaucgugcacaugucugaagaag

SEQ ID NO: 4996 - RNA, 24 nt, Murine hepatitis virus
caguauugcagaguuggaggcaua

SEQ ID NO: 4997 - RNA, 24 nt, Murine hepatitis virus
ugucgcagcgcuucaacuuccugc

SEQ ID NO: 4998 - RNA, 24 nt, Murine hepatitis virus
uugggcacgcucuuaacuaguuug

SEQ ID NO: 4999 - RNA, 24 nt, Murine hepatitis virus
uaaaguauugucuuugcaaaugga

SEQ ID NO: 5000 - RNA, 21 nt, Murine hepatitis virus
ugacuuagcaauauuacacgc

SEQ ID NO: 5001 - RNA, 24 nt, Murine hepatitis virus
uggguucucaugguauacuaaagg

SEQ ID NO: 5002 - RNA, 24 nt, Murine hepatitis virus
auaaugccucauaauagagccugg

SEQ ID NO: 5003 - RNA, 24 nt, Murine hepatitis virus
uacguuaaauugggugcaaugcac

SEQ ID NO: 5004 - RNA, 24 nt, Murine hepatitis virus
uuuggcagcgaucauuaacaaggc

SEQ ID NO: 5005 - RNA, 24 nt, Murine hepatitis virus
aauuacacaacuuugggucgaggu

SEQ ID NO: 5006 - RNA, 24 nt, Ectromelia virus
uccaauguauuuaugucugauuuu

SEQ ID NO: 5007 - RNA, 24 nt, Ectromelia virus
uugcucaaaaacgaugguagugac

SEQ ID NO: 5008 - RNA, 24 nt, Ectromelia virus
uagcauuagucauaaacuugggau

SEQ ID NO: 5009 - RNA, 24 nt, Ectromelia virus
ugauauaauuuuguccauuguagu

SEQ ID NO: 5010 - RNA, 24 nt, Ectromelia virus
ucgcggaguauagccuauuauuuu

SEQ ID NO: 5011 - RNA, 24 nt, Ectromelia virus
ucgcuagccuuauccucuauaucc

SEQ ID NO: 5012 - RNA, 24 nt, Ectromelia virus
auccgauaacuuuuuugacgaauu

SEQ ID NO: 5013 - RNA, 24 nt, Ectromelia virus
uguaaaccacaauuugcguccgcc

SEQ ID NO: 5014 - RNA, 24 nt, Ectromelia virus
uaugucauaaacuguaaaugauuc

SEQ ID NO: 5015 - RNA, 24 nt, Ectromelia virus
ggacuaguaucguauaauucauag

SEQ ID NO: 5016 - RNA, 24 nt, Camelpox virus
gggcggagccgaacauucuccaau

SEQ ID NO: 5017 - RNA, 24 nt, Ectromelia virus
uaccagucaagucaaugauauuag

SEQ ID NO: 5018 - RNA, 24 nt, lumpy skin disease virus
ucaucugaauaauaacuauaugua

SEQ ID NO: 5019 - RNA, 22 nt, Goatpox virus
uaagugauuguuuuuuuaaugg

SEQ ID NO: 5020 - RNA, 24 nt, lumpy skin disease virus
uaugauaauguaucgacguaaaua

SEQ ID NO: 5021 - RNA, 24 nt, lumpy skin disease virus
aucacaucauuaaaacauauugau

SEQ ID NO: 5022 - RNA, 24 nt, lumpy skin disease virus
ugaaagauuacucuaauaucccuc

SEQ ID NO: 5023 - RNA, 24 nt, lumpy skin disease virus
ugaauaguugcaaaaagaaaauga

SEQ ID NO: 5024 - RNA, 24 nt, lumpy skin disease virus
agagguggagcaucuucccauuuu

SEQ ID NO: 5025 - RNA, 24 nt, lumpy skin disease virus
aaaugaacgggaaaaaagucucuu

SEQ ID NO: 5026 - RNA, 24 nt, lumpy skin disease virus
uaguaauaguacauagauauuuac

SEQ ID NO: 5027 - RNA, 24 nt, Rana tigrina ranavirus
uauccucuuuuccagguccgacaa

SEQ ID NO: 5028 - RNA, 24 nt, Rana tigrina ranavirus
ugagccaagucugccugucgucgg

SEQ ID NO: 5029 - RNA, 24 nt, Rana tigrina ranavirus
guccaguccccgaggcaagaaggg

SEQ ID NO: 5030 - RNA, 24 nt, Rana tigrina ranavirus
uaugacaacgagcuuaguuccgcc

SEQ ID NO: 5031 - RNA, 22 nt, Rana tigrina ranavirus
auuacaucucauucucuuuugg

SEQ ID NO: 5032 - RNA, 24 nt, Rana tigrina ranavirus
uccagcacucguccucgucgcacu

SEQ ID NO: 5033 - RNA, 22 nt, Rana tigrina ranavirus
ugacugcaaaggcaccagccuu

SEQ ID NO: 5034 - RNA, 24 nt, Rana tigrina ranavirus
cgucagggugggcgucauauccug

SEQ ID NO: 5035 - RNA, 24 nt, Rana tigrina ranavirus
gaugguaauaucuuaagauauuua

SEQ ID NO: 5036 - RNA, 23 nt, Rana tigrina ranavirus
uugacaguaggcuuguuguggca

SEQ ID NO: 5037 - RNA, 24 nt, Rana tigrina ranavirus
ugggagacuuucugggagacuuuc

SEQ ID NO: 5038 - RNA, 24 nt, Rana tigrina ranavirus
uauaacaggcaguaguuuuagagu

SEQ ID NO: 5039 - RNA, 24 nt, Rana tigrina ranavirus
ucagagucuuuaccaucucggaaa

SEQ ID NO: 5040 - RNA, 21 nt, Equine herpesvirus 2
ugagaucuugauucaguguuu

SEQ ID NO: 5041 - RNA, 24 nt, Equine herpesvirus 2
ugagguaggcgguugccaggcaga

SEQ ID NO: 5042 - RNA, 24 nt, Equine herpesvirus 2
gaucacuaccucgggugugacggu

SEQ ID NO: 5043 - RNA, 24 nt, Equine herpesvirus 2
ugaggucaggccucuccccggggu

SEQ ID NO: 5044 - RNA, 24 nt, Equine herpesvirus 2
uguuguagcccgucacaaacucca

SEQ ID NO: 5045 - RNA, 24 nt, Equine herpesvirus 2
aacacagcacuugaaguccugugu

SEQ ID NO: 5046 - RNA, 23 nt, Equine herpesvirus 2
uugaaugagguuggagucggggg

SEQ ID NO: 5047 - RNA, 24 nt, Equine herpesvirus 2
uuucacuacagaacagcacgcggc

SEQ ID NO: 5048 - RNA, 24 nt, Equine herpesvirus 2
cuggcagagaacucugccacgggg

SEQ ID NO: 5049 - RNA, 21 nt, Equine herpesvirus 2
ucccugcacaccugguacaug

SEQ ID NO: 5050 - RNA, 24 nt, Equine herpesvirus 2
ugaaaacaccguccggagacuucu

SEQ ID NO: 5051 - RNA, 24 nt, Equine herpesvirus 2
ugaguucucuagggaaacaggugu

SEQ ID NO: 5052 - RNA, 24 nt, Equine herpesvirus 2
caguuuaagcacugaauguaucaa

SEQ ID NO: 5053 - RNA, 24 nt, Equine herpesvirus 2
aagcagugcauagagugccuggag

SEQ ID NO: 5054 - RNA, 24 nt, Equine herpesvirus 2
guaaaccuuacacucggggcucug

SEQ ID NO: 5055 - RNA, 24 nt, Equine herpesvirus 2
uaguuuaagcaccuuuucaugacc

SEQ ID NO: 5056 - RNA, 24 nt, Equine herpesvirus 2
uggcaucuaucuguacgguuacuc

SEQ ID NO: 5057 - RNA, 24 nt, Equine herpesvirus 2
cacugcaggauguuggccgccccg

SEQ ID NO: 5058 - RNA, 24 nt, Equine herpesvirus 2
ucacaacuaacggcucagagggac

SEQ ID NO: 5059 - RNA, 24 nt, Equine herpesvirus 2
uuaaugcacauccccuauuacuca

SEQ ID NO: 5060 - RNA, 22 nt, Equine herpesvirus 2
ugacuccugagaggacagaggc

SEQ ID NO: 5061 - RNA, 23 nt, Equine herpesvirus 2
uggcagcgucccccucagcaggc

SEQ ID NO: 5062 - RNA, 24 nt, Equine herpesvirus 2
agugguaggugcuuaggaaccuca

SEQ ID NO: 5063 - RNA, 22 nt, Equine herpesvirus 2
ugcccaguggggucucucuggu

SEQ ID NO: 5064 - RNA, 24 nt, Equine herpesvirus 2
agaggaagcgggcggggccguccc

SEQ ID NO: 5065 - RNA, 24 nt, Equine herpesvirus 2
aaggugcuuauuucucucucuccu

SEQ ID NO: 5066 - RNA, 23 nt, Equine herpesvirus 2
ugucacagacugcuuaagccauc

SEQ ID NO: 5067 - RNA, 23 nt, Equine herpesvirus 2
ucucccguacgcaaggggcaacc

SEQ ID NO: 5068 - RNA, 24 nt, Equine herpesvirus 2
uagaguguggucuuuucaagauuu

SEQ ID NO: 5069 - RNA, 24 nt, Equine herpesvirus 2
aaaaagcguuaacaagcaggagaa

SEQ ID NO: 5070 - RNA, 24 nt, Equine herpesvirus 2
ugagcagcaugcccccaaagggau

SEQ ID NO: 5071 - RNA, 24 nt, Equine herpesvirus 2
ugacuccacucggacgauucacag

SEQ ID NO: 5072 - RNA, 24 nt, Equine herpesvirus 2
uauccuggcuaugggggccagggc

SEQ ID NO: 5073 - RNA, 21 nt, Equine herpesvirus 2
uggccacgucgcucccguaga

SEQ ID NO: 5074 - RNA, 24 nt, Equine herpesvirus 2
agagggguaguuacgauuacucca

SEQ ID NO: 5075 - RNA, 24 nt, Equine herpesvirus 2
cagcccaccguggggugccucagg

SEQ ID NO: 5076 - RNA, 24 nt, Rat cytomegalovirus
ucuccagacacgguauuuuugaac

SEQ ID NO: 5077 - RNA, 24 nt, Rat cytomegalovirus
uacccagaaacacgcuaacaccgc

SEQ ID NO: 5078 - RNA, 21 nt, Rat cytomegalovirus
uauuauaagcgcaauuacgau

SEQ ID NO: 5079 - RNA, 24 nt, Rat cytomegalovirus
agaauugaucaucgaguaguuucg

SEQ ID NO: 5080 - RNA, 24 nt, Rat cytomegalovirus
aucauaggcauugguauuguuauu

SEQ ID NO: 5081 - RNA, 24 nt, Rat cytomegalovirus
ucgaagucaaaucggucgauucau

SEQ ID NO: 5082 - RNA, 24 nt, Rat cytomegalovirus
ugacacaugacacaagaacgucgc

SEQ ID NO: 5083 - RNA, 24 nt, Rat cytomegalovirus
uacgauacagcgaaaucaaaaaga

SEQ ID NO: 5084 - RNA, 24 nt, Rat cytomegalovirus
uaacgugacaccguuucucggucc

SEQ ID NO: 5085 - RNA, 24 nt, Rat cytomegalovirus
uaucauagacaacuugacauuuuc

SEQ ID NO: 5086 - RNA, 24 nt, Rat cytomegalovirus
uaaauagaaauaaagaguguuaau

SEQ ID NO: 5087 - RNA, 22 nt, Rat cytomegalovirus
uucguucuucgguugguaagau

SEQ ID NO: 5088 - RNA, 24 nt, Rat cytomegalovirus
aaaagucgacguuccacguucacg

SEQ ID NO: 5089 - RNA, 24 nt, Rat cytomegalovirus
ucagaucucucgcucuccugacau

SEQ ID NO: 5090 - RNA, 23 nt, Rat cytomegalovirus
uaccacacaaggaucaaagcaga

SEQ ID NO: 5091 - RNA, 24 nt, Human herpesvirus 4
uagcauaugcuauccuaaucuaua

SEQ ID NO: 5092 - RNA, 24 nt, Human herpesvirus 4
ugacaguuguuccugguagggauu

SEQ ID NO: 5093 - RNA, 24 nt, Human herpesvirus 4
uguagaccagccgcccuguugaug

SEQ ID NO: 5094 - RNA, 24 nt, Human herpesvirus 4
uaauaaggagccguccuuauucuu

SEQ ID NO: 5095 - RNA, 24 nt, Human herpesvirus 4
ucucuggacauuaacuuccacgcc

SEQ ID NO: 5096 - RNA, 24 nt, Human herpesvirus 4
uagcauaugcuauccuaaucuaua

SEQ ID NO: 5097 - RNA, 21 nt, Human herpesvirus 4
ugcaacguuaagccccguuua

SEQ ID NO: 5098 - RNA, 24 nt, Human herpesvirus 4
agagggauuagagaauccugacuu

SEQ ID NO: 5099 - RNA, 24 nt, Human herpesvirus 4
uuuuaacgaagagcgugaagcacc

SEQ ID NO: 5100 - RNA, 24 nt, Goatpox virus
uaaauugauggaccuaauggaguu

SEQ ID NO: 5101 - RNA, 24 nt, Goatpox virus
aggcaguaauguuaccuuagguuc

SEQ ID NO: 5102 - RNA, 24 nt, Goatpox virus
uaucaaauaacgauauuaaacuug

SEQ ID NO: 5103 - RNA, 24 nt, Goatpox virus
ugaaguaaaauaauauguuaaguu

SEQ ID NO: 5104 - RNA, 24 nt, Goatpox virus
ugaaauaacugauagaccuacuuu

SEQ ID NO: 5105 - RNA, 21 nt, Goatpox virus
ucucugauuauuuguuuuggu

SEQ ID NO: 5106 - RNA, 24 nt, Goatpox virus
uaauaucaaugaaauaaaaaauaa

SEQ ID NO: 5107 - RNA, 24 nt, Goatpox virus
uauuauucuacuuuugcauuaacc

SEQ ID NO: 5108 - RNA, 24 nt, Goatpox virus
uauuucgcuaguuaaaucagcacu

SEQ ID NO: 5109 - RNA, 24 nt, Goatpox virus
uaucacuucucaugagaauauuag

SEQ ID NO: 5110 - RNA, 24 nt, Goatpox virus
uauuuuuucuuguuugauuacuga

SEQ ID NO: 5111 - RNA, 24 nt, Goatpox virus
uaauauagacuuauacgaagauuu

SEQ ID NO: 5112 - RNA, 24 nt, Goatpox virus
cagcaaacacaauaacagaaguau

SEQ ID NO: 5113 - RNA, 24 nt, Goatpox virus
aaugacagaucauuauuuauuucu

SEQ ID NO: 5114 - RNA, 24 nt, Goatpox virus
ugaaggaucuaguguacguauguc

SEQ ID NO: 5115 - RNA, 24 nt, Goatpox virus
uguuaucuuuuuaaauuguuccca

SEQ ID NO: 5116 - RNA, 24 nt, Goatpox virus
uggaaaaggaugauuaugaaauaa

SEQ ID NO: 5117 - RNA, 24 nt, Goatpox virus
uuaggaaauauuaugaauuuaaua

SEQ ID NO: 5118 - RNA, 24 nt, Goatpox virus
auuagauucaucuauaucuucuuc

SEQ ID NO: 5119 - RNA, 24 nt, Goatpox virus
uuuguuggugguacguuaagcgua

SEQ ID NO: 5120 - RNA, 24 nt, Goatpox virus
ugauauaaaugauaaaauguuuug

SEQ ID NO: 5121 - RNA, 24 nt, Goatpox virus
uaagaucucucuuguuggagauua

SEQ ID NO: 5122 - RNA, 24 nt, Goatpox virus
uaguacaaaucaaaauauuguguu

SEQ ID NO: 5123 - RNA, 24 nt, Goatpox virus
uaauacugugguuaaagauuuuga

SEQ ID NO: 5124 - RNA, 24 nt, Goatpox virus
uuuaaaaaaguuuauauauuagua

SEQ ID NO: 5125 - RNA, 24 nt, Goatpox virus
ggaaaugaaccuaguacauuugau

SEQ ID NO: 5126 - RNA, 24 nt, Goatpox virus
uucguuagaaaaguacugauaaua

SEQ ID NO: 5127 - RNA, 24 nt, Goatpox virus
ucugaugauaaaauauauuucaaa

SEQ ID NO: 5128 - RNA, 21 nt, Goatpox virus
aaugacaacuauaccgguuac

SEQ ID NO: 5129 - RNA, 24 nt, Goatpox virus
aucagaguuauaacaaauccuaug

SEQ ID NO: 5130 - RNA, 24 nt, Goatpox virus
ucugcaguauaugguaacuuuaau

SEQ ID NO: 5131 - RNA, 24 nt, Goatpox virus
uucuucauguuugguaauggauuu

SEQ ID NO: 5132 - RNA, 24 nt, Goatpox virus
uuauuuguucuucguccgacauaa

SEQ ID NO: 5133 - RNA, 24 nt, Goatpox virus
uaaguuuaaaucuggcaaauguuu

SEQ ID NO: 5134 - RNA, 24 nt, Goatpox virus
agaaggauuuuguuauuagguuua

SEQ ID NO: 5135 - RNA, 24 nt, Goatpox virus
uuuaucaaauucauccaaauacuu

SEQ ID NO: 5136 - RNA, 24 nt, Goatpox virus
uugcucagcuguaaaauuuaguga

SEQ ID NO: 5137 - RNA, 22 nt, Goatpox virus
uuaaugccuauacgaacugaua

SEQ ID NO: 5138 - RNA, 24 nt, Goatpox virus
ugucaagaagcaaaaaaaauagca

SEQ ID NO: 5139 - RNA, 24 nt, Goatpox virus
ucuaaagaagagacgaugacuggc

SEQ ID NO: 5140 - RNA, 22 nt, Goatpox virus
uaauacaacuauaaaauaugga

SEQ ID NO: 5141 - RNA, 24 nt, Goatpox virus
uauaacaauccuaaauugucgaga

SEQ ID NO: 5142 - RNA, 24 nt, Goatpox virus
ugaguuaaauguuuauagaucaug

SEQ ID NO: 5143 - RNA, 24 nt, Goatpox virus
uaucacauuccuacaaugagauua

SEQ ID NO: 5144 - RNA, 22 nt, Goatpox virus
uggaauguuaacaaauauauca

SEQ ID NO: 5145 - RNA, 23 nt, Goatpox virus
uugaaccuaagagcaauggacca

SEQ ID NO: 5146 - RNA, 24 nt, Goatpox virus
aauggaacaaaugacgauaauggu

SEQ ID NO: 5147 - RNA, 24 nt, Goatpox virus
uugcacaacauguuauauaacaga

SEQ ID NO: 5148 - RNA, 24 nt, Goatpox virus
gugauaaguuuccaaauaaacaua

SEQ ID NO: 5149 - RNA, 22 nt, Goatpox virus
ucaauuggcacaguuguauugg

SEQ ID NO: 5150 - RNA, 24 nt, Goatpox virus
uaucuagacauaguagguugcaua

SEQ ID NO: 5151 - RNA, 24 nt, Goatpox virus
uaucguagaugaaaaacuuacuau

SEQ ID NO: 5152 - RNA, 24 nt, Goatpox virus
aaaugaacgggaaaaagucucuuu

SEQ ID NO: 5153 - RNA, 24 nt, Goatpox virus
uaguaucauaaaugucaucguuug

SEQ ID NO: 5154 - RNA, 24 nt, Mouse cytomegalovirus 1
uaugguacuacugcugcugcugag

SEQ ID NO: 5155 - RNA, 24 nt, Mouse cytomegalovirus 1
ucugacacacccugugauauuggu

SEQ ID NO: 5156 - RNA, 24 nt, Mouse cytomegalovirus 1
uauaccagaguuugguauuuuuuu

SEQ ID NO: 5157 - RNA, 24 nt, Mouse cytomegalovirus 1
ugaaauuuuaacagaguguccaug

SEQ ID NO: 5158 - RNA, 21 nt, Mouse cytomegalovirus 1
uacaguaucccaaucaaacgu

SEQ ID NO: 5159 - RNA, 24 nt, Mouse cytomegalovirus 1
ugucauagggagcgugaucgaggg

SEQ ID NO: 5160 - RNA, 22 nt, Mouse cytomegalovirus 1
cgccgcggacuaaaagaugagu

SEQ ID NO: 5161 - RNA, 24 nt, Mouse cytomegalovirus 1
cucgucgucuuuauuauggggugg

SEQ ID NO: 5162 - RNA, 24 nt, Mouse cytomegalovirus 1
ugaugaaucgagcggaggaucgca

SEQ ID NO: 5163 - RNA, 24 nt, Mouse cytomegalovirus 1
uggcagaucuucuuguggaugcgc

SEQ ID NO: 5164 - RNA, 24 nt, Mouse cytomegalovirus 1
cgguucaccgacguuauccgacag

SEQ ID NO: 5165 - RNA, 24 nt, Mouse cytomegalovirus 1
uagcugcggcggaucgacgaagga

SEQ ID NO: 5166 - RNA, 24 nt, Mouse cytomegalovirus 1
ugaauaaaugugugauaaguuaac

SEQ ID NO: 5167 - RNA, 24 nt, Mouse cytomegalovirus 1
agcgguuggaacucgcucccguug

SEQ ID NO: 5168 - RNA, 24 nt, Mouse cytomegalovirus 1
gacgagccggaccgaaaccccguc

SEQ ID NO: 5169 - RNA, 24 nt, Mouse cytomegalovirus 1
uggaaagucccuauugagucagug

SEQ ID NO: 5170 - RNA, 24 nt, Mouse cytomegalovirus 1
aggccgucagccuguugccgcggc

SEQ ID NO: 5171 - RNA, 24 nt, Mouse cytomegalovirus 1
agacugucgccuccuggauaucgg

SEQ ID NO: 5172 - RNA, 24 nt, Mouse cytomegalovirus 1
uagcguguuauuaggaagacuccc

SEQ ID NO: 5173 - RNA, 24 nt, Mouse cytomegalovirus 1
ugggaagauucuggcgggaacuuc

SEQ ID NO: 5174 - RNA, 24 nt, Mouse cytomegalovirus 1
agaggcagaggaggacagagaagc

SEQ ID NO: 5175 - RNA, 24 nt, Mouse cytomegalovirus 1
ugggcucgggacgcggacgcuccu

SEQ ID NO: 5176 - RNA, 24 nt, Mouse cytomegalovirus 1
guaaagcaguacgaggcggcaucg

SEQ ID NO: 5177 - RNA, 24 nt, Mouse cytomegalovirus 1
cgaggcacugcuccuuuugagcgg

SEQ ID NO: 5178 - RNA, 24 nt, Mouse cytomegalovirus 1
uagaacgugcaccgagcgucgagu

SEQ ID NO: 5179 - RNA, 24 nt, Mouse cytomegalovirus 1
uaccgagaagucgcaggcggcggg

SEQ ID NO: 5180 - RNA, 24 nt, Mouse cytomegalovirus 1
aagcaccauccgaucugacaccgu

SEQ ID NO: 5181 - RNA, 24 nt, Mouse cytomegalovirus 1
cgaggucuuccacggcgagccgua

SEQ ID NO: 5182 - RNA, 24 nt, Mouse cytomegalovirus 1
uaaagucugacagaacuaugauua

SEQ ID NO: 5183 - RNA, 24 nt, Mouse cytomegalovirus 1
gcugcaacgacuuguagggggaau

SEQ ID NO: 5184 - RNA, 24 nt, Mouse cytomegalovirus 1
ugacccgucucgucuuuuuuacga

SEQ ID NO: 5185 - RNA, 24 nt, Mouse cytomegalovirus 1
uugaaggagagccgguacagguug

SEQ ID NO: 5186 - RNA, 24 nt, Mouse cytomegalovirus 1
agagggagagggacauucuguggu

SEQ ID NO: 5187 - RNA, 24 nt, Mouse cytomegalovirus 1
uccccgucaagcuaggauucucgc

SEQ ID NO: 5188 - RNA, 24 nt, Mouse cytomegalovirus 1
uacagugagaauaaauaacaaacc

SEQ ID NO: 5189 - RNA, 24 nt, Mouse cytomegalovirus 1
gugagcaggugcagcacggggacg

SEQ ID NO: 5190 - RNA, 24 nt, Mouse cytomegalovirus 1
ugaugugggugcuggcggggcugu

SEQ ID NO: 5191 - RNA, 24 nt, Mouse cytomegalovirus 1
ugucggggucucggucgucuccgu

SEQ ID NO: 5192 - RNA, 24 nt, Mouse cytomegalovirus 1
ugguggagcucacggucgaaggcg

SEQ ID NO: 5193 - RNA, 24 nt, Mouse cytomegalovirus 1
uacgguggucagaccgaagacugc

SEQ ID NO: 5194 - RNA, 24 nt, Mouse cytomegalovirus 1
uagcagcacgagcacggacagcac

SEQ ID NO: 5195 - RNA, 24 nt, Mouse cytomegalovirus 1
ucaguguacuuggcagcaaugggu

SEQ ID NO: 5196 - RNA, 24 nt, Mouse cytomegalovirus 1
ugucaggacaucauguguuuaacu

SEQ ID NO: 5197 - RNA, 24 nt, Mouse cytomegalovirus 1
agauggagauggaguucucuccgc

SEQ ID NO: 5198 - RNA, 24 nt, Mouse cytomegalovirus 1
ugaguugaccgugaaugagagaua

SEQ ID NO: 5199 - RNA, 24 nt, Mouse cytomegalovirus 1
aagagcaaggcgcugaaggcgcuc

SEQ ID NO: 5200 - RNA, 24 nt, Mouse cytomegalovirus 1
uuagaucgguuugaaguugaaacu

SEQ ID NO: 5201 - RNA, 24 nt, Mouse cytomegalovirus 1
acgcugcgcauccccucgagcgug

SEQ ID NO: 5202 - RNA, 24 nt, Mouse cytomegalovirus 1
ccagcaccgcuugaacucgggguc

SEQ ID NO: 5203 - RNA, 22 nt, Mouse cytomegalovirus 1
uggcucacguggaacaccgugu

SEQ ID NO: 5204 - RNA, 24 nt, Mouse cytomegalovirus 1
caucagauagaguucugucuguaa

SEQ ID NO: 5205 - RNA, 21 nt, Mouse cytomegalovirus 1
ugucacguugugaacagccgc

SEQ ID NO: 5206 - RNA, 24 nt, Mouse cytomegalovirus 1
ucaccgauccgcguucgcgguagc

SEQ ID NO: 5207 - RNA, 24 nt, Mouse cytomegalovirus 1
uggguuaucucgacguggcggaga

SEQ ID NO: 5208 - RNA, 24 nt, Mouse cytomegalovirus 1
ucgcacgggagucccggccggcgc

SEQ ID NO: 5209 - RNA, 23 nt, Mouse cytomegalovirus 1
ggagaaccgaagacggaccgucc

SEQ ID NO: 5210 - RNA, 24 nt, Mouse cytomegalovirus 1
ugggaaguucgaacucgucguccc

SEQ ID NO: 5211 - RNA, 24 nt, Mouse cytomegalovirus 1
uggcacgaauucguccucguccac

SEQ ID NO: 5212 - RNA, 21 nt, Mouse cytomegalovirus 1
cacccggaguacguguacgcc

SEQ ID NO: 5213 - RNA, 24 nt, Mouse cytomegalovirus 1
ucgccgcgauggcgccccgauacc

SEQ ID NO: 5214 - RNA, 24 nt, Mouse cytomegalovirus 1
agcugguucucggccguguccacc

SEQ ID NO: 5215 - RNA, 24 nt, Mouse cytomegalovirus 1
ugacauggaggccgcugcuguaac

SEQ ID NO: 5216 - RNA, 24 nt, Mouse cytomegalovirus 1
ggagguggaaguggaggucggcga

SEQ ID NO: 5217 - RNA, 24 nt, Mouse cytomegalovirus 1
ugauauacuuacuguuguuguuca

SEQ ID NO: 5218 - RNA, 24 nt, Mouse cytomegalovirus 1
ucaccggaguugaugcccagcaug

SEQ ID NO: 5219 - RNA, 24 nt, Mouse cytomegalovirus 1
ggaggcagaagcggcugcuggcgc

SEQ ID NO: 5220 - RNA, 21 nt, Mouse cytomegalovirus 1
acaccggaagcgcggaagaac

SEQ ID NO: 5221 - RNA, 24 nt, Mouse cytomegalovirus 1
ucuaccgccccgaaacgacguugu

SEQ ID NO: 5222 - RNA, 23 nt, Mouse cytomegalovirus 1
ggcgaucgcgcauauauagacac

SEQ ID NO: 5223 - RNA, 21 nt, Mouse cytomegalovirus 1
uagcuaguauuggugucagua

SEQ ID NO: 5224 - RNA, 24 nt, Mouse cytomegalovirus 1
ugaaaugguguguauaggaugggu

SEQ ID NO: 5225 - RNA, 22 nt, Mouse cytomegalovirus 1
uaguacaggcgaaaguuguuga

SEQ ID NO: 5226 - RNA, 24 nt, Mouse cytomegalovirus 1
ucagaucgccgugacuccuggcac

SEQ ID NO: 5227 - RNA, 24 nt, Mouse cytomegalovirus 1
uaaauugcaguugagcauagguga

SEQ ID NO: 5228 - RNA, 24 nt, Mouse cytomegalovirus 1
caccccuauugccuaaaauuaugg

SEQ ID NO: 5229 - RNA, 24 nt, Mouse cytomegalovirus 1
ugagucaccaaacacgaucgugac

SEQ ID NO: 5230 - RNA, 24 nt, Mouse cytomegalovirus 1
ugacggagcgcacgcacucaucga

SEQ ID NO: 5231 - RNA, 24 nt, Mouse cytomegalovirus 1
ggaaaucggagacguuucucgaaa

SEQ ID NO: 5232 - RNA, 24 nt, Mouse cytomegalovirus 1
uucaacggcaucucgugcgucuua

SEQ ID NO: 5233 - RNA, 24 nt, Mouse cytomegalovirus 1
uagcugcucgucggccgagcucau

SEQ ID NO: 5234 - RNA, 24 nt, Mouse cytomegalovirus 1
uguuguaguugguccucgagcggg

SEQ ID NO: 5235 - RNA, 24 nt, Mouse cytomegalovirus 1
ucaguggcuucaccagcagguucc

SEQ ID NO: 5236 - RNA, 24 nt, Mouse cytomegalovirus 1
ugucgugcuagguuucgaagaugu

SEQ ID NO: 5237 - RNA, 24 nt, Mouse cytomegalovirus 1
gucaacagaaaccauguucuccgu

SEQ ID NO: 5238 - RNA, 24 nt, Mouse cytomegalovirus 1
uugcugauugauguucuucccgac

SEQ ID NO: 5239 - RNA, 24 nt, Cowpox virus
uauaacagccgucaauuguuuagg

SEQ ID NO: 5240 - RNA, 22 nt, Pepper ringspot virus
uuauauguucaugaucaagucg

SEQ ID NO: 5241 - RNA, 24 nt, Pepper ringspot virus
ucaaaggugcaaagaaagacagaa

SEQ ID NO: 5242 - RNA, 24 nt, Pepper ringspot virus
agagguuauccgaaugguuuagau

SEQ ID NO: 5243 - RNA, 24 nt, Rio Bravo virus
ucaaugaucgaauuggcaagagug

SEQ ID NO: 5244 - RNA, 24 nt, Rio Bravo virus
uggaacaaaaguccaaauucuaga

SEQ ID NO: 5245 - RNA, 24 nt, Rio Bravo virus
ucacugguccgaggagauuucuuu

SEQ ID NO: 5246 - RNA, 24 nt, Rio Bravo virus
uuaaaccaauggaaaaaggcaaua

SEQ ID NO: 5247 - RNA, 24 nt, pestivirus Reindeer-1
uauuaucuccauaaaaaaauaaua

SEQ ID NO: 5248 - RNA, 24 nt, pestivirus Reindeer-1
uggaaagaaauugguuggggaagg

SEQ ID NO: 5249 - RNA, 24 nt, pestivirus Reindeer-1
gugcauuccaauuagugugcccau

SEQ ID NO: 5250 - RNA, 24 nt, pestivirus Giraffe-1
uaucucagaggggugaacaggagc

SEQ ID NO: 5251 - RNA, 24 nt, pestivirus Giraffe-1
uaauguaccuagcuauagaucucc

SEQ ID NO: 5252 - RNA, 24 nt, Langat virus
ucacuggcuggggucccuguagcu

SEQ ID NO: 5253 - RNA, 24 nt, Langat virus
ucacugggcguccagggcuucuag

SEQ ID NO: 5254 - RNA, 24 nt, Langat virus
ccucacauugguucucgagcuggg

SEQ ID NO: 5255 - RNA, 22 nt, Langat virus
ugucauggacaucauaacgcgu

SEQ ID NO: 5256 - RNA, 24 nt, Langat virus
ucuggcucuuuuggugacgggacu

SEQ ID NO: 5257 - RNA, 24 nt, Langat virus
ugacaacggggcucuacucaguga

SEQ ID NO: 5258 - RNA, 24 nt, Langat virus
gcacugguguuuuacacccuacug

SEQ ID NO: 5259 - RNA, 23 nt, Saccharomyces cerevisiae virus L-A
uucggaguuggugaugacguugu

SEQ ID NO: 5260 - RNA, 24 nt, Saccharomyces cerevisiae virus L-A
agcagcaguagcuacuauucucgc

SEQ ID NO: 5261 - RNA, 24 nt, Saccharomyces cerevisiae virus L-A
uaugcuaaccugagcaaauucaug

SEQ ID NO: 5262 - RNA, 23 nt, Rice yellow stunt virus
aucacagaagaaagauggaugcu

SEQ ID NO: 5263 - RNA, 24 nt, rice ragged stunt virus
ucaucgcauggauuugauuacaau

SEQ ID NO: 5264 - RNA, 24 nt, rice ragged stunt virus
auuuagcuguuguuaaucguaagc

SEQ ID NO: 5265 - RNA, 24 nt, Plautia stali intestine virus
ugauauggaugguaaagauucuua

SEQ ID NO: 5266 - RNA, 24 nt, Plautia stali intestine virus
uuuaauggugagacuacaccacug

SEQ ID NO: 5267 - RNA, 24 nt, Plautia stali intestine virus
ucagguacauguggugccccuguu

SEQ ID NO: 5268 - RNA, 24 nt, Himetobi P virus
ucucaucgaauauaucccuaaaua

SEQ ID NO: 5269 - RNA, 24 nt, Himetobi P virus
uaucuuggguaauguuuuaccgca

SEQ ID NO: 5270 - RNA, 24 nt, Himetobi P virus
uuacuccagccgcuacugguaggg

SEQ ID NO: 5271 - RNA, 24 nt, Himetobi P virus
uaccccuuucaaacgcauuagacc

SEQ ID NO: 5272 - RNA, 24 nt, Himetobi P virus
ucaaucgguugcuuuuacaaauac

SEQ ID NO: 5273 - RNA, 24 nt, Himetobi P virus
auuacauugauucauuuuccuauu

SEQ ID NO: 5274 - RNA, 24 nt, Himetobi P virus
uggcugcugcugaugauuuugauu

SEQ ID NO: 5275 - RNA, 24 nt, Triatoma virus
uugcagccuuucccacgcauuuua

SEQ ID NO: 5276 - RNA, 21 nt, Triatoma virus
uguuucaggauuuugccuauu

SEQ ID NO: 5277 - RNA, 24 nt, Triatoma virus
uagcgaauuugcucgcuuuauugc

SEQ ID NO: 5278 - RNA, 24 nt, Triatoma virus
uaggguagcauggucucauaauga

SEQ ID NO: 5279 - RNA, 24 nt, Triatoma virus
ucaaugaaccaauaacuuggaaug

SEQ ID NO: 5280 - RNA, 24 nt, Triatoma virus
aacgguacaagaaugggcccuucu

SEQ ID NO: 5281 - RNA, 24 nt, Triatoma virus
uguuguaauguggggucaugcauu

SEQ ID NO: 5282 - RNA, 24 nt, Triatoma virus
uauuucaugauugggcagauacua

SEQ ID NO: 5283 - RNA, 24 nt, Triatoma virus
acagguaggguauuuaccuggcga

SEQ ID NO: 5284 - RNA, 24 nt, Triatoma virus
aaaaguggaacaacgaccuguggu

SEQ ID NO: 5285 - RNA, 24 nt, Triatoma virus
uauuacaugaaauauuuggaaucu

SEQ ID NO: 5286 - RNA, 24 nt, Triatoma virus
ugguaagaaacagauuuuuggaaa

SEQ ID NO: 5287 - RNA, 24 nt, Triatoma virus
uaucuuaaauccaagucugauggu

SEQ ID NO: 5288 - RNA, 24 nt, Triatoma virus
ugaaagauugagaggauauccaug

SEQ ID NO: 5289 - RNA, 24 nt, Triatoma virus
ugauucggaaagaguauauuauga

SEQ ID NO: 5290 - RNA, 24 nt, Triatoma virus
uguuauggauucggaugguaagau

SEQ ID NO: 5291 - RNA, 24 nt, Triatoma virus
uaacuggaaugucuagaaaucaug

SEQ ID NO: 5292 - RNA, 24 nt, Triatoma virus
uaccuguuccagauauuuuaccuc

SEQ ID NO: 5293 - RNA, 24 nt, Triatoma virus
ugaaagaaucuuaucuuuuucuga

SEQ ID NO: 5294 - RNA, 24 nt, Triatoma virus
uauggaaaugagguuauuuugaaa

SEQ ID NO: 5295 - RNA, 24 nt, Satsuma dwarf virus
uugaaacgggcgauacuauuagug

SEQ ID NO: 5296 - RNA, 24 nt, Satsuma dwarf virus
uaugugaggcuuucuuucauggua

SEQ ID NO: 5297 - RNA, 24 nt, Satsuma dwarf virus
agaggcaauuuguugcagacucug

SEQ ID NO: 5298 - RNA, 24 nt, Satsuma dwarf virus
ucagugaaugucguaaagaacuca

SEQ ID NO: 5299 - RNA, 22 nt, Satsuma dwarf virus
uuaaagccaaauugccuucgua

SEQ ID NO: 5300 - RNA, 24 nt, Apple latent spherical virus
uggcauguuauggaucguuaugug

SEQ ID NO: 5301 - RNA, 24 nt, Apple latent spherical virus
uucagagaauggcggcacaggaaa

SEQ ID NO: 5302 - RNA, 24 nt, Apple latent spherical virus
uaggagcaguucuaggggucuuuu

SEQ ID NO: 5303 - RNA, 24 nt, Apple latent spherical virus
aaauguguugguaugauaaacgau

SEQ ID NO: 5304 - RNA, 24 nt, Apple latent spherical virus
ugagaaaguugauucuucuaaagu

SEQ ID NO: 5305 - RNA, 24 nt, Apple latent spherical virus
ugauaacaccuucuccaaauuugu

SEQ ID NO: 5306 - RNA, 24 nt, Apple latent spherical virus
caaauugcaaaaauucuuaaugca

SEQ ID NO: 5307 - RNA, 24 nt, Tobacco rattle virus
ugaggaagauugugucuaaagaac

SEQ ID NO: 5308 - RNA, 24 nt, Tobacco rattle virus
ucaacgauuucuuuagcagucugu

SEQ ID NO: 5309 - RNA, 24 nt, Tobacco rattle virus
aucauauuugaguucaaauaauug

SEQ ID NO: 5310 - RNA, 24 nt, Obuda pepper virus
uguaaugaauccggucacuaagcc

SEQ ID NO: 5311 - RNA, 24 nt, Obuda pepper virus
uuaauggaguuacugcgagaucug

SEQ ID NO: 5312 - RNA, 24 nt, Obuda pepper virus
ugagguaguaugcaauaauacuuu

SEQ ID NO: 5313 - RNA, 24 nt, Obuda pepper virus
uaguauacuccggaccgcuacaag

SEQ ID NO: 5314 - RNA, 24 nt, Sugarcane striate mosaic associated virus
ugagguuuauucuuaaaaauucaa

SEQ ID NO: 5315 - RNA, 24 nt, Sugarcane striate mosaic associated virus
ugaaguccaggaaaauggucacaa

SEQ ID NO: 5316 - RNA, 24 nt, Salmon pancreas disease virus
ugauguguaugacgcucugccgau

SEQ ID NO: 5317 - RNA, 24 nt, Salmon pancreas disease virus
uacccgcaaauuaaaggauccgaa

SEQ ID NO: 5318 - RNA, 24 nt, Ljungan virus
ucgcaugcuacgcuauguuuuuga

SEQ ID NO: 5319 - RNA, 24 nt, Ljungan virus
ugagauauggaguggaaauacuug

SEQ ID NO: 5320 - RNA, 24 nt, Ljungan virus
aaugacacuuuguguacccuauua

SEQ ID NO: 5321 - RNA, 24 nt, Ljungan virus
cagcccaaaauuuuggaauggaag

SEQ ID NO: 5322 - RNA, 24 nt, Equine rhinitis A virus
ggucacaaaugugggagaggaugg

SEQ ID NO: 5323 - RNA, 24 nt, Equine rhinitis A virus
uaccaaggcaaaauuuuugguugc

SEQ ID NO: 5324 - RNA, 24 nt, Equine rhinitis A virus
uaucagauuuuuaaaaccccagau

SEQ ID NO: 5325 - RNA, 24 nt, Equine rhinitis B virus
uacaacgcgugggaagacuuugau

SEQ ID NO: 5326 - RNA, 24 nt, Equine rhinitis B virus
gugcagugcaaugccagccaguuc

SEQ ID NO: 5327 - RNA, 24 nt, Equine rhinitis B virus
ugggauacucugauuaugaaaccg

SEQ ID NO: 5328 - RNA, 24 nt, Equine rhinitis B virus
ccgcagcguaugaugucuucacca

SEQ ID NO: 5329 - RNA, 24 nt, Equine rhinitis B virus
uugcauuccuuucuggcauucaug

SEQ ID NO: 5330 - RNA, 24 nt, Equine rhinitis B virus
uggcucaacuuucuuacaaaacuu

SEQ ID NO: 5331 - RNA, 24 nt, Porcine enterovirus A (PEV8)
uauuacaaaguuuaaagcuuuuac

SEQ ID NO: 5332 - RNA, 24 nt, Porcine enterovirus A (PEV8)
uuauagcaauagaccauuugguuu

SEQ ID NO: 5333 - RNA, 24 nt, Porcine enterovirus A (PEV8)
uauaguuacagcuaagacugaaag

SEQ ID NO: 5334 - RNA, 24 nt, A-2 plaque virus
aggcagcaaggccaugugaugagg

SEQ ID NO: 5335 - RNA, 24 nt, A-2 plaque virus
ucaaucuugaaauuaccguauuga

SEQ ID NO: 5336 - RNA, 24 nt, A-2 plaque virus
uauggcagaagcaauugaugauua

SEQ ID NO: 5337 - RNA, 24 nt, Avian encephalomyelitis virus
uaaagagaacauucuauguggaug

SEQ ID NO: 5338 - RNA, 24 nt, Avian encephalomyelitis virus
uccacaggagguuauuaaaugucc

SEQ ID NO: 5339 - RNA, 21 nt, Avian encephalomyelitis virus
augguccaaguuuuguucuug

SEQ ID NO: 5340 - RNA, 24 nt, Avian encephalomyelitis virus
uggcuugaugaugacgaguuggua

SEQ ID NO: 5341 - RNA, 24 nt, Tamana bat virus
ugacaaguauguucuaaugguuga

SEQ ID NO: 5342 - RNA, 24 nt, Tamana bat virus
uauggcauguugccaggaaggccu

SEQ ID NO: 5343 - RNA, 24 nt, Tamana bat virus
ucacuugugcagcaguaacuuacu

SEQ ID NO: 5344 - RNA, 22 nt, Tamana bat virus
uacguugguaacugcaacagac

SEQ ID NO: 5345 - RNA, 24 nt, Tamana bat virus
aguuaugaacauaaaccuugcaaa

SEQ ID NO: 5346 - RNA, 24 nt, Tamana bat virus
uccaguagugggcuucuucaagag

SEQ ID NO: 5347 - RNA, 24 nt, sheeppox virus
uaauugauauaauaaaaggaucua

SEQ ID NO: 5348 - RNA, 24 nt, Goatpox virus
agaggaacuaauguuuuuauaucu

SEQ ID NO: 5349 - RNA, 24 nt, Foot-and-mouth disease virus O
uggcaaagacuuugacuugcgucu

SEQ ID NO: 5350 - RNA, 24 nt, Foot-and-mouth disease virus O
uggcaugcagcgaugguuacggug

SEQ ID NO: 5351 - RNA, 24 nt, Foot-and-mouth disease virus O
uguggcagcacgguccaaggaccc

SEQ ID NO: 5352 - RNA, 24 nt, Foot-and-mouth disease virus O
gugugcaugguggacgguacagac

SEQ ID NO: 5353 - RNA, 24 nt, Foot-and-mouth disease virus O
cacccguaacggccacacgaccuc

SEQ ID NO: 5354 - RNA, 24 nt, Cowpea aphid-borne mosaic virus
uaaaugcacuguacagcaagcaaa

SEQ ID NO: 5355 - RNA, 24 nt, Cowpea aphid-borne mosaic virus
ggaggaagacucggaacuucauuc

SEQ ID NO: 5356 - RNA, 24 nt, Cowpea aphid-borne mosaic virus
uaagguagagcaguucucacauag

SEQ ID NO: 5357 - RNA, 24 nt, Cowpea aphid-borne mosaic virus
ugaggguguggcaagaaaaccacu

SEQ ID NO: 5358 - RNA, 24 nt, Cowpea aphid-borne mosaic virus
gagguuaguuuucuuugcuaaugg

SEQ ID NO: 5359 - RNA, 24 nt, Cowpea aphid-borne mosaic virus
uucacacccauccuuacaccagau

SEQ ID NO: 5360 - RNA, 23 nt, Cowpea aphid-borne mosaic virus
uguuacggaaaauacuuugacaa

SEQ ID NO: 5361 - RNA, 24 nt, Trichomonas vaginalis virus 3
uuaaagugaacuguuacgcgcgaa

SEQ ID NO: 5362 - RNA, 24 nt, Trichomonas vaginalis virus 3
uacccuacccuaugaauuaaacaa

SEQ ID NO: 5363 - RNA, 24 nt, Sorghum mosaic virus
gugcaucauugagaaucacucgaa

SEQ ID NO: 5364 - RNA, 23 nt, Sorghum mosaic virus
uacaacagcccgugcuaaggagg

SEQ ID NO: 5365 - RNA, 24 nt, Sorghum mosaic virus
agaguuaaucguacagcaaauguc

SEQ ID NO: 5366 - RNA, 23 nt, Sorghum mosaic virus
ugagcggacuaaugguauggugc

SEQ ID NO: 5367 - RNA, 24 nt, Potato virus A
aaucacaaaggacuuguugauagu

SEQ ID NO: 5368 - RNA, 24 nt, Potato virus A
gaggagcaagacagcgucugugca

SEQ ID NO: 5369 - RNA, 24 nt, Potato virus A
ucaaaugcuagagccacccacgaa

SEQ ID NO: 5370 - RNA, 24 nt, Potato virus A
agaagugguucuguuucaagcaaa

SEQ ID NO: 5371 - RNA, 24 nt, Potato virus A
aagcucaagggaauggaucgaauc

SEQ ID NO: 5372 - RNA, 24 nt, Potato virus A
uggcaagaguuaagcuauuuugga

SEQ ID NO: 5373 - RNA, 24 nt, Potato virus A
ugagaucaucaccaagggcagugc

SEQ ID NO: 5374 - RNA, 24 nt, Potato virus A
uaaaguucaucaauacaauguuag

SEQ ID NO: 5375 - RNA, 24 nt, Cryphonectria parasitica mitovirus 1-NB631
ucaagugaauuuacugaauuugca

SEQ ID NO: 5376 - RNA, 24 nt, Cryphonectria parasitica mitovirus 1-NB631
ugacuuaugcgguagggcaaccca

SEQ ID NO: 5377 - RNA, 24 nt, Cryphonectria parasitica mitovirus 1-NB631
uucaaagacuauagaucagaagcu

SEQ ID NO: 5378 - RNA, 24 nt, Bean common mosaic necrosis virus
ugaggaauucugaaggguucuaca

SEQ ID NO: 5379 - RNA, 24 nt, Bean common mosaic necrosis virus
uguuaugggauuauuuccgucacu

SEQ ID NO: 5380 - RNA, 24 nt, Bean common mosaic necrosis virus
agagagaagaucugacgcuugcuu

SEQ ID NO: 5381 - RNA, 24 nt, Bean common mosaic necrosis virus
ucacagggcauucauuuucauugg

SEQ ID NO: 5382 - RNA, 24 nt, Ophiostoma mitovirus 3a
ugauacucuuccuaaguccgagau

SEQ ID NO: 5383 - RNA, 24 nt, Ophiostoma mitovirus 3a
ugagucuuuaguaaauuaaaggac

SEQ ID NO: 5384 - RNA, 24 nt, Ophiostoma mitovirus 3a
uuccucauugaauaagauuauuag

SEQ ID NO: 5385 - RNA, 24 nt, Ophiostoma mitovirus 3a
ugugcaagauaaaccggugagaag

SEQ ID NO: 5386 - RNA, 24 nt, Ophiostoma mitovirus 3a
aggauucuaguacuauaaggggag

SEQ ID NO: 5387 - RNA, 22 nt, Ophiostoma mitovirus 3a
ugaauagagguaacguucuuau

SEQ ID NO: 5388 - RNA, 24 nt, Ophiostoma mitovirus 3a
cucccauucacuaauuaugcguua

SEQ ID NO: 5389 - RNA, 24 nt, Ophiostoma novo-ulmi mitovirus 4-Ld
ugaauauauuuacauauuuacaaa

SEQ ID NO: 5390 - RNA, 24 nt, Ophiostoma novo-ulmi mitovirus 4-Ld
auaaugaucauuaucuaagcauaa

SEQ ID NO: 5391 - RNA, 24 nt, Ophiostoma novo-ulmi mitovirus 4-Ld
uauaacaagauauaugugugguaa

SEQ ID NO: 5392 - RNA, 24 nt, Ophiostoma novo-ulmi mitovirus 4-Ld
ugucauauucuacacuaacauucg

SEQ ID NO: 5393 - RNA, 24 nt, Ophiostoma novo-ulmi mitovirus 4-Ld
uagauuuccaauauucuuacaaca

SEQ ID NO: 5394 - RNA, 24 nt, Ophiostoma novo-ulmi mitovirus 4-Ld
uaugaugccuaguauuugagauau

SEQ ID NO: 5395 - RNA, 24 nt, Ophiostoma novo-ulmi mitovirus 5-Ld
ugaaguagagaugaucauuauuug

SEQ ID NO: 5396 - RNA, 24 nt, Ophiostoma novo-ulmi mitovirus 5-Ld
agagguauuuuaaauaaucuaaau

SEQ ID NO: 5397 - RNA, 24 nt, Ophiostoma novo-ulmi mitovirus 5-Ld
uauuacuaaauauauugcaaauga

SEQ ID NO: 5398 - RNA, 24 nt, Southern bean mosaic virus
uucaaguaaaccccucauggauua

SEQ ID NO: 5399 - RNA, 24 nt, Southern bean mosaic virus
ugauguagagaugagaauuguucu

SEQ ID NO: 5400 - RNA, 24 nt, Southern bean mosaic virus
ugagaacucggcugcucccagagg

SEQ ID NO: 5401 - RNA, 24 nt, Phthorimaea operculella granulovirus
uauuguauugaauagcgugugggu

SEQ ID NO: 5402 - RNA, 24 nt, Phthorimaea operculella granulovirus
ucggauggauguuauauuugcguu

SEQ ID NO: 5403 - RNA, 24 nt, Phthorimaea operculella granulovirus
ucgauuaaacaaauugguacaaaa

SEQ ID NO: 5404 - RNA, 21 nt, Phthorimaea operculella granulovirus
uuuacaguugauucaaaaugu

SEQ ID NO: 5405 - RNA, 24 nt, Phthorimaea operculella granulovirus
uuuggcaaacguuuugcguuacaa

SEQ ID NO: 5406 - RNA, 24 nt, Fringilla coelebs papillomavirus (FPV)
uagcuuaccauuaugcuauacaug

SEQ ID NO: 5407 - RNA, 24 nt, Paprika mild mottle virus
uauaacagauagggagcaucugga

SEQ ID NO: 5408 - RNA, 24 nt, Paprika mild mottle virus
uuugcaaauucacuaaacuagaua

SEQ ID NO: 5409 - RNA, 24 nt, Paprika mild mottle virus
ugucacagcgaggucagaauggga

SEQ ID NO: 5410 - RNA, 24 nt, Paprika mild mottle virus
augaagccuuugucuuuggagaua

SEQ ID NO: 5411 - RNA, 24 nt, La Crosse virus
uauuggagauaaggcuauugagua

SEQ ID NO: 5412 - RNA, 24 nt, La Crosse virus
ucaaugauuaguacaguuggauug

SEQ ID NO: 5413 - RNA, 24 nt, La Crosse virus
agagauggacccuagugauauuau

SEQ ID NO: 5414 - RNA, 24 nt, Mamestra configurata nucleopolyhedrovirus B
uauaguaaaaacgaaacacccguu

SEQ ID NO: 5415 - RNA, 24 nt, Mamestra configurata nucleopolyhedrovirus B
uuaaaggcaacuauacgggacacg

SEQ ID NO: 5416 - RNA, 24 nt, Heliothis zea virus 1 (HZV-1)
acaagugcauucaacuggaccgac

SEQ ID NO: 5417 - RNA, 24 nt, Heliothis zea virus 1 (HZV-1)
ucuaaacucuagucaaaagguggc

SEQ ID NO: 5418 - RNA, 24 nt, Heliothis zea virus 1 (HZV-1)
agcgguagcguugccucaaaacua

SEQ ID NO: 5419 - RNA, 24 nt, Heliothis zea virus 1 (HZV-1)
ugguguagagggugauuuuaacaa

SEQ ID NO: 5420 - RNA, 24 nt, Heliothis zea virus 1 (HZV-1)
uauuacaucgguggaccaagugau

SEQ ID NO: 5421 - RNA, 24 nt, Heliothis zea virus 1 (HZV-1)
uaauguagaguccccggagcuuac

SEQ ID NO: 5422 - RNA, 24 nt, Chikungunya virus
uccgaugaauugauggcagccaga

SEQ ID NO: 5423 - RNA, 24 nt, Chikungunya virus
ugacuagcggaaagaaagaaaacu

SEQ ID NO: 5424 - RNA, 24 nt, Mammalian orthoreovirus 2
ugagcgacucgggaaguuguauca

SEQ ID NO: 5425 - RNA, 24 nt, Mammalian orthoreovirus 2
ugagauggaagugcuuggugugcg

SEQ ID NO: 5426 - RNA, 24 nt, Mammalian orthoreovirus 2
ugcaagauggguggugcgggugug

SEQ ID NO: 5427 - RNA, 24 nt, Tacaribe virus
ugagaugacaggcuucauuagaag

SEQ ID NO: 5428 - RNA, 24 nt, Rachiplusia ou multiple nucleopolyhedrovirus
uuuggaaacgacuaaaauuaaaga

SEQ ID NO: 5429 - RNA, 24 nt, Rachiplusia ou multiple nucleopolyhedrovirus
uacagcaauaugaacgaucagaaa

SEQ ID NO: 5430 - RNA, 24 nt, Aphid lethal paralysis virus
uugaacaguaucguuaaucauugu

SEQ ID NO: 5431 - RNA, 24 nt, Aphid lethal paralysis virus
acauugccauuguacaauuaccca

SEQ ID NO: 5432 - RNA, 24 nt, Aphid lethal paralysis virus
aucaagaaucccgaacugaaacga

SEQ ID NO: 5433 - RNA, 24 nt, Aphid lethal paralysis virus
uugaugcuguuuaugaagcaauga

SEQ ID NO: 5434 - RNA, 24 nt, Aphid lethal paralysis virus
uuagcugcacagaaucuauuaccc

SEQ ID NO: 5435 - RNA, 24 nt, Aphid lethal paralysis virus
uuagagcauauuuuguggcaccaa

SEQ ID NO: 5436 - RNA, 24 nt, Aphid lethal paralysis virus
ugugauaacugcucuccuaucgau

SEQ ID NO: 5437 - RNA, 24 nt, Aphid lethal paralysis virus
agucgcagauugugauuguaauac

SEQ ID NO: 5438 - RNA, 21 nt, Aphid lethal paralysis virus
uugcaggaauuacgcauauga

SEQ ID NO: 5439 - RNA, 21 nt, Aphid lethal paralysis virus
aagcuggcgacguacuauaug

SEQ ID NO: 5440 - RNA, 24 nt, Aphid lethal paralysis virus
uuagugcuauuaaugaguuggaag

SEQ ID NO: 5441 - RNA, 24 nt, Callitrichine herpesvirus 3
uguuuacuuuuuacuccgggcggc

SEQ ID NO: 5442 - RNA, 24 nt, Callitrichine herpesvirus 3
ugggaucaaucauacggaguuccg

SEQ ID NO: 5443 - RNA, 24 nt, Callitrichine herpesvirus 3
ugacauagaauggucuaugcuuug

SEQ ID NO: 5444 - RNA, 24 nt, Broad bean necrosis virus
ugaagugcagaggagacaacaaga

SEQ ID NO: 5445 - RNA, 23 nt, Broad bean necrosis virus
ugagaugaagcaguaucuugguu

SEQ ID NO: 5446 - RNA, 24 nt, Broad bean necrosis virus
ugaugugugauacuacuuauuuga

SEQ ID NO: 5447 - RNA, 24 nt, Broad bean necrosis virus
ugaguauacgacugaugacuuuga

SEQ ID NO: 5448 - RNA, 24 nt, Broad bean necrosis virus
uaucaaaguugugauugaauugua

SEQ ID NO: 5449 - RNA, 24 nt, Broad bean necrosis virus
ugagcaggcgaagaaacaauugau

SEQ ID NO: 5450 - RNA, 24 nt, Broad bean necrosis virus
ugaguauacgacugaugacuuuga

SEQ ID NO: 5451 - RNA, 23 nt, Homo sapiens
ccgccucuucccgccccgcccca

SEQ ID NO: 5452 - RNA, 20 nt, Homo sapiens
gaacuuucuugaaaaucuua

SEQ ID NO: 5453 - RNA, 21 nt, Homo sapiens
ucccgggaggcugccgcgcca

SEQ ID NO: 5454 - RNA, 23 nt, Homo sapiens
acucauuaccgucugugauugcc

SEQ ID NO: 5455 - RNA, 19 nt, Homo sapiens
auuucucaucaauucucua

SEQ ID NO: 5456 - RNA, 19 nt, Homo sapiens
ccacagcaaaugagaugua

SEQ ID NO: 5457 - RNA, 18 nt, Homo sapiens
uggauguuucuucuuuga

SEQ ID NO: 5458 - RNA, 20 nt, Homo sapiens
agcuacaaaaaucuguauua

SEQ ID NO: 5459 - RNA, 22 nt, Homo sapiens
cccuccuuccuucuuucccuac

SEQ ID NO: 5460 - RNA, 24 nt, Homo sapiens
gcaaagagagcuccccugguucca

SEQ ID NO: 5461 - RNA, 22 nt, Homo sapiens
ggacuuggacagagggcccaca

SEQ ID NO: 5462 - RNA, 25 nt, Homo sapiens
ucccaugggauuccccggcugugac

SEQ ID NO: 5463 - RNA, 19 nt, Homo sapiens
ucuaccuucccacucaccu

SEQ ID NO: 5464 - RNA, 20 nt, Homo sapiens
acaguugugacaguaaucug

SEQ ID NO: 5465 - RNA, 20 nt, Homo sapiens
cagaaaaccagcauauuuaa

SEQ ID NO: 5466 - RNA, 21 nt, Homo sapiens
ccuaauaaaauaaugguauuu

SEQ ID NO: 5467 - RNA, 23 nt, Homo sapiens
guauauuuuauaugauuuacuua

SEQ ID NO: 5468 - RNA, 22 nt, Homo sapiens
uucuauugaguauuauaagaua

SEQ ID NO: 5469 - RNA, 15 nt, Homo sapiens
cccccagucucccac

SEQ ID NO: 5470 - RNA, 22 nt, Homo sapiens
accugccucaacugcugcccca

SEQ ID NO: 5471 - RNA, 19 nt, Homo sapiens
gcccugaccucaggggcca

SEQ ID NO: 5472 - RNA, 19 nt, Homo sapiens
gcccugucccucccacucc

SEQ ID NO: 5473 - RNA, 22 nt, Homo sapiens
aagaauuuccucugaagcaccg

SEQ ID NO: 5474 - RNA, 18 nt, Homo sapiens
aacaauaaauacuaugca

SEQ ID NO: 5475 - RNA, 17 nt, Homo sapiens
aaugcugcagucugcac

SEQ ID NO: 5476 - RNA, 23 nt, Homo sapiens
cccuccccaacccacauaccucc

SEQ ID NO: 5477 - RNA, 24 nt, Homo sapiens
cccuccccaacccacauaccucca

SEQ ID NO: 5478 - RNA, 22 nt, Homo sapiens
cccuggccgcggggccugugag

SEQ ID NO: 5479 - RNA, 22 nt, Homo sapiens
aauugugucucaacagaaacua

SEQ ID NO: 5480 - RNA, 20 nt, Homo sapiens
agaauuuuugcuaugcugua

SEQ ID NO: 5481 - RNA, 22 nt, Homo sapiens
cccaucccaacuuccuuuaauu

SEQ ID NO: 5482 - RNA, 19 nt, Homo sapiens
ugaacaagcuuuacccagc

SEQ ID NO: 5483 - RNA, 23 nt, Homo sapiens
uguauauucugguauuugaggug

SEQ ID NO: 5484 - RNA, 19 nt, Homo sapiens
aaugucuauccacaggcua

SEQ ID NO: 5485 - RNA, 18 nt, Homo sapiens
aaaaacaaaacaaacaaa

SEQ ID NO: 5486 - RNA, 19 nt, Homo sapiens
ccucccccgucuucucucc

SEQ ID NO: 5487 - RNA, 23 nt, Homo sapiens
gguggaagauucagccaagcuca

SEQ ID NO: 5488 - RNA, 18 nt, Homo sapiens
ccuggguucacuuggccc

SEQ ID NO: 5489 - RNA, 18 nt, Homo sapiens
aagucucauuuacauuuc

SEQ ID NO: 5490 - RNA, 22 nt, Homo sapiens
aucuuggcucacugcaaccucu

SEQ ID NO: 5491 - RNA, 23 nt, Homo sapiens
cagugccgguucagacucaccua

SEQ ID NO: 5492 - RNA, 17 nt, Homo sapiens
ccacauuugaauccucu

SEQ ID NO: 5493 - RNA, 18 nt, Homo sapiens
guagcucaaaagaccuua

SEQ ID NO: 5494 - RNA, 18 nt, Homo sapiens
uacaggagaaagagguga

SEQ ID NO: 5495 - RNA, 23 nt, Homo sapiens
ucaguaauaaauacaaaaaaaaa

SEQ ID NO: 5496 - RNA, 23 nt, Homo sapiens
ucuuuuuggcaaucuugaacuuu

SEQ ID NO: 5497 - RNA, 18 nt, Homo sapiens
ugcauccuuguccuugca

SEQ ID NO: 5498 - RNA, 22 nt, Homo sapiens
ugcauccuuguccuugcaggug

SEQ ID NO: 5499 - RNA, 18 nt, Homo sapiens
uguuucuuuucuacauuu

SEQ ID NO: 5500 - RNA, 21 nt, Homo sapiens
uuacaggugugagccuccaug

SEQ ID NO: 5501 - RNA, 25 nt, Homo sapiens
uucuucauguagucugcugaucuca

SEQ ID NO: 5502 - RNA, 19 nt, Homo sapiens
acauuuccgcuguccguca

SEQ ID NO: 5503 - RNA, 20 nt, Homo sapiens
accaaaaaaccucacugggc

SEQ ID NO: 5504 - RNA, 22 nt, Homo sapiens
agccagggagcuugccacacuc

SEQ ID NO: 5505 - RNA, 21 nt, Homo sapiens
gcaguuuuagcagcacuuuug

SEQ ID NO: 5506 - RNA, 22 nt, Homo sapiens
gcuugaaccugcuuccuggcuc

SEQ ID NO: 5507 - RNA, 20 nt, Homo sapiens
ggacggcccugccugccucu

SEQ ID NO: 5508 - RNA, 18 nt, Homo sapiens
uaaaacuuuuaggaccau

SEQ ID NO: 5509 - RNA, 20 nt, Homo sapiens
ugagaccacaguuuaccuca

SEQ ID NO: 5510 - RNA, 21 nt, Homo sapiens
uucugaugacgccugucugug

SEQ ID NO: 5511 - RNA, 17 nt, Homo sapiens
ucaaucuucccugccca

SEQ ID NO: 5512 - RNA, 21 nt, Homo sapiens
aaacuuuaccaucuuuguugc

SEQ ID NO: 5513 - RNA, 18 nt, Homo sapiens
gcuaguuaaggcaaauca

SEQ ID NO: 5514 - RNA, 22 nt, Homo sapiens
gguugcuuugugucuaguuuuc

SEQ ID NO: 5515 - RNA, 24 nt, Homo sapiens
cccgggcagccgccuucugagccc

SEQ ID NO: 5516 - RNA, 19 nt, Homo sapiens
cccuugcccacuucuccuu

SEQ ID NO: 5517 - RNA, 21 nt, Homo sapiens
ccgaagcaagaaguuaaccaa

SEQ ID NO: 5518 - RNA, 22 nt, Homo sapiens
ccucccccagucucucuucuca

SEQ ID NO: 5519 - RNA, 17 nt, Homo sapiens
cucucucucuccaucuc

SEQ ID NO: 5520 - RNA, 22 nt, Homo sapiens
ugucaccuugcaggcuguggug

SEQ ID NO: 5521 - RNA, 19 nt, Homo sapiens
cguccggacgagacaggcg

SEQ ID NO: 5522 - RNA, 24 nt, Homo sapiens
cucugguggcugccagcuugugag

SEQ ID NO: 5523 - RNA, 24 nt, Homo sapiens
agccgucugucucucccauaugau

SEQ ID NO: 5524 - RNA, 19 nt, Homo sapiens
aguaugcaagaaguuugca

SEQ ID NO: 5525 - RNA, 20 nt, Homo sapiens
auguuguagcaaacauuucu

SEQ ID NO: 5526 - RNA, 23 nt, Homo sapiens
caaauaaugauaaagucuauuca

SEQ ID NO: 5527 - RNA, 21 nt, Homo sapiens
gaauuauaaaagcuuacuuua

SEQ ID NO: 5528 - RNA, 23 nt, Homo sapiens
ggggagugcgcggcggccgcagc

SEQ ID NO: 5529 - RNA, 24 nt, Homo sapiens
acuucuguauaguuuauuuaguca

SEQ ID NO: 5530 - RNA, 24 nt, Homo sapiens
auaguaguugaaaugguaacauca

SEQ ID NO: 5531 - RNA, 18 nt, Homo sapiens
cuauaagaugcagucuca

SEQ ID NO: 5532 - RNA, 16 nt, Homo sapiens
uggcuuaaacaugaaa

SEQ ID NO: 5533 - RNA, 19 nt, Homo sapiens
uuuuauucuuucuucuuca

SEQ ID NO: 5534 - RNA, 21 nt, Homo sapiens
uuuuggggcucaaugucuccu

SEQ ID NO: 5535 - RNA, 19 nt, Homo sapiens
cauaaacugaaauaccuaa

SEQ ID NO: 5536 - RNA, 22 nt, Homo sapiens
uaagauugcuaugguuuaauua

SEQ ID NO: 5537 - RNA, 22 nt, Homo sapiens
aaacaauguauugucugcccag

SEQ ID NO: 5538 - RNA, 19 nt, Homo sapiens
cuucucaggccucugcucu

SEQ ID NO: 5539 - RNA, 21 nt, Homo sapiens
ucacuuuccacccucucucca

SEQ ID NO: 5540 - RNA, 23 nt, Homo sapiens
uuuuguggauggggacuugugaa

SEQ ID NO: 5541 - RNA, 24 nt, Homo sapiens
aggugcugaccuagacagagauga

SEQ ID NO: 5542 - RNA, 19 nt, Homo sapiens
auuguuaggugcugaccua

SEQ ID NO: 5543 - RNA, 20 nt, Homo sapiens
cuguaaaggucaacaauaaa

SEQ ID NO: 5544 - RNA, 20 nt, Homo sapiens
aaggccugauggaacacaga

SEQ ID NO: 5545 - RNA, 22 nt, Homo sapiens
acaaaacauuaaacuaguguua

SEQ ID NO: 5546 - RNA, 21 nt, Homo sapiens
agcauauaaaauuuucccccu

SEQ ID NO: 5547 - RNA, 20 nt, Homo sapiens
cucuuaccaguauuuaacuu

SEQ ID NO: 5548 - RNA, 23 nt, Homo sapiens
cuguaugguuuuguuuuguuuug

SEQ ID NO: 5549 - RNA, 19 nt, Homo sapiens
ggcuacugcuucaaucuca

SEQ ID NO: 5550 - RNA, 19 nt, Homo sapiens
acgaaacaaagacaauuua

SEQ ID NO: 5551 - RNA, 18 nt, Homo sapiens
caagguccgggggcccag

SEQ ID NO: 5552 - RNA, 18 nt, Homo sapiens
cacauuaagcaaaugcug

SEQ ID NO: 5553 - RNA, 26 nt, Homo sapiens
gccuccaacuugcggccgccgggcuu

SEQ ID NO: 5554 - RNA, 23 nt, Homo sapiens
uaguuauucacaaaaauugacuc

SEQ ID NO: 5555 - RNA, 17 nt, Homo sapiens
ucauuugacccauuuga

SEQ ID NO: 5556 - RNA, 19 nt, Homo sapiens
gcccgugggcgagcgcgcc

SEQ ID NO: 5557 - RNA, 22 nt, Homo sapiens
uugggauucucugcacuuuuga

SEQ ID NO: 5558 - RNA, 18 nt, Homo sapiens
aagaacguggucagagua

SEQ ID NO: 5559 - RNA, 21 nt, Homo sapiens
aagagauaacuguaaauguga

SEQ ID NO: 5560 - RNA, 19 nt, Homo sapiens
ccaggcuacaagagaaaaa

SEQ ID NO: 5561 - RNA, 18 nt, Homo sapiens
cguauccauaaagacccg

SEQ ID NO: 5562 - RNA, 20 nt, Homo sapiens
ucauccccuuauccuucucc

SEQ ID NO: 5563 - RNA, 17 nt, Homo sapiens
uuccaaacaccacuuua

SEQ ID NO: 5564 - RNA, 19 nt, Homo sapiens
cuuggaguuuaccuggcuu

SEQ ID NO: 5565 - RNA, 23 nt, Homo sapiens
gugugaaauauauuacuuaacug

SEQ ID NO: 5566 - RNA, 23 nt, Homo sapiens
uaauuaauauauuaaaauuccaa

SEQ ID NO: 5567 - RNA, 24 nt, Homo sapiens
ugucaaccagguccagaugugcua

SEQ ID NO: 5568 - RNA, 15 nt, Homo sapiens
uugguuauuucugaa

SEQ ID NO: 5569 - RNA, 23 nt, Homo sapiens
caacaaagaggauuagacaguaa

SEQ ID NO: 5570 - RNA, 20 nt, Homo sapiens
cugcuuuacuguguaucuca

SEQ ID NO: 5571 - RNA, 20 nt, Homo sapiens
gcugcauaauaaaugacuga

SEQ ID NO: 5572 - RNA, 20 nt, Homo sapiens
guauagguuuuguucgacug

SEQ ID NO: 5573 - RNA, 19 nt, Homo sapiens
ucuuuuugauuuuuaaauc

SEQ ID NO: 5574 - RNA, 18 nt, Homo sapiens
ugguuuuuguugcuuuuu

SEQ ID NO: 5575 - RNA, 20 nt, Homo sapiens
uuuggagagugggcugacau

SEQ ID NO: 5576 - RNA, 21 nt, Homo sapiens
ggcaagaagaaguguucacca

SEQ ID NO: 5577 - RNA, 19 nt, Homo sapiens
caagcacacaugcauggca

SEQ ID NO: 5578 - RNA, 22 nt, Homo sapiens
ccacacuuccacccccagcucc

SEQ ID NO: 5579 - RNA, 21 nt, Homo sapiens
guccuuccacacuuccacccc

SEQ ID NO: 5580 - RNA, 19 nt, Homo sapiens
ccagcucaaggcuauuagg

SEQ ID NO: 5581 - RNA, 18 nt, Homo sapiens
cucgaacccccacagcug

SEQ ID NO: 5582 - RNA, 21 nt, Homo sapiens
uaaguggacuccaagcuaacu

SEQ ID NO: 5583 - RNA, 21 nt, Homo sapiens
uauaccgucugacaguucaaa

SEQ ID NO: 5584 - RNA, 18 nt, Homo sapiens
aaaggaccucagcugcuu

SEQ ID NO: 5585 - RNA, 22 nt, Homo sapiens
cuucuccauccuuucugccucu

SEQ ID NO: 5586 - RNA, 23 nt, Homo sapiens
gccugaggucuggcugcuugccc

SEQ ID NO: 5587 - RNA, 19 nt, Homo sapiens
gcucaaacguggcuuuuag

SEQ ID NO: 5588 - RNA, 20 nt, Homo sapiens
ucugccugagcuuccccccc

SEQ ID NO: 5589 - RNA, 21 nt, Homo sapiens
acaggauaaggcccagcgcac

SEQ ID NO: 5590 - RNA, 20 nt, Homo sapiens
acccaagucccugucauuug

SEQ ID NO: 5591 - RNA, 17 nt, Homo sapiens
ccagaauggagccugcu

SEQ ID NO: 5592 - RNA, 20 nt, Homo sapiens
ccccggugcccgcccgcagc

SEQ ID NO: 5593 - RNA, 16 nt, Homo sapiens
cccggccccccgcgcu

SEQ ID NO: 5594 - RNA, 18 nt, Homo sapiens
cccuguguauucaccacc

SEQ ID NO: 5595 - RNA, 21 nt, Homo sapiens
ggagcccagugaagccucuga

SEQ ID NO: 5596 - RNA, 19 nt, Homo sapiens
cuuaggacgcagccgccuc

SEQ ID NO: 5597 - RNA, 24 nt, Homo sapiens
aaguuaaaauguaaaagaugugau

SEQ ID NO: 5598 - RNA, 24 nt, Homo sapiens
agaaacaacauacuugucccauga

SEQ ID NO: 5599 - RNA, 21 nt, Homo sapiens
ccccgccccguucccuaccgc

SEQ ID NO: 5600 - RNA, 20 nt, Homo sapiens
uccccuaguuggccaagacu

SEQ ID NO: 5601 - RNA, 21 nt, Homo sapiens
ugauaagcacuuuuuaaaugg

SEQ ID NO: 5602 - RNA, 18 nt, Homo sapiens
uguguuccuacaauuggc

SEQ ID NO: 5603 - RNA, 17 nt, Homo sapiens
gcgcgggggccugcgaa

SEQ ID NO: 5604 - RNA, 19 nt, Homo sapiens
aguagaggcaugaacacac

SEQ ID NO: 5605 - RNA, 21 nt, Homo sapiens
cacggaugcacagagauaugc

SEQ ID NO: 5606 - RNA, 17 nt, Homo sapiens
cccccaaacucuccccc

SEQ ID NO: 5607 - RNA, 19 nt, Homo sapiens
gagagagacagagacagag

SEQ ID NO: 5608 - RNA, 21 nt, Homo sapiens
gauaugcacacacauggauga

SEQ ID NO: 5609 - RNA, 18 nt, Homo sapiens
gcugagccuccuuaccuc

SEQ ID NO: 5610 - RNA, 25 nt, Homo sapiens
ggcugcgucuccuccgcacaccugu

SEQ ID NO: 5611 - RNA, 19 nt, Homo sapiens
ugaacacacauggaugcac

SEQ ID NO: 5612 - RNA, 24 nt, Homo sapiens
aacaggggaaauuauauaccguga

SEQ ID NO: 5613 - RNA, 22 nt, Homo sapiens
auaacacaacaaaaauguaaca

SEQ ID NO: 5614 - RNA, 16 nt, Homo sapiens
auuuccugcugaaaau

SEQ ID NO: 5615 - RNA, 18 nt, Homo sapiens
ccugaccccuucacuaug

SEQ ID NO: 5616 - RNA, 21 nt, Homo sapiens
gcagacacugccuugaagccu

SEQ ID NO: 5617 - RNA, 19 nt, Homo sapiens
uauccugaucaagcaugga

SEQ ID NO: 5618 - RNA, 23 nt, Homo sapiens
uccaauuuaacuuaacucuuacc

SEQ ID NO: 5619 - RNA, 19 nt, Homo sapiens
ucuugaaauuugugauggc

SEQ ID NO: 5620 - RNA, 20 nt, Homo sapiens
aauuaaauuauuguauuaca

SEQ ID NO: 5621 - RNA, 21 nt, Homo sapiens
acaucuugaacugguugugaa

SEQ ID NO: 5622 - RNA, 24 nt, Homo sapiens
agcucucuucccugggggcagaua

SEQ ID NO: 5623 - RNA, 19 nt, Homo sapiens
caauuuuccagggcucaaa

SEQ ID NO: 5624 - RNA, 23 nt, Homo sapiens
ccucagccucucaaguuguuuuu

SEQ ID NO: 5625 - RNA, 18 nt, Homo sapiens
uacauuccacagugccca

SEQ ID NO: 5626 - RNA, 20 nt, Homo sapiens
uaugcaauauaucaauguaa

SEQ ID NO: 5627 - RNA, 24 nt, Homo sapiens
uguaaccucaaacuccuggacuca

SEQ ID NO: 5628 - RNA, 24 nt, Homo sapiens
cauccucacugccguccucaggug

SEQ ID NO: 5629 - RNA, 18 nt, Homo sapiens
ccagcccagcucccgugu

SEQ ID NO: 5630 - RNA, 21 nt, Homo sapiens
ccggacaccaagcccgccucc

SEQ ID NO: 5631 - RNA, 20 nt, Homo sapiens
acugacaugauauuauuugc

SEQ ID NO: 5632 - RNA, 22 nt, Homo sapiens
ccuuuucauccagccuuaauuu

SEQ ID NO: 5633 - RNA, 18 nt, Homo sapiens
guccacagugauaagcaa

SEQ ID NO: 5634 - RNA, 18 nt, Homo sapiens
ugguuuaccaggaccucu

SEQ ID NO: 5635 - RNA, 17 nt, Homo sapiens
uuucaacuucaauguca

SEQ ID NO: 5636 - RNA, 19 nt, Homo sapiens
uaaugcaauaacuguuauc

SEQ ID NO: 5637 - RNA, 21 nt, Homo sapiens
acacccacucacuuugcaaua

SEQ ID NO: 5638 - RNA, 26 nt, Homo sapiens
agccaccauguaaccccucucaccug

SEQ ID NO: 5639 - RNA, 19 nt, Homo sapiens
gagccuucgcaacucgcga

SEQ ID NO: 5640 - RNA, 21 nt, Homo sapiens
ggaucuucaagucccaucaua

SEQ ID NO: 5641 - RNA, 19 nt, Homo sapiens
uagaaaauugaaacacaga

SEQ ID NO: 5642 - RNA, 19 nt, Homo sapiens
ucagauccuuugaaaagag

SEQ ID NO: 5643 - RNA, 19 nt, Homo sapiens
auuuaugggccccuggcac

SEQ ID NO: 5644 - RNA, 19 nt, Homo sapiens
cgaccgcccuccgauuucc

SEQ ID NO: 5645 - RNA, 20 nt, Homo sapiens
ggcagguaccgugcucauug

SEQ ID NO: 5646 - RNA, 20 nt, Homo sapiens
uuccagauggcugcccccag

SEQ ID NO: 5647 - RNA, 19 nt, Homo sapiens
uccugaaggucacugacaa

SEQ ID NO: 5648 - RNA, 18 nt, Homo sapiens
accagaagagagcaucug

SEQ ID NO: 5649 - RNA, 21 nt, Homo sapiens
agccuuuucacuuuguacuca

SEQ ID NO: 5650 - RNA, 20 nt, Homo sapiens
ccucggcuguuggggacuuu

SEQ ID NO: 5651 - RNA, 19 nt, Homo sapiens
cugccuggggauucaccua

SEQ ID NO: 5652 - RNA, 20 nt, Homo sapiens
ugcucccagagaccuuccac

SEQ ID NO: 5653 - RNA, 22 nt, Homo sapiens
acuaauuauauaguauaccaua

SEQ ID NO: 5654 - RNA, 23 nt, Homo sapiens
auuauauaguauaccauacauua

SEQ ID NO: 5655 - RNA, 19 nt, Homo sapiens
gccaaccaagagcacauuc

SEQ ID NO: 5656 - RNA, 20 nt, Homo sapiens
guacaucuuugaaaagaaaa

SEQ ID NO: 5657 - RNA, 21 nt, Homo sapiens
ucacauuacaucauccuccuu

SEQ ID NO: 5658 - RNA, 20 nt, Homo sapiens
ugagacggcgcaccuaucac

SEQ ID NO: 5659 - RNA, 22 nt, Homo sapiens
uucaagcgauucucaugucuca

SEQ ID NO: 5660 - RNA, 19 nt, Homo sapiens
uuggagggucgccuggcuu

SEQ ID NO: 5661 - RNA, 23 nt, Homo sapiens
uuucucuaucccaagccaaccaa

SEQ ID NO: 5662 - RNA, 19 nt, Homo sapiens
ggcucuauguagcaaauca

SEQ ID NO: 5663 - RNA, 23 nt, Homo sapiens
ucauugaacuaauucuacuauuu

SEQ ID NO: 5664 - RNA, 22 nt, Homo sapiens
ccagugugcagccccugccaga

SEQ ID NO: 5665 - RNA, 19 nt, Homo sapiens
ccacagaaacacaaacaca

SEQ ID NO: 5666 - RNA, 21 nt, Homo sapiens
ccuuuucauauccaugaucuu

SEQ ID NO: 5667 - RNA, 22 nt, Homo sapiens
cuuugaugcuugcuuuaacuuu

SEQ ID NO: 5668 - RNA, 18 nt, Homo sapiens
guacaguaauuugccuca

SEQ ID NO: 5669 - RNA, 18 nt, Homo sapiens
gugugugugcguugguug

SEQ ID NO: 5670 - RNA, 20 nt, Homo sapiens
ccacagcucaacacaaccag

SEQ ID NO: 5671 - RNA, 22 nt, Homo sapiens
auuuauuuucuuggauuccuga

SEQ ID NO: 5672 - RNA, 19 nt, Homo sapiens
cuauaaccagacacauacu

SEQ ID NO: 5673 - RNA, 19 nt, Homo sapiens
cugcaaucuccaccuccca

SEQ ID NO: 5674 - RNA, 20 nt, Homo sapiens
cuuuucccaaaauguugaaa

SEQ ID NO: 5675 - RNA, 24 nt, Homo sapiens
aacuugccuuuucauuuuacuuca

SEQ ID NO: 5676 - RNA, 20 nt, Homo sapiens
acuuuucuucuugcaugcau

SEQ ID NO: 5677 - RNA, 21 nt, Homo sapiens
gauauagcaguaaugcuauua

SEQ ID NO: 5678 - RNA, 18 nt, Homo sapiens
guccuuaagucccugcua

SEQ ID NO: 5679 - RNA, 18 nt, Homo sapiens
uacucaacagccuuauuc

SEQ ID NO: 5680 - RNA, 20 nt, Homo sapiens
ucuuuuuccauccacuugca

SEQ ID NO: 5681 - RNA, 22 nt, Homo sapiens
uuuuuuaaaacucaucacagaa

SEQ ID NO: 5682 - RNA, 23 nt, Homo sapiens
gcccccauaacucguggacuaca

SEQ ID NO: 5683 - RNA, 17 nt, Homo sapiens
ccugaccaaaggcuuca

SEQ ID NO: 5684 - RNA, 19 nt, Homo sapiens
agguaccagcaauauguaa

SEQ ID NO: 5685 - RNA, 24 nt, Homo sapiens
auaucccagaaauuagaaaccuua

SEQ ID NO: 5686 - RNA, 19 nt, Homo sapiens
ccaaaaacuaaaucucuaa

SEQ ID NO: 5687 - RNA, 15 nt, Homo sapiens
cuccugcuguugccu

SEQ ID NO: 5688 - RNA, 17 nt, Homo sapiens
gaagccaccucaagaca

SEQ ID NO: 5689 - RNA, 19 nt, Homo sapiens
accagcagacacugccggg

SEQ ID NO: 5690 - RNA, 23 nt, Homo sapiens
ggaccgcgccgcccgccuccccu

SEQ ID NO: 5691 - RNA, 21 nt, Homo sapiens
uuugugucuuauguucaucac

SEQ ID NO: 5692 - RNA, 21 nt, Homo sapiens
aggccccagauccuucucucu

SEQ ID NO: 5693 - RNA, 19 nt, Homo sapiens
cgauggcaccuccguccca

SEQ ID NO: 5694 - RNA, 21 nt, Homo sapiens
cugagagcccugggacuggga

SEQ ID NO: 5695 - RNA, 21 nt, Homo sapiens
ugagaagguggcagugaggaa

SEQ ID NO: 5696 - RNA, 20 nt, Homo sapiens
ugggacugggagugucugcu

SEQ ID NO: 5697 - RNA, 22 nt, Homo sapiens
cgcacggacgcacucgcgcugc

SEQ ID NO: 5698 - RNA, 20 nt, Homo sapiens
gccaagucucuaacgugaca

SEQ ID NO: 5699 - RNA, 19 nt, Homo sapiens
acaacccaaaagguuuaag

SEQ ID NO: 5700 - RNA, 21 nt, Homo sapiens
accaaaacaguuaaucaguga

SEQ ID NO: 5701 - RNA, 22 nt, Homo sapiens
auuuggauuuaaaagccugcuc

SEQ ID NO: 5702 - RNA, 16 nt, Homo sapiens
ccaucacguuagcugu

SEQ ID NO: 5703 - RNA, 18 nt, Homo sapiens
gccaaauuuaaaacuguu

SEQ ID NO: 5704 - RNA, 21 nt, Homo sapiens
ucuacuucuguaauugugugg

SEQ ID NO: 5705 - RNA, 22 nt, Homo sapiens
uugauacauuuuuguacuaacu

SEQ ID NO: 5706 - RNA, 21 nt, Homo sapiens
uuucuggguugccuuuguuuu

SEQ ID NO: 5707 - RNA, 19 nt, Homo sapiens
cucucgcaagggaaguccu

SEQ ID NO: 5708 - RNA, 18 nt, Homo sapiens
cuugugaaggaauuauuc

SEQ ID NO: 5709 - RNA, 21 nt, Homo sapiens
uaggaacugcugggcuuggca

SEQ ID NO: 5710 - RNA, 18 nt, Homo sapiens
ccccccaaccccccgcgc

SEQ ID NO: 5711 - RNA, 17 nt, Homo sapiens
gggcugcugugaagcug

SEQ ID NO: 5712 - RNA, 23 nt, Homo sapiens
gguauaauaggcucugccugaca

SEQ ID NO: 5713 - RNA, 20 nt, Homo sapiens
acaacagaacucaguuuucc

SEQ ID NO: 5714 - RNA, 22 nt, Homo sapiens
acacccaagccagaggaacuca

SEQ ID NO: 5715 - RNA, 21 nt, Homo sapiens
cacuuuuguuucaccaucuga

SEQ ID NO: 5716 - RNA, 21 nt, Homo sapiens
cucuacugaauauucuaguga

SEQ ID NO: 5717 - RNA, 16 nt, Homo sapiens
cugcuaccuucucauc

SEQ ID NO: 5718 - RNA, 21 nt, Homo sapiens
gucuugauauucugugacuca

SEQ ID NO: 5719 - RNA, 20 nt, Homo sapiens
ucaucaaaaauauugucauc

SEQ ID NO: 5720 - RNA, 19 nt, Homo sapiens
uucacugcagcuccuguca

SEQ ID NO: 5721 - RNA, 22 nt, Homo sapiens
aggcacaggcagggcaggacca

SEQ ID NO: 5722 - RNA, 21 nt, Homo sapiens
cagagcaaccccuggacccca

SEQ ID NO: 5723 - RNA, 17 nt, Homo sapiens
gcaagcuuuuccuaaua

SEQ ID NO: 5724 - RNA, 23 nt, Homo sapiens
gcccuggcccccacauggugaug

SEQ ID NO: 5725 - RNA, 19 nt, Homo sapiens
ugcgccugcacaugugugu

SEQ ID NO: 5726 - RNA, 17 nt, Homo sapiens
ccgaauaauaaagacuu

SEQ ID NO: 5727 - RNA, 26 nt, Homo sapiens
gccugcugcccagagaccuuagcuga

SEQ ID NO: 5728 - RNA, 17 nt, Homo sapiens
uugguaaauauuagcua

SEQ ID NO: 5729 - RNA, 16 nt, Homo sapiens
cugaacugcucuggcu

SEQ ID NO: 5730 - RNA, 18 nt, Homo sapiens
gagguccgaucuggaaca

SEQ ID NO: 5731 - RNA, 18 nt, Homo sapiens
cuuuccaaggcuucucca

SEQ ID NO: 5732 - RNA, 23 nt, Homo sapiens
gaaccauccauaguaguaugaug

SEQ ID NO: 5733 - RNA, 19 nt, Homo sapiens
guuucccccuucuacauuu

SEQ ID NO: 5734 - RNA, 21 nt, Homo sapiens
auggguccaggguugaucaca

SEQ ID NO: 5735 - RNA, 18 nt, Homo sapiens
cagaagggagaaggaucu

SEQ ID NO: 5736 - RNA, 21 nt, Homo sapiens
gaacaagguucccucugagaa

SEQ ID NO: 5737 - RNA, 18 nt, Homo sapiens
gaauguguuuucugaaua

SEQ ID NO: 5738 - RNA, 22 nt, Homo sapiens
gagccaagaucgcgccacugca

SEQ ID NO: 5739 - RNA, 21 nt, Homo sapiens
ggaaaaugugacccagauccu

SEQ ID NO: 5740 - RNA, 19 nt, Homo sapiens
ggccgggugcgguggcuca

SEQ ID NO: 5741 - RNA, 21 nt, Homo sapiens
uagaugggucuggcugagcug

SEQ ID NO: 5742 - RNA, 17 nt, Homo sapiens
gcagcugcacaucguga

SEQ ID NO: 5743 - RNA, 18 nt, Homo sapiens
gcucaacaucauauagua

SEQ ID NO: 5744 - RNA, 25 nt, Homo sapiens
aagcacauuucagccuauuugcuua

SEQ ID NO: 5745 - RNA, 22 nt, Homo sapiens
aucuauauucaugagcucucaa

SEQ ID NO: 5746 - RNA, 21 nt, Homo sapiens
gcugugauuugacacguuuua

SEQ ID NO: 5747 - RNA, 17 nt, Homo sapiens
acacagagguuuuaaac

SEQ ID NO: 5748 - RNA, 23 nt, Homo sapiens
acauuuuauuuauuagcuguaaa

SEQ ID NO: 5749 - RNA, 23 nt, Homo sapiens
auuuggguugugacccagggugc

SEQ ID NO: 5750 - RNA, 21 nt, Homo sapiens
caauaucugacaguuacucuu

SEQ ID NO: 5751 - RNA, 22 nt, Homo sapiens
uagaaccuccuauuuuaauugg

SEQ ID NO: 5752 - RNA, 23 nt, Homo sapiens
uccagugcgucucuuuuguuccu

SEQ ID NO: 5753 - RNA, 19 nt, Homo sapiens
ucccuaccauuggccugca

SEQ ID NO: 5754 - RNA, 25 nt, Homo sapiens
ucucucccccuucuuuuuugucuca

SEQ ID NO: 5755 - RNA, 25 nt, Homo sapiens
ccagucugugcgcgcccgugcucgc

SEQ ID NO: 5756 - RNA, 20 nt, Homo sapiens
agcucauuuugucucucuca

SEQ ID NO: 5757 - RNA, 18 nt, Homo sapiens
ccugcaaccuccaccucc

SEQ ID NO: 5758 - RNA, 23 nt, Homo sapiens
ucacacuaccauuauuuccccuu

SEQ ID NO: 5759 - RNA, 21 nt, Homo sapiens
uuaagccuacaacauuuuuca

SEQ ID NO: 5760 - RNA, 17 nt, Homo sapiens
ccauuuacaacaaacac

SEQ ID NO: 5761 - RNA, 17 nt, Homo sapiens
cuccuccuaguacuaac

SEQ ID NO: 5762 - RNA, 23 nt, Homo sapiens
cuucuucccaauugcuuuaccuu

SEQ ID NO: 5763 - RNA, 18 nt, Homo sapiens
ggacauuuuugacucccu

SEQ ID NO: 5764 - RNA, 20 nt, Homo sapiens
ucaacuuaugcagaacuggc

SEQ ID NO: 5765 - RNA, 24 nt, Homo sapiens
ugugucaaacaguacacuaucuua

SEQ ID NO: 5766 - RNA, 19 nt, Homo sapiens
aaacuccugaccucaggug

SEQ ID NO: 5767 - RNA, 21 nt, Homo sapiens
aucuuggcucacugcaaccuc

SEQ ID NO: 5768 - RNA, 18 nt, Homo sapiens
ccugcaaccuccaccucc

SEQ ID NO: 5769 - RNA, 19 nt, Homo sapiens
cugcaaccuccaccuccca

SEQ ID NO: 5770 - RNA, 19 nt, Homo sapiens
cugcaaccuccgccuccca

SEQ ID NO: 5771 - RNA, 18 nt, Homo sapiens
uccaccucccagguucaa

SEQ ID NO: 5772 - RNA, 18 nt, Homo sapiens
uccgccucccagguucaa

SEQ ID NO: 5773 - RNA, 25 nt, Homo sapiens
agcccggggagccuaggaccacuca

SEQ ID NO: 5774 - RNA, 16 nt, Homo sapiens
cccacgauuuucucca

SEQ ID NO: 5775 - RNA, 21 nt, Homo sapiens
aaacagcuaaugggacacuaa

SEQ ID NO: 5776 - RNA, 18 nt, Homo sapiens
aguauuacuucugcuaca

SEQ ID NO: 5777 - RNA, 21 nt, Homo sapiens
cagauacaggaaaagcugcug

SEQ ID NO: 5778 - RNA, 22 nt, Homo sapiens
ccuugaacuggguacuugugga

SEQ ID NO: 5779 - RNA, 18 nt, Homo sapiens
gccugcccaggccccugc

SEQ ID NO: 5780 - RNA, 23 nt, Homo sapiens
gcugguccacucaguccauagca

SEQ ID NO: 5781 - RNA, 17 nt, Homo sapiens
ucaagugauucuccugc

SEQ ID NO: 5782 - RNA, 26 nt, Homo sapiens
ucaauucucauuugucacacacuuug

SEQ ID NO: 5783 - RNA, 18 nt, Homo sapiens
uccgccucuuggguucaa

SEQ ID NO: 5784 - RNA, 21 nt, Homo sapiens
ucuggaauccagugguaugau

SEQ ID NO: 5785 - RNA, 19 nt, Homo sapiens
uguggcuuccuaaaauuca

SEQ ID NO: 5786 - RNA, 22 nt, Homo sapiens
gccuggguuccaauccuggcuc

SEQ ID NO: 5787 - RNA, 22 nt, Homo sapiens
uggcuccccuuuuucuuccuca

SEQ ID NO: 5788 - RNA, 25 nt, Homo sapiens
acuugaaguaccaggccguuugcuu

SEQ ID NO: 5789 - RNA, 19 nt, Homo sapiens
aucucaaauacaguaguau

SEQ ID NO: 5790 - RNA, 21 nt, Homo sapiens
guauuguguuuaugcauuuca

SEQ ID NO: 5791 - RNA, 23 nt, Homo sapiens
uauuuguaaaagcuaaggcucga

SEQ ID NO: 5792 - RNA, 21 nt, Homo sapiens
uuuaaguaauugccagcuuuu

SEQ ID NO: 5793 - RNA, 24 nt, Homo sapiens
uuuguaaaugcuguaaauauuuca

SEQ ID NO: 5794 - RNA, 21 nt, Homo sapiens
augacuaaguacuugcucucu

SEQ ID NO: 5795 - RNA, 21 nt, Homo sapiens
accacaaugagauuccauuuu

SEQ ID NO: 5796 - RNA, 19 nt, Homo sapiens
ccuaaguaaucccagaaca

SEQ ID NO: 5797 - RNA, 21 nt, Homo sapiens
gaucuguagggacuuguacaa

SEQ ID NO: 5798 - RNA, 22 nt, Homo sapiens
cagcaguccccuggccagcacc

SEQ ID NO: 5799 - RNA, 23 nt, Homo sapiens
cccugguggcucuccccuuugga

SEQ ID NO: 5800 - RNA, 18 nt, Homo sapiens
ccuggacuugaccaauua

SEQ ID NO: 5801 - RNA, 19 nt, Homo sapiens
ccuucauucuuucaacaaa

SEQ ID NO: 5802 - RNA, 21 nt, Homo sapiens
cucugaaaucaggauuuggaa

SEQ ID NO: 5803 - RNA, 19 nt, Homo sapiens
guuguuucguauuucugaa

SEQ ID NO: 5804 - RNA, 24 nt, Homo sapiens
cccggaagccgcgacuccuggccc

SEQ ID NO: 5805 - RNA, 20 nt, Homo sapiens
augugaaacauguugccaaa

SEQ ID NO: 5806 - RNA, 22 nt, Homo sapiens
cgauuucaaaguccagauacca

SEQ ID NO: 5807 - RNA, 19 nt, Homo sapiens
cgggcaucauucucuaaua

SEQ ID NO: 5808 - RNA, 19 nt, Homo sapiens
gcuauaauuauuauucaga

SEQ ID NO: 5809 - RNA, 18 nt, Homo sapiens
uauuugugggugugcuau

SEQ ID NO: 5810 - RNA, 18 nt, Homo sapiens
ucuaguaauaaagacucu

SEQ ID NO: 5811 - RNA, 19 nt, Homo sapiens
uuggcucucaaugcuguuu

SEQ ID NO: 5812 - RNA, 18 nt, Homo sapiens
ccagggcgccggcccacc

SEQ ID NO: 5813 - RNA, 21 nt, Homo sapiens
gccgccccccggccgcgggga

SEQ ID NO: 5814 - RNA, 22 nt, Homo sapiens
cuuugaacguagcgccugugaa

SEQ ID NO: 5815 - RNA, 21 nt, Homo sapiens
ugaacaccggauggugccaac

SEQ ID NO: 5816 - RNA, 22 nt, Homo sapiens
uuuaacauuccuaaauuguuuu

SEQ ID NO: 5817 - RNA, 18 nt, Homo sapiens
agcguuuccuaaucccuc

SEQ ID NO: 5818 - RNA, 22 nt, Homo sapiens
ccauggcuauuccagcacccca

SEQ ID NO: 5819 - RNA, 22 nt, Homo sapiens
cuguaauugccaaguccucuaa

SEQ ID NO: 5820 - RNA, 25 nt, Homo sapiens
uccuggaucacuccuuugcacucca

SEQ ID NO: 5821 - RNA, 22 nt, Homo sapiens
ucuuagaucacauuuaguagca

SEQ ID NO: 5822 - RNA, 19 nt, Homo sapiens
aguaaucugucgcauuuca

SEQ ID NO: 5823 - RNA, 16 nt, Homo sapiens
auccccauaacuucca

SEQ ID NO: 5824 - RNA, 18 nt, Homo sapiens
guucccaggcuucugaga

SEQ ID NO: 5825 - RNA, 20 nt, Homo sapiens
aaaccccaaccaaacaaaac

SEQ ID NO: 5826 - RNA, 21 nt, Homo sapiens
aggccggcgccgcacacacac

SEQ ID NO: 5827 - RNA, 18 nt, Homo sapiens
ccugcaaccuccaccucc

SEQ ID NO: 5828 - RNA, 19 nt, Homo sapiens
cugcaaccuccaccuccca

SEQ ID NO: 5829 - RNA, 17 nt, Homo sapiens
ucaagcgauucucgugc

SEQ ID NO: 5830 - RNA, 18 nt, Homo sapiens
uccaccucccagguucaa

SEQ ID NO: 5831 - RNA, 20 nt, Homo sapiens
aguauugcgcuguaauguca

SEQ ID NO: 5832 - RNA, 23 nt, Homo sapiens
ggucuuuuuuucccaguucauuu

SEQ ID NO: 5833 - RNA, 19 nt, Homo sapiens
ugguuucagcaugguauug

SEQ ID NO: 5834 - RNA, 21 nt, Homo sapiens
acacuugugucucucugugga

SEQ ID NO: 5835 - RNA, 22 nt, Homo sapiens
aucauuuucuagguucauuucu

SEQ ID NO: 5836 - RNA, 18 nt, Homo sapiens
ucuggaacauuugcugua

SEQ ID NO: 5837 - RNA, 16 nt, Homo sapiens
ccagccaacaugguga

SEQ ID NO: 5838 - RNA, 20 nt, Homo sapiens
uucaagaccagcccagccaa

SEQ ID NO: 5839 - RNA, 18 nt, Homo sapiens
cuccucagcuucaggcac

SEQ ID NO: 5840 - RNA, 18 nt, Homo sapiens
gagucggaguggacaccg

SEQ ID NO: 5841 - RNA, 20 nt, Homo sapiens
gccugagcugcggucuccgc

SEQ ID NO: 5842 - RNA, 23 nt, Homo sapiens
uccuggcgggggugggccgugga

SEQ ID NO: 5843 - RNA, 23 nt, Homo sapiens
agccaccaaucaaagagauucaa

SEQ ID NO: 5844 - RNA, 18 nt, Homo sapiens
cuucccccaccucuucca

SEQ ID NO: 5845 - RNA, 19 nt, Homo sapiens
guucucacucuuagguuca

SEQ ID NO: 5846 - RNA, 28 nt, Homo sapiens
agaaaucagugacaacaagucuuugaaa

SEQ ID NO: 5847 - RNA, 24 nt, Homo sapiens
cuccuucucccucauuuucucuca

SEQ ID NO: 5848 - RNA, 25 nt, Homo sapiens
cuuugaaauaugcauguacuuuaua

SEQ ID NO: 5849 - RNA, 18 nt, Homo sapiens
gaaagcaccaucaucaua

SEQ ID NO: 5850 - RNA, 19 nt, Homo sapiens
aggagaagcaggcccaguc

SEQ ID NO: 5851 - RNA, 17 nt, Homo sapiens
cauccagcagccgccgc

SEQ ID NO: 5852 - RNA, 21 nt, Homo sapiens
ccagcagcuucugccaucucu

SEQ ID NO: 5853 - RNA, 18 nt, Homo sapiens
gacggcggcggccgcggc

SEQ ID NO: 5854 - RNA, 22 nt, Homo sapiens
ggagaugagagacggcggcggc

SEQ ID NO: 5855 - RNA, 18 nt, Homo sapiens
ggccgcggcggcugcagc

SEQ ID NO: 5856 - RNA, 18 nt, Homo sapiens
ggcggcggcggccgcggc

SEQ ID NO: 5857 - RNA, 15 nt, Homo sapiens
ggcggcggcggcggc

SEQ ID NO: 5858 - RNA, 18 nt, Homo sapiens
gugucagauuaccaguua

SEQ ID NO: 5859 - RNA, 18 nt, Homo sapiens
ucuccuccuuuuucuuca

SEQ ID NO: 5860 - RNA, 18 nt, Homo sapiens
uuccagagaauguuucag

SEQ ID NO: 5861 - RNA, 21 nt, Homo sapiens
acugcauucacggggauccca

SEQ ID NO: 5862 - RNA, 23 nt, Homo sapiens
cacccuuuggagaccaggccuca

SEQ ID NO: 5863 - RNA, 20 nt, Homo sapiens
cugagaaauagugcacucca

SEQ ID NO: 5864 - RNA, 26 nt, Homo sapiens
cuucccccaagauacccaucuugaaa

SEQ ID NO: 5865 - RNA, 21 nt, Homo sapiens
uaggauaugcccuccugguga

SEQ ID NO: 5866 - RNA, 18 nt, Homo sapiens
acguaaaugcagaaguua

SEQ ID NO: 5867 - RNA, 21 nt, Homo sapiens
cgaggguuaggccaacaggga

SEQ ID NO: 5868 - RNA, 22 nt, Homo sapiens
cuguguauaacauuucguacaa

SEQ ID NO: 5869 - RNA, 19 nt, Homo sapiens
uggagaggccaggacagag

SEQ ID NO: 5870 - RNA, 18 nt, Homo sapiens
aaacuuuuucucaaacca

SEQ ID NO: 5871 - RNA, 18 nt, Homo sapiens
aaauggcuuuuaauuccu

SEQ ID NO: 5872 - RNA, 20 nt, Homo sapiens
cuugaaagcauuacagauca

SEQ ID NO: 5873 - RNA, 22 nt, Homo sapiens
agacacaggguagucuuugcua

SEQ ID NO: 5874 - RNA, 18 nt, Homo sapiens
cauuuccgaguuacuuuu

SEQ ID NO: 5875 - RNA, 20 nt, Homo sapiens
ccacccucugccuugcaaua

SEQ ID NO: 5876 - RNA, 18 nt, Homo sapiens
ccugcacccaucagccaa

SEQ ID NO: 5877 - RNA, 18 nt, Homo sapiens
cgaaucgacugucucugu

SEQ ID NO: 5878 - RNA, 21 nt, Homo sapiens
gcuucucacccuccacccucu

SEQ ID NO: 5879 - RNA, 19 nt, Homo sapiens
ucauuggcacuuagagcgc

SEQ ID NO: 5880 - RNA, 17 nt, Homo sapiens
gcugcuguuggcggauu

SEQ ID NO: 5881 - RNA, 23 nt, Homo sapiens
uggugaaguauaggcugaggcua

SEQ ID NO: 5882 - RNA, 20 nt, Homo sapiens
acagcaaguaucgacagcaa

SEQ ID NO: 5883 - RNA, 18 nt, Homo sapiens
cccuccuuccuuuuacua

SEQ ID NO: 5884 - RNA, 19 nt, Homo sapiens
cguccucacccggcaccca

SEQ ID NO: 5885 - RNA, 22 nt, Homo sapiens
cuaugugacugucccuaucuua

SEQ ID NO: 5886 - RNA, 18 nt, Homo sapiens
gagaccagaaaccuucca

SEQ ID NO: 5887 - RNA, 22 nt, Homo sapiens
uguaguuguuuggagcacacug

SEQ ID NO: 5888 - RNA, 21 nt, Homo sapiens
aucugggacugugccuggcuc

SEQ ID NO: 5889 - RNA, 19 nt, Homo sapiens
ccugagcgggagucaggga

SEQ ID NO: 5890 - RNA, 18 nt, Homo sapiens
ggggcgugcagcagggaa

SEQ ID NO: 5891 - RNA, 23 nt, Homo sapiens
guguguguucaagugcgugacug

SEQ ID NO: 5892 - RNA, 16 nt, Homo sapiens
cuucuuugucuuagcu

SEQ ID NO: 5893 - RNA, 23 nt, Homo sapiens
cccucccccaccauuccacaucc

SEQ ID NO: 5894 - RNA, 19 nt, Homo sapiens
cccuuccccacucugcucc

SEQ ID NO: 5895 - RNA, 16 nt, Homo sapiens
gcgguccucccggcca

SEQ ID NO: 5896 - RNA, 19 nt, Homo sapiens
gaccccaacuacuauugua

SEQ ID NO: 5897 - RNA, 18 nt, Homo sapiens
uucaauccugucaauguu

SEQ ID NO: 5898 - RNA, 21 nt, Homo sapiens
agcgcccccacuuuugcucuu

SEQ ID NO: 5899 - RNA, 19 nt, Homo sapiens
augauccuaaaaauaaccg

SEQ ID NO: 5900 - RNA, 23 nt, Homo sapiens
cugggaaacauuugcacucuuuu

SEQ ID NO: 5901 - RNA, 21 nt, Homo sapiens
gcucuuuuuccuccccuccuc

SEQ ID NO: 5902 - RNA, 18 nt, Homo sapiens
ucucagaacaccagcagu

SEQ ID NO: 5903 - RNA, 21 nt, Homo sapiens
cacagaacaagcagcacccca

SEQ ID NO: 5904 - RNA, 19 nt, Homo sapiens
ucccuacuggaagccugca

SEQ ID NO: 5905 - RNA, 18 nt, Homo sapiens
uuccagaaauauagucca

SEQ ID NO: 5906 - RNA, 18 nt, Homo sapiens
augauuuuguuuucaucc

SEQ ID NO: 5907 - RNA, 24 nt, Homo sapiens
cauaauuuccuuuaguucuaguua

SEQ ID NO: 5908 - RNA, 20 nt, Homo sapiens
cccuggugaagcagcugcuu

SEQ ID NO: 5909 - RNA, 21 nt, Homo sapiens
gaaccaguuauuuaaccugua

SEQ ID NO: 5910 - RNA, 19 nt, Homo sapiens
ucaccaucuucacuacaaa

SEQ ID NO: 5911 - RNA, 18 nt, Homo sapiens
uccacugcccaugacccu

SEQ ID NO: 5912 - RNA, 22 nt, Homo sapiens
uggcacuggggaaacauaacuc

SEQ ID NO: 5913 - RNA, 18 nt, Homo sapiens
ccugcaaccuccaccucc

SEQ ID NO: 5914 - RNA, 18 nt, Homo sapiens
uccaccuccuggguucaa

SEQ ID NO: 5915 - RNA, 22 nt, Homo sapiens
ccagcuguggucaggagagccu

SEQ ID NO: 5916 - RNA, 19 nt, Homo sapiens
gacuuagccgugcauugca

SEQ ID NO: 5917 - RNA, 18 nt, Homo sapiens
accuuagcuggcauuaca

SEQ ID NO: 5918 - RNA, 20 nt, Homo sapiens
ccuggccgauccgcauguca

SEQ ID NO: 5919 - RNA, 19 nt, Homo sapiens
gaagagacaaacaccuccc

SEQ ID NO: 5920 - RNA, 25 nt, Homo sapiens
gccagagaacccagcaauccgagua

SEQ ID NO: 5921 - RNA, 18 nt, Homo sapiens
gcggccagagaacccagc

SEQ ID NO: 5922 - RNA, 16 nt, Homo sapiens
gggcaaugauggcaau

SEQ ID NO: 5923 - RNA, 23 nt, Homo sapiens
uuucuuuguguagcuuugcucuu

SEQ ID NO: 5924 - RNA, 20 nt, Homo sapiens
uuuuguugcuguuuugauuu

SEQ ID NO: 5925 - RNA, 19 nt, Homo sapiens
agaaaggucuaugcuguca

SEQ ID NO: 5926 - RNA, 22 nt, Homo sapiens
ccagaagugauggagagaaacc

SEQ ID NO: 5927 - RNA, 22 nt, Homo sapiens
cgggguccccgggggcccagcg

SEQ ID NO: 5928 - RNA, 21 nt, Homo sapiens
cuucauagcccuagcaucaca

SEQ ID NO: 5929 - RNA, 21 nt, Homo sapiens
gaccucugucuugcaugugac

SEQ ID NO: 5930 - RNA, 25 nt, Homo sapiens
gauugcucucugucucuuuuuucag

SEQ ID NO: 5931 - RNA, 18 nt, Homo sapiens
gcccacccacucgcgugc

SEQ ID NO: 5932 - RNA, 20 nt, Homo sapiens
ggaaacagagcugccaauug

SEQ ID NO: 5933 - RNA, 18 nt, Homo sapiens
ucccagaugaugacaaug

SEQ ID NO: 5934 - RNA, 18 nt, Homo sapiens
ugaugacaaugaaauuag

SEQ ID NO: 5935 - RNA, 24 nt, Homo sapiens
uuacuucaccccaaguccugcugc

SEQ ID NO: 5936 - RNA, 17 nt, Homo sapiens
aaguuauugggcucagu

SEQ ID NO: 5937 - RNA, 19 nt, Homo sapiens
aacccuugucuuuuacuca

SEQ ID NO: 5938 - RNA, 21 nt, Homo sapiens
gcaacuccuugcucacaguga

SEQ ID NO: 5939 - RNA, 19 nt, Homo sapiens
gcuucucugagaccugcuc

SEQ ID NO: 5940 - RNA, 20 nt, Homo sapiens
uaugauagaucuuuacuaaa

SEQ ID NO: 5941 - RNA, 17 nt, Homo sapiens
ggugcuauaggcaugca

SEQ ID NO: 5942 - RNA, 21 nt, Homo sapiens
agacccccacucucauucccc

SEQ ID NO: 5943 - RNA, 16 nt, Homo sapiens
aguugcuaaacgaguc

SEQ ID NO: 5944 - RNA, 21 nt, Homo sapiens
cacccccuucagugcccacca

SEQ ID NO: 5945 - RNA, 17 nt, Homo sapiens
ccagguggcugacccag

SEQ ID NO: 5946 - RNA, 19 nt, Homo sapiens
cggggaacuccugaaauau

SEQ ID NO: 5947 - RNA, 17 nt, Homo sapiens
cucucccucuggcccug

SEQ ID NO: 5948 - RNA, 21 nt, Homo sapiens
gugcccuggcugcugggcucu

SEQ ID NO: 5949 - RNA, 18 nt, Homo sapiens
uagguggaucaccugagg

SEQ ID NO: 5950 - RNA, 21 nt, Homo sapiens
aagaauuuuaccauucaguua

SEQ ID NO: 5951 - RNA, 18 nt, Homo sapiens
agaacuaaccaguaccuc

SEQ ID NO: 5952 - RNA, 19 nt, Homo sapiens
uuauagauguacauaccuc

SEQ ID NO: 5953 - RNA, 18 nt, Homo sapiens
uucaguugaucuucuuca

SEQ ID NO: 5954 - RNA, 18 nt, Homo sapiens
aauagcagcaccacuuug

SEQ ID NO: 5955 - RNA, 17 nt, Homo sapiens
cgguguuuccgcucuga

SEQ ID NO: 5956 - RNA, 18 nt, Homo sapiens
uagaguuguaagaccaaa

SEQ ID NO: 5957 - RNA, 23 nt, Homo sapiens
uuucgccggguugcuuuugucuu

SEQ ID NO: 5958 - RNA, 18 nt, Homo sapiens
acucugacaagcuggcca

SEQ ID NO: 5959 - RNA, 22 nt, Homo sapiens
auucacccacucccuugaaguu

SEQ ID NO: 5960 - RNA, 20 nt, Homo sapiens
caugaugggaggugugccag

SEQ ID NO: 5961 - RNA, 21 nt, Homo sapiens
cauguguccccacugcaggga

SEQ ID NO: 5962 - RNA, 19 nt, Homo sapiens
aucuuccagaguaaaaugc

SEQ ID NO: 5963 - RNA, 22 nt, Homo sapiens
aucuugguucugauauggacua

SEQ ID NO: 5964 - RNA, 15 nt, Homo sapiens
ccugaaaugcgguga

SEQ ID NO: 5965 - RNA, 17 nt, Homo sapiens
cgcccuuccucccuugc

SEQ ID NO: 5966 - RNA, 21 nt, Homo sapiens
cuuaaguaaaaaaucauuuuu

SEQ ID NO: 5967 - RNA, 23 nt, Homo sapiens
cuucuucauggaaugcugaccuu

SEQ ID NO: 5968 - RNA, 17 nt, Homo sapiens
guuuacuugucugccuu

SEQ ID NO: 5969 - RNA, 24 nt, Homo sapiens
acccuuuccugucccucucucccu

SEQ ID NO: 5970 - RNA, 18 nt, Homo sapiens
guguuaccuuuguaguca

SEQ ID NO: 5971 - RNA, 22 nt, Homo sapiens
uauuauggagaaaaaaaucacu

SEQ ID NO: 5972 - RNA, 23 nt, Homo sapiens
ugcaauuguguuggaaguguccu

SEQ ID NO: 5973 - RNA, 20 nt, Homo sapiens
uggaugucagaguugaucua

SEQ ID NO: 5974 - RNA, 16 nt, Homo sapiens
ucuuugguuuggcuuu

SEQ ID NO: 5975 - RNA, 23 nt, Homo sapiens
ugcuuccugauuagauccaguca

SEQ ID NO: 5976 - RNA, 22 nt, Homo sapiens
uggaggucugaaugugaggcug

SEQ ID NO: 5977 - RNA, 18 nt, Homo sapiens
uuggugggauuugauaaa

SEQ ID NO: 5978 - RNA, 17 nt, Homo sapiens
cauugaccucagcugca

SEQ ID NO: 5979 - RNA, 19 nt, Homo sapiens
cgcggagcugcacccgugc

SEQ ID NO: 5980 - RNA, 17 nt, Homo sapiens
gaccccgagucgggagg

SEQ ID NO: 5981 - RNA, 18 nt, Homo sapiens
ggcacccaccuccacccc

SEQ ID NO: 5982 - RNA, 16 nt, Homo sapiens
acagaaaaaguuccua

SEQ ID NO: 5983 - RNA, 18 nt, Homo sapiens
gugcucaacaguguguuu

SEQ ID NO: 5984 - RNA, 21 nt, Homo sapiens
ccaaaagaagcggagauuuaa

SEQ ID NO: 5985 - RNA, 22 nt, Homo sapiens
gguugugaagagguguuuuuuc

SEQ ID NO: 5986 - RNA, 17 nt, Homo sapiens
aaaaacaaacaaacaaa

SEQ ID NO: 5987 - RNA, 17 nt, Homo sapiens
acagagaucauccucuu

SEQ ID NO: 5988 - RNA, 20 nt, Homo sapiens
acggaauauagaagacaugg

SEQ ID NO: 5989 - RNA, 19 nt, Homo sapiens
aguuuucucucuuccaguc

SEQ ID NO: 5990 - RNA, 19 nt, Homo sapiens
auacaaguccacaccaucc

SEQ ID NO: 5991 - RNA, 19 nt, Homo sapiens
ggacagccagggcuuccuu

SEQ ID NO: 5992 - RNA, 20 nt, Homo sapiens
ggucgccccuugcccuggag

SEQ ID NO: 5993 - RNA, 19 nt, Homo sapiens
ugagauuucuguuccccac

SEQ ID NO: 5994 - RNA, 20 nt, Homo sapiens
uuugggaaaaaauguuauca

SEQ ID NO: 5995 - RNA, 19 nt, Homo sapiens
ccugaggcaccccaacaug

SEQ ID NO: 5996 - RNA, 18 nt, Homo sapiens
guaaccauggucauguga

SEQ ID NO: 5997 - RNA, 19 nt, Homo sapiens
accaaaaagggauccguac

SEQ ID NO: 5998 - RNA, 18 nt, Homo sapiens
aguauaaagaaaaguagg

SEQ ID NO: 5999 - RNA, 25 nt, Homo sapiens
ccaggcggaccgaucuucccauccc

SEQ ID NO: 6000 - RNA, 19 nt, Homo sapiens
cuguuaucuguguuugcug

SEQ ID NO: 6001 - RNA, 19 nt, Homo sapiens
cucccccagccacucccca

SEQ ID NO: 6002 - RNA, 18 nt, Homo sapiens
cuuugccaucucugcucc

SEQ ID NO: 6003 - RNA, 22 nt, Homo sapiens
gaggccaucuggagagcccaga

SEQ ID NO: 6004 - RNA, 18 nt, Homo sapiens
auccacccucccaagcug

SEQ ID NO: 6005 - RNA, 20 nt, Homo sapiens
ccucuauuacauaaacacug

SEQ ID NO: 6006 - RNA, 17 nt, Homo sapiens
agcuucuauuuuccaca

SEQ ID NO: 6007 - RNA, 20 nt, Homo sapiens
aguaagauuuguugcucuca

SEQ ID NO: 6008 - RNA, 28 nt, Homo sapiens
agugguaauugaggaaaacaguucccca

SEQ ID NO: 6009 - RNA, 22 nt, Homo sapiens
ccguucgccucuuucuguuucu

SEQ ID NO: 6010 - RNA, 20 nt, Homo sapiens
ccuccccccuccuucccucc

SEQ ID NO: 6011 - RNA, 20 nt, Homo sapiens
ggagcccgcccgcuccccuc

SEQ ID NO: 6012 - RNA, 20 nt, Homo sapiens
ucaugacacauuugccaaau

SEQ ID NO: 6013 - RNA, 20 nt, Homo sapiens
ugcccagagcacuacucuca

SEQ ID NO: 6014 - RNA, 20 nt, Homo sapiens
uguuuuucaacaugaaucug

SEQ ID NO: 6015 - RNA, 24 nt, Homo sapiens
uugacagugucauuuuauguugga

SEQ ID NO: 6016 - RNA, 21 nt, Homo sapiens
acucccucugccccagcccca

SEQ ID NO: 6017 - RNA, 18 nt, Homo sapiens
ccuccccaccccaccucc

SEQ ID NO: 6018 - RNA, 18 nt, Homo sapiens
gucuuuuucauccucuuc

SEQ ID NO: 6019 - RNA, 19 nt, Homo sapiens
ggcaugcugugacauuuua

SEQ ID NO: 6020 - RNA, 18 nt, Homo sapiens
guuuuuauaauagguaau

SEQ ID NO: 6021 - RNA, 23 nt, Homo sapiens
uuucuucagccuccucugacuuu

SEQ ID NO: 6022 - RNA, 18 nt, Homo sapiens
ugacagaacaacaguguu

SEQ ID NO: 6023 - RNA, 18 nt, Homo sapiens
accuucuggcuuccuucu

SEQ ID NO: 6024 - RNA, 23 nt, Homo sapiens
guuugcuuauguaaucucaccuc

SEQ ID NO: 6025 - RNA, 21 nt, Homo sapiens
uuugagcaauuuucgaacauu

SEQ ID NO: 6026 - RNA, 22 nt, Homo sapiens
augcugccucauuuucacagca

SEQ ID NO: 6027 - RNA, 23 nt, Homo sapiens
gaaccaggccaauauauuuugaa

SEQ ID NO: 6028 - RNA, 20 nt, Homo sapiens
gcaaacugcgggaauacugu

SEQ ID NO: 6029 - RNA, 21 nt, Homo sapiens
auggaagaaauaacaguaugu

SEQ ID NO: 6030 - RNA, 19 nt, Homo sapiens
auggucaugguagacugau

SEQ ID NO: 6031 - RNA, 21 nt, Homo sapiens
gguaaguggaaaaauaucaug

SEQ ID NO: 6032 - RNA, 21 nt, Homo sapiens
agucucuaugaucuuggcaca

SEQ ID NO: 6033 - RNA, 20 nt, Homo sapiens
ugguagugcugguggguuuu

SEQ ID NO: 6034 - RNA, 22 nt, Homo sapiens
gccugcugagaagaagaaacca

SEQ ID NO: 6035 - RNA, 18 nt, Homo sapiens
gucaggagagugauguga

SEQ ID NO: 6036 - RNA, 19 nt, Homo sapiens
agcuucugcauacagucuu

SEQ ID NO: 6037 - RNA, 20 nt, Homo sapiens
augucuuacugaaacauuuu

SEQ ID NO: 6038 - RNA, 21 nt, Homo sapiens
gcagggguaagcggcuuuuaa

SEQ ID NO: 6039 - RNA, 19 nt, Homo sapiens
guggauucagaauugugua

SEQ ID NO: 6040 - RNA, 19 nt, Homo sapiens
guuacaucaggacaacuuu

SEQ ID NO: 6041 - RNA, 21 nt, Homo sapiens
uccgcuaaguuuagauggagu

SEQ ID NO: 6042 - RNA, 19 nt, Homo sapiens
ucuacaaguuuucugccaa

SEQ ID NO: 6043 - RNA, 18 nt, Homo sapiens
uguauuuggugcuucuuc

SEQ ID NO: 6044 - RNA, 16 nt, Homo sapiens
agaaacacugauuuuc

SEQ ID NO: 6045 - RNA, 24 nt, Homo sapiens
ccaagaaacacugauuuucuuuca

SEQ ID NO: 6046 - RNA, 19 nt, Homo sapiens
ccuuccuuuuccuguuucu

SEQ ID NO: 6047 - RNA, 22 nt, Homo sapiens
ccuuuuccuguuucuuaauuuu

SEQ ID NO: 6048 - RNA, 25 nt, Homo sapiens
ggugaccuuaaagacuuccuagcca

SEQ ID NO: 6049 - RNA, 23 nt, Homo sapiens
ugaagaccuacuuuguccucuac

SEQ ID NO: 6050 - RNA, 21 nt, Homo sapiens
uucagucucauuuagaugaua

SEQ ID NO: 6051 - RNA, 23 nt, Homo sapiens
aagaguucuuaaggauugugaua

SEQ ID NO: 6052 - RNA, 16 nt, Homo sapiens
ugugaucaggcuaugu

SEQ ID NO: 6053 - RNA, 24 nt, Homo sapiens
agcgcuggugauccacccgcgcgc

SEQ ID NO: 6054 - RNA, 20 nt, Homo sapiens
auguggacuucggaauccca

SEQ ID NO: 6055 - RNA, 18 nt, Homo sapiens
ccugagcuguuucugguu

SEQ ID NO: 6056 - RNA, 17 nt, Homo sapiens
ggccaccgugcuccggg

SEQ ID NO: 6057 - RNA, 18 nt, Homo sapiens
uagagucuauugaaacug

SEQ ID NO: 6058 - RNA, 22 nt, Homo sapiens
ucccagcgcuggccgccuggca

SEQ ID NO: 6059 - RNA, 21 nt, Homo sapiens
uggucuccgaugaaaaugcca

SEQ ID NO: 6060 - RNA, 17 nt, Homo sapiens
aacaaaccuucauggca

SEQ ID NO: 6061 - RNA, 24 nt, Homo sapiens
acuuaacugaaauuauccaacaaa

SEQ ID NO: 6062 - RNA, 24 nt, Homo sapiens
acuuaacugaaauuauccaacaaa

SEQ ID NO: 6063 - RNA, 17 nt, Homo sapiens
cuaauuugcuaguggga

SEQ ID NO: 6064 - RNA, 17 nt, Homo sapiens
gacuuggcuuucuuaca

SEQ ID NO: 6065 - RNA, 20 nt, Homo sapiens
ggaaaaacauaauucuuuca

SEQ ID NO: 6066 - RNA, 23 nt, Homo sapiens
uaagugucacuuaacugaaauua

SEQ ID NO: 6067 - RNA, 23 nt, Homo sapiens
ucuuguaauuucaacacacccaa

SEQ ID NO: 6068 - RNA, 23 nt, Homo sapiens
cccgcccuccccguccugccucc

SEQ ID NO: 6069 - RNA, 24 nt, Homo sapiens
auuugagcuguggcugugaggggu

SEQ ID NO: 6070 - RNA, 30 nt, Homo sapiens
uaccuggaagccgcgcggccgcuuugguuu

SEQ ID NO: 6071 - RNA, 20 nt, Homo sapiens
gcacagagcugugguccuca

SEQ ID NO: 6072 - RNA, 22 nt, Homo sapiens
cacuuggggcaccuugcuccuc

SEQ ID NO: 6073 - RNA, 22 nt, Homo sapiens
cacccccucacccccuucuuuu

SEQ ID NO: 6074 - RNA, 20 nt, Homo sapiens
cagaagaaaaaguugcaguc

SEQ ID NO: 6075 - RNA, 21 nt, Homo sapiens
cugcuggcaccucagacaauc

SEQ ID NO: 6076 - RNA, 19 nt, Homo sapiens
gaaaagagaccuccugcuc

SEQ ID NO: 6077 - RNA, 17 nt, Homo sapiens
gaaggagaugucaguga

SEQ ID NO: 6078 - RNA, 20 nt, Homo sapiens
agaauuacauuguauagccc

SEQ ID NO: 6079 - RNA, 22 nt, Homo sapiens
auuacugcuguucuagccccca

SEQ ID NO: 6080 - RNA, 20 nt, Homo sapiens
cuguuaggguacauacgcua

SEQ ID NO: 6081 - RNA, 19 nt, Homo sapiens
ucguuguuguuuuaaguuu

SEQ ID NO: 6082 - RNA, 21 nt, Homo sapiens
gucccaccgcugccccuacug

SEQ ID NO: 6083 - RNA, 20 nt, Homo sapiens
cugaacaguuguuuguguuu

SEQ ID NO: 6084 - RNA, 19 nt, Homo sapiens
acucaaugucccccucacc

SEQ ID NO: 6085 - RNA, 19 nt, Homo sapiens
agaaauaaacaggaguuca

SEQ ID NO: 6086 - RNA, 18 nt, Homo sapiens
caacccuccguuccuccu

SEQ ID NO: 6087 - RNA, 22 nt, Homo sapiens
gagccaagauugcgccacugca

SEQ ID NO: 6088 - RNA, 19 nt, Homo sapiens
gguggguggggagucaguc

SEQ ID NO: 6089 - RNA, 19 nt, Homo sapiens
guuggaagccaaauguacu

SEQ ID NO: 6090 - RNA, 19 nt, Homo sapiens
ugagugacggaccagcuca

SEQ ID NO: 6091 - RNA, 18 nt, Homo sapiens
uggcucaggguggggcug

SEQ ID NO: 6092 - RNA, 25 nt, Homo sapiens
uugcugcuucugcuauauuugugau

SEQ ID NO: 6093 - RNA, 24 nt, Homo sapiens
acugaaguugugguuguuagguuc

SEQ ID NO: 6094 - RNA, 24 nt, Homo sapiens
caguucugcaaaaaugaccuauaa

SEQ ID NO: 6095 - RNA, 18 nt, Homo sapiens
cucaacauggcagaacca

SEQ ID NO: 6096 - RNA, 18 nt, Homo sapiens
guuuuaauguucuuuuga

SEQ ID NO: 6097 - RNA, 20 nt, Homo sapiens
uguuuuauaaacaacaucaa

SEQ ID NO: 6098 - RNA, 21 nt, Homo sapiens
uucuuuggguguaaagcguuu

SEQ ID NO: 6099 - RNA, 15 nt, Homo sapiens
uuuaauugggugggg

SEQ ID NO: 6100 - RNA, 17 nt, Homo sapiens
caacuaucucauuucca

SEQ ID NO: 6101 - RNA, 21 nt, Homo sapiens
cugaaaacccuugccaugugc

SEQ ID NO: 6102 - RNA, 19 nt, Homo sapiens
ggaauuggagcucguggaa

SEQ ID NO: 6103 - RNA, 18 nt, Homo sapiens
uaugccuuuucccaacuc

SEQ ID NO: 6104 - RNA, 18 nt, Homo sapiens
uguuugcuaagcauucca

SEQ ID NO: 6105 - RNA, 20 nt, Homo sapiens
auauuucugauggugcacua

SEQ ID NO: 6106 - RNA, 19 nt, Homo sapiens
auacuagaguucauggaua

SEQ ID NO: 6107 - RNA, 19 nt, Homo sapiens
gauaaaaaaaaagugagca

SEQ ID NO: 6108 - RNA, 18 nt, Homo sapiens
auaaagguguuaagcuua

SEQ ID NO: 6109 - RNA, 21 nt, Homo sapiens
caagauuaugucaauugguua

SEQ ID NO: 6110 - RNA, 22 nt, Homo sapiens
ucuauuauuuuucuacuaaaga

SEQ ID NO: 6111 - RNA, 22 nt, Homo sapiens
acacaacaauccuucuauucua

SEQ ID NO: 6112 - RNA, 21 nt, Homo sapiens
aucugggcugugggcaagccu

SEQ ID NO: 6113 - RNA, 19 nt, Homo sapiens
ccauugauuuaauguaaua

SEQ ID NO: 6114 - RNA, 21 nt, Homo sapiens
cugggaacaucacauuccucu

SEQ ID NO: 6115 - RNA, 18 nt, Homo sapiens
acagaacggugggagcug

SEQ ID NO: 6116 - RNA, 20 nt, Homo sapiens
gaauuuuugguguaaauuug

SEQ ID NO: 6117 - RNA, 26 nt, Homo sapiens
ucaaugugauauaaacagcuucucca

SEQ ID NO: 6118 - RNA, 19 nt, Homo sapiens
aacuuauaauuacaaugca

SEQ ID NO: 6119 - RNA, 24 nt, Homo sapiens
aaugcacaauuuauaauuacaaua

SEQ ID NO: 6120 - RNA, 19 nt, Homo sapiens
cauaaacuauauucuguga

SEQ ID NO: 6121 - RNA, 23 nt, Homo sapiens
ccaguuggcccugcaagugccug

SEQ ID NO: 6122 - RNA, 22 nt, Homo sapiens
ccuccucgcccacggcgccuca

SEQ ID NO: 6123 - RNA, 22 nt, Homo sapiens
ccuccucgcccacggcgccuca

SEQ ID NO: 6124 - RNA, 18 nt, Homo sapiens
cucccccaacccugccca

SEQ ID NO: 6125 - RNA, 22 nt, Homo sapiens
agagaaacaggcccggggggac

SEQ ID NO: 6126 - RNA, 19 nt, Homo sapiens
aguaagaccccaucucuua

SEQ ID NO: 6127 - RNA, 24 nt, Homo sapiens
gcuucggacagugcccaugcaaug

SEQ ID NO: 6128 - RNA, 22 nt, Homo sapiens
gcuuggguugggauuuugguuu

SEQ ID NO: 6129 - RNA, 18 nt, Homo sapiens
ccagaucagacucuccuu

SEQ ID NO: 6130 - RNA, 23 nt, Homo sapiens
gacaagugaucgccaccccccca

SEQ ID NO: 6131 - RNA, 20 nt, Homo sapiens
ggaggaagaggcugcacugc

SEQ ID NO: 6132 - RNA, 25 nt, Homo sapiens
aaauaaauggaaauaguacuacuca

SEQ ID NO: 6133 - RNA, 18 nt, Homo sapiens
uucucuaucaucuugcac

SEQ ID NO: 6134 - RNA, 18 nt, Homo sapiens
auguugauggcuauuuug

SEQ ID NO: 6135 - RNA, 20 nt, Homo sapiens
cggggucguggaccccggcc

SEQ ID NO: 6136 - RNA, 22 nt, Homo sapiens
gguauaggcgccuuuuacccca

SEQ ID NO: 6137 - RNA, 19 nt, Homo sapiens
ggucaauuugauugucaua

SEQ ID NO: 6138 - RNA, 21 nt, Homo sapiens
ccauccccuacaccuuccccc

SEQ ID NO: 6139 - RNA, 16 nt, Homo sapiens
gggaugugugccccuc

SEQ ID NO: 6140 - RNA, 20 nt, Homo sapiens
ccucuuccggccauucuuca

SEQ ID NO: 6141 - RNA, 23 nt, Homo sapiens
ucaaagaggcucaaugacuuucc

SEQ ID NO: 6142 - RNA, 22 nt, Homo sapiens
uccuauauccuuccuuguuccu

SEQ ID NO: 6143 - RNA, 22 nt, Homo sapiens
uucagagcacacacuguuccag

SEQ ID NO: 6144 - RNA, 23 nt, Homo sapiens
uucugccuuccccaacaccuuug

SEQ ID NO: 6145 - RNA, 20 nt, Homo sapiens
cccggcacccccugcagcuu

SEQ ID NO: 6146 - RNA, 19 nt, Homo sapiens
ccugccccaacuccuucca

SEQ ID NO: 6147 - RNA, 21 nt, Homo sapiens
ccugccccaacuccuuccagc

SEQ ID NO: 6148 - RNA, 19 nt, Homo sapiens
cuggccaagcugaggugcc

SEQ ID NO: 6149 - RNA, 19 nt, Homo sapiens
cuuguucugucaccaaugu

SEQ ID NO: 6150 - RNA, 24 nt, Homo sapiens
gagcgcccugcagacccugcccuu

SEQ ID NO: 6151 - RNA, 19 nt, Homo sapiens
cacuucaccguacuaacca

SEQ ID NO: 6152 - RNA, 18 nt, Homo sapiens
cagccaaacccugucuga

SEQ ID NO: 6153 - RNA, 20 nt, Homo sapiens
ugagccaccacguggagcug

SEQ ID NO: 6154 - RNA, 19 nt, Homo sapiens
aaacuccugaccucaggug

SEQ ID NO: 6155 - RNA, 21 nt, Homo sapiens
aacuuacacuguuucaucuca

SEQ ID NO: 6156 - RNA, 18 nt, Homo sapiens
aagaaaaacauucacauc

SEQ ID NO: 6157 - RNA, 19 nt, Homo sapiens
aaugcuucuaucagacuca

SEQ ID NO: 6158 - RNA, 21 nt, Homo sapiens
agaggaacaaaccaggggaca

SEQ ID NO: 6159 - RNA, 18 nt, Homo sapiens
caguacuuugggaagcca

SEQ ID NO: 6160 - RNA, 19 nt, Homo sapiens
ccaugaaaacagaacccaa

SEQ ID NO: 6161 - RNA, 17 nt, Homo sapiens
cuuuuucauuuaacuuu

SEQ ID NO: 6162 - RNA, 18 nt, Homo sapiens
gccaccagccucauucca

SEQ ID NO: 6163 - RNA, 20 nt, Homo sapiens
uagauacacuucuuaaauac

SEQ ID NO: 6164 - RNA, 22 nt, Homo sapiens
uggguauuucuuggcaugcauc

SEQ ID NO: 6165 - RNA, 23 nt, Homo sapiens
uucaagugauucuccuggcucac

SEQ ID NO: 6166 - RNA, 20 nt, Homo sapiens
uuuguaaauaugugacauuc

SEQ ID NO: 6167 - RNA, 22 nt, Homo sapiens
gccuggguugcaggcccugcuu

SEQ ID NO: 6168 - RNA, 20 nt, Homo sapiens
ugcaggcccugcuuguggug

SEQ ID NO: 6169 - RNA, 20 nt, Homo sapiens
cugucuuauacaaccagaga

SEQ ID NO: 6170 - RNA, 21 nt, Homo sapiens
uuccagaaaaaaacuauccag

SEQ ID NO: 6171 - RNA, 18 nt, Homo sapiens
aagaugcuucucacugcc

SEQ ID NO: 6172 - RNA, 17 nt, Homo sapiens
ccccgccccgccccugc

SEQ ID NO: 6173 - RNA, 15 nt, Homo sapiens
cgcacacaguaucua

SEQ ID NO: 6174 - RNA, 19 nt, Homo sapiens
gcuucauaaagucuuugaa

SEQ ID NO: 6175 - RNA, 21 nt, Homo sapiens
ggucuaauuuauucaaagggg

SEQ ID NO: 6176 - RNA, 16 nt, Homo sapiens
ucucaccucuccuacu

SEQ ID NO: 6177 - RNA, 16 nt, Homo sapiens
augacucguauauguc

SEQ ID NO: 6178 - RNA, 20 nt, Homo sapiens
cauggcaaggacugcaggga

SEQ ID NO: 6179 - RNA, 20 nt, Homo sapiens
ugcccaggccugccuguucc

SEQ ID NO: 6180 - RNA, 20 nt, Homo sapiens
uggucacaggacucugccuc

SEQ ID NO: 6181 - RNA, 23 nt, Homo sapiens
agaaaaaaucgucucucccuccc

SEQ ID NO: 6182 - RNA, 18 nt, Homo sapiens
agaagccucacugcaagc

SEQ ID NO: 6183 - RNA, 18 nt, Homo sapiens
auggcuuaguuuucauac

SEQ ID NO: 6184 - RNA, 19 nt, Homo sapiens
cccacaaaaguacaauuua

SEQ ID NO: 6185 - RNA, 18 nt, Homo sapiens
gucaaagacauucugaca

SEQ ID NO: 6186 - RNA, 19 nt, Homo sapiens
gucagagaggagucagaga

SEQ ID NO: 6187 - RNA, 20 nt, Homo sapiens
agucucacuuuguugcccag

SEQ ID NO: 6188 - RNA, 21 nt, Homo sapiens
cuauuucuauccugaguagua

SEQ ID NO: 6189 - RNA, 22 nt, Homo sapiens
cucuuugggguuuuaguaugug

SEQ ID NO: 6190 - RNA, 19 nt, Homo sapiens
gagugaaaacaucugcaca

SEQ ID NO: 6191 - RNA, 20 nt, Homo sapiens
ucuacaaaaugacuaggaua

SEQ ID NO: 6192 - RNA, 24 nt, Homo sapiens
ugaaugcuccauucaggccuauca

SEQ ID NO: 6193 - RNA, 18 nt, Homo sapiens
aggagaaacagagacagg

SEQ ID NO: 6194 - RNA, 22 nt, Homo sapiens
aggcaaaaaaauuaaauuauuu

SEQ ID NO: 6195 - RNA, 23 nt, Homo sapiens
ccaccucuccuuuggccauucca

SEQ ID NO: 6196 - RNA, 18 nt, Homo sapiens
acauucagaggcaucaca

SEQ ID NO: 6197 - RNA, 21 nt, Homo sapiens
aucccaacgcaugcuccugga

SEQ ID NO: 6198 - RNA, 17 nt, Homo sapiens
ccuccuuagcacaaugu

SEQ ID NO: 6199 - RNA, 18 nt, Homo sapiens
cugcuuggggacuauugg

SEQ ID NO: 6200 - RNA, 19 nt, Homo sapiens
uuagagucauucucaugcu

SEQ ID NO: 6201 - RNA, 18 nt, Homo sapiens
agagguguuaggguuugg

SEQ ID NO: 6202 - RNA, 21 nt, Homo sapiens
ucccacccccaacgccaucuc

SEQ ID NO: 6203 - RNA, 23 nt, Homo sapiens
uucugacccgcucaggcuugagg

SEQ ID NO: 6204 - RNA, 18 nt, Homo sapiens
cccucucccuccaccucc

SEQ ID NO: 6205 - RNA, 22 nt, Homo sapiens
ccucccugccaccaggcacugc

SEQ ID NO: 6206 - RNA, 19 nt, Homo sapiens
cgcacgguacccgugcugc

SEQ ID NO: 6207 - RNA, 18 nt, Homo sapiens
cuguuuugccuucaccca

SEQ ID NO: 6208 - RNA, 21 nt, Homo sapiens
gcacaagccacggcggacucu

SEQ ID NO: 6209 - RNA, 22 nt, Homo sapiens
gcuacuuuugcuguuuuauuuu

SEQ ID NO: 6210 - RNA, 19 nt, Homo sapiens
gcuugaaaagccgcggaac

SEQ ID NO: 6211 - RNA, 21 nt, Homo sapiens
caggguuaauagggccugguc

SEQ ID NO: 6212 - RNA, 22 nt, Homo sapiens
gacccaagcuucuagagauccc

SEQ ID NO: 6213 - RNA, 23 nt, Homo sapiens
ucugcagcccucagauuauuuuu

SEQ ID NO: 6214 - RNA, 18 nt, Homo sapiens
caaccuucccuucgcucc

SEQ ID NO: 6215 - RNA, 18 nt, Homo sapiens
cuggcccgccccagcccg

SEQ ID NO: 6216 - RNA, 18 nt, Homo sapiens
ccuggcaauugucugccc

SEQ ID NO: 6217 - RNA, 19 nt, Homo sapiens
acccuuccucaccacuucc

SEQ ID NO: 6218 - RNA, 24 nt, Homo sapiens
agugccggacuagcaagugcugga

SEQ ID NO: 6219 - RNA, 19 nt, Homo sapiens
uuugcuuacuuugcauuug

SEQ ID NO: 6220 - RNA, 23 nt, Homo sapiens
acaaagcugcugcuuuuacuuca

SEQ ID NO: 6221 - RNA, 21 nt, Homo sapiens
agccccucaaguaauauagca

SEQ ID NO: 6222 - RNA, 19 nt, Homo sapiens
agcugcugcuuuuacuuca

SEQ ID NO: 6223 - RNA, 20 nt, Homo sapiens
augguguugaaggacuucuc

SEQ ID NO: 6224 - RNA, 20 nt, Homo sapiens
ccuuuucaguuauuuuaauu

SEQ ID NO: 6225 - RNA, 21 nt, Homo sapiens
gggucuggguggguccaguca

SEQ ID NO: 6226 - RNA, 18 nt, Homo sapiens
gguguugaaggacuucuc

SEQ ID NO: 6227 - RNA, 19 nt, Homo sapiens
ugcacagacuguguuuaug

SEQ ID NO: 6228 - RNA, 20 nt, Homo sapiens
agagggcugaagccuuguca

SEQ ID NO: 6229 - RNA, 17 nt, Homo sapiens
aucuuggccugauagca

SEQ ID NO: 6230 - RNA, 20 nt, Homo sapiens
ccugcucacucuuccacaga

SEQ ID NO: 6231 - RNA, 21 nt, Homo sapiens
cuguggcccucgcucugccuc

SEQ ID NO: 6232 - RNA, 18 nt, Homo sapiens
gugguuuccucggcccuc

SEQ ID NO: 6233 - RNA, 18 nt, Homo sapiens
uaugacucaccuugcucu

SEQ ID NO: 6234 - RNA, 19 nt, Homo sapiens
uauuaaucccucguguguc

SEQ ID NO: 6235 - RNA, 18 nt, Homo sapiens
uuucuccuuuuuuaugau

SEQ ID NO: 6236 - RNA, 18 nt, Homo sapiens
cuugagcccagaagcuca

SEQ ID NO: 6237 - RNA, 21 nt, Homo sapiens
ccaaaaucacaacagcauuac

SEQ ID NO: 6238 - RNA, 17 nt, Homo sapiens
ccugagccagccugcuc

SEQ ID NO: 6239 - RNA, 21 nt, Homo sapiens
aagagagguccagaguccugg

SEQ ID NO: 6240 - RNA, 25 nt, Homo sapiens
uccugaaaucauauagaaaggcugg

SEQ ID NO: 6241 - RNA, 21 nt, Homo sapiens
uccuuuaagaaaaacaucugg

SEQ ID NO: 6242 - RNA, 21 nt, Homo sapiens
ccguucuuagccaagcugcua

SEQ ID NO: 6243 - RNA, 19 nt, Homo sapiens
ggagcauuuuugaaauuca

SEQ ID NO: 6244 - RNA, 16 nt, Homo sapiens
cuuagaggucgaggca

SEQ ID NO: 6245 - RNA, 23 nt, Homo sapiens
acauuggcuuccacaucacagua

SEQ ID NO: 6246 - RNA, 25 nt, Homo sapiens
gucugaacacguuaucacuugguuu

SEQ ID NO: 6247 - RNA, 18 nt, Homo sapiens
acgugugcacacaccaca

SEQ ID NO: 6248 - RNA, 21 nt, Homo sapiens
cucuuguuauugcaucugcug

SEQ ID NO: 6249 - RNA, 26 nt, Homo sapiens
gcguggguaagccgcugcuggguuuu

SEQ ID NO: 6250 - RNA, 17 nt, Homo sapiens
ggugacggcagcguagc

SEQ ID NO: 6251 - RNA, 24 nt, Homo sapiens
caggauuacaugcauguuugguua

SEQ ID NO: 6252 - RNA, 20 nt, Homo sapiens
cauguaucacuguagaggga

SEQ ID NO: 6253 - RNA, 19 nt, Homo sapiens
cccagucccucgcugcaca

SEQ ID NO: 6254 - RNA, 19 nt, Homo sapiens
cccccaacucccaauacug

SEQ ID NO: 6255 - RNA, 23 nt, Homo sapiens
cuaaaccuuuuggaaaaucugcc

SEQ ID NO: 6256 - RNA, 19 nt, Homo sapiens
cuauuugugagcaaaggug

SEQ ID NO: 6257 - RNA, 19 nt, Homo sapiens
gaacacugguggaggaugg

SEQ ID NO: 6258 - RNA, 23 nt, Homo sapiens
gagggguguggcugggccuguca

SEQ ID NO: 6259 - RNA, 21 nt, Homo sapiens
gagucucagcuaccuaagaaa

SEQ ID NO: 6260 - RNA, 19 nt, Homo sapiens
uaugacucacaugaugcau

SEQ ID NO: 6261 - RNA, 24 nt, Homo sapiens
ucacagaaucaaggaagcaccuca

SEQ ID NO: 6262 - RNA, 22 nt, Homo sapiens
ucagccuugaaacauugaugga

SEQ ID NO: 6263 - RNA, 20 nt, Homo sapiens
ucugcgaagaaccuugugug

SEQ ID NO: 6264 - RNA, 23 nt, Homo sapiens
uucaguuaaaaauccagauggca

SEQ ID NO: 6265 - RNA, 18 nt, Homo sapiens
agucaagggugugugcag

SEQ ID NO: 6266 - RNA, 18 nt, Homo sapiens
cuccccaaaugcuuucca

SEQ ID NO: 6267 - RNA, 22 nt, Homo sapiens
gugugugcagcauuguuggcug

SEQ ID NO: 6268 - RNA, 23 nt, Homo sapiens
uugccuaggcauagccugccuca

SEQ ID NO: 6269 - RNA, 18 nt, Homo sapiens
accgucaccaucaagcca

SEQ ID NO: 6270 - RNA, 22 nt, Homo sapiens
cagcgagucccaccuggaccuc

SEQ ID NO: 6271 - RNA, 15 nt, Homo sapiens
cgccgccgccauaga

SEQ ID NO: 6272 - RNA, 22 nt, Homo sapiens
gagaccagagcccagcuugcca

SEQ ID NO: 6273 - RNA, 21 nt, Homo sapiens
ggcuuuguuaauccuauuuua

SEQ ID NO: 6274 - RNA, 19 nt, Homo sapiens
gugaccuuugcugcagcag

SEQ ID NO: 6275 - RNA, 21 nt, Homo sapiens
ugcaauuguaggggugugugu

SEQ ID NO: 6276 - RNA, 22 nt, Homo sapiens
uguaggggugugugugugugug

SEQ ID NO: 6277 - RNA, 19 nt, Homo sapiens
aagcaauucuccugccuca

SEQ ID NO: 6278 - RNA, 20 nt, Homo sapiens
caaagccaccaccguccuuc

SEQ ID NO: 6279 - RNA, 18 nt, Homo sapiens
caaggucaagaugguuca

SEQ ID NO: 6280 - RNA, 18 nt, Homo sapiens
gauguccugacaugaaac

SEQ ID NO: 6281 - RNA, 20 nt, Homo sapiens
acaguugugacaguaaucug

SEQ ID NO: 6282 - RNA, 20 nt, Homo sapiens
cagaaaaccagcauauuuaa

SEQ ID NO: 6283 - RNA, 21 nt, Homo sapiens
ccuaauaaaauaaugguauuu

SEQ ID NO: 6284 - RNA, 23 nt, Homo sapiens
guauauuuuauaugauuuacuua

SEQ ID NO: 6285 - RNA, 22 nt, Homo sapiens
uucuauugaguauuauaagaua

SEQ ID NO: 6286 - RNA, 20 nt, Homo sapiens
acaguugugacaguaaucug

SEQ ID NO: 6287 - RNA, 20 nt, Homo sapiens
cagaaaaccagcauauuuaa

SEQ ID NO: 6288 - RNA, 21 nt, Homo sapiens
ccuaauaaaauaaugguauuu

SEQ ID NO: 6289 - RNA, 23 nt, Homo sapiens
guauauuuuauaugauuuacuua

SEQ ID NO: 6290 - RNA, 22 nt, Homo sapiens
uucuauugaguauuauaagaua

SEQ ID NO: 6291 - RNA, 20 nt, Homo sapiens
acaguugugacaguaaucug

SEQ ID NO: 6292 - RNA, 20 nt, Homo sapiens
cagaaaaccagcauauuuaa

SEQ ID NO: 6293 - RNA, 21 nt, Homo sapiens
ccuaauaaaauaaugguauuu

SEQ ID NO: 6294 - RNA, 23 nt, Homo sapiens
guauauuuuauaugauuuacuua

SEQ ID NO: 6295 - RNA, 22 nt, Homo sapiens
uucuauugaguauuauaagaua

SEQ ID NO: 6296 - RNA, 20 nt, Homo sapiens
acaguugugacaguaaucug

SEQ ID NO: 6297 - RNA, 20 nt, Homo sapiens
cagaaaaccagcauauuuaa

SEQ ID NO: 6298 - RNA, 21 nt, Homo sapiens
ccuaauaaaauaaugguauuu

SEQ ID NO: 6299 - RNA, 23 nt, Homo sapiens
guauauuuuauaugauuuacuua

SEQ ID NO: 6300 - RNA, 22 nt, Homo sapiens
uucuauugaguauuauaagaua

SEQ ID NO: 6301 - RNA, 16 nt, Homo sapiens
aagaaacugggucuca

SEQ ID NO: 6302 - RNA, 20 nt, Homo sapiens
acagauucgaauuuuacuuc

SEQ ID NO: 6303 - RNA, 20 nt, Homo sapiens
acaguugugacaguaaucug

SEQ ID NO: 6304 - RNA, 20 nt, Homo sapiens
cagaaaaccagcauauuuaa

SEQ ID NO: 6305 - RNA, 21 nt, Homo sapiens
ccuaauaaaauaaugguauuu

SEQ ID NO: 6306 - RNA, 23 nt, Homo sapiens
guauauuuuauaugauuuacuua

SEQ ID NO: 6307 - RNA, 19 nt, Homo sapiens
ucuucagacuugaacaaga

SEQ ID NO: 6308 - RNA, 22 nt, Homo sapiens
uucuauugaguauuauaagaua

SEQ ID NO: 6309 - RNA, 20 nt, Homo sapiens
guucuuauguugcccagugu

SEQ ID NO: 6310 - RNA, 24 nt, Homo sapiens
ucaacccaauaguuguugauuggc

SEQ ID NO: 6311 - RNA, 20 nt, Homo sapiens
aagaugcauuaucuaugaua

SEQ ID NO: 6312 - RNA, 17 nt, Homo sapiens
uauauguauaugcaaua

SEQ ID NO: 6313 - RNA, 19 nt, Homo sapiens
uccagaaagcucaucucag

SEQ ID NO: 6314 - RNA, 19 nt, Homo sapiens
ccuguaacaugcaauuuug

SEQ ID NO: 6315 - RNA, 21 nt, Homo sapiens
cuguagccucgccgucuguga

SEQ ID NO: 6316 - RNA, 18 nt, Homo sapiens
ucaaacaugaaguguguu

SEQ ID NO: 6317 - RNA, 19 nt, Homo sapiens
ucaggccucccucaacccc

SEQ ID NO: 6318 - RNA, 17 nt, Homo sapiens
caccacugcgcccuucu

SEQ ID NO: 6319 - RNA, 20 nt, Homo sapiens
ccccgccccgcccccgcugc

SEQ ID NO: 6320 - RNA, 20 nt, Homo sapiens
uccaccacugcgcccuucuc

SEQ ID NO: 6321 - RNA, 18 nt, Homo sapiens
agaaagaaacuuccaaca

SEQ ID NO: 6322 - RNA, 18 nt, Homo sapiens
ugauacacaagcuuaaau

SEQ ID NO: 6323 - RNA, 21 nt, Homo sapiens
acccaagucugcuucugugau

SEQ ID NO: 6324 - RNA, 18 nt, Homo sapiens
ucuuguuuuaugcuguca

SEQ ID NO: 6325 - RNA, 19 nt, Homo sapiens
ugaacuuuuaagggucuca

SEQ ID NO: 6326 - RNA, 26 nt, Homo sapiens
uucaacgauuaagaaucaucauuaca

SEQ ID NO: 6327 - RNA, 19 nt, Homo sapiens
ccugcaggaggccugggag

SEQ ID NO: 6328 - RNA, 17 nt, Homo sapiens
gaggagccuggagugua

SEQ ID NO: 6329 - RNA, 22 nt, Homo sapiens
guuggaaauugggugugcccug

SEQ ID NO: 6330 - RNA, 21 nt, Homo sapiens
ugaagagauacccacagagug

SEQ ID NO: 6331 - RNA, 28 nt, Homo sapiens
gcuugggcacagcagacuggccuggccc

SEQ ID NO: 6332 - RNA, 22 nt, Homo sapiens
ucugggccccuccgccugggcc

SEQ ID NO: 6333 - RNA, 23 nt, Homo sapiens
ugcucccaccugauccugcacug

SEQ ID NO: 6334 - RNA, 20 nt, Homo sapiens
uccagccgagaccuuuugau

SEQ ID NO: 6335 - RNA, 22 nt, Homo sapiens
acagggaaaagauuucugucca

SEQ ID NO: 6336 - RNA, 16 nt, Homo sapiens
aggcggacgcccagga

SEQ ID NO: 6337 - RNA, 19 nt, Homo sapiens
cuggcuaauuccccuucca

SEQ ID NO: 6338 - RNA, 19 nt, Homo sapiens
uacaagggcauggcucaca

SEQ ID NO: 6339 - RNA, 19 nt, Homo sapiens
gcugcuccccgcaaugcug

SEQ ID NO: 6340 - RNA, 22 nt, Homo sapiens
ucacuggcauucacccccugca

SEQ ID NO: 6341 - RNA, 19 nt, Homo sapiens
agagaacauuccucugcag

SEQ ID NO: 6342 - RNA, 18 nt, Homo sapiens
gauuguucuguccaguuu

SEQ ID NO: 6343 - RNA, 21 nt, Homo sapiens
uuagcuacuuuucagaauuga

SEQ ID NO: 6344 - RNA, 18 nt, Homo sapiens
ugcccaggccccaccucu

SEQ ID NO: 6345 - RNA, 22 nt, Homo sapiens
uugcccaggccccaccucuccu

SEQ ID NO: 6346 - RNA, 16 nt, Homo sapiens
agccaagaacacccuu

SEQ ID NO: 6347 - RNA, 20 nt, Homo sapiens
agucucacucugucgcccag

SEQ ID NO: 6348 - RNA, 19 nt, Homo sapiens
caaacaucccaaaugucca

SEQ ID NO: 6349 - RNA, 19 nt, Homo sapiens
uacugacacaugcugugac

SEQ ID NO: 6350 - RNA, 19 nt, Homo sapiens
aaugucuuuaauaugaaau

SEQ ID NO: 6351 - RNA, 16 nt, Homo sapiens
acaaugcgagaaugau

SEQ ID NO: 6352 - RNA, 17 nt, Homo sapiens
agcuguaauucacuuua

SEQ ID NO: 6353 - RNA, 19 nt, Homo sapiens
ccaaggcacuuucuuaagc

SEQ ID NO: 6354 - RNA, 20 nt, Homo sapiens
guguccagcaguugcuugaa

SEQ ID NO: 6355 - RNA, 20 nt, Homo sapiens
acccgccuccaacgggucac

SEQ ID NO: 6356 - RNA, 20 nt, Homo sapiens
cacacgcgcacuuccaccuc

SEQ ID NO: 6357 - RNA, 22 nt, Homo sapiens
caggguuggccaggcccaguca

SEQ ID NO: 6358 - RNA, 18 nt, Homo sapiens
ggauuuaucaccaagaca

SEQ ID NO: 6359 - RNA, 19 nt, Homo sapiens
acacuuguaaagugcuacg

SEQ ID NO: 6360 - RNA, 17 nt, Homo sapiens
gauaauguuaauucucu

SEQ ID NO: 6361 - RNA, 18 nt, Homo sapiens
gcucuccccgcuucuucg

SEQ ID NO: 6362 - RNA, 18 nt, Homo sapiens
uguggugucuuguuccac

SEQ ID NO: 6363 - RNA, 26 nt, Homo sapiens
accagauccuuuuccaucccacucca

SEQ ID NO: 6364 - RNA, 21 nt, Homo sapiens
ccauuucccacuuccaccccc

SEQ ID NO: 6365 - RNA, 17 nt, Homo sapiens
cucccaaaggcugucau

SEQ ID NO: 6366 - RNA, 18 nt, Homo sapiens
gacaauauuaauuuggau

SEQ ID NO: 6367 - RNA, 21 nt, Homo sapiens
gacgaucauugugcccacuua

SEQ ID NO: 6368 - RNA, 18 nt, Homo sapiens
gagcuuccagaaaugcca

SEQ ID NO: 6369 - RNA, 15 nt, Homo sapiens
gauuucuacacuuua

SEQ ID NO: 6370 - RNA, 20 nt, Homo sapiens
ucuaccaaaaacaauacuuu

SEQ ID NO: 6371 - RNA, 19 nt, Homo sapiens
ugaaccuuccugucuccca

SEQ ID NO: 6372 - RNA, 19 nt, Homo sapiens
uguacuuaauaacacuuca

SEQ ID NO: 6373 - RNA, 20 nt, Homo sapiens
aucaaucaccuugcauuuca

SEQ ID NO: 6374 - RNA, 17 nt, Homo sapiens
cccaaaccccgcuguga

SEQ ID NO: 6375 - RNA, 17 nt, Homo sapiens
gaaaaugaaccaacaca

SEQ ID NO: 6376 - RNA, 20 nt, Homo sapiens
uggauaguaaaguggaauua

SEQ ID NO: 6377 - RNA, 22 nt, Homo sapiens
uuaaaagucacauaaaaugcgg

SEQ ID NO: 6378 - RNA, 23 nt, Homo sapiens
aaaacaaacguguaucuaaaugu

SEQ ID NO: 6379 - RNA, 21 nt, Homo sapiens
ccaaugagacuacacaauuga

SEQ ID NO: 6380 - RNA, 23 nt, Homo sapiens
cucccggccagccgccggcccgc

SEQ ID NO: 6381 - RNA, 17 nt, Homo sapiens
gucugcagaggcgggga

SEQ ID NO: 6382 - RNA, 18 nt, Homo sapiens
uccgcugagcgcucuuuu

SEQ ID NO: 6383 - RNA, 21 nt, Homo sapiens
uugaucaauauuuucccagua

SEQ ID NO: 6384 - RNA, 18 nt, Homo sapiens
caccacugcccucccuuc

SEQ ID NO: 6385 - RNA, 22 nt, Homo sapiens
ccagauccaaggucccucaccc

SEQ ID NO: 6386 - RNA, 15 nt, Homo sapiens
cuggagcuugucuug

SEQ ID NO: 6387 - RNA, 22 nt, Homo sapiens
uggaacacucugguccgccuca

SEQ ID NO: 6388 - RNA, 21 nt, Homo sapiens
guuuuggcaugccugcaggaa

SEQ ID NO: 6389 - RNA, 17 nt, Homo sapiens
ggcugaaaaagcccaca

SEQ ID NO: 6390 - RNA, 22 nt, Homo sapiens
aaacgcucucugcucugcuuuu

SEQ ID NO: 6391 - RNA, 20 nt, Homo sapiens
gcgggagccucccugccuca

SEQ ID NO: 6392 - RNA, 21 nt, Homo sapiens
ggaaaaacccgucaauguacu

SEQ ID NO: 6393 - RNA, 21 nt, Homo sapiens
ccuccugguggccuugccgcc

SEQ ID NO: 6394 - RNA, 21 nt, Homo sapiens
ccuuggcgcuggaccagugag

SEQ ID NO: 6395 - RNA, 19 nt, Homo sapiens
augacauaccuugcuucuu

SEQ ID NO: 6396 - RNA, 23 nt, Homo sapiens
ccccaccuucuaucuaagacaau

SEQ ID NO: 6397 - RNA, 19 nt, Homo sapiens
gcggcggacaggaacacca

SEQ ID NO: 6398 - RNA, 20 nt, Homo sapiens
gcuuuuccccugccugugag

SEQ ID NO: 6399 - RNA, 23 nt, Homo sapiens
uggggagaccgaguguggagcug

SEQ ID NO: 6400 - RNA, 22 nt, Homo sapiens
acagauccauccuuuugcuuca

SEQ ID NO: 6401 - RNA, 20 nt, Homo sapiens
cagagauggcagagccaucc

SEQ ID NO: 6402 - RNA, 21 nt, Homo sapiens
gaaaagccuccgccugcucau

SEQ ID NO: 6403 - RNA, 19 nt, Homo sapiens
ugggugggccccacagugg

SEQ ID NO: 6404 - RNA, 17 nt, Homo sapiens
ucaagugauucuccugc

SEQ ID NO: 6405 - RNA, 17 nt, Homo sapiens
ccuucuccuauaugaua

SEQ ID NO: 6406 - RNA, 20 nt, Homo sapiens
ccccgcccccgccccacagc

SEQ ID NO: 6407 - RNA, 19 nt, Homo sapiens
ccugcuucccaaacuccca

SEQ ID NO: 6408 - RNA, 22 nt, Homo sapiens
cuguggauaacauugcuagcga

SEQ ID NO: 6409 - RNA, 21 nt, Homo sapiens
ccugcgaagcgccugggaagc

SEQ ID NO: 6410 - RNA, 17 nt, Homo sapiens
aaaaacaaacaaacaaa

SEQ ID NO: 6411 - RNA, 20 nt, Homo sapiens
ccucugccucccagguucaa

SEQ ID NO: 6412 - RNA, 19 nt, Homo sapiens
cugcaaccucugccuccca

SEQ ID NO: 6413 - RNA, 18 nt, Homo sapiens
uccaccucgcagguucaa

SEQ ID NO: 6414 - RNA, 21 nt, Homo sapiens
cacagccacacuuccaucuca

SEQ ID NO: 6415 - RNA, 17 nt, Homo sapiens
ucaagugauucuccugc

SEQ ID NO: 6416 - RNA, 16 nt, Homo sapiens
ugcaaccuccaccccc

SEQ ID NO: 6417 - RNA, 21 nt, Homo sapiens
uuuagguggucuugaacuccu

SEQ ID NO: 6418 - RNA, 18 nt, Homo sapiens
agcagaugcuaaaccguc

SEQ ID NO: 6419 - RNA, 21 nt, Homo sapiens
ucuuuucucacugcuuugacu

SEQ ID NO: 6420 - RNA, 21 nt, Homo sapiens
uuguuugaucaccaauaaaua

SEQ ID NO: 6421 - RNA, 19 nt, Homo sapiens
caggacugcagaacacccu

SEQ ID NO: 6422 - RNA, 22 nt, Homo sapiens
cugacaauuaugaaaaaauguu

SEQ ID NO: 6423 - RNA, 21 nt, Homo sapiens
guaguuuuucugucauuguua

SEQ ID NO: 6424 - RNA, 17 nt, Homo sapiens
caaccucgccccacccc

SEQ ID NO: 6425 - RNA, 18 nt, Homo sapiens
cuucccgcgcuccggugu

SEQ ID NO: 6426 - RNA, 18 nt, Homo sapiens
gaccuacaacagcuaaau

SEQ ID NO: 6427 - RNA, 21 nt, Homo sapiens
gacuuaaaaauuguguuuaca

SEQ ID NO: 6428 - RNA, 20 nt, Homo sapiens
guguguguggguucuaaugg

SEQ ID NO: 6429 - RNA, 24 nt, Homo sapiens
uaaaaugcacagaaaugcaugcaa

SEQ ID NO: 6430 - RNA, 22 nt, Homo sapiens
ucagcaccaucuucaggugcuu

SEQ ID NO: 6431 - RNA, 17 nt, Homo sapiens
acucuccuuugcucucu

SEQ ID NO: 6432 - RNA, 19 nt, Homo sapiens
cucucugcuugcuuggccc

SEQ ID NO: 6433 - RNA, 17 nt, Homo sapiens
gguauacaucuuccccu

SEQ ID NO: 6434 - RNA, 20 nt, Homo sapiens
ugacuaggugucaccauaca

SEQ ID NO: 6435 - RNA, 20 nt, Homo sapiens
aacucuuguaguuuacuguu

SEQ ID NO: 6436 - RNA, 22 nt, Homo sapiens
ccuguggacgaccaucugccag

SEQ ID NO: 6437 - RNA, 23 nt, Homo sapiens
cgagggguggggcuggguuuagu

SEQ ID NO: 6438 - RNA, 20 nt, Homo sapiens
ucaucgcucuugccaaauaa

SEQ ID NO: 6439 - RNA, 20 nt, Homo sapiens
ccccgcccccgccccgcugc

SEQ ID NO: 6440 - RNA, 20 nt, Homo sapiens
ggaacgcccccgcccccgcc

SEQ ID NO: 6441 - RNA, 18 nt, Homo sapiens
aguaaaugguaguguguc

SEQ ID NO: 6442 - RNA, 21 nt, Homo sapiens
cugugauuacucuuugcuuug

SEQ ID NO: 6443 - RNA, 18 nt, Homo sapiens
gcuuccuucugucauucc

SEQ ID NO: 6444 - RNA, 23 nt, Homo sapiens
ucagcauagugacuaaacuacau

SEQ ID NO: 6445 - RNA, 21 nt, Homo sapiens
accugcuacagugagcugcca

SEQ ID NO: 6446 - RNA, 18 nt, Homo sapiens
auuccagcuauggagcua

SEQ ID NO: 6447 - RNA, 19 nt, Homo sapiens
cagucccagacagaaccua

SEQ ID NO: 6448 - RNA, 21 nt, Homo sapiens
cgcacaccuguauucccaucu

SEQ ID NO: 6449 - RNA, 22 nt, Homo sapiens
gcccggcggcagggcccggcga

SEQ ID NO: 6450 - RNA, 19 nt, Homo sapiens
ugaugugacugcuuagccc

SEQ ID NO: 6451 - RNA, 20 nt, Homo sapiens
gccaaaagauuuaaaccugu

SEQ ID NO: 6452 - RNA, 21 nt, Homo sapiens
acuuggaucuucccuuggucc

SEQ ID NO: 6453 - RNA, 22 nt, Homo sapiens
agaauuguaguucuuaguccca

SEQ ID NO: 6454 - RNA, 17 nt, Homo sapiens
agagggagacagagaug

SEQ ID NO: 6455 - RNA, 24 nt, Homo sapiens
aguucucuuucuuagucccuaauc

SEQ ID NO: 6456 - RNA, 20 nt, Homo sapiens
cagcacagccuugauuuccu

SEQ ID NO: 6457 - RNA, 19 nt, Homo sapiens
gaaagaaacccacagaagg

SEQ ID NO: 6458 - RNA, 20 nt, Homo sapiens
gaaucuggacauuuguucca

SEQ ID NO: 6459 - RNA, 18 nt, Homo sapiens
gagcaaaacauugggcca

SEQ ID NO: 6460 - RNA, 18 nt, Homo sapiens
ggcuuaaguaccaaucuc

SEQ ID NO: 6461 - RNA, 20 nt, Homo sapiens
ucaagacuucuccaggccca

SEQ ID NO: 6462 - RNA, 23 nt, Homo sapiens
ucuccuugauuuuugguaguauc

SEQ ID NO: 6463 - RNA, 19 nt, Homo sapiens
ugcauugagaaggaacuga

SEQ ID NO: 6464 - RNA, 17 nt, Homo sapiens
uucucccguuaaccagg

SEQ ID NO: 6465 - RNA, 18 nt, Homo sapiens
ccaaacgcaccccggcga

SEQ ID NO: 6466 - RNA, 22 nt, Homo sapiens
uaaauuaaugaguuuuauccaa

SEQ ID NO: 6467 - RNA, 18 nt, Homo sapiens
uggggcuuggcguggagc

SEQ ID NO: 6468 - RNA, 16 nt, Homo sapiens
ugcaccgccgagcuuc

SEQ ID NO: 6469 - RNA, 24 nt, Homo sapiens
aaagaaauccccccuucagaacag

SEQ ID NO: 6470 - RNA, 20 nt, Homo sapiens
cugggucuggguuuggaucu

SEQ ID NO: 6471 - RNA, 19 nt, Homo sapiens
caccauucccacccacccu

SEQ ID NO: 6472 - RNA, 17 nt, Homo sapiens
caccucuguuuccucuu

SEQ ID NO: 6473 - RNA, 21 nt, Homo sapiens
ccaccauucccacccacccuc

SEQ ID NO: 6474 - RNA, 19 nt, Homo sapiens
cucuguuuccucuuccccu

SEQ ID NO: 6475 - RNA, 21 nt, Homo sapiens
guuccacuccacuuuguauag

SEQ ID NO: 6476 - RNA, 21 nt, Homo sapiens
uccucuuccccuuucuccucg

SEQ ID NO: 6477 - RNA, 18 nt, Homo sapiens
aaacaccaccaaaugaca

SEQ ID NO: 6478 - RNA, 19 nt, Homo sapiens
aaccuaaggcaacauuucc

SEQ ID NO: 6479 - RNA, 23 nt, Homo sapiens
augcugccaaccagcuuguccaa

SEQ ID NO: 6480 - RNA, 18 nt, Homo sapiens
cugcccccgccuaccccg

SEQ ID NO: 6481 - RNA, 19 nt, Homo sapiens
ucugaaaacuguuuauggu

SEQ ID NO: 6482 - RNA, 17 nt, Homo sapiens
gacgcaaugugaaacug

SEQ ID NO: 6483 - RNA, 19 nt, Homo sapiens
uucucuacuaaaaauacaa

SEQ ID NO: 6484 - RNA, 15 nt, Homo sapiens
ucacuguccuugcca

SEQ ID NO: 6485 - RNA, 19 nt, Homo sapiens
ccugcccuuaccugccagg

SEQ ID NO: 6486 - RNA, 18 nt, Homo sapiens
ucccucuggggcuguuca

SEQ ID NO: 6487 - RNA, 19 nt, Homo sapiens
ugguccuaaucuucugaac

SEQ ID NO: 6488 - RNA, 18 nt, Homo sapiens
acagagaggggaauacuu

SEQ ID NO: 6489 - RNA, 18 nt, Homo sapiens
cacuucauagcaccaaca

SEQ ID NO: 6490 - RNA, 18 nt, Homo sapiens
cacuugcacccaugugua

SEQ ID NO: 6491 - RNA, 20 nt, Homo sapiens
ccaacaugcucacucccuua

SEQ ID NO: 6492 - RNA, 19 nt, Homo sapiens
gaagaagggacuggacauu

SEQ ID NO: 6493 - RNA, 20 nt, Homo sapiens
gaacuucacagcccgaguga

SEQ ID NO: 6494 - RNA, 15 nt, Homo sapiens
cacacauuauuaaca

SEQ ID NO: 6495 - RNA, 21 nt, Homo sapiens
ccaggccagacccaucccaaa

SEQ ID NO: 6496 - RNA, 18 nt, Homo sapiens
gcugcugauuucucagcc

SEQ ID NO: 6497 - RNA, 22 nt, Homo sapiens
gugucuuggcugucauaacuuu

SEQ ID NO: 6498 - RNA, 20 nt, Homo sapiens
guuuuauacaucauugucau

SEQ ID NO: 6499 - RNA, 22 nt, Homo sapiens
ucugcuauuugcuguuguguaa

SEQ ID NO: 6500 - RNA, 19 nt, Homo sapiens
ucuuggcugucauaacuuu

SEQ ID NO: 6501 - RNA, 22 nt, Homo sapiens
uuuuuucuugcuguuuugauuu

SEQ ID NO: 6502 - RNA, 23 nt, Homo sapiens
caagaaccugcgucuuggaccau

SEQ ID NO: 6503 - RNA, 19 nt, Homo sapiens
cgccugccccuccugccga

SEQ ID NO: 6504 - RNA, 20 nt, Homo sapiens
cucugucugucuccagcccu

SEQ ID NO: 6505 - RNA, 25 nt, Homo sapiens
cuugggucccaccagugucacuuuu

SEQ ID NO: 6506 - RNA, 25 nt, Homo sapiens
ccccgccccucugucuccccgcagc

SEQ ID NO: 6507 - RNA, 20 nt, Homo sapiens
cccugaauaaaguuuugugg

SEQ ID NO: 6508 - RNA, 19 nt, Homo sapiens
cuccccgccccucugucuc

SEQ ID NO: 6509 - RNA, 19 nt, Homo sapiens
gaagagcuucuguauagua

SEQ ID NO: 6510 - RNA, 21 nt, Homo sapiens
uccuuucuuccucuugccucg

SEQ ID NO: 6511 - RNA, 20 nt, Homo sapiens
ugguuuugaccgugggacua

SEQ ID NO: 6512 - RNA, 20 nt, Homo sapiens
uuccagaauuauuuauucca

SEQ ID NO: 6513 - RNA, 20 nt, Homo sapiens
uuuuccuguuuuuuugcaug

SEQ ID NO: 6514 - RNA, 24 nt, Homo sapiens
accuggcauaggacucuuuggucc

SEQ ID NO: 6515 - RNA, 17 nt, Homo sapiens
acugacaucagcacugc

SEQ ID NO: 6516 - RNA, 20 nt, Homo sapiens
cacugccaacuuggcugcaa

SEQ ID NO: 6517 - RNA, 24 nt, Homo sapiens
cuccagcgccgccgccgccaccgc

SEQ ID NO: 6518 - RNA, 17 nt, Homo sapiens
uuugacugaucagugug

SEQ ID NO: 6519 - RNA, 20 nt, Homo sapiens
aguggaugggugugugugug

SEQ ID NO: 6520 - RNA, 19 nt, Homo sapiens
ggguuuuuugucuucuguu

SEQ ID NO: 6521 - RNA, 19 nt, Homo sapiens
aagggaagaaacacucuua

SEQ ID NO: 6522 - RNA, 23 nt, Homo sapiens
gucgguuugcccaguaucacuua

SEQ ID NO: 6523 - RNA, 22 nt, Homo sapiens
cucgauuaaaaagggagugagc

SEQ ID NO: 6524 - RNA, 21 nt, Homo sapiens
cugguaagcaaaaacuaguaa

SEQ ID NO: 6525 - RNA, 22 nt, Homo sapiens
gagccaagaucacgccacugca

SEQ ID NO: 6526 - RNA, 23 nt, Homo sapiens
gugcauuuuuaucugugaguucu

SEQ ID NO: 6527 - RNA, 23 nt, Homo sapiens
ugagcccuccuggaauggagcug

SEQ ID NO: 6528 - RNA, 22 nt, Homo sapiens
ccaaauguguggaggucugugg

SEQ ID NO: 6529 - RNA, 19 nt, Homo sapiens
ccuguacccuuccuucuuc

SEQ ID NO: 6530 - RNA, 19 nt, Homo sapiens
cgcccgccucagcauccca

SEQ ID NO: 6531 - RNA, 26 nt, Homo sapiens
aucugaauuucuaaaacccuuggucu

SEQ ID NO: 6532 - RNA, 20 nt, Homo sapiens
augguguccugcauguaugc

SEQ ID NO: 6533 - RNA, 19 nt, Homo sapiens
cuugccccuuaccugccga

SEQ ID NO: 6534 - RNA, 21 nt, Homo sapiens
gcagcucagcgcaccgacugc

SEQ ID NO: 6535 - RNA, 21 nt, Homo sapiens
gcagcucagcgcaccgacugc

SEQ ID NO: 6536 - RNA, 18 nt, Homo sapiens
uccucaaguugugugcua

SEQ ID NO: 6537 - RNA, 19 nt, Homo sapiens
gauccagcugaaggacuga

SEQ ID NO: 6538 - RNA, 19 nt, Homo sapiens
gugaggcugcagccucaga

SEQ ID NO: 6539 - RNA, 21 nt, Homo sapiens
aggugucaguuauuguuucca

SEQ ID NO: 6540 - RNA, 20 nt, Homo sapiens
auaauggccuccuuguucac

SEQ ID NO: 6541 - RNA, 19 nt, Homo sapiens
ccagugcaggaacccggug

SEQ ID NO: 6542 - RNA, 20 nt, Homo sapiens
cguccgucacagccauguuc

SEQ ID NO: 6543 - RNA, 17 nt, Homo sapiens
gcgcccuggcugugcug

SEQ ID NO: 6544 - RNA, 18 nt, Homo sapiens
ucauuuuccccugcagcu

SEQ ID NO: 6545 - RNA, 19 nt, Homo sapiens
ucugcuuuugccgcguggu

SEQ ID NO: 6546 - RNA, 20 nt, Homo sapiens
ugaucuuggcugugguuuaa

SEQ ID NO: 6547 - RNA, 24 nt, Homo sapiens
accccagggagcccauccgaccuc

SEQ ID NO: 6548 - RNA, 19 nt, Homo sapiens
aucacucccuugccgucca

SEQ ID NO: 6549 - RNA, 19 nt, Homo sapiens
cggggcccucaucugcuuu

SEQ ID NO: 6550 - RNA, 18 nt, Homo sapiens
gcgacccagcgcccccgc

SEQ ID NO: 6551 - RNA, 20 nt, Homo sapiens
aaguuuaauuagacacuuca

SEQ ID NO: 6552 - RNA, 21 nt, Homo sapiens
aguggcgguggcuauaccaug

SEQ ID NO: 6553 - RNA, 16 nt, Homo sapiens
caccaugccuagcaaa

SEQ ID NO: 6554 - RNA, 18 nt, Homo sapiens
cccgaagaggacuacagc

SEQ ID NO: 6555 - RNA, 19 nt, Homo sapiens
cuugagugggcccugugag

SEQ ID NO: 6556 - RNA, 22 nt, Homo sapiens
ccuguaccucaguggaucuuca

SEQ ID NO: 6557 - RNA, 16 nt, Homo sapiens
cuuucucucuccucuc

SEQ ID NO: 6558 - RNA, 16 nt, Homo sapiens
cagcaggggugugaug

SEQ ID NO: 6559 - RNA, 20 nt, Homo sapiens
uucagguucucaugauacca

SEQ ID NO: 6560 - RNA, 20 nt, Homo sapiens
uuggaauaaggcauggcuca

SEQ ID NO: 6561 - RNA, 20 nt, Homo sapiens
aaaaagggcaauaaaugccc

SEQ ID NO: 6562 - RNA, 23 nt, Homo sapiens
acuugagccuccauuucuggcuu

SEQ ID NO: 6563 - RNA, 20 nt, Homo sapiens
augccgcucuucugucaucc

SEQ ID NO: 6564 - RNA, 18 nt, Homo sapiens
ccaaauucauguacagca

SEQ ID NO: 6565 - RNA, 21 nt, Homo sapiens
ccuccagcuggaauugcugcu

SEQ ID NO: 6566 - RNA, 18 nt, Homo sapiens
gccugcccccagcacucc

SEQ ID NO: 6567 - RNA, 23 nt, Homo sapiens
uggucucccuccagcuggaauug

SEQ ID NO: 6568 - RNA, 19 nt, Homo sapiens
acgaauuaauuaccuggca

SEQ ID NO: 6569 - RNA, 18 nt, Homo sapiens
caggggggcaguaacucc

SEQ ID NO: 6570 - RNA, 17 nt, Homo sapiens
ccccacccaguccugca

SEQ ID NO: 6571 - RNA, 23 nt, Homo sapiens
cccugaugcugccaggccuggga

SEQ ID NO: 6572 - RNA, 23 nt, Homo sapiens
ccuugggagcaggugcuugugga

SEQ ID NO: 6573 - RNA, 20 nt, Homo sapiens
gcagaggaccuuggguuccc

SEQ ID NO: 6574 - RNA, 18 nt, Homo sapiens
gcuuguggacaaggcucc

SEQ ID NO: 6575 - RNA, 24 nt, Homo sapiens
ugcaauggcucaaacaacauucca

SEQ ID NO: 6576 - RNA, 23 nt, Homo sapiens
uuucuugagguugucugagucuu

SEQ ID NO: 6577 - RNA, 20 nt, Homo sapiens
accccaguguccacuuuugg

SEQ ID NO: 6578 - RNA, 17 nt, Homo sapiens
ccuagccucccagcaaa

SEQ ID NO: 6579 - RNA, 20 nt, Homo sapiens
gacgggguucuuuccagucc

SEQ ID NO: 6580 - RNA, 18 nt, Homo sapiens
cccagcgcccccugcagc

SEQ ID NO: 6581 - RNA, 23 nt, Homo sapiens
ccgaacguccgcccgcggugggc

SEQ ID NO: 6582 - RNA, 21 nt, Homo sapiens
cucuccuuccuuuagcccgcu

SEQ ID NO: 6583 - RNA, 19 nt, Homo sapiens
gcaccacgcccgggacccc

SEQ ID NO: 6584 - RNA, 18 nt, Homo sapiens
ugcaaggggaaaaucuca

SEQ ID NO: 6585 - RNA, 20 nt, Homo sapiens
aaacccagcccucacagcuc

SEQ ID NO: 6586 - RNA, 24 nt, Homo sapiens
cagaagaauggcaugaaccuggga

SEQ ID NO: 6587 - RNA, 19 nt, Homo sapiens
cucagagugcuucuaauca

SEQ ID NO: 6588 - RNA, 22 nt, Homo sapiens
gagccaagaucaugccacugca

SEQ ID NO: 6589 - RNA, 22 nt, Homo sapiens
aacucugcaugucaguagacag

SEQ ID NO: 6590 - RNA, 18 nt, Homo sapiens
cauguuauacguacacuu

SEQ ID NO: 6591 - RNA, 23 nt, Homo sapiens
cuguuccacaguccuguauucca

SEQ ID NO: 6592 - RNA, 20 nt, Homo sapiens
uccuuauggguaugcugugg

SEQ ID NO: 6593 - RNA, 17 nt, Homo sapiens
ucucuacuaaaguacaa

SEQ ID NO: 6594 - RNA, 17 nt, Homo sapiens
uuauguuuauacugcca

SEQ ID NO: 6595 - RNA, 20 nt, Homo sapiens
cccgcuuggggcauuugugg

SEQ ID NO: 6596 - RNA, 24 nt, Homo sapiens
cuuuucucuugccccaaaucacaa

SEQ ID NO: 6597 - RNA, 19 nt, Homo sapiens
gaacguuuuaaagcuuacc

SEQ ID NO: 6598 - RNA, 24 nt, Homo sapiens
guguaguuucugguaucguucgcu

SEQ ID NO: 6599 - RNA, 19 nt, Homo sapiens
uguuuguuuggcacugaug

SEQ ID NO: 6600 - RNA, 20 nt, Homo sapiens
aaaaaguuacagaaauacua

SEQ ID NO: 6601 - RNA, 22 nt, Homo sapiens
aaacaguugugaaccaagaucu

SEQ ID NO: 6602 - RNA, 18 nt, Homo sapiens
uaauaucauucacuagcu

SEQ ID NO: 6603 - RNA, 18 nt, Homo sapiens
ucuugcucuaucucucaa

SEQ ID NO: 6604 - RNA, 19 nt, Homo sapiens
aaacuccugaccucaggug

SEQ ID NO: 6605 - RNA, 18 nt, Homo sapiens
agcaauucuccugccuca

SEQ ID NO: 6606 - RNA, 22 nt, Homo sapiens
cuggugguuuuugcucucgaca

SEQ ID NO: 6607 - RNA, 21 nt, Homo sapiens
ccuagcagggaaaaauacaca

SEQ ID NO: 6608 - RNA, 22 nt, Homo sapiens
uaaauggauuccaauaucggga

SEQ ID NO: 6609 - RNA, 20 nt, Homo sapiens
cccaccuucacccgcccacc

SEQ ID NO: 6610 - RNA, 19 nt, Homo sapiens
cucuagacaaaauccauca

SEQ ID NO: 6611 - RNA, 18 nt, Homo sapiens
cuguuuugcuccuaccca

SEQ ID NO: 6612 - RNA, 23 nt, Homo sapiens
gcgagggggcgccccucugggua

SEQ ID NO: 6613 - RNA, 17 nt, Homo sapiens
aacgggaggauggcuuc

SEQ ID NO: 6614 - RNA, 18 nt, Homo sapiens
caacccagcccugcuucu

SEQ ID NO: 6615 - RNA, 17 nt, Homo sapiens
cauccucccaaggcucc

SEQ ID NO: 6616 - RNA, 21 nt, Homo sapiens
gcugccuucagcccugugacg

SEQ ID NO: 6617 - RNA, 21 nt, Homo sapiens
gcuucaugugacucuuggccu

SEQ ID NO: 6618 - RNA, 23 nt, Homo sapiens
augacacaguuuuguauauagaa

SEQ ID NO: 6619 - RNA, 20 nt, Homo sapiens
ccgcucauuugcaguggcuc

SEQ ID NO: 6620 - RNA, 18 nt, Homo sapiens
ccucagcuuagcaucaca

SEQ ID NO: 6621 - RNA, 21 nt, Homo sapiens
gaaguacucacacaugccaca

SEQ ID NO: 6622 - RNA, 23 nt, Homo sapiens
ucacaaugagauuccaguuuaca

SEQ ID NO: 6623 - RNA, 18 nt, Homo sapiens
uuucuuuauacuagcaac

SEQ ID NO: 6624 - RNA, 17 nt, Homo sapiens
acuggguuccaugugau

SEQ ID NO: 6625 - RNA, 22 nt, Homo sapiens
cuuacuuuguggguucuuuuaa

SEQ ID NO: 6626 - RNA, 17 nt, Homo sapiens
uccaugauugauucagu

SEQ ID NO: 6627 - RNA, 21 nt, Homo sapiens
uucuguugguaucacagaaga

SEQ ID NO: 6628 - RNA, 17 nt, Homo sapiens
cgggggcugcacaccca

SEQ ID NO: 6629 - RNA, 23 nt, Homo sapiens
ggaagaggagcugguggcugcca

SEQ ID NO: 6630 - RNA, 22 nt, Homo sapiens
uggccuguucaaggcagaacca

SEQ ID NO: 6631 - RNA, 18 nt, Homo sapiens
ccaggucuacuugccuaa

SEQ ID NO: 6632 - RNA, 20 nt, Homo sapiens
guauggaugucacucaacua

SEQ ID NO: 6633 - RNA, 21 nt, Homo sapiens
ugauacauccugccaacacug

SEQ ID NO: 6634 - RNA, 16 nt, Homo sapiens
ccccaccaucucugaa

SEQ ID NO: 6635 - RNA, 20 nt, Homo sapiens
ugcacuccagccuggggcug

SEQ ID NO: 6636 - RNA, 21 nt, Homo sapiens
cuuucuccucccucugccccu

SEQ ID NO: 6637 - RNA, 18 nt, Homo sapiens
agcacagcgcuucgcucu

SEQ ID NO: 6638 - RNA, 23 nt, Homo sapiens
guuuuuacuuucuguugccacaa

SEQ ID NO: 6639 - RNA, 22 nt, Homo sapiens
gcucugggaacagaggacacug

SEQ ID NO: 6640 - RNA, 18 nt, Homo sapiens
cuugaaaaucagauucua

SEQ ID NO: 6641 - RNA, 23 nt, Homo sapiens
aaaccuuuuccuuuucccuucuu

SEQ ID NO: 6642 - RNA, 20 nt, Homo sapiens
cagauaagagaagccuguuu

SEQ ID NO: 6643 - RNA, 21 nt, Homo sapiens
gacuaucccaagguuauuuua

SEQ ID NO: 6644 - RNA, 18 nt, Homo sapiens
uauagagaaaaaaauuuu

SEQ ID NO: 6645 - RNA, 22 nt, Homo sapiens
uauccugacuaaaaaaauuuca

SEQ ID NO: 6646 - RNA, 19 nt, Homo sapiens
ugguuagcauguuuagcaa

SEQ ID NO: 6647 - RNA, 20 nt, Homo sapiens
uguggauauuucuccauccu

SEQ ID NO: 6648 - RNA, 22 nt, Homo sapiens
uugcugaauuaaauauuuauga

SEQ ID NO: 6649 - RNA, 18 nt, Homo sapiens
ccguucgcgaaacagcuu

SEQ ID NO: 6650 - RNA, 24 nt, Homo sapiens
ugacaaaacuaaagaacucuccua

SEQ ID NO: 6651 - RNA, 18 nt, Homo sapiens
cacuucacacuuguuuua

SEQ ID NO: 6652 - RNA, 20 nt, Homo sapiens
cauguuaugcuaggugcaca

SEQ ID NO: 6653 - RNA, 26 nt, Homo sapiens
cccauaaauggguaacauauuccuaa

SEQ ID NO: 6654 - RNA, 22 nt, Homo sapiens
gccaccacuguaccuugagcaa

SEQ ID NO: 6655 - RNA, 24 nt, Homo sapiens
uaaauggguugccaacauaagcug

SEQ ID NO: 6656 - RNA, 22 nt, Homo sapiens
uacuuccuuaaaguaaauguaa

SEQ ID NO: 6657 - RNA, 22 nt, Homo sapiens
ucacacuuguuuuauuuucuuu

SEQ ID NO: 6658 - RNA, 23 nt, Homo sapiens
gccugugggcgcauacuacagua

SEQ ID NO: 6659 - RNA, 20 nt, Homo sapiens
auuuugaaauuguucccugg

SEQ ID NO: 6660 - RNA, 19 nt, Homo sapiens
aaaucgacagccacugaga

SEQ ID NO: 6661 - RNA, 18 nt, Homo sapiens
ccauggcacaccgagcgg

SEQ ID NO: 6662 - RNA, 16 nt, Homo sapiens
cuauguuaucugagua

SEQ ID NO: 6663 - RNA, 22 nt, Homo sapiens
gguuuguuauaacaaccucugc

SEQ ID NO: 6664 - RNA, 25 nt, Homo sapiens
gucuggcagacagguugccugaccc

SEQ ID NO: 6665 - RNA, 18 nt, Homo sapiens
agauggauccacgugcuc

SEQ ID NO: 6666 - RNA, 18 nt, Homo sapiens
caccauucuccugccuca

SEQ ID NO: 6667 - RNA, 24 nt, Homo sapiens
cauucagcagucagucccccaaua

SEQ ID NO: 6668 - RNA, 18 nt, Homo sapiens
ccagaaggcuggguccag

SEQ ID NO: 6669 - RNA, 18 nt, Homo sapiens
cggcacuccagccugggc

SEQ ID NO: 6670 - RNA, 20 nt, Homo sapiens
ucaccacaaccuccaccucc

SEQ ID NO: 6671 - RNA, 19 nt, Homo sapiens
agauauaacauucaguucc

SEQ ID NO: 6672 - RNA, 20 nt, Homo sapiens
ccaaauauguauuuuccuaa

SEQ ID NO: 6673 - RNA, 20 nt, Homo sapiens
cuucuaacccccucugcucu

SEQ ID NO: 6674 - RNA, 23 nt, Homo sapiens
gccugaucuugccugucuggcuc

SEQ ID NO: 6675 - RNA, 19 nt, Homo sapiens
gggauccuugggcccauca

SEQ ID NO: 6676 - RNA, 18 nt, Homo sapiens
guuuccuggaaaagaaga

SEQ ID NO: 6677 - RNA, 26 nt, Homo sapiens
uacaaucaguugacuuuaagugaaag

SEQ ID NO: 6678 - RNA, 22 nt, Homo sapiens
uccccucuucugcuaauaccuc

SEQ ID NO: 6679 - RNA, 18 nt, Homo sapiens
uccugguuugacucaguu

SEQ ID NO: 6680 - RNA, 26 nt, Homo sapiens
uucuggccaaggggugggccugugaa

SEQ ID NO: 6681 - RNA, 21 nt, Homo sapiens
aaacaauaauuugaaauuucu

SEQ ID NO: 6682 - RNA, 19 nt, Homo sapiens
agaaauagucaauaugcuu

SEQ ID NO: 6683 - RNA, 17 nt, Homo sapiens
aucaccuguaaaagcuu

SEQ ID NO: 6684 - RNA, 21 nt, Homo sapiens
gugucaagcacuguggguuuu

SEQ ID NO: 6685 - RNA, 22 nt, Homo sapiens
uaaaccucagcucaggacugcu

SEQ ID NO: 6686 - RNA, 18 nt, Homo sapiens
caccugcccucccgggca

SEQ ID NO: 6687 - RNA, 18 nt, Homo sapiens
ccccauccucagaacuca

SEQ ID NO: 6688 - RNA, 19 nt, Homo sapiens
gcccccacccccggccuca

SEQ ID NO: 6689 - RNA, 24 nt, Homo sapiens
gugcaccuguuacuguugggcuuu

SEQ ID NO: 6690 - RNA, 20 nt, Homo sapiens
ucaaccuccccccugccucg

SEQ ID NO: 6691 - RNA, 22 nt, Homo sapiens
aaggggggaccagaauucccca

SEQ ID NO: 6692 - RNA, 20 nt, Homo sapiens
augacauaacuacacaguua

SEQ ID NO: 6693 - RNA, 18 nt, Homo sapiens
gacauuuucuagcuacuu

SEQ ID NO: 6694 - RNA, 18 nt, Homo sapiens
uuguucaaucacuaugaa

SEQ ID NO: 6695 - RNA, 18 nt, Homo sapiens
cagcuguucgaaucaucu

SEQ ID NO: 6696 - RNA, 22 nt, Homo sapiens
gcagcuguucgaaucaucugau

SEQ ID NO: 6697 - RNA, 21 nt, Homo sapiens
agcuucuuaaguuaaaucacu

SEQ ID NO: 6698 - RNA, 17 nt, Homo sapiens
caguccuuuaaccagca

SEQ ID NO: 6699 - RNA, 18 nt, Homo sapiens
cuaaugggagccaauuca

SEQ ID NO: 6700 - RNA, 19 nt, Homo sapiens
ugucagucaacugcuguua

SEQ ID NO: 6701 - RNA, 20 nt, Homo sapiens
uguugggauggaagcaugaa

SEQ ID NO: 6702 - RNA, 24 nt, Homo sapiens
aagaaaccgcugauaaccaggaca

SEQ ID NO: 6703 - RNA, 20 nt, Homo sapiens
ccagggcuccucuagccuca

SEQ ID NO: 6704 - RNA, 18 nt, Homo sapiens
ccugucucucaccaacaa

SEQ ID NO: 6705 - RNA, 20 nt, Homo sapiens
uucauaccacauucacaucu

SEQ ID NO: 6706 - RNA, 20 nt, Homo sapiens
uuuuuauuuuugcuuuuaaa

SEQ ID NO: 6707 - RNA, 17 nt, Homo sapiens
gcguguacuaccccagg

SEQ ID NO: 6708 - RNA, 17 nt, Homo sapiens
gcguguacuaccccagg

SEQ ID NO: 6709 - RNA, 17 nt, Homo sapiens
gcguguacuaccccagg

SEQ ID NO: 6710 - RNA, 17 nt, Homo sapiens
gcguguacuaccccagg

SEQ ID NO: 6711 - RNA, 17 nt, Homo sapiens
gcguguacuaccccagg

SEQ ID NO: 6712 - RNA, 18 nt, Homo sapiens
guuguccgugucuguuga

SEQ ID NO: 6713 - RNA, 24 nt, Homo sapiens
ugucuguugaccaaucucuauuca

SEQ ID NO: 6714 - RNA, 19 nt, Homo sapiens
accgggugacaucaccggg

SEQ ID NO: 6715 - RNA, 23 nt, Homo sapiens
cucccccuauagggcuggaaucu

SEQ ID NO: 6716 - RNA, 20 nt, Homo sapiens
cuggguaauaacugcugaua

SEQ ID NO: 6717 - RNA, 22 nt, Homo sapiens
uuucaguugucuuuaacaacau

SEQ ID NO: 6718 - RNA, 18 nt, Homo sapiens
aacaaugucaguguuaaa

SEQ ID NO: 6719 - RNA, 21 nt, Homo sapiens
augccacccuuuuggaagccc

SEQ ID NO: 6720 - RNA, 17 nt, Homo sapiens
cauuuucccaacuauuc

SEQ ID NO: 6721 - RNA, 20 nt, Homo sapiens
cuggcaauuccaaacaaugu

SEQ ID NO: 6722 - RNA, 20 nt, Homo sapiens
uaacaguaugucaccacuuc

SEQ ID NO: 6723 - RNA, 18 nt, Homo sapiens
uuggguucagucucaugc

SEQ ID NO: 6724 - RNA, 19 nt, Homo sapiens
agcgccccucccgcgccuu

SEQ ID NO: 6725 - RNA, 18 nt, Homo sapiens
ccugcaaccuccaccucc

SEQ ID NO: 6726 - RNA, 18 nt, Homo sapiens
gguauacaaauuccucca

SEQ ID NO: 6727 - RNA, 21 nt, Homo sapiens
gugccucagccucccgagcag

SEQ ID NO: 6728 - RNA, 17 nt, Homo sapiens
ucaagcgauucucgugc

SEQ ID NO: 6729 - RNA, 18 nt, Homo sapiens
uccaccucccggguucaa

SEQ ID NO: 6730 - RNA, 18 nt, Homo sapiens
uccgccucccggguucaa

SEQ ID NO: 6731 - RNA, 20 nt, Homo sapiens
uggccaggcuggucuugaac

SEQ ID NO: 6732 - RNA, 25 nt, Homo sapiens
aggaauaaaguugcugauucauucc

SEQ ID NO: 6733 - RNA, 20 nt, Homo sapiens
acccuggaaucaagauguca

SEQ ID NO: 6734 - RNA, 21 nt, Homo sapiens
gaaaucguuugaacccgggaa

SEQ ID NO: 6735 - RNA, 19 nt, Homo sapiens
uccgccuucacuccggugu

SEQ ID NO: 6736 - RNA, 19 nt, Homo sapiens
ccaauaaagcucgguuccu

SEQ ID NO: 6737 - RNA, 18 nt, Homo sapiens
caacuuucccaauguggc

SEQ ID NO: 6738 - RNA, 22 nt, Homo sapiens
cuuucagguacuaaauaccuca

SEQ ID NO: 6739 - RNA, 18 nt, Homo sapiens
uauagacaaauaauaagc

SEQ ID NO: 6740 - RNA, 19 nt, Homo sapiens
cacgugccuguggcugcag

SEQ ID NO: 6741 - RNA, 21 nt, Homo sapiens
cuuaaacagaugcaaauccua

SEQ ID NO: 6742 - RNA, 23 nt, Homo sapiens
cuguuccacaguccuguauucca

SEQ ID NO: 6743 - RNA, 22 nt, Homo sapiens
cagugacuuguccaaguuuaca

SEQ ID NO: 6744 - RNA, 20 nt, Homo sapiens
caugcgcaucuccaugucug

SEQ ID NO: 6745 - RNA, 17 nt, Homo sapiens
gcugagcaacugaaccu

SEQ ID NO: 6746 - RNA, 17 nt, Homo sapiens
ggaucccacucugauug

SEQ ID NO: 6747 - RNA, 18 nt, Homo sapiens
acuugaaagacugcaaua

SEQ ID NO: 6748 - RNA, 21 nt, Homo sapiens
gacugcaauagaaaacuccca

SEQ ID NO: 6749 - RNA, 18 nt, Homo sapiens
gcuaugggaaggcugcaa

SEQ ID NO: 6750 - RNA, 20 nt, Homo sapiens
gcuucucucuuggcccugcu

SEQ ID NO: 6751 - RNA, 16 nt, Homo sapiens
ugcuuugccuugcugc

SEQ ID NO: 6752 - RNA, 18 nt, Homo sapiens
caccaugaggccacccug

SEQ ID NO: 6753 - RNA, 21 nt, Homo sapiens
ucgcuccggccacguccaaca

SEQ ID NO: 6754 - RNA, 19 nt, Homo sapiens
auauaacacggcuaaaaug

SEQ ID NO: 6755 - RNA, 22 nt, Homo sapiens
caugcuuuuuguuagagcuuau

SEQ ID NO: 6756 - RNA, 20 nt, Homo sapiens
cccucgcgccccgccgcagc

SEQ ID NO: 6757 - RNA, 24 nt, Homo sapiens
gaaguuuuuacaguauaugacaua

SEQ ID NO: 6758 - RNA, 20 nt, Homo sapiens
gcuucuguaaucacucaucc

SEQ ID NO: 6759 - RNA, 17 nt, Homo sapiens
gucaguuuaauugccag

SEQ ID NO: 6760 - RNA, 20 nt, Homo sapiens
ugacacaggaugcuacaugc

SEQ ID NO: 6761 - RNA, 22 nt, Homo sapiens
caaggcagacgucguacccagc

SEQ ID NO: 6762 - RNA, 22 nt, Homo sapiens
cauuacccacgugacaccaccg

SEQ ID NO: 6763 - RNA, 17 nt, Homo sapiens
gugaccauagcccacug

SEQ ID NO: 6764 - RNA, 20 nt, Homo sapiens
uggaauccaucugucucccu

SEQ ID NO: 6765 - RNA, 20 nt, Homo sapiens
gagcugugugcuugcgggug

SEQ ID NO: 6766 - RNA, 19 nt, Homo sapiens
gccugcugagccggcugcc

SEQ ID NO: 6767 - RNA, 22 nt, Homo sapiens
ccaauguacauaccuuguuaua

SEQ ID NO: 6768 - RNA, 18 nt, Homo sapiens
ggaggcggcggcggcggc

SEQ ID NO: 6769 - RNA, 23 nt, Homo sapiens
uaacuuaauggcacaaagucuua

SEQ ID NO: 6770 - RNA, 24 nt, Homo sapiens
cagcacccucagaugauuucccuc

SEQ ID NO: 6771 - RNA, 17 nt, Homo sapiens
cagccauccucccaucc

SEQ ID NO: 6772 - RNA, 23 nt, Homo sapiens
cggucuugauuagguuucaguca

SEQ ID NO: 6773 - RNA, 20 nt, Homo sapiens
cugaacuguggcuacugugc

SEQ ID NO: 6774 - RNA, 19 nt, Homo sapiens
gccagcugccucuucuuua

SEQ ID NO: 6775 - RNA, 19 nt, Homo sapiens
gcccccaugccccucugag

SEQ ID NO: 6776 - RNA, 19 nt, Homo sapiens
uaugugucccuugauaaca

SEQ ID NO: 6777 - RNA, 19 nt, Homo sapiens
gcgcccagcgugcacggga

SEQ ID NO: 6778 - RNA, 22 nt, Homo sapiens
agacaacuuggacaaccuguga

SEQ ID NO: 6779 - RNA, 18 nt, Homo sapiens
caacaaugcugguaaggg

SEQ ID NO: 6780 - RNA, 22 nt, Homo sapiens
cacacguaucuaacaaacaaac

SEQ ID NO: 6781 - RNA, 18 nt, Homo sapiens
caggagaagacucuccgc

SEQ ID NO: 6782 - RNA, 20 nt, Homo sapiens
cauguaaggaggacuacugu

SEQ ID NO: 6783 - RNA, 18 nt, Homo sapiens
ccagaggcccucucccca

SEQ ID NO: 6784 - RNA, 19 nt, Homo sapiens
gcaaaaagccagguuuugg

SEQ ID NO: 6785 - RNA, 19 nt, Homo sapiens
ggccgggaagccagucucc

SEQ ID NO: 6786 - RNA, 21 nt, Homo sapiens
ucucuucuuuccuuuagucuu

SEQ ID NO: 6787 - RNA, 18 nt, Homo sapiens
cuuccuccaaauuaacua

SEQ ID NO: 6788 - RNA, 24 nt, Homo sapiens
gccacccccggcccgguuccgggg

SEQ ID NO: 6789 - RNA, 20 nt, Homo sapiens
ggaggagguggugaccacca

SEQ ID NO: 6790 - RNA, 19 nt, Homo sapiens
agcugugguuaagaucuca

SEQ ID NO: 6791 - RNA, 21 nt, Homo sapiens
aggaugcccaccuguccccca

SEQ ID NO: 6792 - RNA, 23 nt, Homo sapiens
cgccucucacccccgacccucca

SEQ ID NO: 6793 - RNA, 16 nt, Homo sapiens
cugacagcccugcgga

SEQ ID NO: 6794 - RNA, 18 nt, Homo sapiens
cuucgcuuccuuagccuu

SEQ ID NO: 6795 - RNA, 17 nt, Homo sapiens
gcgagguguaaaguugu

SEQ ID NO: 6796 - RNA, 18 nt, Homo sapiens
cugcaccacccacuugca

SEQ ID NO: 6797 - RNA, 18 nt, Homo sapiens
gcugacccacauggucaa

SEQ ID NO: 6798 - RNA, 20 nt, Homo sapiens
guggcugugaugugggguua

SEQ ID NO: 6799 - RNA, 23 nt, Homo sapiens
ccaccccucccacauuuacagcc

SEQ ID NO: 6800 - RNA, 17 nt, Homo sapiens
ccuuuuuccgcacuucu

SEQ ID NO: 6801 - RNA, 19 nt, Homo sapiens
guuaaaaagagcuuuuguu

SEQ ID NO: 6802 - RNA, 26 nt, Homo sapiens
uucuggaggcuacuuugcacucuucc

SEQ ID NO: 6803 - RNA, 18 nt, Homo sapiens
acaagacacagcggagcu

SEQ ID NO: 6804 - RNA, 18 nt, Homo sapiens
cuucccuccuccuccccu

SEQ ID NO: 6805 - RNA, 24 nt, Homo sapiens
cccuguccuguggaaauuugugga

SEQ ID NO: 6806 - RNA, 18 nt, Homo sapiens
gcccugccauauaagcca

SEQ ID NO: 6807 - RNA, 19 nt, Homo sapiens
agacaccugcucacucacc

SEQ ID NO: 6808 - RNA, 23 nt, Homo sapiens
agaacuaggacugaacuauuuua

SEQ ID NO: 6809 - RNA, 18 nt, Homo sapiens
cacccucuucccaugucc

SEQ ID NO: 6810 - RNA, 20 nt, Homo sapiens
gacagagucucacuuugaca

SEQ ID NO: 6811 - RNA, 22 nt, Homo sapiens
guauuaucuacaauuauuggca

SEQ ID NO: 6812 - RNA, 18 nt, Homo sapiens
aaauaacacaaaugcuca

SEQ ID NO: 6813 - RNA, 19 nt, Homo sapiens
acacuguuccagugucuau

SEQ ID NO: 6814 - RNA, 18 nt, Homo sapiens
cuuaggcaauuuuuaauu

SEQ ID NO: 6815 - RNA, 24 nt, Homo sapiens
ggucuagaauauguacacgcagcu

SEQ ID NO: 6816 - RNA, 19 nt, Homo sapiens
ucuaaaaacugauugaaug

SEQ ID NO: 6817 - RNA, 23 nt, Homo sapiens
uucuugguggcuucuucauagca

SEQ ID NO: 6818 - RNA, 18 nt, Homo sapiens
gcucuguaaaagcugaca

SEQ ID NO: 6819 - RNA, 19 nt, Homo sapiens
aauccauugaucagaagaa

SEQ ID NO: 6820 - RNA, 19 nt, Homo sapiens
accagaaaccacacauuca

SEQ ID NO: 6821 - RNA, 22 nt, Homo sapiens
augcucagaugaacaacauauu

SEQ ID NO: 6822 - RNA, 21 nt, Homo sapiens
cagaagaacuucaccugcaga

SEQ ID NO: 6823 - RNA, 23 nt, Homo sapiens
acuugggucccacagucuggucc

SEQ ID NO: 6824 - RNA, 17 nt, Homo sapiens
cuacauacaaucaaugu

SEQ ID NO: 6825 - RNA, 21 nt, Homo sapiens
ugcuugguuugcacauguugu

SEQ ID NO: 6826 - RNA, 24 nt, Homo sapiens
cuuaagcaaucuauaaaucauuuu

SEQ ID NO: 6827 - RNA, 19 nt, Homo sapiens
aagcaauucuccugccuca

SEQ ID NO: 6828 - RNA, 18 nt, Homo sapiens
gcauuuucccuugcugua

SEQ ID NO: 6829 - RNA, 20 nt, Homo sapiens
gucucccagucuugucccgg

SEQ ID NO: 6830 - RNA, 18 nt, Homo sapiens
ucagacuccuggguucaa

SEQ ID NO: 6831 - RNA, 20 nt, Homo sapiens
ucgcugccuccuggguucaa

SEQ ID NO: 6832 - RNA, 19 nt, Homo sapiens
ucuuguuucuuacauauca

SEQ ID NO: 6833 - RNA, 24 nt, Homo sapiens
uuuuggaauuaaaagccacugacu

SEQ ID NO: 6834 - RNA, 17 nt, Homo sapiens
ccaccacccuucccucu

SEQ ID NO: 6835 - RNA, 21 nt, Homo sapiens
agaaauaaaaagccugucauu

SEQ ID NO: 6836 - RNA, 26 nt, Homo sapiens
cucucucucucuuuuuugggggcuca

SEQ ID NO: 6837 - RNA, 21 nt, Homo sapiens
cugugcuccuguuuugucuug

SEQ ID NO: 6838 - RNA, 18 nt, Homo sapiens
aaaacaaacagaacccaa

SEQ ID NO: 6839 - RNA, 20 nt, Homo sapiens
aaaacaaacagaacccaaac

SEQ ID NO: 6840 - RNA, 18 nt, Homo sapiens
acuuggcauucaacauua

SEQ ID NO: 6841 - RNA, 22 nt, Homo sapiens
aguacuugacccugagcggcgc

SEQ ID NO: 6842 - RNA, 20 nt, Homo sapiens
caagaaaaaggcagugccuc

SEQ ID NO: 6843 - RNA, 18 nt, Homo sapiens
cguccuucuccacaccca

SEQ ID NO: 6844 - RNA, 18 nt, Homo sapiens
cuccacacccagcacccc

SEQ ID NO: 6845 - RNA, 18 nt, Homo sapiens
gagcgccugaccuuccuc

SEQ ID NO: 6846 - RNA, 16 nt, Homo sapiens
ggcccacccugcggug

SEQ ID NO: 6847 - RNA, 24 nt, Homo sapiens
gggauaacccuuccuucgauacca

SEQ ID NO: 6848 - RNA, 24 nt, Homo sapiens
uccacagcgucuucuccuguuccu

SEQ ID NO: 6849 - RNA, 21 nt, Homo sapiens
uccuggaccaaggcuugggaa

SEQ ID NO: 6850 - RNA, 20 nt, Homo sapiens
cuuccuuccuguucuaacug

SEQ ID NO: 6851 - RNA, 18 nt, Homo sapiens
ccgcaugggccuugucuu

SEQ ID NO: 6852 - RNA, 21 nt, Homo sapiens
gccccuccuccacucuccucu

SEQ ID NO: 6853 - RNA, 19 nt, Homo sapiens
aaguaacuacacuaccuca

SEQ ID NO: 6854 - RNA, 19 nt, Homo sapiens
aaguaacuacacuaccuca

SEQ ID NO: 6855 - RNA, 19 nt, Homo sapiens
aaguuguaaugcagaugga

SEQ ID NO: 6856 - RNA, 19 nt, Homo sapiens
auacuguuuuuuuccuuua

SEQ ID NO: 6857 - RNA, 21 nt, Homo sapiens
caccgugggucaccaaugcca

SEQ ID NO: 6858 - RNA, 15 nt, Homo sapiens
cccuuuuugaucagg

SEQ ID NO: 6859 - RNA, 20 nt, Homo sapiens
gcaauguuacggugaauucu

SEQ ID NO: 6860 - RNA, 23 nt, Homo sapiens
accgcagugccgcugccuggccc

SEQ ID NO: 6861 - RNA, 20 nt, Homo sapiens
ccaaggggugcgaaacccug

SEQ ID NO: 6862 - RNA, 20 nt, Homo sapiens
aggcgaaguucauuguucuc

SEQ ID NO: 6863 - RNA, 18 nt, Homo sapiens
ccagaccaaagccaugcc

SEQ ID NO: 6864 - RNA, 21 nt, Homo sapiens
ccccaccguggccccccacgc

SEQ ID NO: 6865 - RNA, 20 nt, Homo sapiens
caacccucggcuccgccgcc

SEQ ID NO: 6866 - RNA, 18 nt, Homo sapiens
cgcggagcccggcccgga

SEQ ID NO: 6867 - RNA, 22 nt, Homo sapiens
gcagcuucccugagccuuucca

SEQ ID NO: 6868 - RNA, 22 nt, Homo sapiens
aacaaaaaguuaaacuuacaag

SEQ ID NO: 6869 - RNA, 23 nt, Homo sapiens
uccuuucaaacuguauugugaua

SEQ ID NO: 6870 - RNA, 23 nt, Homo sapiens
caccgaagccguucugacuggca

SEQ ID NO: 6871 - RNA, 24 nt, Homo sapiens
uaugcuuuuaguuaacaucauuau

SEQ ID NO: 6872 - RNA, 19 nt, Homo sapiens
aagaaaccuagaccagaga

SEQ ID NO: 6873 - RNA, 19 nt, Homo sapiens
aagagguuacuuccuccca

SEQ ID NO: 6874 - RNA, 21 nt, Homo sapiens
cauuucagacacuccucagca

SEQ ID NO: 6875 - RNA, 22 nt, Homo sapiens
ucucuauuuucaaaaaauacaa

SEQ ID NO: 6876 - RNA, 24 nt, Homo sapiens
cggaucucagucccuggcugcuuu

SEQ ID NO: 6877 - RNA, 20 nt, Homo sapiens
aagagauauacauugugaua

SEQ ID NO: 6878 - RNA, 18 nt, Homo sapiens
auauucuuccccgaauca

SEQ ID NO: 6879 - RNA, 20 nt, Homo sapiens
ccaaauccaaccuccuguca

SEQ ID NO: 6880 - RNA, 19 nt, Homo sapiens
cggagcucccgggcacauc

SEQ ID NO: 6881 - RNA, 19 nt, Homo sapiens
gaugucaaaucgugguuua

SEQ ID NO: 6882 - RNA, 18 nt, Homo sapiens
agcuucugguuucacaug

SEQ ID NO: 6883 - RNA, 22 nt, Homo sapiens
auuagcucuuuacucuuucuca

SEQ ID NO: 6884 - RNA, 20 nt, Homo sapiens
cuauaucuuuguggauaaua

SEQ ID NO: 6885 - RNA, 19 nt, Homo sapiens
gcagcaagcauuauacggu

SEQ ID NO: 6886 - RNA, 18 nt, Homo sapiens
uaggggccacauauuaca

SEQ ID NO: 6887 - RNA, 18 nt, Homo sapiens
ugguuucacaugaaauug

SEQ ID NO: 6888 - RNA, 21 nt, Homo sapiens
ugucauugaaagugccuuuaa

SEQ ID NO: 6889 - RNA, 19 nt, Homo sapiens
auguuauuguuuucaaccu

SEQ ID NO: 6890 - RNA, 17 nt, Homo sapiens
gugaaguuguaaacaca

SEQ ID NO: 6891 - RNA, 18 nt, Homo sapiens
uccccaucauccacgcca

SEQ ID NO: 6892 - RNA, 18 nt, Homo sapiens
uccugaccucaugaucca

SEQ ID NO: 6893 - RNA, 18 nt, Homo sapiens
uucuccugccucagccuu

SEQ ID NO: 6894 - RNA, 20 nt, Homo sapiens
ucuguauugaaaauggcuuu

SEQ ID NO: 6895 - RNA, 21 nt, Homo sapiens
aaacagaaaccauucuaggug

SEQ ID NO: 6896 - RNA, 16 nt, Homo sapiens
aauaacacugucuccu

SEQ ID NO: 6897 - RNA, 19 nt, Homo sapiens
gccuuggccgccugagccc

SEQ ID NO: 6898 - RNA, 23 nt, Homo sapiens
acuuuccucgccugacaaccacu

SEQ ID NO: 6899 - RNA, 19 nt, Homo sapiens
cacguggccucuugagcag

SEQ ID NO: 6900 - RNA, 22 nt, Homo sapiens
cucacccugccuuaucuugcac

SEQ ID NO: 6901 - RNA, 21 nt, Homo sapiens
uccugaguggugccaaacaaa

SEQ ID NO: 6902 - RNA, 19 nt, Homo sapiens
aacugggaugggagguuga

SEQ ID NO: 6903 - RNA, 18 nt, Homo sapiens
agucucacauauucauca

SEQ ID NO: 6904 - RNA, 17 nt, Homo sapiens
ucagcuggcuuccuagc

SEQ ID NO: 6905 - RNA, 21 nt, Homo sapiens
agccagguaccuucucaccug

SEQ ID NO: 6906 - RNA, 25 nt, Homo sapiens
cucccggcgccgccgccgccacugc

SEQ ID NO: 6907 - RNA, 19 nt, Homo sapiens
aaacagauggcaggauggg

SEQ ID NO: 6908 - RNA, 20 nt, Homo sapiens
accaccaggcccacagccca

SEQ ID NO: 6909 - RNA, 20 nt, Homo sapiens
acccagagccuaggggaucc

SEQ ID NO: 6910 - RNA, 21 nt, Homo sapiens
ggacccuccuggugcugccca

SEQ ID NO: 6911 - RNA, 20 nt, Homo sapiens
gugccugugguuguuucucc

SEQ ID NO: 6912 - RNA, 19 nt, Homo sapiens
uugcccagggacuuccucc

SEQ ID NO: 6913 - RNA, 22 nt, Homo sapiens
acaaguucaaagacuuuuacuu

SEQ ID NO: 6914 - RNA, 23 nt, Homo sapiens
acagagaaguggggaauccaguc

SEQ ID NO: 6915 - RNA, 25 nt, Homo sapiens
gagacuaguaccagagcagcuagca

SEQ ID NO: 6916 - RNA, 18 nt, Homo sapiens
ugcagauggccuaaugcu

SEQ ID NO: 6917 - RNA, 19 nt, Homo sapiens
agccacagucccagaacca

SEQ ID NO: 6918 - RNA, 26 nt, Homo sapiens
aucuggccagagggcugucuggaccu

SEQ ID NO: 6919 - RNA, 16 nt, Homo sapiens
ccucauguguuccacu

SEQ ID NO: 6920 - RNA, 21 nt, Homo sapiens
uuuucuggacaccaacugugu

SEQ ID NO: 6921 - RNA, 19 nt, Homo sapiens
uacucuaugauuuacuaac

SEQ ID NO: 6922 - RNA, 17 nt, Homo sapiens
uugaagaauugaccuca

SEQ ID NO: 6923 - RNA, 23 nt, Homo sapiens
ccuuucagccacccaauaucucg

SEQ ID NO: 6924 - RNA, 20 nt, Homo sapiens
uggccaggcuggucuugaac

SEQ ID NO: 6925 - RNA, 18 nt, Homo sapiens
aucuguauguauauauac

SEQ ID NO: 6926 - RNA, 22 nt, Homo sapiens
augacauaugacuugaucuucu

SEQ ID NO: 6927 - RNA, 17 nt, Homo sapiens
acucaaaaagcgcucaa

SEQ ID NO: 6928 - RNA, 21 nt, Homo sapiens
ccuccuuaaaacucugccguu

SEQ ID NO: 6929 - RNA, 19 nt, Homo sapiens
auugaauguucugaucaga

SEQ ID NO: 6930 - RNA, 26 nt, Homo sapiens
uggacagcauuaacaagaaugagaua

SEQ ID NO: 6931 - RNA, 24 nt, Homo sapiens
uguaugaugagcuauguuuggcug

SEQ ID NO: 6932 - RNA, 20 nt, Homo sapiens
uuaaaacagccuguaauuau

SEQ ID NO: 6933 - RNA, 19 nt, Homo sapiens
uguugaagaaaauucaucu

SEQ ID NO: 6934 - RNA, 15 nt, Homo sapiens
agugggaaaauuuca

SEQ ID NO: 6935 - RNA, 24 nt, Homo sapiens
uaaccucauagcagcuuugguuuu

SEQ ID NO: 6936 - RNA, 23 nt, Homo sapiens
uaccuugaauuuacagugggaaa

SEQ ID NO: 6937 - RNA, 22 nt, Homo sapiens
uucugcuggugauaaacucuuu

SEQ ID NO: 6938 - RNA, 22 nt, Homo sapiens
uuuugauguccuugucugcgaa

SEQ ID NO: 6939 - RNA, 20 nt, Homo sapiens
uaggugcccggccccacacc

SEQ ID NO: 6940 - RNA, 18 nt, Homo sapiens
ugcaggggagcuugcggg

SEQ ID NO: 6941 - RNA, 18 nt, Homo sapiens
agcucuaucaccaaggag

SEQ ID NO: 6942 - RNA, 18 nt, Homo sapiens
ggagccaaacauccuaca

SEQ ID NO: 6943 - RNA, 18 nt, Homo sapiens
ccauggcugaagcggagc

SEQ ID NO: 6944 - RNA, 24 nt, Homo sapiens
cccuuccuccugauggagugugca

SEQ ID NO: 6945 - RNA, 19 nt, Homo sapiens
cucuccugcccucugcucu

SEQ ID NO: 6946 - RNA, 22 nt, Homo sapiens
cugcccuuccuccugauggagu

SEQ ID NO: 6947 - RNA, 21 nt, Homo sapiens
ucugaaaacaagguuuccaua

SEQ ID NO: 6948 - RNA, 23 nt, Homo sapiens
accugggcugugcucuccggcuc

SEQ ID NO: 6949 - RNA, 25 nt, Homo sapiens
accuugagaaucuccaagagaaaaa

SEQ ID NO: 6950 - RNA, 23 nt, Homo sapiens
caacccaugaacucuucacuccu

SEQ ID NO: 6951 - RNA, 22 nt, Homo sapiens
caccaucuuugucccuggcaaa

SEQ ID NO: 6952 - RNA, 20 nt, Homo sapiens
cauguuggacugagaccuaa

SEQ ID NO: 6953 - RNA, 19 nt, Homo sapiens
ccuucaaccaugcugugau

SEQ ID NO: 6954 - RNA, 22 nt, Homo sapiens
uaagaucaucccagagguucag

SEQ ID NO: 6955 - RNA, 17 nt, Homo sapiens
ucucagguccaguucaa

SEQ ID NO: 6956 - RNA, 23 nt, Homo sapiens
uguugcccuaagaaugcuucuca

SEQ ID NO: 6957 - RNA, 21 nt, Homo sapiens
uuucuucaugauacuuagucu

SEQ ID NO: 6958 - RNA, 19 nt, Homo sapiens
aagugagcaucugggcauu

SEQ ID NO: 6959 - RNA, 19 nt, Homo sapiens
cagcagccgccugcccuga

SEQ ID NO: 6960 - RNA, 21 nt, Homo sapiens
ccuaaacugacuggacggcug

SEQ ID NO: 6961 - RNA, 21 nt, Homo sapiens
cuuuuucauuuccuuaaguuu

SEQ ID NO: 6962 - RNA, 19 nt, Homo sapiens
gugguuugacucuccuuag

SEQ ID NO: 6963 - RNA, 19 nt, Homo sapiens
cagcuucacacuggcgcca

SEQ ID NO: 6964 - RNA, 19 nt, Homo sapiens
cuugggagcugcuuggccu

SEQ ID NO: 6965 - RNA, 22 nt, Homo sapiens
acaggucuucauacuuuuacuu

SEQ ID NO: 6966 - RNA, 18 nt, Homo sapiens
caaucucacccugcuccu

SEQ ID NO: 6967 - RNA, 25 nt, Homo sapiens
ggaggcaggaggcugacaacuggca

SEQ ID NO: 6968 - RNA, 17 nt, Homo sapiens
uccaggucugacucagu

SEQ ID NO: 6969 - RNA, 17 nt, Homo sapiens
ccagaauccacugucaa

SEQ ID NO: 6970 - RNA, 18 nt, Homo sapiens
gcacaguggcuccgugug

SEQ ID NO: 6971 - RNA, 21 nt, Homo sapiens
acaagagaacgagccagaguu

SEQ ID NO: 6972 - RNA, 21 nt, Homo sapiens
gugagguaaccagguggcauc

SEQ ID NO: 6973 - RNA, 20 nt, Homo sapiens
guuuuauaaggaauuuugua

SEQ ID NO: 6974 - RNA, 20 nt, Homo sapiens
ccccgccacccucccacugc

SEQ ID NO: 6975 - RNA, 18 nt, Homo sapiens
gcuuuauugcagcgauua

SEQ ID NO: 6976 - RNA, 18 nt, Homo sapiens
uuucuguucuuccaucac

SEQ ID NO: 6977 - RNA, 19 nt, Homo sapiens
cacagaaaaaagcaucuca

SEQ ID NO: 6978 - RNA, 17 nt, Homo sapiens
gaagagacauccccucc

SEQ ID NO: 6979 - RNA, 16 nt, Homo sapiens
auacaaaaaaggaauu

SEQ ID NO: 6980 - RNA, 18 nt, Homo sapiens
cagccagucccuuccgau

SEQ ID NO: 6981 - RNA, 19 nt, Homo sapiens
acacaugguuuucagauga

SEQ ID NO: 6982 - RNA, 16 nt, Homo sapiens
agaauccagaaacauu

SEQ ID NO: 6983 - RNA, 21 nt, Homo sapiens
auuaauguaucaguuauccca

SEQ ID NO: 6984 - RNA, 24 nt, Homo sapiens
gcaguuuugaacuucccuuccuua

SEQ ID NO: 6985 - RNA, 24 nt, Homo sapiens
guggcuuuaguauuuuucuuuguu

SEQ ID NO: 6986 - RNA, 24 nt, Homo sapiens
uaaaugcccacuugaaugaagcug

SEQ ID NO: 6987 - RNA, 18 nt, Homo sapiens
cccuuggaaguccugggg

SEQ ID NO: 6988 - RNA, 22 nt, Homo sapiens
cuucuuugugguuucuguuuug

SEQ ID NO: 6989 - RNA, 18 nt, Homo sapiens
ccgccuggccuucgggga

SEQ ID NO: 6990 - RNA, 20 nt, Homo sapiens
aggagagaugaguggcuauu

SEQ ID NO: 6991 - RNA, 22 nt, Homo sapiens
uagguggaccuuggauuuuggc

SEQ ID NO: 6992 - RNA, 16 nt, Homo sapiens
agagcaguagaggaug

SEQ ID NO: 6993 - RNA, 18 nt, Homo sapiens
gaggaggaggcagccaga

SEQ ID NO: 6994 - RNA, 16 nt, Homo sapiens
gggaagaacuacauua

SEQ ID NO: 6995 - RNA, 18 nt, Homo sapiens
ucacugauuaaaacagcu

SEQ ID NO: 6996 - RNA, 22 nt, Homo sapiens
ugagccauuccagcauaagcug

SEQ ID NO: 6997 - RNA, 21 nt, Homo sapiens
uguaauuguaugucugugugu

SEQ ID NO: 6998 - RNA, 16 nt, Homo sapiens
augguguuuucauucc

SEQ ID NO: 6999 - RNA, 22 nt, Homo sapiens
uucugaauucaaagcuugugaa

SEQ ID NO: 7000 - RNA, 18 nt, Homo sapiens
aguaaaggccucaucucc

SEQ ID NO: 7001 - RNA, 22 nt, Homo sapiens
caagugauaucaccucucuuca

SEQ ID NO: 7002 - RNA, 22 nt, Homo sapiens
cccauaccuucugguugcuuca

SEQ ID NO: 7003 - RNA, 20 nt, Homo sapiens
ggggucgcggcagccgcacc

SEQ ID NO: 7004 - RNA, 20 nt, Homo sapiens
gguggaagggggugugcgug

SEQ ID NO: 7005 - RNA, 18 nt, Homo sapiens
ucccaauaacuaaugcua

SEQ ID NO: 7006 - RNA, 18 nt, Homo sapiens
agcuugucucccucgauc

SEQ ID NO: 7007 - RNA, 26 nt, Homo sapiens
gccucggcuaaccaaaaugcugcacc

SEQ ID NO: 7008 - RNA, 21 nt, Homo sapiens
acgugcgcucggagcgguaga

SEQ ID NO: 7009 - RNA, 18 nt, Homo sapiens
gcgcagcggucgcuuggc

SEQ ID NO: 7010 - RNA, 22 nt, Homo sapiens
ucaugcacgcagacuccugcaa

SEQ ID NO: 7011 - RNA, 20 nt, Homo sapiens
cucuccuuguccccaucugg

SEQ ID NO: 7012 - RNA, 20 nt, Homo sapiens
ucuguuuuuuccauccccac

SEQ ID NO: 7013 - RNA, 25 nt, Homo sapiens
uuccgucucuccuuccgcuucuuug

SEQ ID NO: 7014 - RNA, 23 nt, Homo sapiens
aggaaauauuaagagcuauuuua

SEQ ID NO: 7015 - RNA, 22 nt, Homo sapiens
augaaucgcaaguuaacuugga

SEQ ID NO: 7016 - RNA, 22 nt, Homo sapiens
cccuucuuguagagagauggac

SEQ ID NO: 7017 - RNA, 18 nt, Homo sapiens
uaccuacaaaagauucua

SEQ ID NO: 7018 - RNA, 21 nt, Homo sapiens
agccagaucaaggauguagua

SEQ ID NO: 7019 - RNA, 17 nt, Homo sapiens
ucaagugauucuccugc

SEQ ID NO: 7020 - RNA, 17 nt, Homo sapiens
uccaccuucagguucaa

SEQ ID NO: 7021 - RNA, 19 nt, Homo sapiens
accacaucccuucauauca

SEQ ID NO: 7022 - RNA, 18 nt, Homo sapiens
auuauucaucucuccucc

SEQ ID NO: 7023 - RNA, 18 nt, Homo sapiens
cuuagacacuuuggaauc

SEQ ID NO: 7024 - RNA, 17 nt, Homo sapiens
aagggaauaaaccgcga

SEQ ID NO: 7025 - RNA, 21 nt, Homo sapiens
caccccuaacagagccagugc

SEQ ID NO: 7026 - RNA, 21 nt, Homo sapiens
ccgcgaagaaggagcgccccg

SEQ ID NO: 7027 - RNA, 27 nt, Homo sapiens
ugaauggacuuagggcccaugagguug

SEQ ID NO: 7028 - RNA, 20 nt, Homo sapiens
ugagguuguggcuggcuuag

SEQ ID NO: 7029 - RNA, 20 nt, Homo sapiens
gcccggaggaggguuugcgg

SEQ ID NO: 7030 - RNA, 20 nt, Homo sapiens
ugacagagcgagacccugcc

SEQ ID NO: 7031 - RNA, 19 nt, Homo sapiens
ggagugugcuggugaucgc

SEQ ID NO: 7032 - RNA, 18 nt, Homo sapiens
aagacaguacaaaaacac

SEQ ID NO: 7033 - RNA, 21 nt, Homo sapiens
cccgccuacccccaucccaaa

SEQ ID NO: 7034 - RNA, 18 nt, Homo sapiens
gauuguugaacgcagcuu

SEQ ID NO: 7035 - RNA, 28 nt, Homo sapiens
gcaguucucccgugagagggccuucgcg

SEQ ID NO: 7036 - RNA, 22 nt, Homo sapiens
gcaguuuuagucaguuuuaguu

SEQ ID NO: 7037 - RNA, 20 nt, Homo sapiens
gccgcccucucaguuucggg

SEQ ID NO: 7038 - RNA, 26 nt, Homo sapiens
uccugcuucacaaaauggccaccgca

SEQ ID NO: 7039 - RNA, 24 nt, Homo sapiens
ccugugagcgcccacccucucgaa

SEQ ID NO: 7040 - RNA, 21 nt, Homo sapiens
gcaggugggcucugcuucccg

SEQ ID NO: 7041 - RNA, 23 nt, Homo sapiens
aagagagguggggggagagccug

SEQ ID NO: 7042 - RNA, 19 nt, Homo sapiens
gugcuuuggcccggugcuu

SEQ ID NO: 7043 - RNA, 21 nt, Homo sapiens
augaaagaggcagaguuuauc

SEQ ID NO: 7044 - RNA, 20 nt, Homo sapiens
guuuucuuguugaucucaug

SEQ ID NO: 7045 - RNA, 23 nt, Homo sapiens
ccauccucucccacacacauucc

SEQ ID NO: 7046 - RNA, 18 nt, Homo sapiens
ccugcccucccccauccu

SEQ ID NO: 7047 - RNA, 21 nt, Homo sapiens
uuccagagacuaugugcccag

SEQ ID NO: 7048 - RNA, 18 nt, Homo sapiens
cagcacuuugggaagcca

SEQ ID NO: 7049 - RNA, 16 nt, Homo sapiens
cuuugggaggcugaga

SEQ ID NO: 7050 - RNA, 20 nt, Homo sapiens
aaugauuauccauauguguu

SEQ ID NO: 7051 - RNA, 17 nt, Homo sapiens
agugugucuggcucuga

SEQ ID NO: 7052 - RNA, 21 nt, Homo sapiens
uugcccaaacauucuuucuuu

SEQ ID NO: 7053 - RNA, 17 nt, Homo sapiens
auccauccugcaaaggc

SEQ ID NO: 7054 - RNA, 19 nt, Homo sapiens
cuugaauuagccugcgcuc

SEQ ID NO: 7055 - RNA, 23 nt, Homo sapiens
ugaauaugguuggagagcccugg

SEQ ID NO: 7056 - RNA, 23 nt, Homo sapiens
ugucucugcuccuacauccagcu

SEQ ID NO: 7057 - RNA, 21 nt, Homo sapiens
acucaggccccgaagcugucc

SEQ ID NO: 7058 - RNA, 18 nt, Homo sapiens
augcguguuguuuggcug

SEQ ID NO: 7059 - RNA, 18 nt, Homo sapiens
ggauaugccaucauggca

SEQ ID NO: 7060 - RNA, 19 nt, Homo sapiens
gugcagcuacaggauaugc

SEQ ID NO: 7061 - RNA, 20 nt, Homo sapiens
caccgagccucauuaaccca

SEQ ID NO: 7062 - RNA, 20 nt, Homo sapiens
caguucagaagugcuaagcu

SEQ ID NO: 7063 - RNA, 21 nt, Homo sapiens
cuccuucucucucucucucuc

SEQ ID NO: 7064 - RNA, 23 nt, Homo sapiens
gguuguuuugguuguuuucuuaa

SEQ ID NO: 7065 - RNA, 21 nt, Homo sapiens
guaugaggcugcagaaccgga

SEQ ID NO: 7066 - RNA, 20 nt, Homo sapiens
ugucucucuacacauuuugc

SEQ ID NO: 7067 - RNA, 18 nt, Homo sapiens
uuuuuguaaccacugucu

SEQ ID NO: 7068 - RNA, 18 nt, Homo sapiens
aaugguacaccgauauuu

SEQ ID NO: 7069 - RNA, 24 nt, Homo sapiens
accagagaaaaguacacacugggc

SEQ ID NO: 7070 - RNA, 24 nt, Homo sapiens
auuacuaacucuccaagcauagaa

SEQ ID NO: 7071 - RNA, 19 nt, Homo sapiens
ccaagcauagaaaucccug

SEQ ID NO: 7072 - RNA, 19 nt, Homo sapiens
gauccuggcacauccauga

SEQ ID NO: 7073 - RNA, 21 nt, Homo sapiens
gcacugcccuugggacuuccg

SEQ ID NO: 7074 - RNA, 18 nt, Homo sapiens
uggggaauccaaguggua

SEQ ID NO: 7075 - RNA, 16 nt, Homo sapiens
ccuugggugccccaca

SEQ ID NO: 7076 - RNA, 19 nt, Homo sapiens
ggguguccuaaagugccuc

SEQ ID NO: 7077 - RNA, 19 nt, Homo sapiens
ccggcuggcgcacgggagg

SEQ ID NO: 7078 - RNA, 20 nt, Homo sapiens
cucuccuucagaaccccgcu

SEQ ID NO: 7079 - RNA, 24 nt, Homo sapiens
aaguuguugaucagacccuucucu

SEQ ID NO: 7080 - RNA, 18 nt, Homo sapiens
cacucagaagcuaaccuc

SEQ ID NO: 7081 - RNA, 20 nt, Homo sapiens
cucuccuucagaaccccgcu

SEQ ID NO: 7082 - RNA, 20 nt, Homo sapiens
cugaaccuguggucaggcuc

SEQ ID NO: 7083 - RNA, 17 nt, Homo sapiens
gggagacgagaggguca

SEQ ID NO: 7084 - RNA, 18 nt, Homo sapiens
uucaaguuguugaucaga

SEQ ID NO: 7085 - RNA, 16 nt, Homo sapiens
acacagaugaacaacc

SEQ ID NO: 7086 - RNA, 21 nt, Homo sapiens
caguauauuaagauuaccuuc

SEQ ID NO: 7087 - RNA, 20 nt, Homo sapiens
ucaacuugaauacugguguu

SEQ ID NO: 7088 - RNA, 18 nt, Homo sapiens
uguuuauaaacuuuacuc

SEQ ID NO: 7089 - RNA, 18 nt, Homo sapiens
aaaguugggacugagcag

SEQ ID NO: 7090 - RNA, 19 nt, Homo sapiens
gggcagcgcuggcgccagc

SEQ ID NO: 7091 - RNA, 22 nt, Homo sapiens
ucuggugggcuguuuuguuuuu

SEQ ID NO: 7092 - RNA, 22 nt, Homo sapiens
aucuucauggauagcucagagg

SEQ ID NO: 7093 - RNA, 20 nt, Homo sapiens
ccaucuucauggauagcuca

SEQ ID NO: 7094 - RNA, 22 nt, Homo sapiens
ucuguucauccugaacauuuuu

SEQ ID NO: 7095 - RNA, 22 nt, Homo sapiens
uucaagauuacaacaucuguua

SEQ ID NO: 7096 - RNA, 18 nt, Homo sapiens
cccaagcuucccaacaga

SEQ ID NO: 7097 - RNA, 20 nt, Homo sapiens
cuccccucucucccgccccu

SEQ ID NO: 7098 - RNA, 20 nt, Homo sapiens
gccugggcucagccugguuu

SEQ ID NO: 7099 - RNA, 17 nt, Homo sapiens
gugacucuuagcccuca

SEQ ID NO: 7100 - RNA, 18 nt, Homo sapiens
uccucuaggcccugugag

SEQ ID NO: 7101 - RNA, 17 nt, Homo sapiens
ucgagagccuuacuuca

SEQ ID NO: 7102 - RNA, 22 nt, Homo sapiens
acuuuugcuauuuugucugcug

SEQ ID NO: 7103 - RNA, 19 nt, Homo sapiens
ccugcagagggucggugga

SEQ ID NO: 7104 - RNA, 21 nt, Homo sapiens
uguggugggggcggaaaaagc

SEQ ID NO: 7105 - RNA, 16 nt, Homo sapiens
aacguccaucugagga

SEQ ID NO: 7106 - RNA, 19 nt, Homo sapiens
cuggggggccugccccuca

SEQ ID NO: 7107 - RNA, 19 nt, Homo sapiens
gcacucaugcccugcuccu

SEQ ID NO: 7108 - RNA, 18 nt, Homo sapiens
ggaaaggacaaagccaca

SEQ ID NO: 7109 - RNA, 16 nt, Homo sapiens
ugccccucauacgcca

SEQ ID NO: 7110 - RNA, 20 nt, Homo sapiens
ccauauuuuauguugcuuua

SEQ ID NO: 7111 - RNA, 24 nt, Homo sapiens
ccuccaggcugaaagacuguugua

SEQ ID NO: 7112 - RNA, 20 nt, Homo sapiens
ucuuuuuaggccuucauuuu

SEQ ID NO: 7113 - RNA, 22 nt, Homo sapiens
ugaauggauucgaaugaaauug

SEQ ID NO: 7114 - RNA, 21 nt, Homo sapiens
ugcgcgccaccacacuuggcu

SEQ ID NO: 7115 - RNA, 19 nt, Homo sapiens
cacaaaacugaucaguuuu

SEQ ID NO: 7116 - RNA, 22 nt, Homo sapiens
ccuucccucccccuuuuuuuug

SEQ ID NO: 7117 - RNA, 26 nt, Homo sapiens
ugcccuugaagugguuuuugugggug

SEQ ID NO: 7118 - RNA, 26 nt, Homo sapiens
uuuuuuuguaguguaaugucuuaauc

SEQ ID NO: 7119 - RNA, 21 nt, Homo sapiens
cucuggggugggagggucugc

SEQ ID NO: 7120 - RNA, 18 nt, Homo sapiens
gccugcccucccaccccc

SEQ ID NO: 7121 - RNA, 19 nt, Homo sapiens
ccguugucagcucucugaa

SEQ ID NO: 7122 - RNA, 18 nt, Homo sapiens
cuaccuggcucuaucuca

SEQ ID NO: 7123 - RNA, 19 nt, Homo sapiens
gccacggaaacaacucuaa

SEQ ID NO: 7124 - RNA, 18 nt, Homo sapiens
ggcagccaggaguucccg

SEQ ID NO: 7125 - RNA, 20 nt, Homo sapiens
gguccagcccagaaugcagc

SEQ ID NO: 7126 - RNA, 18 nt, Homo sapiens
uaacccugacuccuucac

SEQ ID NO: 7127 - RNA, 21 nt, Homo sapiens
uacuuguuggucuguaucuua

SEQ ID NO: 7128 - RNA, 21 nt, Homo sapiens
ucucuucguggcucccugcuu

SEQ ID NO: 7129 - RNA, 22 nt, Homo sapiens
uugccuggaucuccuccccucu

SEQ ID NO: 7130 - RNA, 24 nt, Homo sapiens
acggcugucccucauggagaccuc

SEQ ID NO: 7131 - RNA, 29 nt, Homo sapiens
augucccucuuuggaacagauauuuagcu

SEQ ID NO: 7132 - RNA, 19 nt, Homo sapiens
cagggcuccuaggcucagu

SEQ ID NO: 7133 - RNA, 17 nt, Homo sapiens
gaggaggaagccguuga

SEQ ID NO: 7134 - RNA, 19 nt, Homo sapiens
gaguaaaccauguauuccc

SEQ ID NO: 7135 - RNA, 21 nt, Homo sapiens
ggaagaugaacuuugucauua

SEQ ID NO: 7136 - RNA, 22 nt, Homo sapiens
uccuuuuuggggaguuguuaug

SEQ ID NO: 7137 - RNA, 18 nt, Homo sapiens
cgcagaaggagagcgagc

SEQ ID NO: 7138 - RNA, 22 nt, Homo sapiens
ccaccucuucucccccaccucc

SEQ ID NO: 7139 - RNA, 16 nt, Homo sapiens
cccacgggccgcuggc

SEQ ID NO: 7140 - RNA, 19 nt, Homo sapiens
ccccacgggccgcuggcaa

SEQ ID NO: 7141 - RNA, 19 nt, Homo sapiens
cgccgcuacaagccaaaga

SEQ ID NO: 7142 - RNA, 22 nt, Homo sapiens
guugaaacgcagcauuuuugaa

SEQ ID NO: 7143 - RNA, 23 nt, Homo sapiens
accuugucuuucaaaagaacuca

SEQ ID NO: 7144 - RNA, 18 nt, Homo sapiens
cuggccucgcgucucuca

SEQ ID NO: 7145 - RNA, 21 nt, Homo sapiens
gccaccucaaggccuugggga

SEQ ID NO: 7146 - RNA, 26 nt, Homo sapiens
ggggacggccgggcggcggcggcggc

SEQ ID NO: 7147 - RNA, 18 nt, Homo sapiens
ucaaaauugugaacaccc

SEQ ID NO: 7148 - RNA, 21 nt, Homo sapiens
ccucuagagccgcgaguucuc

SEQ ID NO: 7149 - RNA, 18 nt, Homo sapiens
cuugggccaggccggccc

SEQ ID NO: 7150 - RNA, 21 nt, Homo sapiens
gcgaaggaggggagcgccggc

SEQ ID NO: 7151 - RNA, 23 nt, Homo sapiens
gcgccucuagagccgcgaguucu

SEQ ID NO: 7152 - RNA, 20 nt, Homo sapiens
gcgcggagcgcggcggcagg

SEQ ID NO: 7153 - RNA, 23 nt, Homo sapiens
uauggaagaguuaaaacauuucu

SEQ ID NO: 7154 - RNA, 22 nt, Homo sapiens
caugcccuucggcagcauucca

SEQ ID NO: 7155 - RNA, 19 nt, Homo sapiens
auugauauuauauuaaaca

SEQ ID NO: 7156 - RNA, 20 nt, Homo sapiens
guggauaccaagguacaacu

SEQ ID NO: 7157 - RNA, 18 nt, Homo sapiens
ucuguaauugcacuuuuu

SEQ ID NO: 7158 - RNA, 24 nt, Homo sapiens
uuguacaaacaguauuucuggugu

SEQ ID NO: 7159 - RNA, 18 nt, Homo sapiens
aaaaacaaaaacaaagaa

SEQ ID NO: 7160 - RNA, 20 nt, Homo sapiens
agggaaauaaaucggcuggc

SEQ ID NO: 7161 - RNA, 25 nt, Homo sapiens
ccaaacacuugcauucacaacuuua

SEQ ID NO: 7162 - RNA, 17 nt, Homo sapiens
ccugaaaacugcuuggc

SEQ ID NO: 7163 - RNA, 20 nt, Homo sapiens
gucuaguuguuugcuugaua

SEQ ID NO: 7164 - RNA, 19 nt, Homo sapiens
ugcaaucuacugcacucga

SEQ ID NO: 7165 - RNA, 20 nt, Homo sapiens
accaaaacaugccgcaggga

SEQ ID NO: 7166 - RNA, 17 nt, Homo sapiens
cugacuuguauuccuuu

SEQ ID NO: 7167 - RNA, 19 nt, Homo sapiens
gagaucguuuuguggaaua

SEQ ID NO: 7168 - RNA, 18 nt, Homo sapiens
gccaucugugugcagcaa

SEQ ID NO: 7169 - RNA, 18 nt, Homo sapiens
gccuucuucccucgggga

SEQ ID NO: 7170 - RNA, 20 nt, Homo sapiens
gcgccugacccuggugggcu

SEQ ID NO: 7171 - RNA, 18 nt, Homo sapiens
ugugguuuuuggaccccu

SEQ ID NO: 7172 - RNA, 23 nt, Homo sapiens
ccaucaaguauuaccugcagcga

SEQ ID NO: 7173 - RNA, 21 nt, Homo sapiens
cccaggcuguugucccuugaa

SEQ ID NO: 7174 - RNA, 20 nt, Homo sapiens
gcaaagccugauugacugug

SEQ ID NO: 7175 - RNA, 17 nt, Homo sapiens
guccccggggcaaagcc

SEQ ID NO: 7176 - RNA, 19 nt, Homo sapiens
cugcagacuacugcuuuga

SEQ ID NO: 7177 - RNA, 19 nt, Homo sapiens
cugugaucucgccuuguuu

SEQ ID NO: 7178 - RNA, 21 nt, Homo sapiens
uagguagagcugagaauacua

SEQ ID NO: 7179 - RNA, 22 nt, Homo sapiens
uguuuuuuuuuaaaaccaggca

SEQ ID NO: 7180 - RNA, 20 nt, Homo sapiens
ugaugccucauuucuacauu

SEQ ID NO: 7181 - RNA, 20 nt, Homo sapiens
uuucuacauucugucauuag

SEQ ID NO: 7182 - RNA, 20 nt, Homo sapiens
uuugggacggagucucgcuu

SEQ ID NO: 7183 - RNA, 20 nt, Homo sapiens
aucgguaaauaaaaguuuuu

SEQ ID NO: 7184 - RNA, 23 nt, Homo sapiens
ccucuucuguuauguuuugucuu

SEQ ID NO: 7185 - RNA, 17 nt, Homo sapiens
gagcucagaucucccuc

SEQ ID NO: 7186 - RNA, 15 nt, Homo sapiens
aaggcagugcuaagc

SEQ ID NO: 7187 - RNA, 23 nt, Homo sapiens
ucaguaaucagggugugaaaaaa

SEQ ID NO: 7188 - RNA, 19 nt, Homo sapiens
cauacuuauucggaggagg

SEQ ID NO: 7189 - RNA, 23 nt, Homo sapiens
gccguguaacgggagucugggga

SEQ ID NO: 7190 - RNA, 22 nt, Homo sapiens
gggggugacggggggucgcgga

SEQ ID NO: 7191 - RNA, 24 nt, Homo sapiens
uucugucuuuccuuuauuuuuugg

SEQ ID NO: 7192 - RNA, 19 nt, Homo sapiens
cccucgccgaggcugcagc

SEQ ID NO: 7193 - RNA, 21 nt, Homo sapiens
ugcccagaaaucuacuuuaau

SEQ ID NO: 7194 - RNA, 16 nt, Homo sapiens
gcuuuugugucccuga

SEQ ID NO: 7195 - RNA, 20 nt, Homo sapiens
gguggccaauugagcuucaa

SEQ ID NO: 7196 - RNA, 18 nt, Homo sapiens
uguuuaaacucaaauaga

SEQ ID NO: 7197 - RNA, 20 nt, Homo sapiens
uugaauuccuggaauaaacc

SEQ ID NO: 7198 - RNA, 17 nt, Homo sapiens
aggaagcggugauugcc

SEQ ID NO: 7199 - RNA, 22 nt, Homo sapiens
ccucuucgccgcccgccgccuc

SEQ ID NO: 7200 - RNA, 21 nt, Homo sapiens
gcgucuuggcugguagggccu

SEQ ID NO: 7201 - RNA, 19 nt, Homo sapiens
ugagccucuggcugccaga

SEQ ID NO: 7202 - RNA, 18 nt, Homo sapiens
ccguccacauuccucacu

SEQ ID NO: 7203 - RNA, 20 nt, Homo sapiens
guugaggcccgccugcgcuu

SEQ ID NO: 7204 - RNA, 19 nt, Homo sapiens
ccucuucuaguuaccacgg

SEQ ID NO: 7205 - RNA, 19 nt, Homo sapiens
cugcagcuccucugccuuu

SEQ ID NO: 7206 - RNA, 20 nt, Homo sapiens
gcugccuccucagcagccuc

SEQ ID NO: 7207 - RNA, 17 nt, Homo sapiens
ucacaaucaucuucucc

SEQ ID NO: 7208 - RNA, 16 nt, Homo sapiens
ucacgcucagcacaca

SEQ ID NO: 7209 - RNA, 21 nt, Homo sapiens
cccuccuuuuuccagugccca

SEQ ID NO: 7210 - RNA, 18 nt, Homo sapiens
ccugccaggaauuuccaa

SEQ ID NO: 7211 - RNA, 23 nt, Homo sapiens
gaaccuaagguggaaacacuguc

SEQ ID NO: 7212 - RNA, 21 nt, Homo sapiens
gcgcggagccgaagcagccgc

SEQ ID NO: 7213 - RNA, 18 nt, Homo sapiens
gggucccccacacccuca

SEQ ID NO: 7214 - RNA, 20 nt, Homo sapiens
ucucugcaaugcugugggca

SEQ ID NO: 7215 - RNA, 20 nt, Homo sapiens
gagaaguaauauugugaacu

SEQ ID NO: 7216 - RNA, 24 nt, Homo sapiens
gcggagagaagggucuuuccaccu

SEQ ID NO: 7217 - RNA, 21 nt, Homo sapiens
uaggaaauuccuaggucuagu

SEQ ID NO: 7218 - RNA, 16 nt, Homo sapiens
uccucuaaaaauguua

SEQ ID NO: 7219 - RNA, 19 nt, Homo sapiens
acugccuaaaugaugcccg

SEQ ID NO: 7220 - RNA, 20 nt, Homo sapiens
aucagcaaaugaaagcuuuu

SEQ ID NO: 7221 - RNA, 20 nt, Homo sapiens
cacugccuaaaugaugcccg

SEQ ID NO: 7222 - RNA, 22 nt, Homo sapiens
gggaugaaucacccuuggccca

SEQ ID NO: 7223 - RNA, 20 nt, Homo sapiens
gugaccaucugggucugugu

SEQ ID NO: 7224 - RNA, 19 nt, Homo sapiens
cuauuuggcuucaaguaua

SEQ ID NO: 7225 - RNA, 19 nt, Homo sapiens
guuuuuaauauucucaucu

SEQ ID NO: 7226 - RNA, 18 nt, Homo sapiens
cuccagaagggguccacg

SEQ ID NO: 7227 - RNA, 18 nt, Homo sapiens
gauguuucaaugugagac

SEQ ID NO: 7228 - RNA, 17 nt, Homo sapiens
ugacuguuaccauguga

SEQ ID NO: 7229 - RNA, 19 nt, Homo sapiens
uguguuggccgguucugaa

SEQ ID NO: 7230 - RNA, 17 nt, Homo sapiens
accaccaucauugucua

SEQ ID NO: 7231 - RNA, 23 nt, Homo sapiens
agaagaauuucuguucucacacc

SEQ ID NO: 7232 - RNA, 18 nt, Homo sapiens
cacagacaaagagcccau

SEQ ID NO: 7233 - RNA, 18 nt, Homo sapiens
gcccggcugcuaccucug

SEQ ID NO: 7234 - RNA, 19 nt, Homo sapiens
ucagcugccccuuacuuca

SEQ ID NO: 7235 - RNA, 21 nt, Homo sapiens
ugcugucuccucaacucaacc

SEQ ID NO: 7236 - RNA, 20 nt, Homo sapiens
aaaaugagaagaugugaccu

SEQ ID NO: 7237 - RNA, 18 nt, Homo sapiens
caaccuucaaggccacga

SEQ ID NO: 7238 - RNA, 20 nt, Homo sapiens
caggcuguggauccuugcca

SEQ ID NO: 7239 - RNA, 21 nt, Homo sapiens
gcuguaauaucggcacaggga

SEQ ID NO: 7240 - RNA, 20 nt, Homo sapiens
ugggcuucagcaaccugcca

SEQ ID NO: 7241 - RNA, 18 nt, Homo sapiens
caaauguuauggcagggc

SEQ ID NO: 7242 - RNA, 26 nt, Homo sapiens
uccuccuuuccccuuucucuuuccuc

SEQ ID NO: 7243 - RNA, 19 nt, Homo sapiens
aaccaagggaaauacugcu

SEQ ID NO: 7244 - RNA, 17 nt, Homo sapiens
caaggcacagccagggc

SEQ ID NO: 7245 - RNA, 20 nt, Homo sapiens
cagggcacaguuaggccugg

SEQ ID NO: 7246 - RNA, 19 nt, Homo sapiens
cgaagugugucaugugccg

SEQ ID NO: 7247 - RNA, 16 nt, Homo sapiens
cuucuguguuauuuua

SEQ ID NO: 7248 - RNA, 21 nt, Homo sapiens
ugccagaccucggggaggaua

SEQ ID NO: 7249 - RNA, 19 nt, Homo sapiens
uggccccuuggcagguaag

SEQ ID NO: 7250 - RNA, 18 nt, Homo sapiens
cgucaugucucuaaacug

SEQ ID NO: 7251 - RNA, 19 nt, Homo sapiens
cugugggugaagcgccuca

SEQ ID NO: 7252 - RNA, 16 nt, Homo sapiens
gcgcccgccgucugcu

SEQ ID NO: 7253 - RNA, 16 nt, Homo sapiens
ugccaggcucacuuca

SEQ ID NO: 7254 - RNA, 21 nt, Homo sapiens
agaccccccuacccccgccca

SEQ ID NO: 7255 - RNA, 23 nt, Homo sapiens
cauccaaggacccuccaaggcug

SEQ ID NO: 7256 - RNA, 17 nt, Homo sapiens
cccccaccccugccucc

SEQ ID NO: 7257 - RNA, 21 nt, Homo sapiens
cuugaagguccucugccucca

SEQ ID NO: 7258 - RNA, 21 nt, Homo sapiens
gcuucucgagggcuuggggga

SEQ ID NO: 7259 - RNA, 16 nt, Homo sapiens
ugcggcugccggcagg

SEQ ID NO: 7260 - RNA, 18 nt, Homo sapiens
cccuggccuugggucugc

SEQ ID NO: 7261 - RNA, 19 nt, Homo sapiens
gccaucucggcaggaucuc

SEQ ID NO: 7262 - RNA, 22 nt, Homo sapiens
gccuggaccuuuaggccugccu

SEQ ID NO: 7263 - RNA, 17 nt, Homo sapiens
cucccuccucucccucu

SEQ ID NO: 7264 - RNA, 24 nt, Homo sapiens
aguaauuuuagaagcauuauuuua

SEQ ID NO: 7265 - RNA, 21 nt, Homo sapiens
ccgccucgcacccccaccucu

SEQ ID NO: 7266 - RNA, 18 nt, Homo sapiens
gaagaaauuuuuuuuggc

SEQ ID NO: 7267 - RNA, 20 nt, Homo sapiens
guaaagccauuuacauaaua

SEQ ID NO: 7268 - RNA, 19 nt, Homo sapiens
guauguggcauuuauuugg

SEQ ID NO: 7269 - RNA, 17 nt, Homo sapiens
uggguaaagccauuuac

SEQ ID NO: 7270 - RNA, 21 nt, Homo sapiens
ccaguguccucuggccugcug

SEQ ID NO: 7271 - RNA, 19 nt, Homo sapiens
agaccaaaaauucugauga

SEQ ID NO: 7272 - RNA, 17 nt, Homo sapiens
gcaucuagauuauuuuu

SEQ ID NO: 7273 - RNA, 20 nt, Homo sapiens
ggccgcgaucgggcuuaguc

SEQ ID NO: 7274 - RNA, 19 nt, Homo sapiens
cauguacuacgugccagcu

SEQ ID NO: 7275 - RNA, 21 nt, Homo sapiens
ccuuccccuacaccucccucc

SEQ ID NO: 7276 - RNA, 23 nt, Homo sapiens
acugcaaacagaaaucagguguu

SEQ ID NO: 7277 - RNA, 16 nt, Homo sapiens
gaugacuuucuguuuu

SEQ ID NO: 7278 - RNA, 21 nt, Homo sapiens
acuuucuugguaugcuggcca

SEQ ID NO: 7279 - RNA, 25 nt, Homo sapiens
aggaccauucaugcaaugacuauuu

SEQ ID NO: 7280 - RNA, 21 nt, Homo sapiens
gaugccucaucuugccuuucc

SEQ ID NO: 7281 - RNA, 19 nt, Homo sapiens
ucccugauggcugucaaca

SEQ ID NO: 7282 - RNA, 19 nt, Homo sapiens
cauccucuucuuuuagcag

SEQ ID NO: 7283 - RNA, 19 nt, Homo sapiens
ccucucuacuaaaacuaca

SEQ ID NO: 7284 - RNA, 17 nt, Homo sapiens
gcaauuugggaguccga

SEQ ID NO: 7285 - RNA, 18 nt, Homo sapiens
gucugggcuggguccggu

SEQ ID NO: 7286 - RNA, 23 nt, Homo sapiens
uguaggggaacucauuuggggug

SEQ ID NO: 7287 - RNA, 20 nt, Homo sapiens
aagcaagaacaccauccuac

SEQ ID NO: 7288 - RNA, 18 nt, Homo sapiens
acaccauccuacauaaua

SEQ ID NO: 7289 - RNA, 22 nt, Homo sapiens
uggucucaaacuccuagguuca

SEQ ID NO: 7290 - RNA, 18 nt, Homo sapiens
uguugggacuuucuugaa

SEQ ID NO: 7291 - RNA, 19 nt, Homo sapiens
uuuuuuuuuuuuuuugaca

SEQ ID NO: 7292 - RNA, 21 nt, Homo sapiens
uggacagucagcaaggaauug

SEQ ID NO: 7293 - RNA, 19 nt, Homo sapiens
uagauguauauauuuccua

SEQ ID NO: 7294 - RNA, 18 nt, Homo sapiens
uauauuguuuucagugua

SEQ ID NO: 7295 - RNA, 19 nt, Homo sapiens
ggcucuggcgcgccagccg

SEQ ID NO: 7296 - RNA, 20 nt, Homo sapiens
guuugcuuaguucucacugu

SEQ ID NO: 7297 - RNA, 19 nt, Homo sapiens
aaaguugggagcauggcag

SEQ ID NO: 7298 - RNA, 22 nt, Homo sapiens
caggcuucggaggccacaagcu

SEQ ID NO: 7299 - RNA, 16 nt, Homo sapiens
gagucacacuacaugc

SEQ ID NO: 7300 - RNA, 19 nt, Homo sapiens
ggccgggugcgguggcuca

SEQ ID NO: 7301 - RNA, 19 nt, Homo sapiens
ugcagggguguggaguagg

SEQ ID NO: 7302 - RNA, 18 nt, Homo sapiens
cuguagcccccucugcca

SEQ ID NO: 7303 - RNA, 22 nt, Homo sapiens
uaaauggaugcaauggaagcua

SEQ ID NO: 7304 - RNA, 18 nt, Homo sapiens
agcguuuccuaaucccuc

SEQ ID NO: 7305 - RNA, 22 nt, Homo sapiens
ccauggcuauuccagcacccca

SEQ ID NO: 7306 - RNA, 22 nt, Homo sapiens
cuguaauugccaaguccucuaa

SEQ ID NO: 7307 - RNA, 25 nt, Homo sapiens
uccuggaucacuccuuugcacucca

SEQ ID NO: 7308 - RNA, 22 nt, Homo sapiens
ucuuagaucacauuuaguagca

SEQ ID NO: 7309 - RNA, 20 nt, Homo sapiens
aaaccccaaccaaacaaaac

SEQ ID NO: 7310 - RNA, 21 nt, Homo sapiens
aggccggcgccgcacacacac

SEQ ID NO: 7311 - RNA, 16 nt, Homo sapiens
acuggcaagaucacua

SEQ ID NO: 7312 - RNA, 21 nt, Homo sapiens
aucagaaaauauucaauacag

SEQ ID NO: 7313 - RNA, 24 nt, Homo sapiens
cuuaggcacaggagauccacuuuu

SEQ ID NO: 7314 - RNA, 18 nt, Homo sapiens
ggaaaaugcaauaaaaua

SEQ ID NO: 7315 - RNA, 17 nt, Homo sapiens
ggcaucugaaguacaau

SEQ ID NO: 7316 - RNA, 22 nt, Homo sapiens
uuauuauugcacuuuauccuga

SEQ ID NO: 7317 - RNA, 22 nt, Homo sapiens
uugaauacuguuucuucaguca

SEQ ID NO: 7318 - RNA, 18 nt, Homo sapiens
aaacuggcagucaguguu

SEQ ID NO: 7319 - RNA, 18 nt, Homo sapiens
ugggcccucgcuccugac

SEQ ID NO: 7320 - RNA, 23 nt, Homo sapiens
acuuguuuuuauugcauuugcug

SEQ ID NO: 7321 - RNA, 18 nt, Homo sapiens
ucaacaagguauaccuca

SEQ ID NO: 7322 - RNA, 18 nt, Homo sapiens
ugcuauuuuuuuuaaauc

SEQ ID NO: 7323 - RNA, 19 nt, Homo sapiens
cauagacuaguccuaugga

SEQ ID NO: 7324 - RNA, 21 nt, Homo sapiens
gcggcaagcguguuucuaggu

SEQ ID NO: 7325 - RNA, 24 nt, Homo sapiens
gggaacggcgguggccggugcggc

SEQ ID NO: 7326 - RNA, 18 nt, Homo sapiens
ugaacaugggagcucuug

SEQ ID NO: 7327 - RNA, 19 nt, Homo sapiens
ugcacuuauuguccccuuu

SEQ ID NO: 7328 - RNA, 20 nt, Homo sapiens
cccgccuuuuauaaaccucu

SEQ ID NO: 7329 - RNA, 18 nt, Homo sapiens
gccuccacucccacuucc

SEQ ID NO: 7330 - RNA, 21 nt, Homo sapiens
aacaggggcagccguguagcc

SEQ ID NO: 7331 - RNA, 22 nt, Homo sapiens
aucuuggcucacugcaaccucu

SEQ ID NO: 7332 - RNA, 18 nt, Homo sapiens
ggcagcucaccuguacug

SEQ ID NO: 7333 - RNA, 18 nt, Homo sapiens
uaaauccaaccaauuuuc

SEQ ID NO: 7334 - RNA, 17 nt, Homo sapiens
ucaagugauucucuugc

SEQ ID NO: 7335 - RNA, 19 nt, Homo sapiens
ucacauggaggcauugaug

SEQ ID NO: 7336 - RNA, 18 nt, Homo sapiens
ucuaccuccuggguucaa

SEQ ID NO: 7337 - RNA, 16 nt, Homo sapiens
ugaugacaaucaguua

SEQ ID NO: 7338 - RNA, 18 nt, Homo sapiens
gcuaggugacagcguacc

SEQ ID NO: 7339 - RNA, 19 nt, Homo sapiens
ccaugcccucagcaccacu

SEQ ID NO: 7340 - RNA, 19 nt, Homo sapiens
cucuucccaacuuccucca

SEQ ID NO: 7341 - RNA, 21 nt, Homo sapiens
gcugggagcccuuuuguuuua

SEQ ID NO: 7342 - RNA, 19 nt, Homo sapiens
caacccccacccugccucu

SEQ ID NO: 7343 - RNA, 22 nt, Homo sapiens
ccaugcggcugccugcacccca

SEQ ID NO: 7344 - RNA, 19 nt, Homo sapiens
gcucuggguacagggcagc

SEQ ID NO: 7345 - RNA, 27 nt, Homo sapiens
ugcugucuccccacuaggaucauucca

SEQ ID NO: 7346 - RNA, 18 nt, Homo sapiens
acucuugcugugaaauug

SEQ ID NO: 7347 - RNA, 20 nt, Homo sapiens
guuccucuuaacuacggugu

SEQ ID NO: 7348 - RNA, 18 nt, Homo sapiens
uaguaauauaggcuuuca

SEQ ID NO: 7349 - RNA, 18 nt, Homo sapiens
ugauccaaagcagaauca

SEQ ID NO: 7350 - RNA, 16 nt, Homo sapiens
agcagacacaggugua

SEQ ID NO: 7351 - RNA, 17 nt, Homo sapiens
acugucagugggaaacc

SEQ ID NO: 7352 - RNA, 19 nt, Homo sapiens
acuuacuuauuuuuaucua

SEQ ID NO: 7353 - RNA, 22 nt, Homo sapiens
agaaaacaaacagcccaaguga

SEQ ID NO: 7354 - RNA, 18 nt, Homo sapiens
ccugacuuccccuuauuc

SEQ ID NO: 7355 - RNA, 21 nt, Homo sapiens
ucauagaaaaucaaucuggug

SEQ ID NO: 7356 - RNA, 19 nt, Homo sapiens
ucuguaucuaguuguauua

SEQ ID NO: 7357 - RNA, 18 nt, Homo sapiens
ugugguuggguucacuca

SEQ ID NO: 7358 - RNA, 24 nt, Homo sapiens
cccagagacagcccccacauccca

SEQ ID NO: 7359 - RNA, 19 nt, Homo sapiens
gcucuggagaggcccccac

SEQ ID NO: 7360 - RNA, 23 nt, Homo sapiens
guuucaucauauuggucagggug

SEQ ID NO: 7361 - RNA, 18 nt, Homo sapiens
ucuaccuccuggguucaa

SEQ ID NO: 7362 - RNA, 20 nt, Homo sapiens
ugucccauucccucucugua

SEQ ID NO: 7363 - RNA, 23 nt, Homo sapiens
aaauauaguuauauuucauacuu

SEQ ID NO: 7364 - RNA, 19 nt, Homo sapiens
aacaaguauaucuaaccca

SEQ ID NO: 7365 - RNA, 20 nt, Homo sapiens
acauuuuguaacccuguaaa

SEQ ID NO: 7366 - RNA, 18 nt, Homo sapiens
aucuguuuacaggcauua

SEQ ID NO: 7367 - RNA, 19 nt, Homo sapiens
ccagucuguccccaucucu

SEQ ID NO: 7368 - RNA, 22 nt, Homo sapiens
uaaauggcuguguguggaauug

SEQ ID NO: 7369 - RNA, 21 nt, Homo sapiens
ucaauucauuccuucaucucu

SEQ ID NO: 7370 - RNA, 18 nt, Homo sapiens
uccgccuccuggguucaa

SEQ ID NO: 7371 - RNA, 20 nt, Homo sapiens
aggucaugcuguuacaggug

SEQ ID NO: 7372 - RNA, 17 nt, Homo sapiens
uacuucaaacuguuucc

SEQ ID NO: 7373 - RNA, 23 nt, Homo sapiens
ucagguaaaaggucaugcuguua

SEQ ID NO: 7374 - RNA, 19 nt, Homo sapiens
ugugcauaaauaauacuuc

SEQ ID NO: 7375 - RNA, 16 nt, Homo sapiens
uuuucacuaauuuugc

SEQ ID NO: 7376 - RNA, 19 nt, Homo sapiens
ccugggugccagcgcccca

SEQ ID NO: 7377 - RNA, 22 nt, Homo sapiens
acuuugccucuucuccugccuc

SEQ ID NO: 7378 - RNA, 20 nt, Homo sapiens
agugguaacugcaguuccuc

SEQ ID NO: 7379 - RNA, 18 nt, Homo sapiens
cucccucuccucuccucu

SEQ ID NO: 7380 - RNA, 20 nt, Homo sapiens
gguauucuaaugaggagcug

SEQ ID NO: 7381 - RNA, 19 nt, Homo sapiens
guaguaucccuggcugcua

SEQ ID NO: 7382 - RNA, 20 nt, Homo sapiens
uguggguguguuugugugug

SEQ ID NO: 7383 - RNA, 23 nt, Homo sapiens
gcuuggaucguggaagaagggcc

SEQ ID NO: 7384 - RNA, 17 nt, Homo sapiens
caagcuucagcccccuc

SEQ ID NO: 7385 - RNA, 21 nt, Homo sapiens
ccacccccauucuccaagcuu

SEQ ID NO: 7386 - RNA, 22 nt, Homo sapiens
ccugagcaaucccagguccagc

SEQ ID NO: 7387 - RNA, 19 nt, Homo sapiens
accccaaagguauuuuuga

SEQ ID NO: 7388 - RNA, 22 nt, Homo sapiens
accccccgccacacacacacac

SEQ ID NO: 7389 - RNA, 20 nt, Homo sapiens
acuugucugagccucacauc

SEQ ID NO: 7390 - RNA, 17 nt, Homo sapiens
cccaccaacuucuccca

SEQ ID NO: 7391 - RNA, 22 nt, Homo sapiens
ccuucccccauucgccuuccca

SEQ ID NO: 7392 - RNA, 18 nt, Homo sapiens
gucuucuccuccucucca

SEQ ID NO: 7393 - RNA, 18 nt, Homo sapiens
uccgcaucccagguucaa

SEQ ID NO: 7394 - RNA, 22 nt, Homo sapiens
ucucuucagaccccuuugccuu

SEQ ID NO: 7395 - RNA, 17 nt, Homo sapiens
ucuggugacucugugag

SEQ ID NO: 7396 - RNA, 19 nt, Homo sapiens
uguggaugcuccuggaaug

SEQ ID NO: 7397 - RNA, 21 nt, Homo sapiens
uucucuggcuucuuuuagcaa

SEQ ID NO: 7398 - RNA, 16 nt, Homo sapiens
agccgucagccaaguc

SEQ ID NO: 7399 - RNA, 17 nt, Homo sapiens
aggccuccaguucauuu

SEQ ID NO: 7400 - RNA, 18 nt, Homo sapiens
augagcgucgcacagaca

SEQ ID NO: 7401 - RNA, 21 nt, Homo sapiens
ccagaucccucuccagugaca

SEQ ID NO: 7402 - RNA, 23 nt, Homo sapiens
ugaggcucuguaaccuuaucuaa

SEQ ID NO: 7403 - RNA, 17 nt, Homo sapiens
ugcaaaaugucauagcu

SEQ ID NO: 7404 - RNA, 21 nt, Homo sapiens
uccagacccugacaccucuca

SEQ ID NO: 7405 - RNA, 19 nt, Homo sapiens
uggucugugaguuuuugaa

SEQ ID NO: 7406 - RNA, 22 nt, Homo sapiens
cgaccgcccaaggcaacggagg

SEQ ID NO: 7407 - RNA, 16 nt, Homo sapiens
gauggcggaggcugug

SEQ ID NO: 7408 - RNA, 22 nt, Homo sapiens
gcacuuacccuccacuuccucc

SEQ ID NO: 7409 - RNA, 25 nt, Homo sapiens
cuucuauacaacuuguuuuaaccuu

SEQ ID NO: 7410 - RNA, 17 nt, Homo sapiens
ucaagugauucuccugc

SEQ ID NO: 7411 - RNA, 22 nt, Homo sapiens
ugcuuccaaaguggccuacuca

SEQ ID NO: 7412 - RNA, 16 nt, Homo sapiens
uuucugaccaauagug

SEQ ID NO: 7413 - RNA, 18 nt, Homo sapiens
cuaccuggguccucagug

SEQ ID NO: 7414 - RNA, 23 nt, Homo sapiens
cuccaaauaauacacagaauccu

SEQ ID NO: 7415 - RNA, 22 nt, Homo sapiens
guaugccuguauugcugggcug

SEQ ID NO: 7416 - RNA, 20 nt, Homo sapiens
uagcucacuugcuaugcugc

SEQ ID NO: 7417 - RNA, 23 nt, Homo sapiens
aaggaagggguuggauugcaaua

SEQ ID NO: 7418 - RNA, 22 nt, Homo sapiens
agauucuagaucagaugcucca

SEQ ID NO: 7419 - RNA, 19 nt, Homo sapiens
auguugcccccgugagcca

SEQ ID NO: 7420 - RNA, 21 nt, Homo sapiens
caacccuccaccugguacucc

SEQ ID NO: 7421 - RNA, 18 nt, Homo sapiens
caagacucuagaguccaa

SEQ ID NO: 7422 - RNA, 19 nt, Homo sapiens
cuccccugccgcugugcca

SEQ ID NO: 7423 - RNA, 17 nt, Homo sapiens
cucccucucaggaucca

SEQ ID NO: 7424 - RNA, 24 nt, Homo sapiens
gggacagcccggcccugcccccuc

SEQ ID NO: 7425 - RNA, 19 nt, Homo sapiens
uagcaucaccaucuguaaa

SEQ ID NO: 7426 - RNA, 20 nt, Homo sapiens
ccuccgcgcggcugcagcua

SEQ ID NO: 7427 - RNA, 18 nt, Homo sapiens
aggaccuucaugugccaa

SEQ ID NO: 7428 - RNA, 26 nt, Homo sapiens
aacaaaaagaacaaaaaaaucugcag

SEQ ID NO: 7429 - RNA, 22 nt, Homo sapiens
cucugcuuaugaggaccucgaa

SEQ ID NO: 7430 - RNA, 22 nt, Homo sapiens
gagagcugacaccaaguccucc

SEQ ID NO: 7431 - RNA, 19 nt, Homo sapiens
gccggacaccagguuuuga

SEQ ID NO: 7432 - RNA, 19 nt, Homo sapiens
guggcuuugagggcuuuug

SEQ ID NO: 7433 - RNA, 27 nt, Homo sapiens
agaagagagagauguggaaggcaccuu

SEQ ID NO: 7434 - RNA, 20 nt, Homo sapiens
aucugugaccuccaggcagc

SEQ ID NO: 7435 - RNA, 21 nt, Homo sapiens
ccccacaguaccccuucagcu

SEQ ID NO: 7436 - RNA, 22 nt, Homo sapiens
ugacaacaguacccauccccca

SEQ ID NO: 7437 - RNA, 17 nt, Homo sapiens
uguagacucccggacuu

SEQ ID NO: 7438 - RNA, 19 nt, Homo sapiens
ugcccccaaaccuguacug

SEQ ID NO: 7439 - RNA, 17 nt, Homo sapiens
cagaaacaacuuucucc

SEQ ID NO: 7440 - RNA, 19 nt, Homo sapiens
ccuggacuuguuuuaaacu

SEQ ID NO: 7441 - RNA, 22 nt, Homo sapiens
ccuugggaaauggggcugugag

SEQ ID NO: 7442 - RNA, 23 nt, Homo sapiens
uuaggccuaagaggcuuucucca

SEQ ID NO: 7443 - RNA, 19 nt, Homo sapiens
cccagaguccugcucucag

SEQ ID NO: 7444 - RNA, 23 nt, Homo sapiens
cccuuaguaacaaacacaauuua

SEQ ID NO: 7445 - RNA, 26 nt, Homo sapiens
ccccauuucuagaacaucccugccag

SEQ ID NO: 7446 - RNA, 23 nt, Homo sapiens
gggaaguguaagaaacacacuga

SEQ ID NO: 7447 - RNA, 21 nt, Homo sapiens
ggggaaggaggcuggcuuguc

SEQ ID NO: 7448 - RNA, 22 nt, Homo sapiens
uccaggggaugggagguugugg

SEQ ID NO: 7449 - RNA, 25 nt, Homo sapiens
uggaugcuccuuccaacaggagcug

SEQ ID NO: 7450 - RNA, 19 nt, Homo sapiens
ccuggggguggcuuuaaau

SEQ ID NO: 7451 - RNA, 24 nt, Homo sapiens
uccuggggaagaagacucugugga

SEQ ID NO: 7452 - RNA, 17 nt, Homo sapiens
cccccaaaaacccacca

SEQ ID NO: 7453 - RNA, 20 nt, Homo sapiens
cgccccggacgaccaugaga

SEQ ID NO: 7454 - RNA, 16 nt, Homo sapiens
cggggcgcccuugucu

SEQ ID NO: 7455 - RNA, 22 nt, Homo sapiens
uguacucuuugcuaguaccaaa

SEQ ID NO: 7456 - RNA, 25 nt, Homo sapiens
ucucauuuugguuuguuuuaauuuu

SEQ ID NO: 7457 - RNA, 19 nt, Homo sapiens
cgcccccaccuccacccuc

SEQ ID NO: 7458 - RNA, 19 nt, Homo sapiens
uugcaagauuccaaguucu

SEQ ID NO: 7459 - RNA, 17 nt, Homo sapiens
aaaucaguuggcaggca

SEQ ID NO: 7460 - RNA, 21 nt, Homo sapiens
aguaaguuuuuuuagaagaca

SEQ ID NO: 7461 - RNA, 22 nt, Homo sapiens
auaguaaguuuuuuuagaagac

SEQ ID NO: 7462 - RNA, 18 nt, Homo sapiens
cugagagcacgguggggc

SEQ ID NO: 7463 - RNA, 17 nt, Homo sapiens
gcuacauauaugcaaua

SEQ ID NO: 7464 - RNA, 19 nt, Homo sapiens
ugugguaagguaccucuca

SEQ ID NO: 7465 - RNA, 21 nt, Homo sapiens
acugucucaacugugguguua

SEQ ID NO: 7466 - RNA, 22 nt, Homo sapiens
ugggugggcuccucuuggggau

SEQ ID NO: 7467 - RNA, 24 nt, Homo sapiens
agggaucgagauugggucagguua

SEQ ID NO: 7468 - RNA, 19 nt, Homo sapiens
guuuccaggauagauguug

SEQ ID NO: 7469 - RNA, 30 nt, Homo sapiens
uacaaaacucaaaaguuguuugcacagcug

SEQ ID NO: 7470 - RNA, 23 nt, Homo sapiens
ugggucagguuagcaugggguug

SEQ ID NO: 7471 - RNA, 20 nt, Homo sapiens
cacaccaucuuuccauccca

SEQ ID NO: 7472 - RNA, 18 nt, Homo sapiens
cauauggcaauaggugug

SEQ ID NO: 7473 - RNA, 16 nt, Homo sapiens
ccagccucccccaaug

SEQ ID NO: 7474 - RNA, 24 nt, Homo sapiens
ccccccccacacaccaucuuucca

SEQ ID NO: 7475 - RNA, 18 nt, Homo sapiens
uggguggaucaccugagg

SEQ ID NO: 7476 - RNA, 19 nt, Homo sapiens
aaaugaggagguacauuga

SEQ ID NO: 7477 - RNA, 23 nt, Homo sapiens
acuugugguugaccgcuuguuuc

SEQ ID NO: 7478 - RNA, 17 nt, Homo sapiens
ccacaugaacuacguga

SEQ ID NO: 7479 - RNA, 24 nt, Homo sapiens
gaggggaaaaaauuaacugcucca

SEQ ID NO: 7480 - RNA, 22 nt, Homo sapiens
gaacugucagcauguuguuguu

SEQ ID NO: 7481 - RNA, 21 nt, Homo sapiens
gcaaguuaacacaacguaaca

SEQ ID NO: 7482 - RNA, 22 nt, Homo sapiens
gguaagaaauugaaguauccuu

SEQ ID NO: 7483 - RNA, 19 nt, Homo sapiens
ugaaaaucuagccauccua

SEQ ID NO: 7484 - RNA, 21 nt, Homo sapiens
aacaguccaagauuaccauuu

SEQ ID NO: 7485 - RNA, 17 nt, Homo sapiens
aauaaugauacugucaa

SEQ ID NO: 7486 - RNA, 22 nt, Homo sapiens
uaaaggacaaaauaagcuguuu

SEQ ID NO: 7487 - RNA, 23 nt, Homo sapiens
uaacccgcucaucacuggaugaa

SEQ ID NO: 7488 - RNA, 24 nt, Homo sapiens
ugcaaaugcaagcuaguggcuuca

SEQ ID NO: 7489 - RNA, 19 nt, Homo sapiens
ugcguguuucugacucuga

SEQ ID NO: 7490 - RNA, 24 nt, Homo sapiens
uuagucccucaugcaaaucaauua

SEQ ID NO: 7491 - RNA, 20 nt, Homo sapiens
uucugccuucucaugaucca

SEQ ID NO: 7492 - RNA, 21 nt, Homo sapiens
uuuccccccauacaauacaag

SEQ ID NO: 7493 - RNA, 18 nt, Homo sapiens
agaacagagacauugcca

SEQ ID NO: 7494 - RNA, 18 nt, Homo sapiens
aguucuuucuuuuucuca

SEQ ID NO: 7495 - RNA, 21 nt, Homo sapiens
cacuacuguccguggcuacaa

SEQ ID NO: 7496 - RNA, 22 nt, Homo sapiens
ccucucuuccccccaauaucuc

SEQ ID NO: 7497 - RNA, 18 nt, Homo sapiens
cgccggccccagcaccca

SEQ ID NO: 7498 - RNA, 21 nt, Homo sapiens
cuacagcuuugggucauuuuu

SEQ ID NO: 7499 - RNA, 19 nt, Homo sapiens
cuucuuucuugcuuugacc

SEQ ID NO: 7500 - RNA, 18 nt, Homo sapiens
gauucaugucacuacugu

SEQ ID NO: 7501 - RNA, 21 nt, Homo sapiens
ggcaguuauuggguuugguca

SEQ ID NO: 7502 - RNA, 21 nt, Homo sapiens
ucaccaggcugagacccuacc

SEQ ID NO: 7503 - RNA, 18 nt, Homo sapiens
ucccuccacaacucaguu

SEQ ID NO: 7504 - RNA, 19 nt, Homo sapiens
uuucugcugccuuggguuu

SEQ ID NO: 7505 - RNA, 22 nt, Homo sapiens
auugaugcaauuugauauuuuu

SEQ ID NO: 7506 - RNA, 22 nt, Homo sapiens
caugcugggugaugaaagauua

SEQ ID NO: 7507 - RNA, 22 nt, Homo sapiens
cuuaagcuaccagauugcuuuu

SEQ ID NO: 7508 - RNA, 23 nt, Homo sapiens
uuccccugagggaaucgcuuuuu

SEQ ID NO: 7509 - RNA, 24 nt, Homo sapiens
uuugaaaaauguauuuuaucauua

SEQ ID NO: 7510 - RNA, 20 nt, Homo sapiens
aacaagugugaugccauauc

SEQ ID NO: 7511 - RNA, 18 nt, Homo sapiens
auggaaaaaauacauuga

SEQ ID NO: 7512 - RNA, 21 nt, Homo sapiens
ccagaggagcucucccccuug

SEQ ID NO: 7513 - RNA, 19 nt, Homo sapiens
ccuuauaucauguaccuca

SEQ ID NO: 7514 - RNA, 23 nt, Homo sapiens
cgcagaacaccccaugcgugcug

SEQ ID NO: 7515 - RNA, 18 nt, Homo sapiens
gagaauauguaugccugc

SEQ ID NO: 7516 - RNA, 22 nt, Homo sapiens
gagcagccagcaaguaagcuag

SEQ ID NO: 7517 - RNA, 18 nt, Homo sapiens
gccaacaaacccucugua

SEQ ID NO: 7518 - RNA, 21 nt, Homo sapiens
gcccugggagcucugggacug

SEQ ID NO: 7519 - RNA, 28 nt, Homo sapiens
guauaugcgaacaguuauuguuugauua

SEQ ID NO: 7520 - RNA, 20 nt, Homo sapiens
ugacauccugcuucuucuuc

SEQ ID NO: 7521 - RNA, 21 nt, Homo sapiens
uggagagcacagcaugccuua

SEQ ID NO: 7522 - RNA, 19 nt, Homo sapiens
acaacacacccugcugcca

SEQ ID NO: 7523 - RNA, 19 nt, Homo sapiens
auccgcccacuucggucuc

SEQ ID NO: 7524 - RNA, 22 nt, Homo sapiens
caugaucucaacucucaacuca

SEQ ID NO: 7525 - RNA, 19 nt, Homo sapiens
ccagaggcguucguaugug

SEQ ID NO: 7526 - RNA, 21 nt, Homo sapiens
cucugcugugggggcccgugg

SEQ ID NO: 7527 - RNA, 19 nt, Homo sapiens
ggcaaugauaccuaccuca

SEQ ID NO: 7528 - RNA, 24 nt, Homo sapiens
guuuggggcuucaguggggagcug

SEQ ID NO: 7529 - RNA, 21 nt, Homo sapiens
ccuucccuuucauuuuuucca

SEQ ID NO: 7530 - RNA, 19 nt, Homo sapiens
ucacugaugacuuuuuaua

SEQ ID NO: 7531 - RNA, 20 nt, Homo sapiens
caaaccuccaaaacuccugc

SEQ ID NO: 7532 - RNA, 23 nt, Homo sapiens
ccaacagaugcuuuucugucucu

SEQ ID NO: 7533 - RNA, 17 nt, Homo sapiens
ccccugcccccacuucc

SEQ ID NO: 7534 - RNA, 22 nt, Homo sapiens
cccuuccccacugcacacaccu

SEQ ID NO: 7535 - RNA, 18 nt, Homo sapiens
cggccauucagcaagaca

SEQ ID NO: 7536 - RNA, 19 nt, Homo sapiens
uccagaaacggccauucag

SEQ ID NO: 7537 - RNA, 18 nt, Homo sapiens
ugcuuuucugucucugcc

SEQ ID NO: 7538 - RNA, 26 nt, Homo sapiens
agaccuagaauaauacuagucuuaua

SEQ ID NO: 7539 - RNA, 26 nt, Homo sapiens
uaaauggacaaaugcuuaugaaacua

SEQ ID NO: 7540 - RNA, 19 nt, Homo sapiens
guguuuguguuugacccgc

SEQ ID NO: 7541 - RNA, 20 nt, Homo sapiens
cagcuggugucggcaucaua

SEQ ID NO: 7542 - RNA, 21 nt, Homo sapiens
uugccuuuucucuccacccuu

SEQ ID NO: 7543 - RNA, 17 nt, Homo sapiens
ggcuuuggcauaggcug

SEQ ID NO: 7544 - RNA, 21 nt, Homo sapiens
accugggccaggguugccuca

SEQ ID NO: 7545 - RNA, 18 nt, Homo sapiens
ucuucaaaacguuagaga

SEQ ID NO: 7546 - RNA, 19 nt, Homo sapiens
ccaccuccacacccacccc

SEQ ID NO: 7547 - RNA, 20 nt, Homo sapiens
gccaccuccacacccacccc

SEQ ID NO: 7548 - RNA, 22 nt, Homo sapiens
gcccauucccaagggagacuga

SEQ ID NO: 7549 - RNA, 18 nt, Homo sapiens
ucuggagaaggccuggaa

SEQ ID NO: 7550 - RNA, 18 nt, Homo sapiens
cacguggcagagcuguaa

SEQ ID NO: 7551 - RNA, 17 nt, Homo sapiens
aaucucacccucuccuc

SEQ ID NO: 7552 - RNA, 17 nt, Homo sapiens
agccuuccuacacguua

SEQ ID NO: 7553 - RNA, 21 nt, Homo sapiens
caaguaaaacaaaaccacugg

SEQ ID NO: 7554 - RNA, 21 nt, Homo sapiens
gggcggggcggggggcuuugc

SEQ ID NO: 7555 - RNA, 18 nt, Homo sapiens
gugggguuauguaucaga

SEQ ID NO: 7556 - RNA, 21 nt, Homo sapiens
uggcucgcucagcuccuccac

SEQ ID NO: 7557 - RNA, 23 nt, Homo sapiens
uccuggagaaaagggauggagcu

SEQ ID NO: 7558 - RNA, 20 nt, Homo sapiens
gcggagccugagaaccaacu

SEQ ID NO: 7559 - RNA, 18 nt, Homo sapiens
augacuuuccucuguaac

SEQ ID NO: 7560 - RNA, 18 nt, Homo sapiens
caccauucuccugccuca

SEQ ID NO: 7561 - RNA, 20 nt, Homo sapiens
cggggcucccugggcccggu

SEQ ID NO: 7562 - RNA, 18 nt, Homo sapiens
gccccaucgggcacccca

SEQ ID NO: 7563 - RNA, 17 nt, Homo sapiens
aaaaagaaaggaaauau

SEQ ID NO: 7564 - RNA, 22 nt, Homo sapiens
agaagggaguguuucuugugcc

SEQ ID NO: 7565 - RNA, 17 nt, Homo sapiens
ccacaacaaaggcucau

SEQ ID NO: 7566 - RNA, 20 nt, Homo sapiens
ccacaacaaaggcucaucaa

SEQ ID NO: 7567 - RNA, 22 nt, Homo sapiens
gucacgggcgaacuagaacacu

SEQ ID NO: 7568 - RNA, 21 nt, Homo sapiens
uaaaacuacuacuaugauaua

SEQ ID NO: 7569 - RNA, 18 nt, Homo sapiens
auagugcuguaucacuua

SEQ ID NO: 7570 - RNA, 24 nt, Homo sapiens
augcacuucauacuagcaaucaca

SEQ ID NO: 7571 - RNA, 18 nt, Homo sapiens
cuauuggagcauacagua

SEQ ID NO: 7572 - RNA, 17 nt, Homo sapiens
cuccauuagacccucaa

SEQ ID NO: 7573 - RNA, 19 nt, Homo sapiens
gcguuuuaacuuuaucuca

SEQ ID NO: 7574 - RNA, 17 nt, Homo sapiens
ucuuuuucaccguuuuu

SEQ ID NO: 7575 - RNA, 21 nt, Homo sapiens
uuucgguagcguuuuaacuuu

SEQ ID NO: 7576 - RNA, 15 nt, Homo sapiens
aacagaggcuauugu

SEQ ID NO: 7577 - RNA, 21 nt, Homo sapiens
cauccgauuucuccuccugcc

SEQ ID NO: 7578 - RNA, 23 nt, Homo sapiens
gagaacuccaucagaaaaccaaa

SEQ ID NO: 7579 - RNA, 20 nt, Homo sapiens
ugaaccuccaaauggaauua

SEQ ID NO: 7580 - RNA, 16 nt, Homo sapiens
ugaaugacuugacuuc

SEQ ID NO: 7581 - RNA, 19 nt, Homo sapiens
cacaacugucuuagacugc

SEQ ID NO: 7582 - RNA, 19 nt, Homo sapiens
cacuuaaauucucuaaccg

SEQ ID NO: 7583 - RNA, 22 nt, Homo sapiens
aaacccuguccucccaccccuc

SEQ ID NO: 7584 - RNA, 24 nt, Homo sapiens
agacccucgagauuaacggugcua

SEQ ID NO: 7585 - RNA, 22 nt, Homo sapiens
ccaaacccuguccucccacccc

SEQ ID NO: 7586 - RNA, 18 nt, Homo sapiens
gcccugagcuggccucac

SEQ ID NO: 7587 - RNA, 20 nt, Homo sapiens
gacaaaaucugauccauaua

SEQ ID NO: 7588 - RNA, 18 nt, Homo sapiens
gaguugacacugaaaucu

SEQ ID NO: 7589 - RNA, 23 nt, Homo sapiens
guacacagaaacaggacugcuca

SEQ ID NO: 7590 - RNA, 20 nt, Homo sapiens
ucccccaacccccaccccac

SEQ ID NO: 7591 - RNA, 21 nt, Homo sapiens
aauaggacagaugagugucau

SEQ ID NO: 7592 - RNA, 20 nt, Homo sapiens
agguuauuuuauuuauugua

SEQ ID NO: 7593 - RNA, 21 nt, Homo sapiens
aguacaauuagaaacacuguu

SEQ ID NO: 7594 - RNA, 19 nt, Homo sapiens
auugcguguucagauccaa

SEQ ID NO: 7595 - RNA, 16 nt, Homo sapiens
cccucagacuuuaaga

SEQ ID NO: 7596 - RNA, 18 nt, Homo sapiens
gccacucauauuaauuua

SEQ ID NO: 7597 - RNA, 18 nt, Homo sapiens
gcuugguggugaagccac

SEQ ID NO: 7598 - RNA, 26 nt, Homo sapiens
guaguccuaagaugcuggcuauuuua

SEQ ID NO: 7599 - RNA, 22 nt, Homo sapiens
uaccguuuuuauuuucauaaca

SEQ ID NO: 7600 - RNA, 18 nt, Homo sapiens
ucuuuacgauuuaauuga

SEQ ID NO: 7601 - RNA, 17 nt, Homo sapiens
acacacaccccugcuca

SEQ ID NO: 7602 - RNA, 19 nt, Homo sapiens
aauccgaggagcaggacuc

SEQ ID NO: 7603 - RNA, 19 nt, Homo sapiens
ugcucuaauugugaacuuu

SEQ ID NO: 7604 - RNA, 19 nt, Homo sapiens
aaugccucucccauccucu

SEQ ID NO: 7605 - RNA, 19 nt, Homo sapiens
ccuccgaugaaagcagcca

SEQ ID NO: 7606 - RNA, 19 nt, Homo sapiens
ccuucuugggaaacugggc

SEQ ID NO: 7607 - RNA, 18 nt, Homo sapiens
cucagggacagcaauuca

SEQ ID NO: 7608 - RNA, 16 nt, Homo sapiens
cugccaagugcugcuu

SEQ ID NO: 7609 - RNA, 19 nt, Homo sapiens
aaaggaucaguuuggcugc

SEQ ID NO: 7610 - RNA, 18 nt, Homo sapiens
agaaccaccaugucuuca

SEQ ID NO: 7611 - RNA, 21 nt, Homo sapiens
cccuccccagccauccucccc

SEQ ID NO: 7612 - RNA, 24 nt, Homo sapiens
cgcuccccuguccuccuccaccuu

SEQ ID NO: 7613 - RNA, 21 nt, Homo sapiens
uccccugcccuacucauggag

SEQ ID NO: 7614 - RNA, 16 nt, Homo sapiens
uggcccuuggacucca

SEQ ID NO: 7615 - RNA, 18 nt, Homo sapiens
gcauccgaacuccuggau

SEQ ID NO: 7616 - RNA, 17 nt, Homo sapiens
aaucucauuuggaugug

SEQ ID NO: 7617 - RNA, 28 nt, Homo sapiens
auguauuggacuuugaacauuuucugaa

SEQ ID NO: 7618 - RNA, 19 nt, Homo sapiens
uaacauguuaguugucauu

SEQ ID NO: 7619 - RNA, 22 nt, Homo sapiens
uaucugcauuugucugguaaca

SEQ ID NO: 7620 - RNA, 19 nt, Homo sapiens
ucuucagccacaguuguga

SEQ ID NO: 7621 - RNA, 22 nt, Homo sapiens
ccuguucaucucccaacaugcu

SEQ ID NO: 7622 - RNA, 18 nt, Homo sapiens
ggucuuuucccuguucau

SEQ ID NO: 7623 - RNA, 18 nt, Homo sapiens
ccugcaaccuccaccucc

SEQ ID NO: 7624 - RNA, 21 nt, Homo sapiens
aagggcuaaacaugcaugugu

SEQ ID NO: 7625 - RNA, 18 nt, Homo sapiens
gacuugacaguggaacua

SEQ ID NO: 7626 - RNA, 22 nt, Homo sapiens
uucugucucucccaaccccgga

SEQ ID NO: 7627 - RNA, 19 nt, Homo sapiens
cuugggcccagcugggcuc

SEQ ID NO: 7628 - RNA, 23 nt, Homo sapiens
accccgaacucugcuggccuuga

SEQ ID NO: 7629 - RNA, 18 nt, Homo sapiens
ggaagacgcuuccuucca

SEQ ID NO: 7630 - RNA, 19 nt, Homo sapiens
cuccucugagcucugcucu

SEQ ID NO: 7631 - RNA, 21 nt, Homo sapiens
cuucuuuaaaacccuuuagcc

SEQ ID NO: 7632 - RNA, 19 nt, Homo sapiens
auauccuggguaagaaugu

SEQ ID NO: 7633 - RNA, 20 nt, Homo sapiens
gacuucuuaauauggugcug

SEQ ID NO: 7634 - RNA, 20 nt, Homo sapiens
guugaaaacuguaugccaaa

SEQ ID NO: 7635 - RNA, 18 nt, Homo sapiens
ccuuuccacaccugcaaa

SEQ ID NO: 7636 - RNA, 20 nt, Homo sapiens
ugugcuggaaggacaaauaa

SEQ ID NO: 7637 - RNA, 15 nt, Homo sapiens
uucucuuuaaucuca

SEQ ID NO: 7638 - RNA, 15 nt, Homo sapiens
aauaccagcauaaua

SEQ ID NO: 7639 - RNA, 21 nt, Homo sapiens
cugcugcccucccccuccucu

SEQ ID NO: 7640 - RNA, 24 nt, Homo sapiens
ucacacucaugcauuguccucuuu

SEQ ID NO: 7641 - RNA, 20 nt, Homo sapiens
caccuccacccccuucuucc

SEQ ID NO: 7642 - RNA, 16 nt, Homo sapiens
cccaccuccacccccu

SEQ ID NO: 7643 - RNA, 24 nt, Homo sapiens
cuucaagaugccucuucuaccucu

SEQ ID NO: 7644 - RNA, 21 nt, Homo sapiens
gacucacauugccuugagcuu

SEQ ID NO: 7645 - RNA, 17 nt, Homo sapiens
uggcugugcacauucuc

SEQ ID NO: 7646 - RNA, 22 nt, Homo sapiens
uccagcuggacaaagacucugg

SEQ ID NO: 7647 - RNA, 23 nt, Homo sapiens
uuucuuuguaugccuuuggccuu

SEQ ID NO: 7648 - RNA, 19 nt, Homo sapiens
cuuccuuggacucauuuua

SEQ ID NO: 7649 - RNA, 16 nt, Homo sapiens
ccugcuucccagacca

SEQ ID NO: 7650 - RNA, 21 nt, Homo sapiens
aaacauuuuaaaacuuaccuu

SEQ ID NO: 7651 - RNA, 26 nt, Homo sapiens
aaucucaaacuccagcacuggaauua

SEQ ID NO: 7652 - RNA, 20 nt, Homo sapiens
acaaaaacauuuuaaaacuu

SEQ ID NO: 7653 - RNA, 16 nt, Homo sapiens
gagcuacaaaauuuca

SEQ ID NO: 7654 - RNA, 16 nt, Homo sapiens
ugccauucuccugccu

SEQ ID NO: 7655 - RNA, 18 nt, Homo sapiens
cuguugguuucacagaua

SEQ ID NO: 7656 - RNA, 22 nt, Homo sapiens
ggugagguugaggaauaucaca

SEQ ID NO: 7657 - RNA, 18 nt, Homo sapiens
uucuucugauucuagugu

SEQ ID NO: 7658 - RNA, 23 nt, Homo sapiens
acagucuggagaagguauuagca

SEQ ID NO: 7659 - RNA, 18 nt, Homo sapiens
ccccuccaccaaacccca

SEQ ID NO: 7660 - RNA, 24 nt, Homo sapiens
ccuaggcgauuuugucuaccauuu

SEQ ID NO: 7661 - RNA, 19 nt, Homo sapiens
cucacuuucccuuguguca

SEQ ID NO: 7662 - RNA, 21 nt, Homo sapiens
gccugggucccggccaggcuu

SEQ ID NO: 7663 - RNA, 15 nt, Homo sapiens
gguuuuucugucuca

SEQ ID NO: 7664 - RNA, 18 nt, Homo sapiens
aaauccuaccaguuaugu

SEQ ID NO: 7665 - RNA, 20 nt, Homo sapiens
acuccagguagauuuccaca

SEQ ID NO: 7666 - RNA, 21 nt, Homo sapiens
agcuuuuccccauuucccaua

SEQ ID NO: 7667 - RNA, 23 nt, Homo sapiens
ccugguaccauugaguugcugcu

SEQ ID NO: 7668 - RNA, 19 nt, Homo sapiens
gauuguuguguguuuuguu

SEQ ID NO: 7669 - RNA, 21 nt, Homo sapiens
guuaagugccuacuggaaaug

SEQ ID NO: 7670 - RNA, 18 nt, Homo sapiens
uccaagagaguaucauga

SEQ ID NO: 7671 - RNA, 19 nt, Homo sapiens
ucugcuuccagcuuugugu

SEQ ID NO: 7672 - RNA, 21 nt, Homo sapiens
ugaggucugcuaauauggaau

SEQ ID NO: 7673 - RNA, 19 nt, Homo sapiens
uaaaauaaugaauguaaca

SEQ ID NO: 7674 - RNA, 19 nt, Homo sapiens
acagacaaauucucuaauc

SEQ ID NO: 7675 - RNA, 19 nt, Homo sapiens
acucauuuaccacucugug

SEQ ID NO: 7676 - RNA, 21 nt, Homo sapiens
gugauaauuggaaacuccuuu

SEQ ID NO: 7677 - RNA, 19 nt, Homo sapiens
accugggccccacuggaca

SEQ ID NO: 7678 - RNA, 21 nt, Homo sapiens
ucagcuaugacucaguccccu

SEQ ID NO: 7679 - RNA, 21 nt, Homo sapiens
cuugggcugaaggaucgcuuu

SEQ ID NO: 7680 - RNA, 18 nt, Homo sapiens
acuuauuugcccuaagaa

SEQ ID NO: 7681 - RNA, 24 nt, Homo sapiens
ccacgaacacgcaugccucagcca

SEQ ID NO: 7682 - RNA, 24 nt, Homo sapiens
caauucguacguggagaaguggga

SEQ ID NO: 7683 - RNA, 24 nt, Homo sapiens
cagcgggcuauggacaaggaagaa

SEQ ID NO: 7684 - RNA, 19 nt, Homo sapiens
caucccaccgccuucuuuu

SEQ ID NO: 7685 - RNA, 17 nt, Homo sapiens
cccgccccacccccagc

SEQ ID NO: 7686 - RNA, 18 nt, Homo sapiens
gucacagaaaacaucagg

SEQ ID NO: 7687 - RNA, 20 nt, Homo sapiens
uaaauggacuccagaugaaa

SEQ ID NO: 7688 - RNA, 19 nt, Homo sapiens
cacaguaucuuuucuuuca

SEQ ID NO: 7689 - RNA, 19 nt, Homo sapiens
ugcccgggccaugcuccag

SEQ ID NO: 7690 - RNA, 23 nt, Homo sapiens
aaacagcagucccaguauucuca

SEQ ID NO: 7691 - RNA, 19 nt, Homo sapiens
auccuuucugcccacuucc

SEQ ID NO: 7692 - RNA, 22 nt, Homo sapiens
ugcagcuccagccccgggcugc

SEQ ID NO: 7693 - RNA, 18 nt, Homo sapiens
uccccgccacccgcgcgc

SEQ ID NO: 7694 - RNA, 18 nt, Homo sapiens
acaucuaaccuucuagga

SEQ ID NO: 7695 - RNA, 18 nt, Homo sapiens
ugauggaaaaaucuugaa

SEQ ID NO: 7696 - RNA, 22 nt, Homo sapiens
auuugaaugcauuuuguuuggu

SEQ ID NO: 7697 - RNA, 24 nt, Homo sapiens
acuuugcucuauugaacugucuua

SEQ ID NO: 7698 - RNA, 21 nt, Homo sapiens
auggcuuaacaucaugcuaca

SEQ ID NO: 7699 - RNA, 16 nt, Homo sapiens
uccagaggucgcccag

SEQ ID NO: 7700 - RNA, 18 nt, Homo sapiens
uccucaacaggauguaaa

SEQ ID NO: 7701 - RNA, 17 nt, Homo sapiens
uguucagucuggugcca

SEQ ID NO: 7702 - RNA, 26 nt, Homo sapiens
uuuucguucaguguggcuuuaauuuu

SEQ ID NO: 7703 - RNA, 20 nt, Homo sapiens
aaagcgguggauucuggcaa

SEQ ID NO: 7704 - RNA, 17 nt, Homo sapiens
cacuaccaccgucugag

SEQ ID NO: 7705 - RNA, 21 nt, Homo sapiens
ccaccgccaccgccaccgcca

SEQ ID NO: 7706 - RNA, 18 nt, Homo sapiens
ucuuucucucuucccuca

SEQ ID NO: 7707 - RNA, 22 nt, Homo sapiens
accgggcagaagcugggccuuc

SEQ ID NO: 7708 - RNA, 17 nt, Homo sapiens
gcugcuuuccucaccug

SEQ ID NO: 7709 - RNA, 22 nt, Homo sapiens
gcuuggaugacuugccucguuu

SEQ ID NO: 7710 - RNA, 18 nt, Homo sapiens
ugggaauuccagcacuaa

SEQ ID NO: 7711 - RNA, 21 nt, Homo sapiens
auaccucucaguguguuugcu

SEQ ID NO: 7712 - RNA, 19 nt, Homo sapiens
ucugaugauagccagugag

SEQ ID NO: 7713 - RNA, 20 nt, Homo sapiens
gcacccggccuuucuuucuc

SEQ ID NO: 7714 - RNA, 19 nt, Homo sapiens
uuucucccucuugcaacca

SEQ ID NO: 7715 - RNA, 19 nt, Homo sapiens
aguaguuaaacugcuaagc

SEQ ID NO: 7716 - RNA, 18 nt, Homo sapiens
caacuuaggcaguuccca

SEQ ID NO: 7717 - RNA, 22 nt, Homo sapiens
ucaaccccuccccaccacguca

SEQ ID NO: 7718 - RNA, 22 nt, Homo sapiens
uccuggcucgcuggauuugugg

SEQ ID NO: 7719 - RNA, 20 nt, Homo sapiens
acacucuuuccccgcacccc

SEQ ID NO: 7720 - RNA, 18 nt, Homo sapiens
cugaucauguuuaugaga

SEQ ID NO: 7721 - RNA, 21 nt, Homo sapiens
gaaaccuuccugcugagccuc

SEQ ID NO: 7722 - RNA, 18 nt, Homo sapiens
gaauugacauugaaaucu

SEQ ID NO: 7723 - RNA, 27 nt, Homo sapiens
gauugcucaaaucagguuuucuuuuaa

SEQ ID NO: 7724 - RNA, 19 nt, Homo sapiens
ucagucugcuuagaaauaa

SEQ ID NO: 7725 - RNA, 18 nt, Homo sapiens
ccauaugugcuacccaca

SEQ ID NO: 7726 - RNA, 19 nt, Homo sapiens
gcaaacaaaucaugcaaug

SEQ ID NO: 7727 - RNA, 25 nt, Homo sapiens
uuucuuuccucccugucuuagacuu

SEQ ID NO: 7728 - RNA, 17 nt, Homo sapiens
ucaagugauucuugugc

SEQ ID NO: 7729 - RNA, 19 nt, Homo sapiens
ugucguaagaauaucuguc

SEQ ID NO: 7730 - RNA, 24 nt, Homo sapiens
aaaguaaacacauuaauuuccuca

SEQ ID NO: 7731 - RNA, 20 nt, Homo sapiens
accugaaaccaagauuggcu

SEQ ID NO: 7732 - RNA, 22 nt, Homo sapiens
agaauuauauaaucacugcuuu

SEQ ID NO: 7733 - RNA, 17 nt, Homo sapiens
ccagugaagcuuaccua

SEQ ID NO: 7734 - RNA, 15 nt, Homo sapiens
ccauaaucgugccac

SEQ ID NO: 7735 - RNA, 21 nt, Homo sapiens
ccuaacaaaguaaaguuuuca

SEQ ID NO: 7736 - RNA, 22 nt, Homo sapiens
ccuucucuguacccauacagca

SEQ ID NO: 7737 - RNA, 18 nt, Homo sapiens
cggcugcccgcgguugca

SEQ ID NO: 7738 - RNA, 18 nt, Homo sapiens
cugaguaguuuugaucag

SEQ ID NO: 7739 - RNA, 16 nt, Homo sapiens
gccacaucuaaucuca

SEQ ID NO: 7740 - RNA, 23 nt, Homo sapiens
gcuauaaagcaagaaaguaaaca

SEQ ID NO: 7741 - RNA, 21 nt, Homo sapiens
gcuugaaaauaaauuaugggg

SEQ ID NO: 7742 - RNA, 19 nt, Homo sapiens
uacuaauggaauaaacugu

SEQ ID NO: 7743 - RNA, 18 nt, Homo sapiens
ucuuuuucacgcauuugc

SEQ ID NO: 7744 - RNA, 21 nt, Homo sapiens
ugcagugagccauaaucgugc

SEQ ID NO: 7745 - RNA, 20 nt, Homo sapiens
gcaccuccucgguugcgcac

SEQ ID NO: 7746 - RNA, 19 nt, Homo sapiens
aaacaaaagucaaauagca

SEQ ID NO: 7747 - RNA, 19 nt, Homo sapiens
aaauaaaauuugcucuagu

SEQ ID NO: 7748 - RNA, 18 nt, Homo sapiens
aggggccuccaucccucu

SEQ ID NO: 7749 - RNA, 19 nt, Homo sapiens
ccacauauucuugccaauu

SEQ ID NO: 7750 - RNA, 19 nt, Homo sapiens
cugaucaagcuggacuugu

SEQ ID NO: 7751 - RNA, 18 nt, Homo sapiens
cgcugugucaucacauca

SEQ ID NO: 7752 - RNA, 17 nt, Homo sapiens
gggccacuugcuugauu

SEQ ID NO: 7753 - RNA, 18 nt, Homo sapiens
cucccucccucugccuuu

SEQ ID NO: 7754 - RNA, 20 nt, Homo sapiens
ccauuucuucucucuguucc

SEQ ID NO: 7755 - RNA, 18 nt, Homo sapiens
ugcggcugccugcccccc

SEQ ID NO: 7756 - RNA, 23 nt, Homo sapiens
agacacaagaacaaucuuugcua

SEQ ID NO: 7757 - RNA, 22 nt, Homo sapiens
auaauucuuugcucuuguuuca

SEQ ID NO: 7758 - RNA, 22 nt, Homo sapiens
gccaaaaucacuguuaaaaucu

SEQ ID NO: 7759 - RNA, 19 nt, Homo sapiens
ugucaacacucauacuuca

SEQ ID NO: 7760 - RNA, 20 nt, Homo sapiens
uuuuguauauaagcaguaga

SEQ ID NO: 7761 - RNA, 21 nt, Homo sapiens
aagaugcacugaaaacuuagc

SEQ ID NO: 7762 - RNA, 17 nt, Homo sapiens
acaaaagcaggcuagag

SEQ ID NO: 7763 - RNA, 21 nt, Homo sapiens
agaaaagcccauuuucaacug

SEQ ID NO: 7764 - RNA, 17 nt, Homo sapiens
agcaaauagugauaaca

SEQ ID NO: 7765 - RNA, 26 nt, Homo sapiens
auccucauguuacucaguguuagaga

SEQ ID NO: 7766 - RNA, 17 nt, Homo sapiens
gcccagcaaauagugau

SEQ ID NO: 7767 - RNA, 23 nt, Homo sapiens
uguaacugugugugugugugugu

SEQ ID NO: 7768 - RNA, 19 nt, Homo sapiens
gcacagcaaagaucugcca

SEQ ID NO: 7769 - RNA, 19 nt, Homo sapiens
cacuuaauucuucccauuu

SEQ ID NO: 7770 - RNA, 19 nt, Homo sapiens
cagcacuugacagcucucc

SEQ ID NO: 7771 - RNA, 18 nt, Homo sapiens
uccacuucacccacucca

SEQ ID NO: 7772 - RNA, 18 nt, Homo sapiens
ucucugagcuauauccuc

SEQ ID NO: 7773 - RNA, 19 nt, Homo sapiens
ugccaucacaucccugaua

SEQ ID NO: 7774 - RNA, 17 nt, Homo sapiens
auggcacagggcaugaa

SEQ ID NO: 7775 - RNA, 18 nt, Homo sapiens
ccugaaaugugugugaug

SEQ ID NO: 7776 - RNA, 20 nt, Homo sapiens
cugaaaugugugugauguga

SEQ ID NO: 7777 - RNA, 18 nt, Homo sapiens
cuguaagcuguuugguuu

SEQ ID NO: 7778 - RNA, 20 nt, Homo sapiens
cccuuccccacccucuggcc

SEQ ID NO: 7779 - RNA, 20 nt, Homo sapiens
cuucucugguccucugcauc

SEQ ID NO: 7780 - RNA, 19 nt, Homo sapiens
ccacuugcacgccaccauu

SEQ ID NO: 7781 - RNA, 24 nt, Homo sapiens
gcaccaggaggugccucugccucu

SEQ ID NO: 7782 - RNA, 20 nt, Homo sapiens
uaugacucaggauuuauuca

SEQ ID NO: 7783 - RNA, 19 nt, Homo sapiens
ugcacgccaccauucaguc

SEQ ID NO: 7784 - RNA, 18 nt, Homo sapiens
uucuaucuuucuuccacc

SEQ ID NO: 7785 - RNA, 17 nt, Homo sapiens
gggacuuugcauacucu

SEQ ID NO: 7786 - RNA, 16 nt, Homo sapiens
uagcaaaacaaauuca

SEQ ID NO: 7787 - RNA, 19 nt, Homo sapiens
ugcacauuuuuuucuaugc

SEQ ID NO: 7788 - RNA, 15 nt, Homo sapiens
ggcgugacucugaua

SEQ ID NO: 7789 - RNA, 20 nt, Homo sapiens
ggguuuuauugcuguuguua

SEQ ID NO: 7790 - RNA, 20 nt, Homo sapiens
ucucggcuguuggggacuuu

SEQ ID NO: 7791 - RNA, 22 nt, Homo sapiens
aauacgucagauuggaccagug

SEQ ID NO: 7792 - RNA, 21 nt, Homo sapiens
gaccuuguucucccacccgac

SEQ ID NO: 7793 - RNA, 18 nt, Homo sapiens
gauuccggagugggacug

SEQ ID NO: 7794 - RNA, 21 nt, Homo sapiens
aauagcgcccugugcagcuga

SEQ ID NO: 7795 - RNA, 17 nt, Homo sapiens
ccgccgccgccucccgg

SEQ ID NO: 7796 - RNA, 19 nt, Homo sapiens
cgcgcgccgcuuccgucgc

SEQ ID NO: 7797 - RNA, 27 nt, Homo sapiens
gugcugcuuagaggugcucgcgccgcu

SEQ ID NO: 7798 - RNA, 19 nt, Homo sapiens
uccgcguccagugcugcuu

SEQ ID NO: 7799 - RNA, 16 nt, Homo sapiens
gaucucgacagcuguu

SEQ ID NO: 7800 - RNA, 18 nt, Homo sapiens
aagccgacaccacuccug

SEQ ID NO: 7801 - RNA, 22 nt, Homo sapiens
acccccucgccuccuacucuga

SEQ ID NO: 7802 - RNA, 18 nt, Homo sapiens
ccgcugagaggcugccuc

SEQ ID NO: 7803 - RNA, 20 nt, Homo sapiens
cucugggggcagauuugugg

SEQ ID NO: 7804 - RNA, 17 nt, Homo sapiens
gcuccuacccuguaagc

SEQ ID NO: 7805 - RNA, 18 nt, Homo sapiens
guugauuguacguagcca

SEQ ID NO: 7806 - RNA, 21 nt, Homo sapiens
uagccgaacuccaggcugggc

SEQ ID NO: 7807 - RNA, 19 nt, Homo sapiens
ugacgggccaggccuggag

SEQ ID NO: 7808 - RNA, 20 nt, Homo sapiens
uguaauuguuguuuguaugu

SEQ ID NO: 7809 - RNA, 19 nt, Homo sapiens
cuacaaugucccaauauca

SEQ ID NO: 7810 - RNA, 18 nt, Homo sapiens
gauaauaauuagaucuug

SEQ ID NO: 7811 - RNA, 19 nt, Homo sapiens
uaucaacucaggaaaucuc

SEQ ID NO: 7812 - RNA, 22 nt, Homo sapiens
ccacccagcacccagcaacucc

SEQ ID NO: 7813 - RNA, 22 nt, Homo sapiens
cccagaaggaccuccugagcga

SEQ ID NO: 7814 - RNA, 18 nt, Homo sapiens
cucuccaccccauaguga

SEQ ID NO: 7815 - RNA, 23 nt, Homo sapiens
gcuccccucccuccucugucccu

SEQ ID NO: 7816 - RNA, 19 nt, Homo sapiens
uagguagugcccuauuuua

SEQ ID NO: 7817 - RNA, 22 nt, Homo sapiens
auccuuauuuauauaucaguua

SEQ ID NO: 7818 - RNA, 25 nt, Homo sapiens
uaggauuuauaucuaaguuugguua

SEQ ID NO: 7819 - RNA, 25 nt, Homo sapiens
uggacccuccacuucaaucugagaa

SEQ ID NO: 7820 - RNA, 16 nt, Homo sapiens
uguggaggacuuugaa

SEQ ID NO: 7821 - RNA, 21 nt, Homo sapiens
cgcgcggcgccggcagccucg

SEQ ID NO: 7822 - RNA, 19 nt, Homo sapiens
cccuccccaaaaccuuucc

SEQ ID NO: 7823 - RNA, 19 nt, Homo sapiens
cccuccccugucuucucuc

SEQ ID NO: 7824 - RNA, 16 nt, Homo sapiens
gacagagccgcaaauc

SEQ ID NO: 7825 - RNA, 20 nt, Homo sapiens
gcuucuccuccagguauuug

SEQ ID NO: 7826 - RNA, 17 nt, Homo sapiens
ggccggguggccaaucc

SEQ ID NO: 7827 - RNA, 19 nt, Homo sapiens
uuagggaaaccaauagucc

SEQ ID NO: 7828 - RNA, 18 nt, Homo sapiens
uuugaguuguuuuggugc

SEQ ID NO: 7829 - RNA, 17 nt, Homo sapiens
uuuucuuuauugcugug

SEQ ID NO: 7830 - RNA, 22 nt, Homo sapiens
gcucugaaccaguguucuccac

SEQ ID NO: 7831 - RNA, 23 nt, Homo sapiens
ucaacuccaccccaucccauccc

SEQ ID NO: 7832 - RNA, 27 nt, Homo sapiens
uuucuucuggaugagcucuuugguuuu

SEQ ID NO: 7833 - RNA, 20 nt, Homo sapiens
acuucuaauugccauguaca

SEQ ID NO: 7834 - RNA, 23 nt, Homo sapiens
caacuuuucuauuaaaaguggga

SEQ ID NO: 7835 - RNA, 18 nt, Homo sapiens
gaggaggguggggagaca

SEQ ID NO: 7836 - RNA, 22 nt, Homo sapiens
gcuugugggacuagccuggcuu

SEQ ID NO: 7837 - RNA, 26 nt, Homo sapiens
ucuagguaauuuuuacagaauugcuu

SEQ ID NO: 7838 - RNA, 22 nt, Homo sapiens
aggagagagaaaggauuccccu

SEQ ID NO: 7839 - RNA, 22 nt, Homo sapiens
ccuggucgugaggaacagccgc

SEQ ID NO: 7840 - RNA, 21 nt, Homo sapiens
cgagcucggcugggcuuggcg

SEQ ID NO: 7841 - RNA, 20 nt, Homo sapiens
ucugaccuuguuucagcaaa

SEQ ID NO: 7842 - RNA, 21 nt, Homo sapiens
ugguccugcagugugaaacug

SEQ ID NO: 7843 - RNA, 19 nt, Homo sapiens
uuauaucauuucuuuuuca

SEQ ID NO: 7844 - RNA, 21 nt, Homo sapiens
aagacuugagaagcugucaca

SEQ ID NO: 7845 - RNA, 18 nt, Homo sapiens
cagaccuccagccacuca

SEQ ID NO: 7846 - RNA, 25 nt, Homo sapiens
gaccuccagccacucacagcucuuu

SEQ ID NO: 7847 - RNA, 20 nt, Homo sapiens
agaaagaucucugugcugua

SEQ ID NO: 7848 - RNA, 17 nt, Homo sapiens
ccagagagucuagggca

SEQ ID NO: 7849 - RNA, 16 nt, Homo sapiens
ccccgccccccgcacu

SEQ ID NO: 7850 - RNA, 15 nt, Homo sapiens
cuuaccccuuuccac

SEQ ID NO: 7851 - RNA, 23 nt, Homo sapiens
cuuggguagcgggauaagucacu

SEQ ID NO: 7852 - RNA, 25 nt, Homo sapiens
ugucaaugauguaaauucagucccu

SEQ ID NO: 7853 - RNA, 19 nt, Homo sapiens
ccuguacccucccauacuc

SEQ ID NO: 7854 - RNA, 21 nt, Homo sapiens
ucccaggaaccggagcuggaa

SEQ ID NO: 7855 - RNA, 19 nt, Homo sapiens
aucaaaaauacuaacauca

SEQ ID NO: 7856 - RNA, 18 nt, Homo sapiens
aacuggucccacacgcac

SEQ ID NO: 7857 - RNA, 23 nt, Homo sapiens
aagacccuuaguaccaaauacac

SEQ ID NO: 7858 - RNA, 20 nt, Homo sapiens
acggcccuuugagauggugc

SEQ ID NO: 7859 - RNA, 23 nt, Homo sapiens
cacuuuuugauuaaagcucuuca

SEQ ID NO: 7860 - RNA, 21 nt, Homo sapiens
cucuaugggaguggcuuuuaa

SEQ ID NO: 7861 - RNA, 19 nt, Homo sapiens
gccagauccuguguugcca

SEQ ID NO: 7862 - RNA, 18 nt, Homo sapiens
gcucgucaucugugcagg

SEQ ID NO: 7863 - RNA, 21 nt, Homo sapiens
ucggcaguuucagguguagcu

SEQ ID NO: 7864 - RNA, 22 nt, Homo sapiens
ucuaagugauuuaaugcacuuu

SEQ ID NO: 7865 - RNA, 21 nt, Homo sapiens
ucugccuuccagaggccgcuu

SEQ ID NO: 7866 - RNA, 21 nt, Homo sapiens
uuccagaggccgcuucuccag

SEQ ID NO: 7867 - RNA, 17 nt, Homo sapiens
gacacuugcaggacuga

SEQ ID NO: 7868 - RNA, 19 nt, Homo sapiens
accuccggcugccuagccc

SEQ ID NO: 7869 - RNA, 23 nt, Homo sapiens
cccauggcuuguucucuggaacc

SEQ ID NO: 7870 - RNA, 22 nt, Homo sapiens
ccgggggcgccgccggccccgc

SEQ ID NO: 7871 - RNA, 17 nt, Homo sapiens
cucaggucagcugggag

SEQ ID NO: 7872 - RNA, 22 nt, Homo sapiens
gacccgccugcucccauccuca

SEQ ID NO: 7873 - RNA, 21 nt, Homo sapiens
gcccaccuuggacccugguga

SEQ ID NO: 7874 - RNA, 24 nt, Homo sapiens
ggacagggagggccggcggcucug

SEQ ID NO: 7875 - RNA, 19 nt, Homo sapiens
gugacguguguucuuuuga

SEQ ID NO: 7876 - RNA, 22 nt, Homo sapiens
ugggcucugccaaugugggcug

SEQ ID NO: 7877 - RNA, 19 nt, Homo sapiens
ccaaagcugucccuucuca

SEQ ID NO: 7878 - RNA, 20 nt, Homo sapiens
aauuguucugcucuaacuga

SEQ ID NO: 7879 - RNA, 23 nt, Homo sapiens
gccaccccugcuccuucggagga

SEQ ID NO: 7880 - RNA, 20 nt, Homo sapiens
gauccaguuugggauuauga

SEQ ID NO: 7881 - RNA, 18 nt, Homo sapiens
uuuuuuuuuuugccugug

SEQ ID NO: 7882 - RNA, 19 nt, Homo sapiens
gccccgccgccuucccuca

SEQ ID NO: 7883 - RNA, 24 nt, Homo sapiens
gcggcgacgccggggaucuuuguc

SEQ ID NO: 7884 - RNA, 18 nt, Homo sapiens
ucucuguccaccacacac

SEQ ID NO: 7885 - RNA, 20 nt, Homo sapiens
ugagacucugucucaauaaa

SEQ ID NO: 7886 - RNA, 18 nt, Homo sapiens
aaauuuggaaacagauug

SEQ ID NO: 7887 - RNA, 19 nt, Homo sapiens
aagggacagcagcugacca

SEQ ID NO: 7888 - RNA, 21 nt, Homo sapiens
acaaaaaccaaagggacagca

SEQ ID NO: 7889 - RNA, 20 nt, Homo sapiens
agagagagaaauuggggacc

SEQ ID NO: 7890 - RNA, 18 nt, Homo sapiens
acagcagccucccuguca

SEQ ID NO: 7891 - RNA, 22 nt, Homo sapiens
agcuuggugucuuggcacuguu

SEQ ID NO: 7892 - RNA, 16 nt, Homo sapiens
ccacagcugcuggcca

SEQ ID NO: 7893 - RNA, 27 nt, Homo sapiens
cgacugucauguggcuugguuugguca

SEQ ID NO: 7894 - RNA, 18 nt, Homo sapiens
cugagccucucucgguca

SEQ ID NO: 7895 - RNA, 21 nt, Homo sapiens
gacgaggacacucgcuugccg

SEQ ID NO: 7896 - RNA, 20 nt, Homo sapiens
gguaaguggaggaaauguug

SEQ ID NO: 7897 - RNA, 21 nt, Homo sapiens
ugagacccccaagcuuccacc

SEQ ID NO: 7898 - RNA, 16 nt, Homo sapiens
ugccugugugcuccgg

SEQ ID NO: 7899 - RNA, 18 nt, Homo sapiens
uugcccacuaggauccca

SEQ ID NO: 7900 - RNA, 17 nt, Homo sapiens
aaaauggauuuuaguca

SEQ ID NO: 7901 - RNA, 18 nt, Homo sapiens
aagguguucauuuuguca

SEQ ID NO: 7902 - RNA, 21 nt, Homo sapiens
cccuuuuuccuagugguguca

SEQ ID NO: 7903 - RNA, 20 nt, Homo sapiens
ccugccucgcccccacuuuu

SEQ ID NO: 7904 - RNA, 22 nt, Homo sapiens
gaacacagaguguguuuuugca

SEQ ID NO: 7905 - RNA, 25 nt, Homo sapiens
gauuuucuaguuuccugccuucaga

SEQ ID NO: 7906 - RNA, 24 nt, Homo sapiens
acugaguggcaagucccuuuguga

SEQ ID NO: 7907 - RNA, 20 nt, Homo sapiens
gcucugcgggacucugagga

SEQ ID NO: 7908 - RNA, 19 nt, Homo sapiens
aaaccuccaaaagcccuga

SEQ ID NO: 7909 - RNA, 23 nt, Homo sapiens
aaaugcaguauuuuuguuguguu

SEQ ID NO: 7910 - RNA, 22 nt, Homo sapiens
ccuccaaaagcccugaguuuca

SEQ ID NO: 7911 - RNA, 20 nt, Homo sapiens
aggugcaagccacauuguug

SEQ ID NO: 7912 - RNA, 19 nt, Homo sapiens
caaccccgccucuuccucc

SEQ ID NO: 7913 - RNA, 23 nt, Homo sapiens
aacaaaucuggauaaaugugcaa

SEQ ID NO: 7914 - RNA, 22 nt, Homo sapiens
caguauuguagagcaagucuug

SEQ ID NO: 7915 - RNA, 21 nt, Homo sapiens
ggacauaggcaaaauaacuug

SEQ ID NO: 7916 - RNA, 17 nt, Homo sapiens
gguaugaguauauacca

SEQ ID NO: 7917 - RNA, 18 nt, Homo sapiens
ugguggcugaauuuccca

SEQ ID NO: 7918 - RNA, 22 nt, Homo sapiens
uucauagguguucugcauuuga

SEQ ID NO: 7919 - RNA, 21 nt, Homo sapiens
ucagucaggcccccuuaccca

SEQ ID NO: 7920 - RNA, 20 nt, Homo sapiens
ugcaggucucagcuugcggg

SEQ ID NO: 7921 - RNA, 18 nt, Homo sapiens
cgcuuggaacagaccccg

SEQ ID NO: 7922 - RNA, 20 nt, Homo sapiens
ucuaggcagucuugaaaggc

SEQ ID NO: 7923 - RNA, 20 nt, Homo sapiens
uucuccugccuguugcuuuu

SEQ ID NO: 7924 - RNA, 20 nt, Homo sapiens
uuuuccaaacacacaugaca

SEQ ID NO: 7925 - RNA, 24 nt, Homo sapiens
cuuuugguauuuguuuguagcuuu

SEQ ID NO: 7926 - RNA, 18 nt, Homo sapiens
aacacaggcuugucgugc

SEQ ID NO: 7927 - RNA, 18 nt, Homo sapiens
ccccguucauuuucucca

SEQ ID NO: 7928 - RNA, 21 nt, Homo sapiens
cgcacggaggcccgcgcugcu

SEQ ID NO: 7929 - RNA, 20 nt, Homo sapiens
ggcugcccccccguucauuu

SEQ ID NO: 7930 - RNA, 19 nt, Homo sapiens
gugaugauccucccauccg

SEQ ID NO: 7931 - RNA, 23 nt, Homo sapiens
gugcauggcugcccccccguuca

SEQ ID NO: 7932 - RNA, 19 nt, Homo sapiens
cgccaccgccucugccucc

SEQ ID NO: 7933 - RNA, 19 nt, Homo sapiens
ugagucagcagaugaugaa

SEQ ID NO: 7934 - RNA, 26 nt, Homo sapiens
agcaugggccucaccuccucugugau

SEQ ID NO: 7935 - RNA, 21 nt, Homo sapiens
gcaccaaagacaucagucucc

SEQ ID NO: 7936 - RNA, 17 nt, Homo sapiens
aagaaacugaaaguaca

SEQ ID NO: 7937 - RNA, 19 nt, Homo sapiens
uccuauuaaaagccaugca

SEQ ID NO: 7938 - RNA, 19 nt, Homo sapiens
cccuuccccuuacuccccg

SEQ ID NO: 7939 - RNA, 24 nt, Homo sapiens
caacuauuugaacuguugagugau

SEQ ID NO: 7940 - RNA, 19 nt, Homo sapiens
ccuuguccucaucucaggu

SEQ ID NO: 7941 - RNA, 18 nt, Homo sapiens
uuuaaauaugccuuuaaa

SEQ ID NO: 7942 - RNA, 19 nt, Homo sapiens
guauggaauguuucauacu

SEQ ID NO: 7943 - RNA, 18 nt, Homo sapiens
ucagucccuauuaugcaa

SEQ ID NO: 7944 - RNA, 19 nt, Homo sapiens
uuucuaucugauuugcuuu

SEQ ID NO: 7945 - RNA, 19 nt, Homo sapiens
aaacccugccccgaaucuu

SEQ ID NO: 7946 - RNA, 22 nt, Homo sapiens
cccagggcccagcuucccagga

SEQ ID NO: 7947 - RNA, 25 nt, Homo sapiens
uaaacccuuauaauaaaauccuucu

SEQ ID NO: 7948 - RNA, 22 nt, Homo sapiens
ugcaauuuaaaggguugaccca

SEQ ID NO: 7949 - RNA, 21 nt, Homo sapiens
uuuaagcgaaugauugcuuuu

SEQ ID NO: 7950 - RNA, 21 nt, Homo sapiens
caacccucguccucugcgccu

SEQ ID NO: 7951 - RNA, 21 nt, Homo sapiens
ggcuguaaauugaacuuccca

SEQ ID NO: 7952 - RNA, 18 nt, Homo sapiens
uaugauauuauuugauug

SEQ ID NO: 7953 - RNA, 19 nt, Homo sapiens
acauaaaaagaaaugugaa

SEQ ID NO: 7954 - RNA, 17 nt, Homo sapiens
cugagggucuggugcca

SEQ ID NO: 7955 - RNA, 15 nt, Homo sapiens
ugggaggggugcugc

SEQ ID NO: 7956 - RNA, 24 nt, Homo sapiens
ggaaaaaguaucauggaaauauua

SEQ ID NO: 7957 - RNA, 18 nt, Homo sapiens
uuuucuacagcaaauuua

SEQ ID NO: 7958 - RNA, 24 nt, Homo sapiens
aaaguugacuuuaacaagggguua

SEQ ID NO: 7959 - RNA, 18 nt, Homo sapiens
gaaaugaaugcuccauga

SEQ ID NO: 7960 - RNA, 16 nt, Homo sapiens
ucauugccuugccaaa

SEQ ID NO: 7961 - RNA, 22 nt, Homo sapiens
accuucuguggcugucuuguuu

SEQ ID NO: 7962 - RNA, 17 nt, Homo sapiens
agaaacaugaaaugcuu

SEQ ID NO: 7963 - RNA, 19 nt, Homo sapiens
uuuuaggaggcacaacagu

SEQ ID NO: 7964 - RNA, 16 nt, Homo sapiens
auccagccagacccca

SEQ ID NO: 7965 - RNA, 24 nt, Homo sapiens
cccucccccaugggcuguguccua

SEQ ID NO: 7966 - RNA, 23 nt, Homo sapiens
gaggaggggaccaauucuggaca

SEQ ID NO: 7967 - RNA, 17 nt, Homo sapiens
ggaauucccucccccuc

SEQ ID NO: 7968 - RNA, 19 nt, Homo sapiens
acacuuccaccacccugca

SEQ ID NO: 7969 - RNA, 19 nt, Homo sapiens
cauuaccagacgguucacc

SEQ ID NO: 7970 - RNA, 19 nt, Homo sapiens
ccugcugagggaccagcca

SEQ ID NO: 7971 - RNA, 19 nt, Homo sapiens
cuccccugcacuggagucc

SEQ ID NO: 7972 - RNA, 19 nt, Homo sapiens
gauugacguacuuagcagc

SEQ ID NO: 7973 - RNA, 19 nt, Homo sapiens
ugcccagaacuggacucag

SEQ ID NO: 7974 - RNA, 25 nt, Homo sapiens
cacaaaaugagaauuauauuuguca

SEQ ID NO: 7975 - RNA, 20 nt, Homo sapiens
uagcuuuagugaauuucaaa

SEQ ID NO: 7976 - RNA, 20 nt, Homo sapiens
aagaaccgagcaauuuucug

SEQ ID NO: 7977 - RNA, 19 nt, Homo sapiens
ccgugcaaaucccacaaca

SEQ ID NO: 7978 - RNA, 19 nt, Homo sapiens
gcuccgcagacggggcugc

SEQ ID NO: 7979 - RNA, 25 nt, Homo sapiens
guuuggguuugauuguguuuggcuc

SEQ ID NO: 7980 - RNA, 21 nt, Homo sapiens
acgcccucccuggcccccgcc

SEQ ID NO: 7981 - RNA, 21 nt, Homo sapiens
ccaccccggggucucugggga

SEQ ID NO: 7982 - RNA, 21 nt, Homo sapiens
gcuucccugccaucuggcccu

SEQ ID NO: 7983 - RNA, 17 nt, Homo sapiens
ucauuuuccuaacuuca

SEQ ID NO: 7984 - RNA, 18 nt, Homo sapiens
auggcuaaugaguucuga

SEQ ID NO: 7985 - RNA, 18 nt, Homo sapiens
uauguaauaaaugguuaa

SEQ ID NO: 7986 - RNA, 22 nt, Homo sapiens
ucacaauacauuuguagcuccc

SEQ ID NO: 7987 - RNA, 19 nt, Homo sapiens
uggaugaaaaauaugaaau

SEQ ID NO: 7988 - RNA, 16 nt, Homo sapiens
aggaucaucaaugcua

SEQ ID NO: 7989 - RNA, 18 nt, Homo sapiens
cacauucgcaaugcauca

SEQ ID NO: 7990 - RNA, 24 nt, Homo sapiens
ccgagaacaauuuauaacuguguu

SEQ ID NO: 7991 - RNA, 20 nt, Homo sapiens
cugacaacauaacaggaugu

SEQ ID NO: 7992 - RNA, 20 nt, Homo sapiens
gcuauaggguuugcucugac

SEQ ID NO: 7993 - RNA, 23 nt, Homo sapiens
ggggagcgggcggcggcugcggc

SEQ ID NO: 7994 - RNA, 18 nt, Homo sapiens
gguaaaaaguacacuuua

SEQ ID NO: 7995 - RNA, 17 nt, Homo sapiens
ugcuauuaacaguauca

SEQ ID NO: 7996 - RNA, 24 nt, Homo sapiens
cccacucugccagacacccugaca

SEQ ID NO: 7997 - RNA, 17 nt, Homo sapiens
cuagagaccuuuguucc

SEQ ID NO: 7998 - RNA, 18 nt, Homo sapiens
gugcagcucccuccgugc

SEQ ID NO: 7999 - RNA, 17 nt, Homo sapiens
ugcagcucccuccgugc

SEQ ID NO: 8000 - RNA, 19 nt, Homo sapiens
ugugcagcucccuccgugc

SEQ ID NO: 8001 - RNA, 22 nt, Homo sapiens
uuuuggcggcugcggccucugg

SEQ ID NO: 8002 - RNA, 18 nt, Homo sapiens
ggcuaguguugugugauu

SEQ ID NO: 8003 - RNA, 20 nt, Homo sapiens
ugaguucuccacaacagcuc

SEQ ID NO: 8004 - RNA, 19 nt, Homo sapiens
accucgcgcuugcuggcca

SEQ ID NO: 8005 - RNA, 17 nt, Homo sapiens
gcgcgccgcggcgcugc

SEQ ID NO: 8006 - RNA, 21 nt, Homo sapiens
ugcccagaacgcccgcuccag

SEQ ID NO: 8007 - RNA, 21 nt, Homo sapiens
uuucuacguuucuuuaaccuu

SEQ ID NO: 8008 - RNA, 19 nt, Homo sapiens
uuuguaaauguguacauau

SEQ ID NO: 8009 - RNA, 19 nt, Homo sapiens
agaaaaaagaaguguccga

SEQ ID NO: 8010 - RNA, 21 nt, Homo sapiens
caaguuggacuggguucgguc

SEQ ID NO: 8011 - RNA, 21 nt, Homo sapiens
gcacccaguccggucaccgca

SEQ ID NO: 8012 - RNA, 20 nt, Homo sapiens
cugccuggcccccaaccuca

SEQ ID NO: 8013 - RNA, 18 nt, Homo sapiens
aaucccaaaugcauuuuu

SEQ ID NO: 8014 - RNA, 22 nt, Homo sapiens
uguguggaacgugcccccuugg

SEQ ID NO: 8015 - RNA, 23 nt, Homo sapiens
aaucaugcccagcuucugucaua

SEQ ID NO: 8016 - RNA, 21 nt, Homo sapiens
auccccagcgcccaggucacc

SEQ ID NO: 8017 - RNA, 19 nt, Homo sapiens
gcgcaguggagaacuggga

SEQ ID NO: 8018 - RNA, 20 nt, Homo sapiens
ugcggcggcggcagcgaagc

SEQ ID NO: 8019 - RNA, 16 nt, Homo sapiens
ugggugcaguucugaa

SEQ ID NO: 8020 - RNA, 19 nt, Homo sapiens
uuggguccacagucacucu

SEQ ID NO: 8021 - RNA, 17 nt, Homo sapiens
aaacacugaaucauguu

SEQ ID NO: 8022 - RNA, 22 nt, Homo sapiens
cagcauguacaaaaguaccaua

SEQ ID NO: 8023 - RNA, 21 nt, Homo sapiens
cauguguuguacaauaccaga

SEQ ID NO: 8024 - RNA, 22 nt, Homo sapiens
caucugacggauucccaaaggc

SEQ ID NO: 8025 - RNA, 20 nt, Homo sapiens
ccccggccccggcccccgga

SEQ ID NO: 8026 - RNA, 20 nt, Homo sapiens
cucugauggucacuuugugg

SEQ ID NO: 8027 - RNA, 24 nt, Homo sapiens
ggaaucugauaucaacauauccua

SEQ ID NO: 8028 - RNA, 21 nt, Homo sapiens
ucaggauacccaguucccuca

SEQ ID NO: 8029 - RNA, 21 nt, Homo sapiens
acagugagagaguuuucuuca

SEQ ID NO: 8030 - RNA, 25 nt, Homo sapiens
agcugugcucuggacaguguucuca

SEQ ID NO: 8031 - RNA, 24 nt, Homo sapiens
cacaggggcgccauccagguuuaa

SEQ ID NO: 8032 - RNA, 18 nt, Homo sapiens
uaaaauucauaugugaca

SEQ ID NO: 8033 - RNA, 18 nt, Homo sapiens
uuuggcggcggcggugga

SEQ ID NO: 8034 - RNA, 19 nt, Homo sapiens
ucugaaaacucuaugcugg

SEQ ID NO: 8035 - RNA, 23 nt, Homo sapiens
cccgcccugccuggccgucacca

SEQ ID NO: 8036 - RNA, 21 nt, Homo sapiens
ccuagccccuccuuauucuca

SEQ ID NO: 8037 - RNA, 23 nt, Homo sapiens
ccuccccgcccugccuggccguc

SEQ ID NO: 8038 - RNA, 24 nt, Homo sapiens
gccagcagagcaggcugacgaccu

SEQ ID NO: 8039 - RNA, 21 nt, Homo sapiens
gugcugcgaggugggggaccc

SEQ ID NO: 8040 - RNA, 17 nt, Homo sapiens
aauauaucccuauacuc

SEQ ID NO: 8041 - RNA, 19 nt, Homo sapiens
caaguggaggugggagcgg

SEQ ID NO: 8042 - RNA, 19 nt, Homo sapiens
ccgauaaacaccuugcauc

SEQ ID NO: 8043 - RNA, 18 nt, Homo sapiens
gagccuaccaugaggcug

SEQ ID NO: 8044 - RNA, 22 nt, Homo sapiens
gcuugaacucugggcuuggugc

SEQ ID NO: 8045 - RNA, 21 nt, Homo sapiens
uccacagacagggaaacaagc

SEQ ID NO: 8046 - RNA, 19 nt, Homo sapiens
uccaucuuucuucugcccu

SEQ ID NO: 8047 - RNA, 19 nt, Homo sapiens
ucugaagggccccuggccu

SEQ ID NO: 8048 - RNA, 21 nt, Homo sapiens
uggauccccagaguugaucca

SEQ ID NO: 8049 - RNA, 24 nt, Homo sapiens
auuuuccagugauugcuuuggccu

SEQ ID NO: 8050 - RNA, 18 nt, Homo sapiens
ugugcaccacacauucca

SEQ ID NO: 8051 - RNA, 26 nt, Homo sapiens
aaugcgggagguucaaugugaagcug

SEQ ID NO: 8052 - RNA, 24 nt, Homo sapiens
agaaguagcaguaccuggggagcu

SEQ ID NO: 8053 - RNA, 18 nt, Homo sapiens
ccuggaagaggcuuguga

SEQ ID NO: 8054 - RNA, 17 nt, Homo sapiens
gcucugguggagguggg

SEQ ID NO: 8055 - RNA, 23 nt, Homo sapiens
guuuccucugccugcgccgggca

SEQ ID NO: 8056 - RNA, 22 nt, Homo sapiens
caggaaaugaacccuucuuaca

SEQ ID NO: 8057 - RNA, 23 nt, Homo sapiens
gacaguguugggcaucugcuccc

SEQ ID NO: 8058 - RNA, 22 nt, Homo sapiens
gagcucccccagucagaucuca

SEQ ID NO: 8059 - RNA, 18 nt, Homo sapiens
guccccuccgaggaguca

SEQ ID NO: 8060 - RNA, 16 nt, Homo sapiens
uacccaaaucagcccc

SEQ ID NO: 8061 - RNA, 21 nt, Homo sapiens
aggcacuucuaggaccuggcu

SEQ ID NO: 8062 - RNA, 19 nt, Homo sapiens
gcuuaguguuuucauugca

SEQ ID NO: 8063 - RNA, 22 nt, Homo sapiens
guacaaagaagccuccuaccca

SEQ ID NO: 8064 - RNA, 18 nt, Homo sapiens
uucuuuauguauuaaccu

SEQ ID NO: 8065 - RNA, 19 nt, Homo sapiens
aaaugccgcugcaaugcaa

SEQ ID NO: 8066 - RNA, 18 nt, Homo sapiens
acccccgcccccaccucc

SEQ ID NO: 8067 - RNA, 21 nt, Homo sapiens
gggacacccccgcccccaccu

SEQ ID NO: 8068 - RNA, 19 nt, Homo sapiens
cggacccacucucugccuu

SEQ ID NO: 8069 - RNA, 23 nt, Homo sapiens
gaggagggaaaauaagcgaggca

SEQ ID NO: 8070 - RNA, 24 nt, Homo sapiens
ggggcucaccccaauccgucugcc

SEQ ID NO: 8071 - RNA, 18 nt, Homo sapiens
ugguugcgcagccaccuc

SEQ ID NO: 8072 - RNA, 23 nt, Homo sapiens
aagaaagggcaggcggcucggcg

SEQ ID NO: 8073 - RNA, 20 nt, Homo sapiens
acacccccuuccuccuacca

SEQ ID NO: 8074 - RNA, 22 nt, Homo sapiens
cagaagaaaaacaagccuccuc

SEQ ID NO: 8075 - RNA, 23 nt, Homo sapiens
ccuuuuauaugugccuucacuuu

SEQ ID NO: 8076 - RNA, 20 nt, Homo sapiens
gccuccgggggacgccgcua

SEQ ID NO: 8077 - RNA, 19 nt, Homo sapiens
guaaguuuuauaagggagu

SEQ ID NO: 8078 - RNA, 20 nt, Homo sapiens
uccugaugauccuaaccugc

SEQ ID NO: 8079 - RNA, 20 nt, Homo sapiens
ucuagaaugacacucuguuc

SEQ ID NO: 8080 - RNA, 20 nt, Homo sapiens
uggcugaagauuuuucuagu

SEQ ID NO: 8081 - RNA, 17 nt, Homo sapiens
agaaagccaacaugugg

SEQ ID NO: 8082 - RNA, 22 nt, Homo sapiens
caaagaauuccaaagcaaaacc

SEQ ID NO: 8083 - RNA, 20 nt, Homo sapiens
ccauugugaaccaaugcaag

SEQ ID NO: 8084 - RNA, 22 nt, Homo sapiens
aaagccuugccagauucagaca

SEQ ID NO: 8085 - RNA, 23 nt, Homo sapiens
agaccggcgccggaggagacgca

SEQ ID NO: 8086 - RNA, 20 nt, Homo sapiens
agauggagaagagaccauca

SEQ ID NO: 8087 - RNA, 23 nt, Homo sapiens
gcaaagcacaaagaacauuuauc

SEQ ID NO: 8088 - RNA, 21 nt, Homo sapiens
uacaucucaauaugguuccca

SEQ ID NO: 8089 - RNA, 22 nt, Homo sapiens
uccuucugaccacacacagaca

SEQ ID NO: 8090 - RNA, 18 nt, Homo sapiens
ugcucaacccaagcuucu

SEQ ID NO: 8091 - RNA, 17 nt, Homo sapiens
uguacuuugugcaggga

SEQ ID NO: 8092 - RNA, 27 nt, Homo sapiens
gcgccucaacugucguugguguauuuu

SEQ ID NO: 8093 - RNA, 16 nt, Homo sapiens
auagcgcccuggaaca

SEQ ID NO: 8094 - RNA, 25 nt, Homo sapiens
ccuccccaucguccccaucguccuc

SEQ ID NO: 8095 - RNA, 18 nt, Homo sapiens
ccucugggagauugugga

SEQ ID NO: 8096 - RNA, 25 nt, Homo sapiens
gcucuuccucuggguaaaggucugu

SEQ ID NO: 8097 - RNA, 19 nt, Homo sapiens
ggaggucacuuggcauuca

SEQ ID NO: 8098 - RNA, 19 nt, Homo sapiens
aacaagugugacacugacc

SEQ ID NO: 8099 - RNA, 22 nt, Homo sapiens
agauuauucuccucuauccaca

SEQ ID NO: 8100 - RNA, 19 nt, Homo sapiens
cauguuguggaaaaaagcc

SEQ ID NO: 8101 - RNA, 23 nt, Homo sapiens
ccuuuucauuauuuuuuagcuuu

SEQ ID NO: 8102 - RNA, 16 nt, Homo sapiens
cuagcagcguuaguuc

SEQ ID NO: 8103 - RNA, 18 nt, Homo sapiens
cugaccagcccaaaucau

SEQ ID NO: 8104 - RNA, 19 nt, Homo sapiens
cuuggagggauccugugaa

SEQ ID NO: 8105 - RNA, 19 nt, Homo sapiens
uagugacucagaauccuca

SEQ ID NO: 8106 - RNA, 23 nt, Homo sapiens
uucugagcuuuaugaucugugga

SEQ ID NO: 8107 - RNA, 18 nt, Homo sapiens
agaugucacagacucuuu

SEQ ID NO: 8108 - RNA, 22 nt, Homo sapiens
gcagaaaaaaucagacacuuca

SEQ ID NO: 8109 - RNA, 21 nt, Homo sapiens
aaacaauguauagguacacag

SEQ ID NO: 8110 - RNA, 16 nt, Homo sapiens
aacccuccuguguccu

SEQ ID NO: 8111 - RNA, 18 nt, Homo sapiens
acagaacccuuuuccuga

SEQ ID NO: 8112 - RNA, 24 nt, Homo sapiens
agaagaaagagaaaccuucacuuu

SEQ ID NO: 8113 - RNA, 19 nt, Homo sapiens
aucaaauguauaugcuuuu

SEQ ID NO: 8114 - RNA, 18 nt, Homo sapiens
ccacuuuugacuagguaa

SEQ ID NO: 8115 - RNA, 19 nt, Homo sapiens
ccagccaacaguaacacuu

SEQ ID NO: 8116 - RNA, 19 nt, Homo sapiens
gcugucucucugacaccag

SEQ ID NO: 8117 - RNA, 22 nt, Homo sapiens
gucauauacucugcaucacugu

SEQ ID NO: 8118 - RNA, 17 nt, Homo sapiens
gugaauaaaguugugug

SEQ ID NO: 8119 - RNA, 23 nt, Homo sapiens
uaugccccaaagcuugcucuuuu

SEQ ID NO: 8120 - RNA, 20 nt, Homo sapiens
ucacugcacuccuuugucau

SEQ ID NO: 8121 - RNA, 16 nt, Homo sapiens
uccuguguccucugaa

SEQ ID NO: 8122 - RNA, 17 nt, Homo sapiens
ugguuaaaacaccauga

SEQ ID NO: 8123 - RNA, 20 nt, Homo sapiens
cagccccugcagucaucuca

SEQ ID NO: 8124 - RNA, 24 nt, Homo sapiens
ccuuuccacacgccgcugccccag

SEQ ID NO: 8125 - RNA, 23 nt, Homo sapiens
cuccucaugccccucuguccucu

SEQ ID NO: 8126 - RNA, 25 nt, Homo sapiens
gcucccugccccuccucaugccccu

SEQ ID NO: 8127 - RNA, 19 nt, Homo sapiens
ggaccgggcagguguccac

SEQ ID NO: 8128 - RNA, 21 nt, Homo sapiens
ccacgagauucccccaucucu

SEQ ID NO: 8129 - RNA, 23 nt, Homo sapiens
uccucuuuucccccuucucucuc

SEQ ID NO: 8130 - RNA, 20 nt, Homo sapiens
aaagggacccucccaucauu

SEQ ID NO: 8131 - RNA, 21 nt, Homo sapiens
acaguggagccgcgcucuucu

SEQ ID NO: 8132 - RNA, 18 nt, Homo sapiens
ccccauuucuccuccucu

SEQ ID NO: 8133 - RNA, 22 nt, Homo sapiens
gccacgugcccucacccagccc

SEQ ID NO: 8134 - RNA, 23 nt, Homo sapiens
guguuuucugauuuggugagcuc

SEQ ID NO: 8135 - RNA, 21 nt, Homo sapiens
accagaacgcaccccacuggg

SEQ ID NO: 8136 - RNA, 19 nt, Homo sapiens
cgccccccacccccccucc

SEQ ID NO: 8137 - RNA, 19 nt, Homo sapiens
cuccgagauggggcuguga

SEQ ID NO: 8138 - RNA, 19 nt, Homo sapiens
gccuccccuccccugggga

SEQ ID NO: 8139 - RNA, 18 nt, Homo sapiens
ggcuccgagauggggcug

SEQ ID NO: 8140 - RNA, 24 nt, Homo sapiens
uagucuguggcccagcaaagccac

SEQ ID NO: 8141 - RNA, 20 nt, Homo sapiens
gccugaguagggcccgggga

SEQ ID NO: 8142 - RNA, 21 nt, Homo sapiens
ccaagucgccuccagaccgca

SEQ ID NO: 8143 - RNA, 21 nt, Homo sapiens
gcgaccgcaagggcuuuuguu

SEQ ID NO: 8144 - RNA, 18 nt, Homo sapiens
agaacacacacauauaca

SEQ ID NO: 8145 - RNA, 18 nt, Homo sapiens
uccauauuuuauuacugu

SEQ ID NO: 8146 - RNA, 17 nt, Homo sapiens
cccccugcaccuccacc

SEQ ID NO: 8147 - RNA, 18 nt, Homo sapiens
gcccacccccugcaccuc

SEQ ID NO: 8148 - RNA, 21 nt, Homo sapiens
acugcaaaucuccgccuccca

SEQ ID NO: 8149 - RNA, 22 nt, Homo sapiens
aucucggcucacugcaaaucuc

SEQ ID NO: 8150 - RNA, 24 nt, Homo sapiens
gaaaaggugaaaauguuuuauuca

SEQ ID NO: 8151 - RNA, 18 nt, Homo sapiens
uccgccucccagguucaa

SEQ ID NO: 8152 - RNA, 23 nt, Homo sapiens
uuuuaacauguguuaaacagaga

SEQ ID NO: 8153 - RNA, 18 nt, Homo sapiens
gggcggggcggccgcgcc

SEQ ID NO: 8154 - RNA, 19 nt, Homo sapiens
gggcggggcggccgcgcca

SEQ ID NO: 8155 - RNA, 20 nt, Homo sapiens
cuggaguugaaaaucuuaua

SEQ ID NO: 8156 - RNA, 26 nt, Homo sapiens
uguacuggcaagaccugauuucugag

SEQ ID NO: 8157 - RNA, 21 nt, Homo sapiens
aacaggaaaccugacuggggc

SEQ ID NO: 8158 - RNA, 18 nt, Homo sapiens
aagucccuccagauuucu

SEQ ID NO: 8159 - RNA, 17 nt, Homo sapiens
auauguugucuuugaua

SEQ ID NO: 8160 - RNA, 17 nt, Homo sapiens
uaaaauaugggaaaggc

SEQ ID NO: 8161 - RNA, 17 nt, Homo sapiens
ucaggacugguguuagg

SEQ ID NO: 8162 - RNA, 19 nt, Homo sapiens
ugugucccaagauauccua

SEQ ID NO: 8163 - RNA, 18 nt, Homo sapiens
cuccagucccucaucuca

SEQ ID NO: 8164 - RNA, 21 nt, Homo sapiens
cucugggaccggggucugcgg

SEQ ID NO: 8165 - RNA, 21 nt, Homo sapiens
cuugcuuuccaguuugcuuuu

SEQ ID NO: 8166 - RNA, 19 nt, Homo sapiens
caccacccccaccccccuc

SEQ ID NO: 8167 - RNA, 18 nt, Homo sapiens
cccccaccccccucccuc

SEQ ID NO: 8168 - RNA, 17 nt, Homo sapiens
ucuuuauucaaaagugu

SEQ ID NO: 8169 - RNA, 19 nt, Homo sapiens
uugaccaauuugacuuaga

SEQ ID NO: 8170 - RNA, 21 nt, Homo sapiens
auauugcuguauagcuccuuu

SEQ ID NO: 8171 - RNA, 22 nt, Homo sapiens
guaguuugacucaguauaggua

SEQ ID NO: 8172 - RNA, 20 nt, Homo sapiens
agcgcgacagugagcgccgg

SEQ ID NO: 8173 - RNA, 19 nt, Homo sapiens
gggagcucuguccugguga

SEQ ID NO: 8174 - RNA, 19 nt, Homo sapiens
aucauccaggaguacaacu

SEQ ID NO: 8175 - RNA, 21 nt, Homo sapiens
ccugcugcuuucucuguuccu

SEQ ID NO: 8176 - RNA, 20 nt, Homo sapiens
uuagaaauuuaaaauaacuc

SEQ ID NO: 8177 - RNA, 20 nt, Homo sapiens
cacagugcgcugucuccuuu

SEQ ID NO: 8178 - RNA, 21 nt, Homo sapiens
ccccuucccaguugccggcga

SEQ ID NO: 8179 - RNA, 24 nt, Homo sapiens
gcgcggaggucgcgcagcccggga

SEQ ID NO: 8180 - RNA, 17 nt, Homo sapiens
uccugccgacucaguug

SEQ ID NO: 8181 - RNA, 19 nt, Homo sapiens
caacauuccacuaugccau

SEQ ID NO: 8182 - RNA, 17 nt, Homo sapiens
caggagaggaccucgcc

SEQ ID NO: 8183 - RNA, 21 nt, Homo sapiens
ccucccuuccccaaggaucca

SEQ ID NO: 8184 - RNA, 19 nt, Homo sapiens
ccucgccccaagcaagcca

SEQ ID NO: 8185 - RNA, 22 nt, Homo sapiens
gcccugccagacuacugccaga

SEQ ID NO: 8186 - RNA, 24 nt, Homo sapiens
ucccacugcuauacuguucuacug

SEQ ID NO: 8187 - RNA, 22 nt, Homo sapiens
ucuuggacagaggaucugggag

SEQ ID NO: 8188 - RNA, 20 nt, Homo sapiens
cccgccgcccgcaggcucgg

SEQ ID NO: 8189 - RNA, 18 nt, Homo sapiens
ccucacuaaaccauccaa

SEQ ID NO: 8190 - RNA, 25 nt, Homo sapiens
cuuccuucacauccuccuccgccuc

SEQ ID NO: 8191 - RNA, 19 nt, Homo sapiens
gcgcgugcagccccggaca

SEQ ID NO: 8192 - RNA, 23 nt, Homo sapiens
ggaauaauugcaauccccgaucc

SEQ ID NO: 8193 - RNA, 24 nt, Homo sapiens
agaagcaacaccccucucccuccc

SEQ ID NO: 8194 - RNA, 19 nt, Homo sapiens
ggagaagcaacaccccucu

SEQ ID NO: 8195 - RNA, 23 nt, Homo sapiens
gugccggcugcugcccgugcugc

SEQ ID NO: 8196 - RNA, 20 nt, Homo sapiens
cuaaagagcacuaguuguga

SEQ ID NO: 8197 - RNA, 23 nt, Homo sapiens
uaauaaaaguuauuaccuuuaca

SEQ ID NO: 8198 - RNA, 19 nt, Homo sapiens
uugguguacuuaauacuca

SEQ ID NO: 8199 - RNA, 21 nt, Homo sapiens
gcccagguggccuccuggccc

SEQ ID NO: 8200 - RNA, 19 nt, Homo sapiens
gugagugagugugugugug

SEQ ID NO: 8201 - RNA, 23 nt, Homo sapiens
gugugugugggggggacucggcu

SEQ ID NO: 8202 - RNA, 31 nt, Homo sapiens
gucuaagcuguucuauuuuaaaauuauuuuu

SEQ ID NO: 8203 - RNA, 18 nt, Homo sapiens
gcuuucagcacucacucu

SEQ ID NO: 8204 - RNA, 18 nt, Homo sapiens
acuuggcuucuuuaacca

SEQ ID NO: 8205 - RNA, 21 nt, Homo sapiens
cguucauuguaaaaagcccuu

SEQ ID NO: 8206 - RNA, 21 nt, Homo sapiens
acauuuacaggaggccccgga

SEQ ID NO: 8207 - RNA, 21 nt, Homo sapiens
ccccacccaccuccugcggcu

SEQ ID NO: 8208 - RNA, 23 nt, Homo sapiens
auuaagugccauggauuacuuua

SEQ ID NO: 8209 - RNA, 20 nt, Homo sapiens
uuccaugcacauuuacaaua

SEQ ID NO: 8210 - RNA, 22 nt, Homo sapiens
cccuugacaaucuugucagcaa

SEQ ID NO: 8211 - RNA, 17 nt, Homo sapiens
gauaaacagaaaugcug

SEQ ID NO: 8212 - RNA, 18 nt, Homo sapiens
uaaaggaugcuagccugc

SEQ ID NO: 8213 - RNA, 24 nt, Homo sapiens
ucucuuuguagaaguuuuguuuuu

SEQ ID NO: 8214 - RNA, 24 nt, Homo sapiens
ucuuggaaugugaagaucugucga

SEQ ID NO: 8215 - RNA, 24 nt, Homo sapiens
uucagacccuuuaauaagugagug

SEQ ID NO: 8216 - RNA, 23 nt, Homo sapiens
uugcaacacccuaaauuguuuuu

SEQ ID NO: 8217 - RNA, 17 nt, Homo sapiens
cagaugcccccccaucc

SEQ ID NO: 8218 - RNA, 21 nt, Homo sapiens
cucuuucucucucuuuuccuc

SEQ ID NO: 8219 - RNA, 19 nt, Homo sapiens
uguugacuuuauuucugag

SEQ ID NO: 8220 - RNA, 19 nt, Homo sapiens
uuuuucauagucccaccuu

SEQ ID NO: 8221 - RNA, 24 nt, Homo sapiens
gcccgcgauguggaacugcugcca

SEQ ID NO: 8222 - RNA, 24 nt, Homo sapiens
gccugagucgugaccugcuaggcc

SEQ ID NO: 8223 - RNA, 20 nt, Homo sapiens
gggcccgcgauguggaacug

SEQ ID NO: 8224 - RNA, 21 nt, Homo sapiens
ucccagguuggcucugccagu

SEQ ID NO: 8225 - RNA, 18 nt, Homo sapiens
agccagggcacgagcccu

SEQ ID NO: 8226 - RNA, 20 nt, Homo sapiens
gcccgcucccaggcgcccca

SEQ ID NO: 8227 - RNA, 15 nt, Homo sapiens
gggcggccgcggcag

SEQ ID NO: 8228 - RNA, 18 nt, Homo sapiens
gggggcacugggcuuguu

SEQ ID NO: 8229 - RNA, 19 nt, Homo sapiens
uuuugauuuuuccgagugg

SEQ ID NO: 8230 - RNA, 24 nt, Homo sapiens
accuucauagaacacacuuucuuu

SEQ ID NO: 8231 - RNA, 19 nt, Homo sapiens
agaagcagcugcuccuuuc

SEQ ID NO: 8232 - RNA, 21 nt, Homo sapiens
ggccgccgcccgcccgccccu

SEQ ID NO: 8233 - RNA, 24 nt, Homo sapiens
uacaaguuuugaguuagcauuaca

SEQ ID NO: 8234 - RNA, 22 nt, Homo sapiens
ucuuuuuaucugaaacuuugua

SEQ ID NO: 8235 - RNA, 22 nt, Homo sapiens
uuuugauauuuguccaaacagg

SEQ ID NO: 8236 - RNA, 25 nt, Homo sapiens
cagaacuuauuccuccuaaauguaa

SEQ ID NO: 8237 - RNA, 23 nt, Homo sapiens
caugugcaggguuuaugguaaug

SEQ ID NO: 8238 - RNA, 21 nt, Homo sapiens
cuggaaucaggcugccugguc

SEQ ID NO: 8239 - RNA, 20 nt, Homo sapiens
gaguaccaugugagauucaa

SEQ ID NO: 8240 - RNA, 23 nt, Homo sapiens
uccuuugacugaagcauguaugu

SEQ ID NO: 8241 - RNA, 18 nt, Homo sapiens
ugaggauucagugagcaa

SEQ ID NO: 8242 - RNA, 18 nt, Homo sapiens
aaccacaucccacucaca

SEQ ID NO: 8243 - RNA, 22 nt, Homo sapiens
aucauuuaucauauauauacau

SEQ ID NO: 8244 - RNA, 22 nt, Homo sapiens
aucccacucacaacagcugccu

SEQ ID NO: 8245 - RNA, 19 nt, Homo sapiens
caccgagauccuuaucgaa

SEQ ID NO: 8246 - RNA, 19 nt, Homo sapiens
ccaauucauccucacucag

SEQ ID NO: 8247 - RNA, 22 nt, Homo sapiens
ucaucuuguccccaacacccca

SEQ ID NO: 8248 - RNA, 19 nt, Homo sapiens
ucuuguccccaacacccca

SEQ ID NO: 8249 - RNA, 19 nt, Homo sapiens
ugauuaucaauuaccacac

SEQ ID NO: 8250 - RNA, 25 nt, Homo sapiens
uggaagcaugauuggugcccaguua

SEQ ID NO: 8251 - RNA, 22 nt, Homo sapiens
cagccccaccaagaucauuuca

SEQ ID NO: 8252 - RNA, 18 nt, Homo sapiens
cauccaguccugagcuca

SEQ ID NO: 8253 - RNA, 23 nt, Homo sapiens
ccagacaucuuucuccagcuuca

SEQ ID NO: 8254 - RNA, 20 nt, Homo sapiens
cuaggguugcucucaccuga

SEQ ID NO: 8255 - RNA, 18 nt, Homo sapiens
cugggccaagguuugccc

SEQ ID NO: 8256 - RNA, 18 nt, Homo sapiens
acaggcagucucggccca

SEQ ID NO: 8257 - RNA, 21 nt, Homo sapiens
auaucuucuacaugcaauuua

SEQ ID NO: 8258 - RNA, 24 nt, Homo sapiens
cuaucugacuucauacaucccuca

SEQ ID NO: 8259 - RNA, 18 nt, Homo sapiens
ggggaggaggccguguga

SEQ ID NO: 8260 - RNA, 18 nt, Homo sapiens
cucuaaagagcaucugau

SEQ ID NO: 8261 - RNA, 19 nt, Homo sapiens
agcccugaggacagaugcc

SEQ ID NO: 8262 - RNA, 17 nt, Homo sapiens
ccacaccuucuucccuc

SEQ ID NO: 8263 - RNA, 19 nt, Homo sapiens
ccacccagcgcuccugcua

SEQ ID NO: 8264 - RNA, 19 nt, Homo sapiens
gcccccagcucccaccucc

SEQ ID NO: 8265 - RNA, 18 nt, Homo sapiens
uuggagacugucuggccc

SEQ ID NO: 8266 - RNA, 21 nt, Homo sapiens
aaacagaaacccaacuacccc

SEQ ID NO: 8267 - RNA, 21 nt, Homo sapiens
cauuuuauucacaugcuccca

SEQ ID NO: 8268 - RNA, 20 nt, Homo sapiens
gcaggugggucaaugcucuc

SEQ ID NO: 8269 - RNA, 17 nt, Homo sapiens
gucaucucuucucugga

SEQ ID NO: 8270 - RNA, 20 nt, Homo sapiens
uguucauaagagaggacuga

SEQ ID NO: 8271 - RNA, 18 nt, Homo sapiens
aaguauuguuauuucaua

SEQ ID NO: 8272 - RNA, 22 nt, Homo sapiens
cccucugauucugcaguguaca

SEQ ID NO: 8273 - RNA, 19 nt, Homo sapiens
cuauugaucccccucugcc

SEQ ID NO: 8274 - RNA, 20 nt, Homo sapiens
gcagacaaagcagguggcau

SEQ ID NO: 8275 - RNA, 21 nt, Homo sapiens
ggagcuuucagaaaaaccuca

SEQ ID NO: 8276 - RNA, 17 nt, Homo sapiens
ugggcaaccccaccccu

SEQ ID NO: 8277 - RNA, 18 nt, Homo sapiens
acagaauacuagccagag

SEQ ID NO: 8278 - RNA, 20 nt, Homo sapiens
agacacaaacaaacaagcua

SEQ ID NO: 8279 - RNA, 19 nt, Homo sapiens
ggccgggugcgguggcuca

SEQ ID NO: 8280 - RNA, 20 nt, Homo sapiens
aaguggcauaaaaauguagu

SEQ ID NO: 8281 - RNA, 17 nt, Homo sapiens
uauuuuaaggagcuccc

SEQ ID NO: 8282 - RNA, 19 nt, Homo sapiens
cagaaggaauaaggucaug

SEQ ID NO: 8283 - RNA, 19 nt, Homo sapiens
cauccccacccgccccucu

SEQ ID NO: 8284 - RNA, 19 nt, Homo sapiens
auguccauuauguaccucc

SEQ ID NO: 8285 - RNA, 20 nt, Homo sapiens
gaagaaaauccauucauuca

SEQ ID NO: 8286 - RNA, 17 nt, Homo sapiens
ugcccggcggcuggcca

SEQ ID NO: 8287 - RNA, 22 nt, Homo sapiens
aauuugguaaaaugcaucaaaa

SEQ ID NO: 8288 - RNA, 20 nt, Homo sapiens
uuucaugcccuugccuauca

SEQ ID NO: 8289 - RNA, 19 nt, Homo sapiens
auauccuagcggcgaaaca

SEQ ID NO: 8290 - RNA, 19 nt, Homo sapiens
aaguaugaaaaugauuuau

SEQ ID NO: 8291 - RNA, 16 nt, Homo sapiens
ccagugucacggugga

SEQ ID NO: 8292 - RNA, 18 nt, Homo sapiens
ccgcacuccagcacugcg

SEQ ID NO: 8293 - RNA, 24 nt, Homo sapiens
cgcccuugccgcccaccugcucac

SEQ ID NO: 8294 - RNA, 22 nt, Homo sapiens
agucuccugcacagcaccugca

SEQ ID NO: 8295 - RNA, 21 nt, Homo sapiens
agucccaucacugagggagcc

SEQ ID NO: 8296 - RNA, 22 nt, Homo sapiens
aucuucacccucaguuuccuca

SEQ ID NO: 8297 - RNA, 23 nt, Homo sapiens
ccugagcagcuugggcugcuuuu

SEQ ID NO: 8298 - RNA, 23 nt, Homo sapiens
aggaauauaaaaaccaccacccu

SEQ ID NO: 8299 - RNA, 22 nt, Homo sapiens
aguuuugcaccacggcaagaaa

SEQ ID NO: 8300 - RNA, 25 nt, Homo sapiens
caaaccuuuccaacuucucacguca

SEQ ID NO: 8301 - RNA, 23 nt, Homo sapiens
gcaccaccaccaccaccccuacu

SEQ ID NO: 8302 - RNA, 20 nt, Homo sapiens
ugcaaaccuuuccaacuucu

SEQ ID NO: 8303 - RNA, 22 nt, Homo sapiens
uuaaaaauaagcugggcguggu

SEQ ID NO: 8304 - RNA, 18 nt, Homo sapiens
cacuugcucuucugugau

SEQ ID NO: 8305 - RNA, 21 nt, Homo sapiens
gaaaagaacacuugcucuucu

SEQ ID NO: 8306 - RNA, 22 nt, Homo sapiens
uuuuaaggaaaaaaaagcgcaa

SEQ ID NO: 8307 - RNA, 20 nt, Homo sapiens
aacccagccaugcaaugcca

SEQ ID NO: 8308 - RNA, 22 nt, Homo sapiens
acaaaacucagagaaauguguc

SEQ ID NO: 8309 - RNA, 22 nt, Homo sapiens
cuaaugcuuuaagauuugguca

SEQ ID NO: 8310 - RNA, 20 nt, Homo sapiens
gcuccuccaaucccauuuua

SEQ ID NO: 8311 - RNA, 27 nt, Homo sapiens
ugaauggucucucuuuggcuggaauua

SEQ ID NO: 8312 - RNA, 20 nt, Homo sapiens
gcccuucaugaccuugcugg

SEQ ID NO: 8313 - RNA, 19 nt, Homo sapiens
gacauugggcaugaggcug

SEQ ID NO: 8314 - RNA, 23 nt, Homo sapiens
agaaugagccagcagacuggcca

SEQ ID NO: 8315 - RNA, 20 nt, Homo sapiens
cuccaggcauggccaccugc

SEQ ID NO: 8316 - RNA, 19 nt, Homo sapiens
cugcugauauucugcagga

SEQ ID NO: 8317 - RNA, 20 nt, Homo sapiens
gaacacagaaugagccagca

SEQ ID NO: 8318 - RNA, 19 nt, Homo sapiens
guccuugguguucuccaca

SEQ ID NO: 8319 - RNA, 24 nt, Homo sapiens
uguguagggcuggcuccaggcaug

SEQ ID NO: 8320 - RNA, 21 nt, Homo sapiens
uucugagucauugcauccucu

SEQ ID NO: 8321 - RNA, 19 nt, Homo sapiens
uuggaacuuaacccuugaa

SEQ ID NO: 8322 - RNA, 21 nt, Homo sapiens
aaaugcaguccagaauaagug

SEQ ID NO: 8323 - RNA, 23 nt, Homo sapiens
uucaucaauuuuuauacauauca

SEQ ID NO: 8324 - RNA, 22 nt, Homo sapiens
uuugagcaauucauuucacuuu

SEQ ID NO: 8325 - RNA, 19 nt, Homo sapiens
cauucaaagaggcucuuua

SEQ ID NO: 8326 - RNA, 21 nt, Homo sapiens
gcauucaaagaggcucuuuac

SEQ ID NO: 8327 - RNA, 18 nt, Homo sapiens
ucaaaaucuuuaggagca

SEQ ID NO: 8328 - RNA, 20 nt, Homo sapiens
uuugaauauuccaaguagua

SEQ ID NO: 8329 - RNA, 19 nt, Homo sapiens
augcggcaagaaggaauug

SEQ ID NO: 8330 - RNA, 19 nt, Homo sapiens
caacccucccucagccccu

SEQ ID NO: 8331 - RNA, 19 nt, Homo sapiens
caacccuccuaucaccucc

SEQ ID NO: 8332 - RNA, 20 nt, Homo sapiens
ccugccccgucaccaucuca

SEQ ID NO: 8333 - RNA, 19 nt, Homo sapiens
gacccccaccccuucccca

SEQ ID NO: 8334 - RNA, 20 nt, Homo sapiens
gaggaaugcucccccauccu

SEQ ID NO: 8335 - RNA, 20 nt, Homo sapiens
uggggaacaaggguggcauc

SEQ ID NO: 8336 - RNA, 22 nt, Homo sapiens
uugcaacacacagacacacgca

SEQ ID NO: 8337 - RNA, 22 nt, Homo sapiens
uugggcccuccugaaacuuaca

SEQ ID NO: 8338 - RNA, 20 nt, Homo sapiens
aaaaccuacccuguccuaga

SEQ ID NO: 8339 - RNA, 18 nt, Homo sapiens
caguuccucaccaucauc

SEQ ID NO: 8340 - RNA, 23 nt, Homo sapiens
gcacugaugucccuccuuuuuca

SEQ ID NO: 8341 - RNA, 19 nt, Homo sapiens
ggauuacaugcccauccca

SEQ ID NO: 8342 - RNA, 17 nt, Homo sapiens
cccaggcccaggcccca

SEQ ID NO: 8343 - RNA, 16 nt, Homo sapiens
cugguggcagauuucg

SEQ ID NO: 8344 - RNA, 18 nt, Homo sapiens
uuucuuuguggcuuguuu

SEQ ID NO: 8345 - RNA, 20 nt, Homo sapiens
aagacacauugacuccuuuc

SEQ ID NO: 8346 - RNA, 20 nt, Homo sapiens
uaugaggaccuuucauaucu

SEQ ID NO: 8347 - RNA, 20 nt, Homo sapiens
gccuuuguucccaagaccca

SEQ ID NO: 8348 - RNA, 19 nt, Homo sapiens
guugcacauuuguuuuuaa

SEQ ID NO: 8349 - RNA, 16 nt, Homo sapiens
ucauuucugucaaacu

SEQ ID NO: 8350 - RNA, 26 nt, Homo sapiens
ugaauguagauuuuacugugaagcua

SEQ ID NO: 8351 - RNA, 27 nt, Homo sapiens
accagaucuagccccacccucacucca

SEQ ID NO: 8352 - RNA, 18 nt, Homo sapiens
acugaauaauacaugccu

SEQ ID NO: 8353 - RNA, 22 nt, Homo sapiens
gaaaagcaacauggacauuucc

SEQ ID NO: 8354 - RNA, 23 nt, Homo sapiens
gacaagucuuucuagaaauucua

SEQ ID NO: 8355 - RNA, 19 nt, Homo sapiens
gcagaccaccuucugcccc

SEQ ID NO: 8356 - RNA, 17 nt, Homo sapiens
gcauccaucccugcugu

SEQ ID NO: 8357 - RNA, 20 nt, Homo sapiens
ucuacugcacugccuggcuc

SEQ ID NO: 8358 - RNA, 18 nt, Homo sapiens
uucuugcuuuugauaaca

SEQ ID NO: 8359 - RNA, 21 nt, Homo sapiens
aaacagugucuugagcucuaa

SEQ ID NO: 8360 - RNA, 20 nt, Homo sapiens
ccuccucacuuggcugucug

SEQ ID NO: 8361 - RNA, 19 nt, Homo sapiens
cuguuuuggggcuuuccca

SEQ ID NO: 8362 - RNA, 20 nt, Homo sapiens
gcugugaucagugauuuuca

SEQ ID NO: 8363 - RNA, 18 nt, Homo sapiens
uuauaauauuucagugga

SEQ ID NO: 8364 - RNA, 19 nt, Homo sapiens
accauauuuuucuucuuca

SEQ ID NO: 8365 - RNA, 23 nt, Homo sapiens
acggugucucucaggauggugcu

SEQ ID NO: 8366 - RNA, 19 nt, Homo sapiens
ccccagggaaacagggcca

SEQ ID NO: 8367 - RNA, 21 nt, Homo sapiens
cccccuaacccauguuucuca

SEQ ID NO: 8368 - RNA, 19 nt, Homo sapiens
cuggccauggguccuugcc

SEQ ID NO: 8369 - RNA, 15 nt, Homo sapiens
gcccuggccccggcc

SEQ ID NO: 8370 - RNA, 19 nt, Homo sapiens
guccucgggggccugggga

SEQ ID NO: 8371 - RNA, 18 nt, Homo sapiens
uccucgggggccugggga

SEQ ID NO: 8372 - RNA, 23 nt, Homo sapiens
ugcccaagggccaccaaccccag

SEQ ID NO: 8373 - RNA, 22 nt, Homo sapiens
acaccucuccaagcccuccuac

SEQ ID NO: 8374 - RNA, 18 nt, Homo sapiens
gccuuuggcuuuuggcuc

SEQ ID NO: 8375 - RNA, 19 nt, Homo sapiens
aggccccaaggucuccuuc

SEQ ID NO: 8376 - RNA, 27 nt, Homo sapiens
ccugggcaguguccuugaguuguuuuu

SEQ ID NO: 8377 - RNA, 21 nt, Homo sapiens
uuuugguuauuaagacuugug

SEQ ID NO: 8378 - RNA, 22 nt, Homo sapiens
aggaagguucuggugugaacua

SEQ ID NO: 8379 - RNA, 17 nt, Homo sapiens
ccauccgaguuucaggu

SEQ ID NO: 8380 - RNA, 18 nt, Homo sapiens
cuagcacacacuuuuggu

SEQ ID NO: 8381 - RNA, 17 nt, Homo sapiens
cucucccucccugcuuc

SEQ ID NO: 8382 - RNA, 23 nt, Homo sapiens
ggaccgcguccucccgcccccuc

SEQ ID NO: 8383 - RNA, 22 nt, Homo sapiens
ugaagucucugaagugaaacug

SEQ ID NO: 8384 - RNA, 21 nt, Homo sapiens
acguugagaucacuguguaga

SEQ ID NO: 8385 - RNA, 20 nt, Homo sapiens
caacugccaaccccaaagcu

SEQ ID NO: 8386 - RNA, 21 nt, Homo sapiens
ccagcagccagaaaucucaca

SEQ ID NO: 8387 - RNA, 18 nt, Homo sapiens
gcaccaucacuugcuuuu

SEQ ID NO: 8388 - RNA, 16 nt, Homo sapiens
guggaugagaacaccc

SEQ ID NO: 8389 - RNA, 19 nt, Homo sapiens
uggaaugcauuuauucuug

SEQ ID NO: 8390 - RNA, 22 nt, Homo sapiens
gacggcaggcagcagcuguggc

SEQ ID NO: 8391 - RNA, 17 nt, Homo sapiens
gaggaaagcaugagcag

SEQ ID NO: 8392 - RNA, 22 nt, Homo sapiens
gcagagagcccagugccggcca

SEQ ID NO: 8393 - RNA, 21 nt, Homo sapiens
uaaaggucaugucuccuagcu

SEQ ID NO: 8394 - RNA, 24 nt, Homo sapiens
ucuuggugaagacaggguucgugg

SEQ ID NO: 8395 - RNA, 23 nt, Homo sapiens
gacuccuccccagaaaaccacca

SEQ ID NO: 8396 - RNA, 19 nt, Homo sapiens
gcaaagugaagaguccacc

SEQ ID NO: 8397 - RNA, 23 nt, Homo sapiens
ucugcuucucuccucaucaucau

SEQ ID NO: 8398 - RNA, 22 nt, Homo sapiens
aaggucuuggugccucugcagu

SEQ ID NO: 8399 - RNA, 19 nt, Homo sapiens
aaguuagagaaucuggcaa

SEQ ID NO: 8400 - RNA, 21 nt, Homo sapiens
ccuaggucuauuuggauuauu

SEQ ID NO: 8401 - RNA, 19 nt, Homo sapiens
ccugggccguagcuugucu

SEQ ID NO: 8402 - RNA, 19 nt, Homo sapiens
ccuuugccacacuguggua

SEQ ID NO: 8403 - RNA, 23 nt, Homo sapiens
cucuacaaauuuuucugugguga

SEQ ID NO: 8404 - RNA, 22 nt, Homo sapiens
cuuaagaaugccaaagaaugaa

SEQ ID NO: 8405 - RNA, 18 nt, Homo sapiens
ggcccuggucaggaaacu

SEQ ID NO: 8406 - RNA, 21 nt, Homo sapiens
ucccaggcuccuaugcaaguu

SEQ ID NO: 8407 - RNA, 22 nt, Homo sapiens
ggaaacagcagccaaucggcga

SEQ ID NO: 8408 - RNA, 19 nt, Homo sapiens
agauauguauucucugaca

SEQ ID NO: 8409 - RNA, 19 nt, Homo sapiens
auuugguuccagcccacuc

SEQ ID NO: 8410 - RNA, 22 nt, Homo sapiens
uccccucugcaagugccacagc

SEQ ID NO: 8411 - RNA, 20 nt, Homo sapiens
cuuuuccccucuuuaacuuu

SEQ ID NO: 8412 - RNA, 21 nt, Homo sapiens
uccaaacaccucucuguugua

SEQ ID NO: 8413 - RNA, 21 nt, Homo sapiens
aggaagguggcuuaccaagau

SEQ ID NO: 8414 - RNA, 19 nt, Homo sapiens
cgagaggagaagcgcagcg

SEQ ID NO: 8415 - RNA, 21 nt, Homo sapiens
acuuuuccugcugccuggccu

SEQ ID NO: 8416 - RNA, 19 nt, Homo sapiens
ggaaaaagaccaggucuac

SEQ ID NO: 8417 - RNA, 26 nt, Homo sapiens
uuugaucaaauuugaacuucauuuug

SEQ ID NO: 8418 - RNA, 20 nt, Homo sapiens
agccgagaccgacccgcccg

SEQ ID NO: 8419 - RNA, 18 nt, Homo sapiens
cccugcgggcagccgugc

SEQ ID NO: 8420 - RNA, 21 nt, Homo sapiens
ucccgcugcccggacccgaca

SEQ ID NO: 8421 - RNA, 17 nt, Homo sapiens
aaggaaaggggguccca

SEQ ID NO: 8422 - RNA, 20 nt, Homo sapiens
caccguccgcccugcuccuc

SEQ ID NO: 8423 - RNA, 19 nt, Homo sapiens
cauccuacccucgggccca

SEQ ID NO: 8424 - RNA, 17 nt, Homo sapiens
cggcugguuuuguaaga

SEQ ID NO: 8425 - RNA, 17 nt, Homo sapiens
gccacccccucaagcca

SEQ ID NO: 8426 - RNA, 18 nt, Homo sapiens
gccccggccccggcccca

SEQ ID NO: 8427 - RNA, 21 nt, Homo sapiens
gcccugaggugugggggcugc

SEQ ID NO: 8428 - RNA, 19 nt, Homo sapiens
uugcuuguugggauuccug

SEQ ID NO: 8429 - RNA, 25 nt, Homo sapiens
acccugggccauccucacaugugac

SEQ ID NO: 8430 - RNA, 23 nt, Homo sapiens
gcgccgcggccgccuccuccucc

SEQ ID NO: 8431 - RNA, 18 nt, Homo sapiens
ggcaggcacucccaucca

SEQ ID NO: 8432 - RNA, 18 nt, Homo sapiens
ugcauuguuaaucaucca

SEQ ID NO: 8433 - RNA, 19 nt, Homo sapiens
guccuccgcgggugugcua

SEQ ID NO: 8434 - RNA, 20 nt, Homo sapiens
ggcuaggcgcacccacgggg

SEQ ID NO: 8435 - RNA, 20 nt, Homo sapiens
uccugccucagaggccaucu

SEQ ID NO: 8436 - RNA, 21 nt, Homo sapiens
caccugccagcucuacugggc

SEQ ID NO: 8437 - RNA, 16 nt, Homo sapiens
cacuccccccgaacca

SEQ ID NO: 8438 - RNA, 19 nt, Homo sapiens
cccgaaccagagccgugca

SEQ ID NO: 8439 - RNA, 20 nt, Homo sapiens
ggcaguggagggagggacac

SEQ ID NO: 8440 - RNA, 19 nt, Homo sapiens
guccccagaggcacauucg

SEQ ID NO: 8441 - RNA, 22 nt, Homo sapiens
ugcacauucucacagacaccgu

SEQ ID NO: 8442 - RNA, 17 nt, Homo sapiens
gcuggcagcuccgggug

SEQ ID NO: 8443 - RNA, 17 nt, Homo sapiens
uugaggaggaaagcgag

SEQ ID NO: 8444 - RNA, 22 nt, Homo sapiens
ugcaaaaagagcugacauucca

SEQ ID NO: 8445 - RNA, 20 nt, Homo sapiens
cccccaaccuccaccccacc

SEQ ID NO: 8446 - RNA, 22 nt, Homo sapiens
gccacucugaggcuggcggccu

SEQ ID NO: 8447 - RNA, 22 nt, Homo sapiens
cccuuccccaccccacuuguau

SEQ ID NO: 8448 - RNA, 24 nt, Homo sapiens
cuugucuuuuuuuuuuauuucuua

SEQ ID NO: 8449 - RNA, 24 nt, Homo sapiens
uaaaccaauagaaucgcucggugg

SEQ ID NO: 8450 - RNA, 19 nt, Homo sapiens
cugaagccucaguccuuca

SEQ ID NO: 8451 - RNA, 15 nt, Homo sapiens
gauuagcacccauug

SEQ ID NO: 8452 - RNA, 19 nt, Homo sapiens
uacugcgacugaacggcgg

SEQ ID NO: 8453 - RNA, 16 nt, Homo sapiens
aagaacaauuguccau

SEQ ID NO: 8454 - RNA, 20 nt, Homo sapiens
cacguuugaagaugcgagcg

SEQ ID NO: 8455 - RNA, 21 nt, Homo sapiens
cagagcacuagguucaauucc

SEQ ID NO: 8456 - RNA, 16 nt, Homo sapiens
ccacaguuugauguca

SEQ ID NO: 8457 - RNA, 20 nt, Homo sapiens
gauaccauacucauuucuaa

SEQ ID NO: 8458 - RNA, 21 nt, Homo sapiens
gccucugucccggaagaguca

SEQ ID NO: 8459 - RNA, 24 nt, Homo sapiens
ucaaucccaaaagucaccacucca

SEQ ID NO: 8460 - RNA, 20 nt, Homo sapiens
ucccaaaagucaccacucca

SEQ ID NO: 8461 - RNA, 16 nt, Homo sapiens
accuuccugggccuca

SEQ ID NO: 8462 - RNA, 19 nt, Homo sapiens
ggagucccagcagaggcua

SEQ ID NO: 8463 - RNA, 19 nt, Homo sapiens
gugagcagaguguggcauc

SEQ ID NO: 8464 - RNA, 19 nt, Homo sapiens
aauagcagcucaggaaauc

SEQ ID NO: 8465 - RNA, 21 nt, Homo sapiens
agucuuccuucuuucuugggc

SEQ ID NO: 8466 - RNA, 20 nt, Homo sapiens
cccgaacuacugacuuugaa

SEQ ID NO: 8467 - RNA, 23 nt, Homo sapiens
cuugaguuuggagucagaaagca

SEQ ID NO: 8468 - RNA, 19 nt, Homo sapiens
cauguaagguugugcaggg

SEQ ID NO: 8469 - RNA, 20 nt, Homo sapiens
ccuuuccagaaaauguugca

SEQ ID NO: 8470 - RNA, 22 nt, Homo sapiens
guggcuucuuuucguuuucguu

SEQ ID NO: 8471 - RNA, 19 nt, Homo sapiens
ugcacacuuccccaucuuu

SEQ ID NO: 8472 - RNA, 26 nt, Homo sapiens
uguaagguugugcaggguguguacug

SEQ ID NO: 8473 - RNA, 17 nt, Homo sapiens
uuccagaaaauguugca

SEQ ID NO: 8474 - RNA, 18 nt, Homo sapiens
gaguggggaaugaggcug

SEQ ID NO: 8475 - RNA, 21 nt, Homo sapiens
gccaccuccugagcccuccca

SEQ ID NO: 8476 - RNA, 20 nt, Homo sapiens
gucccccucagcacccucca

SEQ ID NO: 8477 - RNA, 19 nt, Homo sapiens
ugcccagacucuucacucc

SEQ ID NO: 8478 - RNA, 22 nt, Homo sapiens
aacagaaagcugucccuggcug

SEQ ID NO: 8479 - RNA, 20 nt, Homo sapiens
aucugcaucucagccugaga

SEQ ID NO: 8480 - RNA, 20 nt, Homo sapiens
cagugagaacagcagcccca

SEQ ID NO: 8481 - RNA, 21 nt, Homo sapiens
ucuacgggagucugaacgcca

SEQ ID NO: 8482 - RNA, 19 nt, Homo sapiens
cuuucccugccuucuccca

SEQ ID NO: 8483 - RNA, 23 nt, Homo sapiens
gccucucugggaagcucuuccuc

SEQ ID NO: 8484 - RNA, 20 nt, Homo sapiens
ugcccaggacacucuucccu

SEQ ID NO: 8485 - RNA, 19 nt, Homo sapiens
uguucacagcugaaucuca

SEQ ID NO: 8486 - RNA, 18 nt, Homo sapiens
aguugugucauguuguuu

SEQ ID NO: 8487 - RNA, 19 nt, Homo sapiens
caaaaagcacuuccuccca

SEQ ID NO: 8488 - RNA, 19 nt, Homo sapiens
uaaaauuguaaaaggcugc

SEQ ID NO: 8489 - RNA, 20 nt, Homo sapiens
ucuaccuagcaacugucuuc

SEQ ID NO: 8490 - RNA, 20 nt, Homo sapiens
accgucacacucuucaguga

SEQ ID NO: 8491 - RNA, 19 nt, Homo sapiens
gaaacagcucagccagugg

SEQ ID NO: 8492 - RNA, 19 nt, Homo sapiens
gccgcccagcuacgggagg

SEQ ID NO: 8493 - RNA, 24 nt, Homo sapiens
gugguugccugggggcuuuugcca

SEQ ID NO: 8494 - RNA, 27 nt, Homo sapiens
uccugucacugauggaagguuugcgga

SEQ ID NO: 8495 - RNA, 21 nt, Homo sapiens
uccuauaaggaagauuuggaa

SEQ ID NO: 8496 - RNA, 19 nt, Homo sapiens
ucuuguucugagauucaau

SEQ ID NO: 8497 - RNA, 17 nt, Homo sapiens
gagaacauuuaagccac

SEQ ID NO: 8498 - RNA, 24 nt, Homo sapiens
guaagauuuuaaacauuuguaaua

SEQ ID NO: 8499 - RNA, 18 nt, Homo sapiens
uaugaacuguuuuauauc

SEQ ID NO: 8500 - RNA, 19 nt, Homo sapiens
ugcuaccucuauaucauuc

SEQ ID NO: 8501 - RNA, 21 nt, Homo sapiens
ugggggguuuuuguuuuuuua

SEQ ID NO: 8502 - RNA, 22 nt, Homo sapiens
ucaacacagcauggaauuucca

SEQ ID NO: 8503 - RNA, 19 nt, Homo sapiens
aagcgauucuccuaccuca

SEQ ID NO: 8504 - RNA, 21 nt, Homo sapiens
agauggauuuuacauuugcuc

SEQ ID NO: 8505 - RNA, 22 nt, Homo sapiens
aucaggcgcccagacaccaugu

SEQ ID NO: 8506 - RNA, 19 nt, Homo sapiens
cuuuuccucauucuguggg

SEQ ID NO: 8507 - RNA, 20 nt, Homo sapiens
ggauaaagcuggcugcuucc

SEQ ID NO: 8508 - RNA, 19 nt, Homo sapiens
guuuugcugacucauucca

SEQ ID NO: 8509 - RNA, 22 nt, Homo sapiens
uccugauuuaaagagaucugug

SEQ ID NO: 8510 - RNA, 19 nt, Homo sapiens
ugcagaugcuacugacugc

SEQ ID NO: 8511 - RNA, 21 nt, Homo sapiens
gaacuuggauuucaaaugcaa

SEQ ID NO: 8512 - RNA, 23 nt, Homo sapiens
uaggauuauuugcagguuugguu

SEQ ID NO: 8513 - RNA, 22 nt, Homo sapiens
ugcccagcucuaccccucccag

SEQ ID NO: 8514 - RNA, 21 nt, Homo sapiens
acaaagaucauauuuuuugug

SEQ ID NO: 8515 - RNA, 21 nt, Homo sapiens
agaucuuuuaaauguuuagua

SEQ ID NO: 8516 - RNA, 18 nt, Homo sapiens
aucuucuuaaaggucuaa

SEQ ID NO: 8517 - RNA, 19 nt, Homo sapiens
auguauguacaaguuaggu

SEQ ID NO: 8518 - RNA, 19 nt, Homo sapiens
auucaagugccauuagaug

SEQ ID NO: 8519 - RNA, 21 nt, Homo sapiens
ccucuuggugcugccuuggcc

SEQ ID NO: 8520 - RNA, 21 nt, Homo sapiens
ccuuauuuuaggacccuuucc

SEQ ID NO: 8521 - RNA, 21 nt, Homo sapiens
cucuauacuacacauauuaca

SEQ ID NO: 8522 - RNA, 19 nt, Homo sapiens
cuuuuacaaaucccauuuu

SEQ ID NO: 8523 - RNA, 19 nt, Homo sapiens
gauauauauguaggccuuu

SEQ ID NO: 8524 - RNA, 18 nt, Homo sapiens
gcacucauuagcccuaua

SEQ ID NO: 8525 - RNA, 23 nt, Homo sapiens
uauacugacugaaacaugagcca

SEQ ID NO: 8526 - RNA, 17 nt, Homo sapiens
ucuagagccauugugga

SEQ ID NO: 8527 - RNA, 18 nt, Homo sapiens
uguuaacaccuuauuuua

SEQ ID NO: 8528 - RNA, 23 nt, Homo sapiens
caggguuggauguaguuuaguua

SEQ ID NO: 8529 - RNA, 17 nt, Homo sapiens
uauaugauauacuauga

SEQ ID NO: 8530 - RNA, 22 nt, Homo sapiens
uucaaaauaagaaaauaaccuu

SEQ ID NO: 8531 - RNA, 19 nt, Homo sapiens
uuuguaccaaauuuaauga

SEQ ID NO: 8532 - RNA, 21 nt, Homo sapiens
cuucuacuugcucuuggccuu

SEQ ID NO: 8533 - RNA, 21 nt, Homo sapiens
gcccagaggagcccuauucca

SEQ ID NO: 8534 - RNA, 21 nt, Homo sapiens
uccugcauuccuccuccccuc

SEQ ID NO: 8535 - RNA, 21 nt, Homo sapiens
agcacugaacuccucugugau

SEQ ID NO: 8536 - RNA, 21 nt, Homo sapiens
gcgccccgggccggcggguuu

SEQ ID NO: 8537 - RNA, 19 nt, Homo sapiens
cauauuuggcugccagcuu

SEQ ID NO: 8538 - RNA, 21 nt, Homo sapiens
uuacugauaacauaaacagua

SEQ ID NO: 8539 - RNA, 20 nt, Homo sapiens
auauguuuuucacagcccgu

SEQ ID NO: 8540 - RNA, 24 nt, Homo sapiens
augcucaaaauaguuauauauuca

SEQ ID NO: 8541 - RNA, 21 nt, Homo sapiens
ucauuugaccccuuccaaaua

SEQ ID NO: 8542 - RNA, 24 nt, Homo sapiens
aaauaaauaacaagauaauugaaa

SEQ ID NO: 8543 - RNA, 15 nt, Homo sapiens
agcuugaaggggcuc

SEQ ID NO: 8544 - RNA, 24 nt, Homo sapiens
ccaaucaguguccuuuucuguucc

SEQ ID NO: 8545 - RNA, 19 nt, Homo sapiens
gucucaguuaaaaggggua

SEQ ID NO: 8546 - RNA, 20 nt, Homo sapiens
accgcuguggugugccggga

SEQ ID NO: 8547 - RNA, 16 nt, Homo sapiens
gggucgugaccgcuua

SEQ ID NO: 8548 - RNA, 19 nt, Homo sapiens
cugaggucuugcuugggcc

SEQ ID NO: 8549 - RNA, 21 nt, Homo sapiens
ggucucagcagcggcugcggc

SEQ ID NO: 8550 - RNA, 24 nt, Homo sapiens
gcagguggucacugacauuuccca

SEQ ID NO: 8551 - RNA, 21 nt, Homo sapiens
ugcgauaacugaacauuucca

SEQ ID NO: 8552 - RNA, 20 nt, Homo sapiens
uuacuuugauuuuuaaaaca

SEQ ID NO: 8553 - RNA, 19 nt, Homo sapiens
uacugguggcacaccagac

SEQ ID NO: 8554 - RNA, 20 nt, Homo sapiens
aacuaguugguaaugugauu

SEQ ID NO: 8555 - RNA, 17 nt, Homo sapiens
auaugauacuguauaga

SEQ ID NO: 8556 - RNA, 23 nt, Homo sapiens
aucuguaucccauugucuggcuu

SEQ ID NO: 8557 - RNA, 19 nt, Homo sapiens
cauauaguauuacccaacu

SEQ ID NO: 8558 - RNA, 22 nt, Homo sapiens
gagcuuuacagacauucaccaa

SEQ ID NO: 8559 - RNA, 17 nt, Homo sapiens
gauaucuguuuaaucuu

SEQ ID NO: 8560 - RNA, 19 nt, Homo sapiens
gauuguaaggcuuauguca

SEQ ID NO: 8561 - RNA, 17 nt, Homo sapiens
gccuucuauaugugcua

SEQ ID NO: 8562 - RNA, 19 nt, Homo sapiens
ugagaaaccuguuaacuua

SEQ ID NO: 8563 - RNA, 24 nt, Homo sapiens
agggcaaagucaaugaguacaacu

SEQ ID NO: 8564 - RNA, 23 nt, Homo sapiens
aggguuuuagucaacaugccaua

SEQ ID NO: 8565 - RNA, 20 nt, Homo sapiens
auccaauauguuuccaucac

SEQ ID NO: 8566 - RNA, 21 nt, Homo sapiens
auuuuuacugagaauaucgaa

SEQ ID NO: 8567 - RNA, 23 nt, Homo sapiens
agaaacccgggguugggggcuca

SEQ ID NO: 8568 - RNA, 22 nt, Homo sapiens
cggggcggccagggcuagagug

SEQ ID NO: 8569 - RNA, 18 nt, Homo sapiens
gggggugggguugaaaua

SEQ ID NO: 8570 - RNA, 21 nt, Homo sapiens
uaauuccagaguacuguccuc

SEQ ID NO: 8571 - RNA, 29 nt, Homo sapiens
uaggucucccacuuucuaggaucauuuuu

SEQ ID NO: 8572 - RNA, 20 nt, Homo sapiens
ucugugacuggugccauaga

SEQ ID NO: 8573 - RNA, 24 nt, Homo sapiens
acuugggcccggcgugcugggccu

SEQ ID NO: 8574 - RNA, 18 nt, Homo sapiens
caaaccccuuuccaguau

SEQ ID NO: 8575 - RNA, 23 nt, Homo sapiens
ccuguaccccaaaccccuuucca

SEQ ID NO: 8576 - RNA, 20 nt, Homo sapiens
ccuuaaugcuugagaaccua

SEQ ID NO: 8577 - RNA, 21 nt, Homo sapiens
ggcuucugugaggcccauuuu

SEQ ID NO: 8578 - RNA, 22 nt, Homo sapiens
gucagcucacucccugcuccca

SEQ ID NO: 8579 - RNA, 22 nt, Homo sapiens
ucacacuacaugcacugccuuu

SEQ ID NO: 8580 - RNA, 19 nt, Homo sapiens
uucccaccuaucuugccca

SEQ ID NO: 8581 - RNA, 21 nt, Homo sapiens
aaggauagcagcaaacaauca

SEQ ID NO: 8582 - RNA, 22 nt, Homo sapiens
uuuguauuucacauauuacaau

SEQ ID NO: 8583 - RNA, 24 nt, Homo sapiens
uuuagguaaggguagggcacuuuu

SEQ ID NO: 8584 - RNA, 19 nt, Homo sapiens
aucucagagacuucuuuua

SEQ ID NO: 8585 - RNA, 21 nt, Homo sapiens
ccucccugacuguggaucuua

SEQ ID NO: 8586 - RNA, 18 nt, Homo sapiens
ccuggaggcaagcgcugc

SEQ ID NO: 8587 - RNA, 22 nt, Homo sapiens
uguguuggcuggcaucccugag

SEQ ID NO: 8588 - RNA, 22 nt, Homo sapiens
ucuguagaaaauacauacuucc

SEQ ID NO: 8589 - RNA, 24 nt, Homo sapiens
ccuuuuuagcaaggccuugguguu

SEQ ID NO: 8590 - RNA, 19 nt, Homo sapiens
auaccucauacugcuuuac

SEQ ID NO: 8591 - RNA, 24 nt, Homo sapiens
gugcugucaauaccucauacugcu

SEQ ID NO: 8592 - RNA, 16 nt, Homo sapiens
aucaucaccugcccca

SEQ ID NO: 8593 - RNA, 23 nt, Homo sapiens
cccacugccccccaacuacagca

SEQ ID NO: 8594 - RNA, 22 nt, Homo sapiens
guguauauagaauuguucacug

SEQ ID NO: 8595 - RNA, 17 nt, Homo sapiens
uucuuuacuuuuauaug

SEQ ID NO: 8596 - RNA, 18 nt, Homo sapiens
ccagugccucccucccuc

SEQ ID NO: 8597 - RNA, 22 nt, Homo sapiens
gcaaaugaacgaagcgccaacc

SEQ ID NO: 8598 - RNA, 22 nt, Homo sapiens
uccagcccccacccacaccccc

SEQ ID NO: 8599 - RNA, 24 nt, Homo sapiens
uguuguaaacauauuugaaaacua

SEQ ID NO: 8600 - RNA, 16 nt, Homo sapiens
uucuccccaucccagg

SEQ ID NO: 8601 - RNA, 17 nt, Homo sapiens
acaucugagcucacacu

SEQ ID NO: 8602 - RNA, 18 nt, Homo sapiens
cgcauguaaaugcugaua

SEQ ID NO: 8603 - RNA, 19 nt, Homo sapiens
ggaaauuucaagcacuuuu

SEQ ID NO: 8604 - RNA, 20 nt, Homo sapiens
uuucuuccuuuucaauuuca

SEQ ID NO: 8605 - RNA, 22 nt, Homo sapiens
aauuaaaaaugaaaauuauguu

SEQ ID NO: 8606 - RNA, 18 nt, Homo sapiens
caauucugaaauacuuuu

SEQ ID NO: 8607 - RNA, 23 nt, Homo sapiens
uccaguauaaucuccucugcuca

SEQ ID NO: 8608 - RNA, 19 nt, Homo sapiens
ucucuuugugcaguguuag

SEQ ID NO: 8609 - RNA, 20 nt, Homo sapiens
uuuacauuuuagggugggua

SEQ ID NO: 8610 - RNA, 26 nt, Homo sapiens
acauaagaugaauuuaauuauauuca

SEQ ID NO: 8611 - RNA, 21 nt, Homo sapiens
ucuguauucuuacucacuuuu

SEQ ID NO: 8612 - RNA, 18 nt, Homo sapiens
uuggcaauuaaacaugcu

SEQ ID NO: 8613 - RNA, 18 nt, Homo sapiens
cugugccuuugcaaauca

SEQ ID NO: 8614 - RNA, 21 nt, Homo sapiens
aagaaucuuuaugaauauaca

SEQ ID NO: 8615 - RNA, 20 nt, Homo sapiens
aagguugcagugcugagcug

SEQ ID NO: 8616 - RNA, 18 nt, Homo sapiens
ccgaguggcugucggcuc

SEQ ID NO: 8617 - RNA, 18 nt, Homo sapiens
cgcccuugagcuacuuca

SEQ ID NO: 8618 - RNA, 24 nt, Homo sapiens
uuacagcuuucugugcagagauga

SEQ ID NO: 8619 - RNA, 24 nt, Homo sapiens
aauguacaccacuccucaugugcc

SEQ ID NO: 8620 - RNA, 19 nt, Homo sapiens
acagcugaggaaagcaauu

SEQ ID NO: 8621 - RNA, 19 nt, Homo sapiens
ccucagcacucccuaugca

SEQ ID NO: 8622 - RNA, 20 nt, Homo sapiens
guugaacuggacccuggcuu

SEQ ID NO: 8623 - RNA, 18 nt, Homo sapiens
uuaaacuugaucagguca

SEQ ID NO: 8624 - RNA, 22 nt, Homo sapiens
uugacaaacagcagacccuaca

SEQ ID NO: 8625 - RNA, 25 nt, Homo sapiens
agcacgguaaucugagugcacagua

SEQ ID NO: 8626 - RNA, 23 nt, Homo sapiens
cagugagacuguacauaauugca

SEQ ID NO: 8627 - RNA, 24 nt, Homo sapiens
cacugcugagacccacaggucuaa

SEQ ID NO: 8628 - RNA, 19 nt, Homo sapiens
ggucacagacuucuggccu

SEQ ID NO: 8629 - RNA, 20 nt, Homo sapiens
gugugugugggcacgugugg

SEQ ID NO: 8630 - RNA, 21 nt, Homo sapiens
accugauaggauugccugcuu

SEQ ID NO: 8631 - RNA, 18 nt, Homo sapiens
agcauugaaggaacucuc

SEQ ID NO: 8632 - RNA, 20 nt, Homo sapiens
cccuuugaaggcucugggga

SEQ ID NO: 8633 - RNA, 21 nt, Homo sapiens
aauguuucuuaaauggaauua

SEQ ID NO: 8634 - RNA, 19 nt, Homo sapiens
aauuuuuggugaauguggg

SEQ ID NO: 8635 - RNA, 23 nt, Homo sapiens
ugagcaucagagaguguacauca

SEQ ID NO: 8636 - RNA, 19 nt, Homo sapiens
agaggggaugaguugugug

SEQ ID NO: 8637 - RNA, 21 nt, Homo sapiens
uccuggugcaaggccggugga

SEQ ID NO: 8638 - RNA, 20 nt, Homo sapiens
cgggagacaccucagacccc

SEQ ID NO: 8639 - RNA, 21 nt, Homo sapiens
aaaaggugcuacgguagugau

SEQ ID NO: 8640 - RNA, 21 nt, Homo sapiens
agcaaguucacuacagcauca

SEQ ID NO: 8641 - RNA, 17 nt, Homo sapiens
cagcuugcaucuuuguu

SEQ ID NO: 8642 - RNA, 19 nt, Homo sapiens
ccaauuuucuuuuuacucc

SEQ ID NO: 8643 - RNA, 19 nt, Homo sapiens
ccugggugaucaccacauc

SEQ ID NO: 8644 - RNA, 18 nt, Homo sapiens
gccucaaguucaauaugg

SEQ ID NO: 8645 - RNA, 17 nt, Homo sapiens
agcauagaaacauccua

SEQ ID NO: 8646 - RNA, 17 nt, Homo sapiens
ucaagugauucuccugc

SEQ ID NO: 8647 - RNA, 18 nt, Homo sapiens
gcauggggagccuccguu

SEQ ID NO: 8648 - RNA, 18 nt, Homo sapiens
ccagaaucacuugcacug

SEQ ID NO: 8649 - RNA, 18 nt, Homo sapiens
ccaggagaaaaugguguu

SEQ ID NO: 8650 - RNA, 22 nt, Homo sapiens
ccuccucaucacguuucucuca

SEQ ID NO: 8651 - RNA, 19 nt, Homo sapiens
ugcccagcugacgagcuuu

SEQ ID NO: 8652 - RNA, 23 nt, Homo sapiens
uuuccagaaucacuugcacuguc

SEQ ID NO: 8653 - RNA, 21 nt, Homo sapiens
acuagcaacaaaggcaaccca

SEQ ID NO: 8654 - RNA, 24 nt, Homo sapiens
acacaauggaaauucagaccuuga

SEQ ID NO: 8655 - RNA, 20 nt, Homo sapiens
ggaccuggcauuuaucuggc

SEQ ID NO: 8656 - RNA, 19 nt, Homo sapiens
guauuucuggaucauuuuu

SEQ ID NO: 8657 - RNA, 17 nt, Homo sapiens
ugggaaguguccagcaa

SEQ ID NO: 8658 - RNA, 17 nt, Homo sapiens
uuggaaaauuuauaauu

SEQ ID NO: 8659 - RNA, 23 nt, Homo sapiens
cuuauugauacuaaagaggaguu

SEQ ID NO: 8660 - RNA, 20 nt, Homo sapiens
gauguugaaccugguuaggg

SEQ ID NO: 8661 - RNA, 18 nt, Homo sapiens
acccucuaccaucuguaa

SEQ ID NO: 8662 - RNA, 21 nt, Homo sapiens
accgucacucagauccacauu

SEQ ID NO: 8663 - RNA, 23 nt, Homo sapiens
cacugcucgcuucggauacucca

SEQ ID NO: 8664 - RNA, 20 nt, Homo sapiens
cugccuucgacaccacccca

SEQ ID NO: 8665 - RNA, 21 nt, Homo sapiens
ggccugcuccccagcccgggg

SEQ ID NO: 8666 - RNA, 19 nt, Homo sapiens
agcgccuggccacacucuu

SEQ ID NO: 8667 - RNA, 19 nt, Homo sapiens
cacugccuacccaccugcc

SEQ ID NO: 8668 - RNA, 23 nt, Homo sapiens
cccacucccuggcccucauccca

SEQ ID NO: 8669 - RNA, 21 nt, Homo sapiens
ccccacccggggcccagagcu

SEQ ID NO: 8670 - RNA, 23 nt, Homo sapiens
gcacugccuacccaccugcccca

SEQ ID NO: 8671 - RNA, 23 nt, Homo sapiens
uucuacuaguuccuccaauucca

SEQ ID NO: 8672 - RNA, 23 nt, Homo sapiens
uucuacuaguuccuccaauucca

SEQ ID NO: 8673 - RNA, 21 nt, Homo sapiens
ugcagugagccuagaucgcgc

SEQ ID NO: 8674 - RNA, 21 nt, Homo sapiens
aaaacaaaagggacuaaacua

SEQ ID NO: 8675 - RNA, 20 nt, Homo sapiens
cucuuucuucuuuuguccca

SEQ ID NO: 8676 - RNA, 24 nt, Homo sapiens
cuuuuucaguagcauuuagaccuu

SEQ ID NO: 8677 - RNA, 18 nt, Homo sapiens
aaaccaaagcucagaugg

SEQ ID NO: 8678 - RNA, 21 nt, Homo sapiens
aaacauccuaacuuguuuuuc

SEQ ID NO: 8679 - RNA, 17 nt, Homo sapiens
cgaauaacuguugagau

SEQ ID NO: 8680 - RNA, 18 nt, Homo sapiens
cacuaggcucuuugugua

SEQ ID NO: 8681 - RNA, 19 nt, Homo sapiens
cagcaggagaggugaugag

SEQ ID NO: 8682 - RNA, 23 nt, Homo sapiens
cuaacaaacauauuccaauaaua

SEQ ID NO: 8683 - RNA, 19 nt, Homo sapiens
ugagaugaauuggugugaa

SEQ ID NO: 8684 - RNA, 22 nt, Homo sapiens
cccuccacacccggggccagac

SEQ ID NO: 8685 - RNA, 18 nt, Homo sapiens
gcuagugaccaucuucau

SEQ ID NO: 8686 - RNA, 22 nt, Homo sapiens
ugcagaacagcaucaugucaua

SEQ ID NO: 8687 - RNA, 17 nt, Homo sapiens
ugguuucuaccagcuca

SEQ ID NO: 8688 - RNA, 21 nt, Homo sapiens
cccagacccacgucuucccca

SEQ ID NO: 8689 - RNA, 19 nt, Homo sapiens
ggcagaugaaggaguuuuc

SEQ ID NO: 8690 - RNA, 19 nt, Homo sapiens
aauuauacucuaaauucca

SEQ ID NO: 8691 - RNA, 19 nt, Homo sapiens
gcaagagccauaacuuuga

SEQ ID NO: 8692 - RNA, 21 nt, Homo sapiens
cuuguggugugaccauguuca

SEQ ID NO: 8693 - RNA, 20 nt, Homo sapiens
uugcucgccgcagccgccuc

SEQ ID NO: 8694 - RNA, 17 nt, Homo sapiens
cccgccuccccgccagc

SEQ ID NO: 8695 - RNA, 19 nt, Homo sapiens
ccgagcgcgccggcaccgc

SEQ ID NO: 8696 - RNA, 20 nt, Homo sapiens
gccucugccgccucuuccag

SEQ ID NO: 8697 - RNA, 23 nt, Homo sapiens
cccugccuugggaggugugugga

SEQ ID NO: 8698 - RNA, 19 nt, Homo sapiens
gccaucucuaggcaccuca

SEQ ID NO: 8699 - RNA, 22 nt, Homo sapiens
ucuccugcuuggucuuggcccu

SEQ ID NO: 8700 - RNA, 21 nt, Homo sapiens
ugggugggcuggaauggaacu

SEQ ID NO: 8701 - RNA, 21 nt, Homo sapiens
acauuauguuagagagguagc

SEQ ID NO: 8702 - RNA, 16 nt, Homo sapiens
ccaaauccacaagcca

SEQ ID NO: 8703 - RNA, 23 nt, Homo sapiens
gugccaggcuguaagcauucuga

SEQ ID NO: 8704 - RNA, 20 nt, Homo sapiens
aaagaaaagcaaacaaagaa

SEQ ID NO: 8705 - RNA, 18 nt, Homo sapiens
cacaagcccaacaucuca

SEQ ID NO: 8706 - RNA, 20 nt, Homo sapiens
ucucugcccucccucccuuu

SEQ ID NO: 8707 - RNA, 18 nt, Homo sapiens
cgaccgcugcggcggcgg

SEQ ID NO: 8708 - RNA, 20 nt, Homo sapiens
aagaaagaagcccagguguc

SEQ ID NO: 8709 - RNA, 19 nt, Homo sapiens
ccccaucucagagcucaga

SEQ ID NO: 8710 - RNA, 18 nt, Homo sapiens
gcccacaccuccaccucc

SEQ ID NO: 8711 - RNA, 17 nt, Homo sapiens
ugaacucacugagcagc

SEQ ID NO: 8712 - RNA, 22 nt, Homo sapiens
ucugugcgcggccggcuggcuc

SEQ ID NO: 8713 - RNA, 18 nt, Homo sapiens
acaguuaccacccucauu

SEQ ID NO: 8714 - RNA, 17 nt, Homo sapiens
auugggcagcuuccaca

SEQ ID NO: 8715 - RNA, 20 nt, Homo sapiens
ugacaagaggugacacaacu

SEQ ID NO: 8716 - RNA, 21 nt, Homo sapiens
ugacccuucggaaucagccca

SEQ ID NO: 8717 - RNA, 16 nt, Homo sapiens
aagacauaaaugagga

SEQ ID NO: 8718 - RNA, 20 nt, Homo sapiens
ccauguuaaaucccauucau

SEQ ID NO: 8719 - RNA, 21 nt, Homo sapiens
cuaaauuaacauugggaaauc

SEQ ID NO: 8720 - RNA, 21 nt, Homo sapiens
cuguggaaaaauauuuaagau

SEQ ID NO: 8721 - RNA, 19 nt, Homo sapiens
uacuuuugacaacaaauua

SEQ ID NO: 8722 - RNA, 21 nt, Homo sapiens
ggaggcagugauuccaagcug

SEQ ID NO: 8723 - RNA, 19 nt, Homo sapiens
ucaccaucguguuugcaaa

SEQ ID NO: 8724 - RNA, 18 nt, Homo sapiens
ucauaaaccaauguggca

SEQ ID NO: 8725 - RNA, 20 nt, Homo sapiens
uguccucagagcaggggcca

SEQ ID NO: 8726 - RNA, 22 nt, Homo sapiens
ccgagcgcggggggcccgugga

SEQ ID NO: 8727 - RNA, 18 nt, Homo sapiens
gcguucccggucacuuuu

SEQ ID NO: 8728 - RNA, 17 nt, Homo sapiens
ugacgacauacaugcua

SEQ ID NO: 8729 - RNA, 18 nt, Homo sapiens
augaagcugcauaugaua

SEQ ID NO: 8730 - RNA, 18 nt, Homo sapiens
cggaauauuuaaacagua

SEQ ID NO: 8731 - RNA, 17 nt, Homo sapiens
gcgggacgagcgcggga

SEQ ID NO: 8732 - RNA, 21 nt, Homo sapiens
ugucuccggggaagcccgggg

SEQ ID NO: 8733 - RNA, 17 nt, Homo sapiens
cuguuacacuugugcag

SEQ ID NO: 8734 - RNA, 25 nt, Homo sapiens
ucuagaaaaaacuacuuuuguacca

SEQ ID NO: 8735 - RNA, 22 nt, Homo sapiens
ugugaauaaaguuaguguguug

SEQ ID NO: 8736 - RNA, 18 nt, Homo sapiens
acaacagaaaacacuuug

SEQ ID NO: 8737 - RNA, 24 nt, Homo sapiens
agggaagagagggguucuacccac

SEQ ID NO: 8738 - RNA, 18 nt, Homo sapiens
auuuaugaaguuauggca

SEQ ID NO: 8739 - RNA, 16 nt, Homo sapiens
cugcagcaugcuggga

SEQ ID NO: 8740 - RNA, 19 nt, Homo sapiens
cuugcuuccagauuguuuu

SEQ ID NO: 8741 - RNA, 19 nt, Homo sapiens
ggacauuuaauaauggacc

SEQ ID NO: 8742 - RNA, 19 nt, Homo sapiens
ggaaugauauaaucugucc

SEQ ID NO: 8743 - RNA, 19 nt, Homo sapiens
uuuugaugauggagguaug

SEQ ID NO: 8744 - RNA, 26 nt, Homo sapiens
gcuccaugugacccucccucugccuc

SEQ ID NO: 8745 - RNA, 17 nt, Homo sapiens
acugcaguauucaccua

SEQ ID NO: 8746 - RNA, 22 nt, Homo sapiens
cguuuuugagaagauagucaua

SEQ ID NO: 8747 - RNA, 19 nt, Homo sapiens
gaacagagggacaauuguu

SEQ ID NO: 8748 - RNA, 21 nt, Homo sapiens
agaagggcccauccuauuucc

SEQ ID NO: 8749 - RNA, 21 nt, Homo sapiens
agcuggcuguccugguucacu

SEQ ID NO: 8750 - RNA, 18 nt, Homo sapiens
aggaaauuaauggcuauu

SEQ ID NO: 8751 - RNA, 18 nt, Homo sapiens
augguuacccugcuucuu

SEQ ID NO: 8752 - RNA, 21 nt, Homo sapiens
cacaaaguccuuaacaugcca

SEQ ID NO: 8753 - RNA, 21 nt, Homo sapiens
guggcagauuucuuuagcugc

SEQ ID NO: 8754 - RNA, 23 nt, Homo sapiens
ucugugaaucuugaauaacuuuu

SEQ ID NO: 8755 - RNA, 21 nt, Homo sapiens
cauaucccuuccccagaucug

SEQ ID NO: 8756 - RNA, 19 nt, Homo sapiens
guagcucucccuaggcugc

SEQ ID NO: 8757 - RNA, 25 nt, Homo sapiens
gucugguguguagauugcuuugucu

SEQ ID NO: 8758 - RNA, 17 nt, Homo sapiens
ugcccacucuccauccu

SEQ ID NO: 8759 - RNA, 18 nt, Homo sapiens
uugucuuuguucugugau

SEQ ID NO: 8760 - RNA, 20 nt, Homo sapiens
agcugcagcaggagaugcaa

SEQ ID NO: 8761 - RNA, 17 nt, Homo sapiens
ccaccucccacugggca

SEQ ID NO: 8762 - RNA, 18 nt, Homo sapiens
cccagcgccuggcuccag

SEQ ID NO: 8763 - RNA, 19 nt, Homo sapiens
agcccaccagagcacuaca

SEQ ID NO: 8764 - RNA, 21 nt, Homo sapiens
aucugggcugcggggaggcuc

SEQ ID NO: 8765 - RNA, 16 nt, Homo sapiens
cacacaucuugcuaug

SEQ ID NO: 8766 - RNA, 20 nt, Homo sapiens
ccaggcagcggcucugugga

SEQ ID NO: 8767 - RNA, 16 nt, Homo sapiens
cugcccccugcccucu

SEQ ID NO: 8768 - RNA, 23 nt, Homo sapiens
ucccggaggaacccauuugugcu

SEQ ID NO: 8769 - RNA, 21 nt, Homo sapiens
ugaccaccacugugccccuca

SEQ ID NO: 8770 - RNA, 19 nt, Homo sapiens
ggugggggggugugcugug

SEQ ID NO: 8771 - RNA, 22 nt, Homo sapiens
aguugcugcuauucuuugccug

SEQ ID NO: 8772 - RNA, 18 nt, Homo sapiens
uucucaaagcacaacgug

SEQ ID NO: 8773 - RNA, 25 nt, Homo sapiens
gauggccucagccccagccaccaua

SEQ ID NO: 8774 - RNA, 26 nt, Homo sapiens
ugguguuuccccuaaucgugggguug

SEQ ID NO: 8775 - RNA, 22 nt, Homo sapiens
caaagcagcaguucuaccaagc

SEQ ID NO: 8776 - RNA, 21 nt, Homo sapiens
cugggagagaaaauuaaccaa

SEQ ID NO: 8777 - RNA, 20 nt, Homo sapiens
guaugaguauggcuugguua

SEQ ID NO: 8778 - RNA, 21 nt, Homo sapiens
ucuuuacuaguuauugugaga

SEQ ID NO: 8779 - RNA, 19 nt, Homo sapiens
aaaaucucaucucuucccu

SEQ ID NO: 8780 - RNA, 18 nt, Homo sapiens
acucagcuccaucuccaa

SEQ ID NO: 8781 - RNA, 22 nt, Homo sapiens
gcaucucuaauaccauguuuga

SEQ ID NO: 8782 - RNA, 19 nt, Homo sapiens
aagauuauaguaccaguca

SEQ ID NO: 8783 - RNA, 17 nt, Homo sapiens
auauagaggaaaggggc

SEQ ID NO: 8784 - RNA, 18 nt, Homo sapiens
cacccccaccgccuuccu

SEQ ID NO: 8785 - RNA, 22 nt, Homo sapiens
ugcuauuuuaaaauuucuugau

SEQ ID NO: 8786 - RNA, 18 nt, Homo sapiens
gagucuuguggugaaaca

SEQ ID NO: 8787 - RNA, 20 nt, Homo sapiens
gcuuaagucauggaauucua

SEQ ID NO: 8788 - RNA, 20 nt, Homo sapiens
ucuuuuuauggcugaauaau

SEQ ID NO: 8789 - RNA, 24 nt, Homo sapiens
cuucuucaucucuguuuugcucuu

SEQ ID NO: 8790 - RNA, 18 nt, Homo sapiens
ucauucugaaccuuauca

SEQ ID NO: 8791 - RNA, 21 nt, Homo sapiens
aaaaaaauugcucuguguaua

SEQ ID NO: 8792 - RNA, 19 nt, Homo sapiens
aacugggauaacugauuuc

SEQ ID NO: 8793 - RNA, 20 nt, Homo sapiens
aagagcauggaugcauuuca

SEQ ID NO: 8794 - RNA, 18 nt, Homo sapiens
aucugaagaggcuucucc

SEQ ID NO: 8795 - RNA, 19 nt, Homo sapiens
aggauuuucuucccaggga

SEQ ID NO: 8796 - RNA, 20 nt, Homo sapiens
aucccaugcugggcccucca

SEQ ID NO: 8797 - RNA, 19 nt, Homo sapiens
ccgggccacccccucugaa

SEQ ID NO: 8798 - RNA, 21 nt, Homo sapiens
ccuggagccccaggugggcug

SEQ ID NO: 8799 - RNA, 21 nt, Homo sapiens
ggacccuccaguucugccaca

SEQ ID NO: 8800 - RNA, 20 nt, Homo sapiens
gugaguaggggguuuauguu

SEQ ID NO: 8801 - RNA, 20 nt, Homo sapiens
gaaaaggucagaaaauauua

SEQ ID NO: 8802 - RNA, 22 nt, Homo sapiens
ggguuauaagaaaaaauugcac

SEQ ID NO: 8803 - RNA, 21 nt, Homo sapiens
uaccagauuuuuauauuugcc

SEQ ID NO: 8804 - RNA, 21 nt, Homo sapiens
uuuuuauauuugccacuguua

SEQ ID NO: 8805 - RNA, 18 nt, Homo sapiens
uuuuggcucuuuuaggaa

SEQ ID NO: 8806 - RNA, 25 nt, Homo sapiens
aacugugggauucugauuuguauua

SEQ ID NO: 8807 - RNA, 18 nt, Homo sapiens
cacaauggaguguguaag

SEQ ID NO: 8808 - RNA, 18 nt, Homo sapiens
uacuaccucacuacuaca

SEQ ID NO: 8809 - RNA, 22 nt, Homo sapiens
ucucuugugcuuuuuugauuuu

SEQ ID NO: 8810 - RNA, 20 nt, Homo sapiens
ucugaaaauaucucuugugc

SEQ ID NO: 8811 - RNA, 19 nt, Homo sapiens
ugccaaagcacuuacacca

SEQ ID NO: 8812 - RNA, 20 nt, Homo sapiens
uuuguugguaacuaauguua

SEQ ID NO: 8813 - RNA, 18 nt, Homo sapiens
aucacugcccugcucuga

SEQ ID NO: 8814 - RNA, 20 nt, Homo sapiens
ccuuuggaagauuuggugga

SEQ ID NO: 8815 - RNA, 20 nt, Homo sapiens
gcggccggaggaguuuuguu

SEQ ID NO: 8816 - RNA, 20 nt, Homo sapiens
ugcuauuuuuuucagugcuu

SEQ ID NO: 8817 - RNA, 23 nt, Homo sapiens
agauugucaucuuguacagcaaa

SEQ ID NO: 8818 - RNA, 21 nt, Homo sapiens
cuacagauacuuaugaagaca

SEQ ID NO: 8819 - RNA, 22 nt, Homo sapiens
cuuguaugugucaaaguauacu

SEQ ID NO: 8820 - RNA, 19 nt, Homo sapiens
ggagcaguaguacuaaggc

SEQ ID NO: 8821 - RNA, 20 nt, Homo sapiens
ggaacgagccggcggcggug

SEQ ID NO: 8822 - RNA, 18 nt, Homo sapiens
cguccucccaccacccca

SEQ ID NO: 8823 - RNA, 21 nt, Homo sapiens
cucucucucucucccucucuc

SEQ ID NO: 8824 - RNA, 20 nt, Homo sapiens
ucuccuccuccuccuccucu

SEQ ID NO: 8825 - RNA, 21 nt, Homo sapiens
cuuuuuuauggcaguguagua

SEQ ID NO: 8826 - RNA, 20 nt, Homo sapiens
uuaaguuauuucucaucccu

SEQ ID NO: 8827 - RNA, 21 nt, Homo sapiens
ugggauuauguggccuuaggu

SEQ ID NO: 8828 - RNA, 16 nt, Homo sapiens
cucucucucucucuca

SEQ ID NO: 8829 - RNA, 19 nt, Homo sapiens
uuccgcacagaaaguuuca

SEQ ID NO: 8830 - RNA, 18 nt, Homo sapiens
ccugggugaggccugggg

SEQ ID NO: 8831 - RNA, 21 nt, Homo sapiens
aaguugacuuuuaguuccuaa

SEQ ID NO: 8832 - RNA, 17 nt, Homo sapiens
cucuccuucagauacug

SEQ ID NO: 8833 - RNA, 19 nt, Homo sapiens
cuguuuugccuguugcuca

SEQ ID NO: 8834 - RNA, 19 nt, Homo sapiens
gccuguuugggaagcagca

SEQ ID NO: 8835 - RNA, 23 nt, Homo sapiens
cccuucccccauaccuuacccua

SEQ ID NO: 8836 - RNA, 18 nt, Homo sapiens
cuucagacuggugucuga

SEQ ID NO: 8837 - RNA, 20 nt, Homo sapiens
ucucagacaccaagcugcag

SEQ ID NO: 8838 - RNA, 19 nt, Homo sapiens
ucuuuuuccugaaacuuug

SEQ ID NO: 8839 - RNA, 19 nt, Homo sapiens
ccaggccaucucuguuccu

SEQ ID NO: 8840 - RNA, 19 nt, Homo sapiens
ccaggucacuguugcccca

SEQ ID NO: 8841 - RNA, 23 nt, Homo sapiens
cccugacagcacagggccugggg

SEQ ID NO: 8842 - RNA, 23 nt, Homo sapiens
ccuggcccaccugucuuggcuuu

SEQ ID NO: 8843 - RNA, 23 nt, Homo sapiens
aguccccaggccagugcuuggca

SEQ ID NO: 8844 - RNA, 18 nt, Homo sapiens
cacagacccccuugcucc

SEQ ID NO: 8845 - RNA, 18 nt, Homo sapiens
ccaccccuccccgcauug

SEQ ID NO: 8846 - RNA, 17 nt, Homo sapiens
cuuugccacuguccuug

SEQ ID NO: 8847 - RNA, 20 nt, Homo sapiens
augauuucaaaaucaguuuu

SEQ ID NO: 8848 - RNA, 22 nt, Homo sapiens
ccaaacaaaacugaaccacaaa

SEQ ID NO: 8849 - RNA, 18 nt, Homo sapiens
cuuguucuauuuuucaau

SEQ ID NO: 8850 - RNA, 20 nt, Homo sapiens
uaagggaacaauccauguga

SEQ ID NO: 8851 - RNA, 23 nt, Homo sapiens
uaaucagaaaaguaauuuuguca

SEQ ID NO: 8852 - RNA, 20 nt, Homo sapiens
ugcaaauuaaaacauauuuc

SEQ ID NO: 8853 - RNA, 23 nt, Homo sapiens
uuguuugaucccuaacccuacaa

SEQ ID NO: 8854 - RNA, 22 nt, Homo sapiens
cuuuucacuucaauuaaugcug

SEQ ID NO: 8855 - RNA, 18 nt, Homo sapiens
guccccuaaggaaauccg

SEQ ID NO: 8856 - RNA, 21 nt, Homo sapiens
uguuuuuuuugacuaaagcua

SEQ ID NO: 8857 - RNA, 26 nt, Homo sapiens
auuuuacagcuggaccuaguuucaca

SEQ ID NO: 8858 - RNA, 19 nt, Homo sapiens
ugauaucauuaacauuuca

SEQ ID NO: 8859 - RNA, 23 nt, Homo sapiens
cccacuuugacuaugaguauacc

SEQ ID NO: 8860 - RNA, 18 nt, Homo sapiens
cuuagacgucaacccuaa

SEQ ID NO: 8861 - RNA, 23 nt, Homo sapiens
cuuuuuugucuuugcuuuaucuu

SEQ ID NO: 8862 - RNA, 19 nt, Homo sapiens
gccuuaagauugguaagcu

SEQ ID NO: 8863 - RNA, 21 nt, Homo sapiens
gcguccccuguggcgggcucu

SEQ ID NO: 8864 - RNA, 18 nt, Homo sapiens
uaagccaguauaaaacac

SEQ ID NO: 8865 - RNA, 19 nt, Homo sapiens
ugcaccagaugccauuaca

SEQ ID NO: 8866 - RNA, 18 nt, Homo sapiens
aaagcaucuggaaaggua

SEQ ID NO: 8867 - RNA, 18 nt, Homo sapiens
ccucugggaaggacagcc

SEQ ID NO: 8868 - RNA, 19 nt, Homo sapiens
cuggugccuuuugcagcca

SEQ ID NO: 8869 - RNA, 18 nt, Homo sapiens
cuguuuucucucugccuu

SEQ ID NO: 8870 - RNA, 25 nt, Homo sapiens
ggacagcccugaccuucgguuuucc

SEQ ID NO: 8871 - RNA, 20 nt, Homo sapiens
gguggaugggggggauaccg

SEQ ID NO: 8872 - RNA, 21 nt, Homo sapiens
ggugucccugucguggagcug

SEQ ID NO: 8873 - RNA, 22 nt, Homo sapiens
ucacuggccuugcuggaggcac

SEQ ID NO: 8874 - RNA, 20 nt, Homo sapiens
uucccaagaauucugggcug

SEQ ID NO: 8875 - RNA, 18 nt, Homo sapiens
uuggggccucccuggcuc

SEQ ID NO: 8876 - RNA, 21 nt, Homo sapiens
agggaaauaaaggcagaaggc

SEQ ID NO: 8877 - RNA, 19 nt, Homo sapiens
cccagaucuaugaacuaca

SEQ ID NO: 8878 - RNA, 20 nt, Homo sapiens
ccgccccuuccuucuguucc

SEQ ID NO: 8879 - RNA, 23 nt, Homo sapiens
cuaaucuuucaaaacagauuuaa

SEQ ID NO: 8880 - RNA, 23 nt, Homo sapiens
cugcuggaaaauuuuaucagcaa

SEQ ID NO: 8881 - RNA, 19 nt, Homo sapiens
caaugccaacagcuggcca

SEQ ID NO: 8882 - RNA, 19 nt, Homo sapiens
cucacuauccuaccccacc

SEQ ID NO: 8883 - RNA, 18 nt, Homo sapiens
uggguggaucacuugagg

SEQ ID NO: 8884 - RNA, 19 nt, Homo sapiens
gauaucuauuguggaucuu

SEQ ID NO: 8885 - RNA, 20 nt, Homo sapiens
uucagaauuucuaaaaguuu

SEQ ID NO: 8886 - RNA, 20 nt, Homo sapiens
agggagaaaauaauccaguc

SEQ ID NO: 8887 - RNA, 19 nt, Homo sapiens
cggguggggcuuggggcuc

SEQ ID NO: 8888 - RNA, 23 nt, Homo sapiens
gugucuugggcagagcuggcucu

SEQ ID NO: 8889 - RNA, 17 nt, Homo sapiens
augagagaagagccgga

SEQ ID NO: 8890 - RNA, 22 nt, Homo sapiens
ccucccccaguggccuuccucc

SEQ ID NO: 8891 - RNA, 18 nt, Homo sapiens
gcuggguccucuucugcc

SEQ ID NO: 8892 - RNA, 23 nt, Homo sapiens
gugucuccuccugaccccagugg

SEQ ID NO: 8893 - RNA, 24 nt, Homo sapiens
ucuaggcucuuucaagugacuuuu

SEQ ID NO: 8894 - RNA, 20 nt, Homo sapiens
uucauucucucgcacauuuc

SEQ ID NO: 8895 - RNA, 23 nt, Homo sapiens
uuggccuuucugaaggcaagacu

SEQ ID NO: 8896 - RNA, 22 nt, Homo sapiens
cuuugaggaaaagguuugagag

SEQ ID NO: 8897 - RNA, 20 nt, Homo sapiens
ugggaaucucuaaugugaaa

SEQ ID NO: 8898 - RNA, 19 nt, Homo sapiens
uugucaugccauuaagcuc

SEQ ID NO: 8899 - RNA, 20 nt, Homo sapiens
accugggacggaagcugcca

SEQ ID NO: 8900 - RNA, 21 nt, Homo sapiens
caagucgcauuugccacuuga

SEQ ID NO: 8901 - RNA, 26 nt, Homo sapiens
cacacccacaccacccacugucugca

SEQ ID NO: 8902 - RNA, 20 nt, Homo sapiens
gcugugaucaccugccuuug

SEQ ID NO: 8903 - RNA, 15 nt, Homo sapiens
ggaagcugccagcuc

SEQ ID NO: 8904 - RNA, 26 nt, Homo sapiens
gggacgcagcagcugcacccgcccac

SEQ ID NO: 8905 - RNA, 22 nt, Homo sapiens
guucuucccguuuccuuccgug

SEQ ID NO: 8906 - RNA, 19 nt, Homo sapiens
uggcccgcacgccgccuca

SEQ ID NO: 8907 - RNA, 20 nt, Homo sapiens
uguaccaauuaaaggauuga

SEQ ID NO: 8908 - RNA, 19 nt, Homo sapiens
ugugugccccgugcaggga

SEQ ID NO: 8909 - RNA, 24 nt, Homo sapiens
accaggacgcaugccccucccucu

SEQ ID NO: 8910 - RNA, 23 nt, Homo sapiens
ccucaguuuccaaaauggaacca

SEQ ID NO: 8911 - RNA, 18 nt, Homo sapiens
gcaccugccgagccucuu

SEQ ID NO: 8912 - RNA, 20 nt, Homo sapiens
ggacgcaugccccucccucu

SEQ ID NO: 8913 - RNA, 19 nt, Homo sapiens
gaagaaauuccuguagcau

SEQ ID NO: 8914 - RNA, 23 nt, Homo sapiens
auccuggaaggacacagugauga

SEQ ID NO: 8915 - RNA, 20 nt, Homo sapiens
aucucaguuguuugcuucuu

SEQ ID NO: 8916 - RNA, 19 nt, Homo sapiens
caaacugugaaaauagugu

SEQ ID NO: 8917 - RNA, 17 nt, Homo sapiens
cagaaccaaaucguggc

SEQ ID NO: 8918 - RNA, 17 nt, Homo sapiens
cagaaccaaaucguggc

SEQ ID NO: 8919 - RNA, 21 nt, Homo sapiens
ggugaugccauuacagaacca

SEQ ID NO: 8920 - RNA, 20 nt, Homo sapiens
aaagagucucuaccccuuuc

SEQ ID NO: 8921 - RNA, 19 nt, Homo sapiens
aauaggcaaaaguguaaca

SEQ ID NO: 8922 - RNA, 17 nt, Homo sapiens
ucaauaggcaaaagugu

SEQ ID NO: 8923 - RNA, 21 nt, Homo sapiens
uugauuuuuaucuccaagugg

SEQ ID NO: 8924 - RNA, 19 nt, Homo sapiens
aaagaacaaugacaaacac

SEQ ID NO: 8925 - RNA, 21 nt, Homo sapiens
aaaucuguuuuucucaucaga

SEQ ID NO: 8926 - RNA, 19 nt, Homo sapiens
agacugauuggccugguca

SEQ ID NO: 8927 - RNA, 18 nt, Homo sapiens
cagcagcaaaaacuacau

SEQ ID NO: 8928 - RNA, 19 nt, Homo sapiens
cauuugaaaggugugcuag

SEQ ID NO: 8929 - RNA, 21 nt, Homo sapiens
ccuccccgcccgcgccgccuc

SEQ ID NO: 8930 - RNA, 20 nt, Homo sapiens
cuugcggccgcggagccggg

SEQ ID NO: 8931 - RNA, 26 nt, Homo sapiens
gaaccaaaagggaggcucucuguagg

SEQ ID NO: 8932 - RNA, 21 nt, Homo sapiens
gagccuuuguuuuucuccaca

SEQ ID NO: 8933 - RNA, 21 nt, Homo sapiens
gauuuguaaagcuuuacaaua

SEQ ID NO: 8934 - RNA, 22 nt, Homo sapiens
ucucugcaacacuuugaggaca

SEQ ID NO: 8935 - RNA, 18 nt, Homo sapiens
uuuguguuguuuuuuuaa

SEQ ID NO: 8936 - RNA, 20 nt, Homo sapiens
augacuucaguuucuguuuu

SEQ ID NO: 8937 - RNA, 17 nt, Homo sapiens
auguuuuaaaaugugau

SEQ ID NO: 8938 - RNA, 22 nt, Homo sapiens
cauguauuuuauaaggcauuca

SEQ ID NO: 8939 - RNA, 18 nt, Homo sapiens
uaaaacuaggaaccugua

SEQ ID NO: 8940 - RNA, 23 nt, Homo sapiens
uaagggaaagguggaggggcuca

SEQ ID NO: 8941 - RNA, 21 nt, Homo sapiens
gccuccgcggcucaggagccg

SEQ ID NO: 8942 - RNA, 18 nt, Homo sapiens
guuucugucuguguccca

SEQ ID NO: 8943 - RNA, 19 nt, Homo sapiens
caggccacacagacggaca

SEQ ID NO: 8944 - RNA, 18 nt, Homo sapiens
cagggaagaagcuuuuga

SEQ ID NO: 8945 - RNA, 16 nt, Homo sapiens
ccucugggucugugag

SEQ ID NO: 8946 - RNA, 19 nt, Homo sapiens
gaccucccgagacuugcca

SEQ ID NO: 8947 - RNA, 18 nt, Homo sapiens
gcacagggagcuucuguu

SEQ ID NO: 8948 - RNA, 22 nt, Homo sapiens
gccugcugagggggcagugcca

SEQ ID NO: 8949 - RNA, 21 nt, Homo sapiens
gcugccucaggucaggccagg

SEQ ID NO: 8950 - RNA, 24 nt, Homo sapiens
gcuuugggaggacucacugacaua

SEQ ID NO: 8951 - RNA, 17 nt, Homo sapiens
ucugauggucguugugg

SEQ ID NO: 8952 - RNA, 20 nt, Homo sapiens
uggccaggcuggucuugaac

SEQ ID NO: 8953 - RNA, 20 nt, Homo sapiens
uuccugugguuccauccgaa

SEQ ID NO: 8954 - RNA, 23 nt, Homo sapiens
uugccccacacuaacuugcccug

SEQ ID NO: 8955 - RNA, 22 nt, Homo sapiens
cucgguuggcagccauguugga

SEQ ID NO: 8956 - RNA, 19 nt, Homo sapiens
gggucacugggucucgguu

SEQ ID NO: 8957 - RNA, 18 nt, Homo sapiens
ggucugaucaggcccugg

SEQ ID NO: 8958 - RNA, 21 nt, Homo sapiens
uuuuggcucggaggccuguga

SEQ ID NO: 8959 - RNA, 20 nt, Homo sapiens
acagagaacauggucuccug

SEQ ID NO: 8960 - RNA, 18 nt, Homo sapiens
ccacauucacauuccccu

SEQ ID NO: 8961 - RNA, 22 nt, Homo sapiens
cccuuccccacuccauggcgcc

SEQ ID NO: 8962 - RNA, 20 nt, Homo sapiens
ccgcuccccaacuucucgcc

SEQ ID NO: 8963 - RNA, 18 nt, Homo sapiens
ucacauuccccucccucu

SEQ ID NO: 8964 - RNA, 20 nt, Homo sapiens
ucccugagcaggaccccaca

SEQ ID NO: 8965 - RNA, 21 nt, Homo sapiens
aguuuucuucccuccuugcua

SEQ ID NO: 8966 - RNA, 21 nt, Homo sapiens
ggaagaaaacacuaguaacca

SEQ ID NO: 8967 - RNA, 18 nt, Homo sapiens
gguuaaccacugcuuugg

SEQ ID NO: 8968 - RNA, 19 nt, Homo sapiens
guaauuccaaauuauuuuu

SEQ ID NO: 8969 - RNA, 17 nt, Homo sapiens
ccaucucuuaggucuaa

SEQ ID NO: 8970 - RNA, 17 nt, Homo sapiens
cccuccaauccuuucca

SEQ ID NO: 8971 - RNA, 17 nt, Homo sapiens
cuuggccuugugucaga

SEQ ID NO: 8972 - RNA, 19 nt, Homo sapiens
uuccagaagaugcccucca

SEQ ID NO: 8973 - RNA, 22 nt, Homo sapiens
aggagagagaaaaauaauggca

SEQ ID NO: 8974 - RNA, 17 nt, Homo sapiens
ccuucucccauaccuug

SEQ ID NO: 8975 - RNA, 20 nt, Homo sapiens
gaggcagacaucugaacagg

SEQ ID NO: 8976 - RNA, 24 nt, Homo sapiens
uuucaauaccuacccccaaaucuu

SEQ ID NO: 8977 - RNA, 20 nt, Homo sapiens
acagagauuaaugaccccuu

SEQ ID NO: 8978 - RNA, 15 nt, Homo sapiens
caccagaggcuccua

SEQ ID NO: 8979 - RNA, 21 nt, Homo sapiens
cgaggcugcagugggcuguga

SEQ ID NO: 8980 - RNA, 18 nt, Homo sapiens
cuucccaaagcucauuua

SEQ ID NO: 8981 - RNA, 19 nt, Homo sapiens
gaggaggacggcagagaca

SEQ ID NO: 8982 - RNA, 21 nt, Homo sapiens
ugaagaaacugagguucagag

SEQ ID NO: 8983 - RNA, 25 nt, Homo sapiens
aguaagagaaccaaaggugugugug

SEQ ID NO: 8984 - RNA, 20 nt, Homo sapiens
ccucugccuccuggguucaa

SEQ ID NO: 8985 - RNA, 19 nt, Homo sapiens
gccuaccacaaggcuccug

SEQ ID NO: 8986 - RNA, 25 nt, Homo sapiens
cacccggggaagccaucacagcuca

SEQ ID NO: 8987 - RNA, 21 nt, Homo sapiens
ccgcagcgccgccgacaacgc

SEQ ID NO: 8988 - RNA, 17 nt, Homo sapiens
gacuaacuucuaaaagc

SEQ ID NO: 8989 - RNA, 21 nt, Homo sapiens
gccuuacugccgccuaccccg

SEQ ID NO: 8990 - RNA, 18 nt, Homo sapiens
ggugcagcuccgcccggc

SEQ ID NO: 8991 - RNA, 18 nt, Homo sapiens
ucuucggcuccucugcac

SEQ ID NO: 8992 - RNA, 21 nt, Homo sapiens
acacacugaccaccagucaca

SEQ ID NO: 8993 - RNA, 17 nt, Homo sapiens
acaggacagguuucaca

SEQ ID NO: 8994 - RNA, 22 nt, Homo sapiens
ccauuucacuucuuggauauca

SEQ ID NO: 8995 - RNA, 19 nt, Homo sapiens
cugugguggucucuggucc

SEQ ID NO: 8996 - RNA, 20 nt, Homo sapiens
cuuccaccaugguucugggc

SEQ ID NO: 8997 - RNA, 18 nt, Homo sapiens
gagaaaaccauguacuaa

SEQ ID NO: 8998 - RNA, 17 nt, Homo sapiens
guguguaguuacuugac

SEQ ID NO: 8999 - RNA, 20 nt, Homo sapiens
ugacuguuuuguacauguga

SEQ ID NO: 9000 - RNA, 22 nt, Homo sapiens
uuuuuccaauuaccugcugaca

SEQ ID NO: 9001 - RNA, 20 nt, Homo sapiens
uuccagaaauaccugucuag

SEQ ID NO: 9002 - RNA, 20 nt, Homo sapiens
acuuccaagcucagucuaaa

SEQ ID NO: 9003 - RNA, 20 nt, Homo sapiens
agcccucauuaaagaugcca

SEQ ID NO: 9004 - RNA, 20 nt, Homo sapiens
caacacccaguccuauucca

SEQ ID NO: 9005 - RNA, 21 nt, Homo sapiens
gcagaccgcagaauuuucaca

SEQ ID NO: 9006 - RNA, 24 nt, Homo sapiens
uggggucauagcagguucugguca

SEQ ID NO: 9007 - RNA, 18 nt, Homo sapiens
uggggucucagggcucag

SEQ ID NO: 9008 - RNA, 21 nt, Homo sapiens
uguaauuguggguaugugugc

SEQ ID NO: 9009 - RNA, 23 nt, Homo sapiens
caaagagacaaagggacuuuuuc

SEQ ID NO: 9010 - RNA, 19 nt, Homo sapiens
cgauauugcuaacugauca

SEQ ID NO: 9011 - RNA, 18 nt, Homo sapiens
ucacaaacacucggcaug

SEQ ID NO: 9012 - RNA, 21 nt, Homo sapiens
uguaaauauuuuuuuaaccua

SEQ ID NO: 9013 - RNA, 21 nt, Homo sapiens
uuguuugacuccuuaccaaua

SEQ ID NO: 9014 - RNA, 17 nt, Homo sapiens
uuugaguguuuauagau

SEQ ID NO: 9015 - RNA, 20 nt, Homo sapiens
acuugagcugugacggguuc

SEQ ID NO: 9016 - RNA, 23 nt, Homo sapiens
agaguguuacccucuuuuccuca

SEQ ID NO: 9017 - RNA, 18 nt, Homo sapiens
ccauuucucuucugcugg

SEQ ID NO: 9018 - RNA, 20 nt, Homo sapiens
uugccugauuuucucuggca

SEQ ID NO: 9019 - RNA, 20 nt, Homo sapiens
gucugcucggccaggacagc

SEQ ID NO: 9020 - RNA, 18 nt, Homo sapiens
accgcggacgugcuggcc

SEQ ID NO: 9021 - RNA, 19 nt, Homo sapiens
cugcucccacacuugugcc

SEQ ID NO: 9022 - RNA, 22 nt, Homo sapiens
gccaucucagguuggcggcaga

SEQ ID NO: 9023 - RNA, 21 nt, Homo sapiens
ggaggggacuggucccgguca

SEQ ID NO: 9024 - RNA, 22 nt, Homo sapiens
ggguccuuccaacaccgcuaca

SEQ ID NO: 9025 - RNA, 19 nt, Homo sapiens
ccuggucgugcgcccuaug

SEQ ID NO: 9026 - RNA, 17 nt, Homo sapiens
gcaaggccuuaccagcc

SEQ ID NO: 9027 - RNA, 23 nt, Homo sapiens
gcuguaauguggguuuuguuuua

SEQ ID NO: 9028 - RNA, 17 nt, Homo sapiens
uacagacaacuucaucu

SEQ ID NO: 9029 - RNA, 24 nt, Homo sapiens
uucucuaagugccaaaaacagugu

SEQ ID NO: 9030 - RNA, 21 nt, Homo sapiens
ggggauggucagcggcugcug

SEQ ID NO: 9031 - RNA, 24 nt, Homo sapiens
ucagcggcugcugccgucuggcuc

SEQ ID NO: 9032 - RNA, 23 nt, Homo sapiens
ugaaugaguucuguaugaaacug

SEQ ID NO: 9033 - RNA, 22 nt, Homo sapiens
uaguuguauuauuguuguuuca

SEQ ID NO: 9034 - RNA, 22 nt, Homo sapiens
uaugucuacuguaaacauugcu

SEQ ID NO: 9035 - RNA, 19 nt, Homo sapiens
ugugaccaaaugggccuca

SEQ ID NO: 9036 - RNA, 22 nt, Homo sapiens
aaacaauauauacagacuauac

SEQ ID NO: 9037 - RNA, 18 nt, Homo sapiens
auuccagaaccaaaucuu

SEQ ID NO: 9038 - RNA, 21 nt, Homo sapiens
uggaauaauaaugugggauua

SEQ ID NO: 9039 - RNA, 21 nt, Homo sapiens
uuaagaguacuauuuuuucca

SEQ ID NO: 9040 - RNA, 18 nt, Homo sapiens
ccucagguuugccucuaa

SEQ ID NO: 9041 - RNA, 21 nt, Homo sapiens
gccuaaucucucucuuuuuca

SEQ ID NO: 9042 - RNA, 16 nt, Homo sapiens
uccagaaagaccccag

SEQ ID NO: 9043 - RNA, 24 nt, Homo sapiens
auuugggcccugugcugccugccu

SEQ ID NO: 9044 - RNA, 15 nt, Homo sapiens
ccuaucucuucccac

SEQ ID NO: 9045 - RNA, 24 nt, Homo sapiens
ccucauaguaucugccuuggucuu

SEQ ID NO: 9046 - RNA, 23 nt, Homo sapiens
ccugcuuccccacccccuccuca

SEQ ID NO: 9047 - RNA, 23 nt, Homo sapiens
ccuguacccuccccuggucuaca

SEQ ID NO: 9048 - RNA, 20 nt, Homo sapiens
ccuuaauggagaaacgggcc

SEQ ID NO: 9049 - RNA, 18 nt, Homo sapiens
ucuagauaguguuagaga

SEQ ID NO: 9050 - RNA, 23 nt, Homo sapiens
auguggaggccaggguaagguga

SEQ ID NO: 9051 - RNA, 23 nt, Homo sapiens
gccacuuuuuuuguacaggggua

SEQ ID NO: 9052 - RNA, 22 nt, Homo sapiens
uagccuuucuaaaccaaaguuc

SEQ ID NO: 9053 - RNA, 22 nt, Homo sapiens
gugcccaccugugcgcgccgcc

SEQ ID NO: 9054 - RNA, 24 nt, Homo sapiens
cugucgggcaagauagcuccuuca

SEQ ID NO: 9055 - RNA, 17 nt, Homo sapiens
uguuguccugugucauc

SEQ ID NO: 9056 - RNA, 17 nt, Homo sapiens
gcagaccauaucccuau

SEQ ID NO: 9057 - RNA, 20 nt, Homo sapiens
uguuuuccagcaugguauua

SEQ ID NO: 9058 - RNA, 20 nt, Homo sapiens
acagggucugcccgcugcac

SEQ ID NO: 9059 - RNA, 21 nt, Homo sapiens
caacccucccugcuaaccccu

SEQ ID NO: 9060 - RNA, 20 nt, Homo sapiens
cguccccaacaugcaucuca

SEQ ID NO: 9061 - RNA, 18 nt, Homo sapiens
cuuccccgccccugccca

SEQ ID NO: 9062 - RNA, 18 nt, Homo sapiens
gacuggaagcagaaaaug

SEQ ID NO: 9063 - RNA, 22 nt, Homo sapiens
gccaccuccucccagcccccca

SEQ ID NO: 9064 - RNA, 22 nt, Homo sapiens
gcccccuugccuuucaaacugg

SEQ ID NO: 9065 - RNA, 24 nt, Homo sapiens
gccugggcugccgacaccugggcc

SEQ ID NO: 9066 - RNA, 19 nt, Homo sapiens
ggcaagcccccuugccuuu

SEQ ID NO: 9067 - RNA, 24 nt, Homo sapiens
ucucacucugggugucuuggucuu

SEQ ID NO: 9068 - RNA, 21 nt, Homo sapiens
gcccccgcugcccucugcccu

SEQ ID NO: 9069 - RNA, 20 nt, Homo sapiens
aguaagaggacuacucagca

SEQ ID NO: 9070 - RNA, 23 nt, Homo sapiens
ugggugggcucugaugcagaacu

SEQ ID NO: 9071 - RNA, 23 nt, Homo sapiens
acccagcgcaccccucccccccu

SEQ ID NO: 9072 - RNA, 18 nt, Homo sapiens
accgggagggcccggcga

SEQ ID NO: 9073 - RNA, 19 nt, Homo sapiens
agaacccagcgcaccccuc

SEQ ID NO: 9074 - RNA, 22 nt, Homo sapiens
ccucuuuuccccuugcccccuc

SEQ ID NO: 9075 - RNA, 17 nt, Homo sapiens
ggggaggaggccagcca

SEQ ID NO: 9076 - RNA, 17 nt, Homo sapiens
uaggaaaugacccgaga

SEQ ID NO: 9077 - RNA, 22 nt, Homo sapiens
ugaugaagacagaaggcuccgg

SEQ ID NO: 9078 - RNA, 20 nt, Homo sapiens
uuugcuugaagagacccccu

SEQ ID NO: 9079 - RNA, 20 nt, Homo sapiens
caccuguguccucccugggc

SEQ ID NO: 9080 - RNA, 22 nt, Homo sapiens
ccagccccgccacaaccucucc

SEQ ID NO: 9081 - RNA, 21 nt, Homo sapiens
gcagugucuuguuuuguuuua

SEQ ID NO: 9082 - RNA, 18 nt, Homo sapiens
ccgccucgcccccacccc

SEQ ID NO: 9083 - RNA, 21 nt, Homo sapiens
ucgcccccacccccacccacc

SEQ ID NO: 9084 - RNA, 20 nt, Homo sapiens
guaugagggaacuguguaga

SEQ ID NO: 9085 - RNA, 16 nt, Homo sapiens
uuuaagcugccuguac

SEQ ID NO: 9086 - RNA, 23 nt, Homo sapiens
uuuuuuguauaguuaaccacuac

SEQ ID NO: 9087 - RNA, 21 nt, Homo sapiens
cccgccgccgcggccccccgg

SEQ ID NO: 9088 - RNA, 19 nt, Homo sapiens
cauucuuagcuguaacuua

SEQ ID NO: 9089 - RNA, 19 nt, Homo sapiens
uuccccagguggccuggag

SEQ ID NO: 9090 - RNA, 19 nt, Homo sapiens
ugccuugguuuuuacugcu

SEQ ID NO: 9091 - RNA, 19 nt, Homo sapiens
gccccugacgggcacccca

SEQ ID NO: 9092 - RNA, 15 nt, Homo sapiens
gaaaaagggcguccc

SEQ ID NO: 9093 - RNA, 21 nt, Homo sapiens
uccaagcacaaggaacuccug

SEQ ID NO: 9094 - RNA, 19 nt, Homo sapiens
ugaaccuuuuugcccccac

SEQ ID NO: 9095 - RNA, 28 nt, Homo sapiens
agcugaagcagggcagggcaucaacuca

SEQ ID NO: 9096 - RNA, 21 nt, Homo sapiens
cacuuauuuauuguugccuuu

SEQ ID NO: 9097 - RNA, 21 nt, Homo sapiens
cagaaaugggcaguucuccca

SEQ ID NO: 9098 - RNA, 21 nt, Homo sapiens
gccuccacccguccucccuca

SEQ ID NO: 9099 - RNA, 21 nt, Homo sapiens
gcggccagcagccccugcccc

SEQ ID NO: 9100 - RNA, 20 nt, Homo sapiens
ggcuggggcauggcaaauca

SEQ ID NO: 9101 - RNA, 26 nt, Homo sapiens
gggaagccgauggcggcggcugcggc

SEQ ID NO: 9102 - RNA, 23 nt, Homo sapiens
ggguucgcagcggcggccgcggc

SEQ ID NO: 9103 - RNA, 21 nt, Homo sapiens
gguggcucugggguaugugug

SEQ ID NO: 9104 - RNA, 23 nt, Homo sapiens
gugugugugggugugugcgccug

SEQ ID NO: 9105 - RNA, 18 nt, Homo sapiens
uccucuccuucccacaaa

SEQ ID NO: 9106 - RNA, 22 nt, Homo sapiens
ucuuguuucacuccaccaucac

SEQ ID NO: 9107 - RNA, 21 nt, Homo sapiens
aaguuuuaauagaaccuguaa

SEQ ID NO: 9108 - RNA, 22 nt, Homo sapiens
agcuguagaucuugaucuucca

SEQ ID NO: 9109 - RNA, 19 nt, Homo sapiens
cacugacccuccgcccuuc

SEQ ID NO: 9110 - RNA, 18 nt, Homo sapiens
ugaggcuuuuuuguuuua

SEQ ID NO: 9111 - RNA, 23 nt, Homo sapiens
uaacagugaucacauucauucca

SEQ ID NO: 9112 - RNA, 20 nt, Homo sapiens
agagauauuucccaguuacu

SEQ ID NO: 9113 - RNA, 19 nt, Homo sapiens
guggcucuuuaauuccuga

SEQ ID NO: 9114 - RNA, 20 nt, Homo sapiens
guucaaauuagugccucgga

SEQ ID NO: 9115 - RNA, 19 nt, Homo sapiens
ucagcccuccucauuccua

SEQ ID NO: 9116 - RNA, 19 nt, Homo sapiens
uuccguacggcuuccggug

SEQ ID NO: 9117 - RNA, 20 nt, Homo sapiens
agcugucccccaggauccca

SEQ ID NO: 9118 - RNA, 22 nt, Homo sapiens
caguaccaaucagucaguguca

SEQ ID NO: 9119 - RNA, 19 nt, Homo sapiens
ggcuuccucucuuugugau

SEQ ID NO: 9120 - RNA, 20 nt, Homo sapiens
guacaaaugcucuuugccuc

SEQ ID NO: 9121 - RNA, 21 nt, Homo sapiens
uuuccucccucucugaugcca

SEQ ID NO: 9122 - RNA, 17 nt, Homo sapiens
cuggcauugcacuuuuu

SEQ ID NO: 9123 - RNA, 23 nt, Homo sapiens
cuuugugguuccagauuuuuuuu

SEQ ID NO: 9124 - RNA, 22 nt, Homo sapiens
uuugagcaaucugggcacuuuu

SEQ ID NO: 9125 - RNA, 18 nt, Homo sapiens
acugacaccuuugcaggc

SEQ ID NO: 9126 - RNA, 17 nt, Homo sapiens
caacuuuucccuccucc

SEQ ID NO: 9127 - RNA, 21 nt, Homo sapiens
ccuugcuuggcugcuuggccu

SEQ ID NO: 9128 - RNA, 22 nt, Homo sapiens
ccuugcuuggcugcuuggccuu

SEQ ID NO: 9129 - RNA, 17 nt, Homo sapiens
gcaugugcuugugugug

SEQ ID NO: 9130 - RNA, 23 nt, Homo sapiens
uguguaaacaguguuuuggaaua

SEQ ID NO: 9131 - RNA, 23 nt, Homo sapiens
gccugggccagaugagccugccc

SEQ ID NO: 9132 - RNA, 18 nt, Homo sapiens
cagcagcagcagcagcac

SEQ ID NO: 9133 - RNA, 19 nt, Homo sapiens
cagucccuuaugagcguca

SEQ ID NO: 9134 - RNA, 19 nt, Homo sapiens
cuucucuuucccccacccu

SEQ ID NO: 9135 - RNA, 20 nt, Homo sapiens
gcuucgucuuguguuugcug

SEQ ID NO: 9136 - RNA, 20 nt, Homo sapiens
gggaggagggguaggacugc

SEQ ID NO: 9137 - RNA, 20 nt, Homo sapiens
ccgcccgcugcccuacccgc

SEQ ID NO: 9138 - RNA, 20 nt, Homo sapiens
cuuuuuuauaucucuuuggc

SEQ ID NO: 9139 - RNA, 20 nt, Homo sapiens
cucuccgcacccucugucuc

SEQ ID NO: 9140 - RNA, 18 nt, Homo sapiens
guguguauuacuugucua

SEQ ID NO: 9141 - RNA, 21 nt, Homo sapiens
ucucuccccgucucccuccca

SEQ ID NO: 9142 - RNA, 18 nt, Homo sapiens
ugaaacuuguuuaccuua

SEQ ID NO: 9143 - RNA, 20 nt, Homo sapiens
uguccccaggcaucauccca

SEQ ID NO: 9144 - RNA, 23 nt, Homo sapiens
ugucucgccauccucaagacuca

SEQ ID NO: 9145 - RNA, 22 nt, Homo sapiens
augaaccucgagaaaguucuga

SEQ ID NO: 9146 - RNA, 20 nt, Homo sapiens
uggauuaacagauggaauug

SEQ ID NO: 9147 - RNA, 21 nt, Homo sapiens
accugguccacguggauuguc

SEQ ID NO: 9148 - RNA, 20 nt, Homo sapiens
agcuuucagaaggaguucuc

SEQ ID NO: 9149 - RNA, 17 nt, Homo sapiens
ucaaccuuucuaccuua

SEQ ID NO: 9150 - RNA, 21 nt, Homo sapiens
ucuuguuccagcuaggcaaug

SEQ ID NO: 9151 - RNA, 19 nt, Homo sapiens
ugguguuuuucacaaagua

SEQ ID NO: 9152 - RNA, 20 nt, Homo sapiens
aucccuuuaggauggaacua

SEQ ID NO: 9153 - RNA, 21 nt, Homo sapiens
accugcaguagcggugcuguc

SEQ ID NO: 9154 - RNA, 17 nt, Homo sapiens
cggccaaaugcgcucgu

SEQ ID NO: 9155 - RNA, 24 nt, Homo sapiens
caguugaauuuauggaaucuacca

SEQ ID NO: 9156 - RNA, 24 nt, Homo sapiens
ccagaguuuuuauguagcagggaa

SEQ ID NO: 9157 - RNA, 19 nt, Homo sapiens
ggugcaaaagcagaaaaua

SEQ ID NO: 9158 - RNA, 24 nt, Homo sapiens
auaagcauuuaaaaacauaugaaa

SEQ ID NO: 9159 - RNA, 15 nt, Homo sapiens
cagugaaauauugua

SEQ ID NO: 9160 - RNA, 17 nt, Homo sapiens
guguuuuuauuucugaa

SEQ ID NO: 9161 - RNA, 23 nt, Homo sapiens
ugcaccauuuuuguauuaacgua

SEQ ID NO: 9162 - RNA, 21 nt, Homo sapiens
cccuccccuccccucccuucc

SEQ ID NO: 9163 - RNA, 22 nt, Homo sapiens
aaaaucaggacugaaauacauu

SEQ ID NO: 9164 - RNA, 22 nt, Homo sapiens
gcaguuuuaccggauuuuguua

SEQ ID NO: 9165 - RNA, 20 nt, Homo sapiens
uuccauccguaaaauaugua

SEQ ID NO: 9166 - RNA, 16 nt, Homo sapiens
aaaaacuggcaacauu

SEQ ID NO: 9167 - RNA, 21 nt, Homo sapiens
aaacacugaaccagaccgauc

SEQ ID NO: 9168 - RNA, 18 nt, Homo sapiens
cccuagcccucucccucu

SEQ ID NO: 9169 - RNA, 19 nt, Homo sapiens
gaaugggaucaugaaagua

SEQ ID NO: 9170 - RNA, 19 nt, Homo sapiens
gaucagaaaaauggagcaa

SEQ ID NO: 9171 - RNA, 25 nt, Homo sapiens
uccaacguuuggaagauccugugag

SEQ ID NO: 9172 - RNA, 19 nt, Homo sapiens
uggauggguuuuaugagau

SEQ ID NO: 9173 - RNA, 19 nt, Homo sapiens
uuaggguugguuccuuucc

SEQ ID NO: 9174 - RNA, 22 nt, Homo sapiens
uucccucagucccaaauccuuc

SEQ ID NO: 9175 - RNA, 18 nt, Homo sapiens
uugcugauggucuggucu

SEQ ID NO: 9176 - RNA, 21 nt, Homo sapiens
uuugcuguaagaugucuguuu

SEQ ID NO: 9177 - RNA, 21 nt, Homo sapiens
aucuuggcuuacugcaaccuc

SEQ ID NO: 9178 - RNA, 21 nt, Homo sapiens
ccauggugucaauacauauca

SEQ ID NO: 9179 - RNA, 18 nt, Homo sapiens
cccuccaaucucucucca

SEQ ID NO: 9180 - RNA, 23 nt, Homo sapiens
cuuaauuuuguuauaaaaucuca

SEQ ID NO: 9181 - RNA, 23 nt, Homo sapiens
gacccacgggguaacgggucuaa

SEQ ID NO: 9182 - RNA, 18 nt, Homo sapiens
uaucauguagcuucugaa

SEQ ID NO: 9183 - RNA, 18 nt, Homo sapiens
uccgccuccuggguucaa

SEQ ID NO: 9184 - RNA, 18 nt, Homo sapiens
ugccaccacacccaguga

SEQ ID NO: 9185 - RNA, 17 nt, Homo sapiens
uuuuggguauguggguu

SEQ ID NO: 9186 - RNA, 21 nt, Homo sapiens
uaaauguucugaguggagcua

SEQ ID NO: 9187 - RNA, 21 nt, Homo sapiens
ucuuggcugugugucugcgga

SEQ ID NO: 9188 - RNA, 17 nt, Homo sapiens
aacuauggccuguggau

SEQ ID NO: 9189 - RNA, 19 nt, Homo sapiens
ucuuuaauuuuacauuucc

SEQ ID NO: 9190 - RNA, 18 nt, Homo sapiens
aaaaagggcuguccaugu

SEQ ID NO: 9191 - RNA, 20 nt, Homo sapiens
aaacaacaugugagcauggu

SEQ ID NO: 9192 - RNA, 20 nt, Homo sapiens
ccccacaggccccccgcagc

SEQ ID NO: 9193 - RNA, 21 nt, Homo sapiens
gacagaggaccauuacaacua

SEQ ID NO: 9194 - RNA, 19 nt, Homo sapiens
uccccauucagacacuuca

SEQ ID NO: 9195 - RNA, 19 nt, Homo sapiens
ugacagugcucuaggcugc

SEQ ID NO: 9196 - RNA, 18 nt, Homo sapiens
ccaaacacacaagcucuc

SEQ ID NO: 9197 - RNA, 20 nt, Homo sapiens
cuggaguguguccuuggccu

SEQ ID NO: 9198 - RNA, 18 nt, Homo sapiens
gacuacaaugucuuuauu

SEQ ID NO: 9199 - RNA, 19 nt, Homo sapiens
uuucuugcgcuuugauuuu

SEQ ID NO: 9200 - RNA, 22 nt, Homo sapiens
aucugugaccauagccuagcua

SEQ ID NO: 9201 - RNA, 20 nt, Homo sapiens
auuucaguguuaaucagcua

SEQ ID NO: 9202 - RNA, 20 nt, Homo sapiens
caccacucugaggcuaauua

SEQ ID NO: 9203 - RNA, 19 nt, Homo sapiens
uuacaucggacucuaucug

SEQ ID NO: 9204 - RNA, 19 nt, Homo sapiens
gagacccaaccagacccca

SEQ ID NO: 9205 - RNA, 23 nt, Homo sapiens
aagcauguaacuagguauugcuu

SEQ ID NO: 9206 - RNA, 19 nt, Homo sapiens
cuguguguuaauccucuag

SEQ ID NO: 9207 - RNA, 21 nt, Homo sapiens
uugauacucucauuuaaacug

SEQ ID NO: 9208 - RNA, 21 nt, Homo sapiens
aucuugguucacugcaaccuc

SEQ ID NO: 9209 - RNA, 20 nt, Homo sapiens
caucugcgugugugcaggga

SEQ ID NO: 9210 - RNA, 21 nt, Homo sapiens
ccccuugcggcucccucgggc

SEQ ID NO: 9211 - RNA, 22 nt, Homo sapiens
ccuccccacgaccccccuuccc

SEQ ID NO: 9212 - RNA, 19 nt, Homo sapiens
cuugcauggcuuguguggu

SEQ ID NO: 9213 - RNA, 24 nt, Homo sapiens
gcgacauaaaauccagcugugaug

SEQ ID NO: 9214 - RNA, 23 nt, Homo sapiens
uccggggcgcugacccaccauca

SEQ ID NO: 9215 - RNA, 19 nt, Homo sapiens
aagcacaaggaaggauggg

SEQ ID NO: 9216 - RNA, 19 nt, Homo sapiens
gacugcucuuaguauuaca

SEQ ID NO: 9217 - RNA, 23 nt, Homo sapiens
gccugagcuguggcggaggaucc

SEQ ID NO: 9218 - RNA, 20 nt, Homo sapiens
gcgccacgaaagaaacugua

SEQ ID NO: 9219 - RNA, 17 nt, Homo sapiens
gucuagagucugugcac

SEQ ID NO: 9220 - RNA, 19 nt, Homo sapiens
guuagcugaugccaguuga

SEQ ID NO: 9221 - RNA, 17 nt, Homo sapiens
caucacccgccccugga

SEQ ID NO: 9222 - RNA, 18 nt, Homo sapiens
uaauggggucuguaaaua

SEQ ID NO: 9223 - RNA, 22 nt, Homo sapiens
ugcaguacagugugugugggug

SEQ ID NO: 9224 - RNA, 21 nt, Homo sapiens
ccagcccccaccucugccucc

SEQ ID NO: 9225 - RNA, 18 nt, Homo sapiens
gucucaucuuccacccca

SEQ ID NO: 9226 - RNA, 17 nt, Homo sapiens
ucaucuuccaccccaaa

SEQ ID NO: 9227 - RNA, 21 nt, Homo sapiens
ugaaauuacuacaaaauuuga

SEQ ID NO: 9228 - RNA, 21 nt, Homo sapiens
aaagagacggacuccuguuca

SEQ ID NO: 9229 - RNA, 20 nt, Homo sapiens
aagagacggacuccuguuca

SEQ ID NO: 9230 - RNA, 19 nt, Homo sapiens
caggauaaacccaauacau

SEQ ID NO: 9231 - RNA, 22 nt, Homo sapiens
ggagaaaaagaugggauugcca

SEQ ID NO: 9232 - RNA, 22 nt, Homo sapiens
aucuggggaggccgccugguuu

SEQ ID NO: 9233 - RNA, 21 nt, Homo sapiens
caacccucuccugucugcccu

SEQ ID NO: 9234 - RNA, 24 nt, Homo sapiens
gaaaggguggaaaucaacccucuc

SEQ ID NO: 9235 - RNA, 23 nt, Homo sapiens
accugucaacuggagugcucucu

SEQ ID NO: 9236 - RNA, 19 nt, Homo sapiens
acugguagugagaauauca

SEQ ID NO: 9237 - RNA, 23 nt, Homo sapiens
caccguagggcaugcugauacca

SEQ ID NO: 9238 - RNA, 20 nt, Homo sapiens
cuaaguacaguggcacuguu

SEQ ID NO: 9239 - RNA, 23 nt, Homo sapiens
cucuuuuuauaucaaaagucuca

SEQ ID NO: 9240 - RNA, 18 nt, Homo sapiens
cuguggcuuguuuuguuu

SEQ ID NO: 9241 - RNA, 17 nt, Homo sapiens
cuuaucugguguuaaga

SEQ ID NO: 9242 - RNA, 21 nt, Homo sapiens
cuuuuucauuacacuugacuu

SEQ ID NO: 9243 - RNA, 20 nt, Homo sapiens
ggcaugcugauaccauccca

SEQ ID NO: 9244 - RNA, 23 nt, Homo sapiens
ucacacaugcagugguucucuga

SEQ ID NO: 9245 - RNA, 18 nt, Homo sapiens
uccaagaagcuuuccuca

SEQ ID NO: 9246 - RNA, 21 nt, Homo sapiens
aaaauaagcucagugauaccu

SEQ ID NO: 9247 - RNA, 20 nt, Homo sapiens
acccggcccaacccagccca

SEQ ID NO: 9248 - RNA, 20 nt, Homo sapiens
cccagacucaaggaguuggu

SEQ ID NO: 9249 - RNA, 18 nt, Homo sapiens
cccugaguuuuacccaga

SEQ ID NO: 9250 - RNA, 20 nt, Homo sapiens
cugucuaauuugcaccuuug

SEQ ID NO: 9251 - RNA, 25 nt, Homo sapiens
uagugucaccaauuccaccaagaca

SEQ ID NO: 9252 - RNA, 23 nt, Homo sapiens
uguuucuucccauacugcauaca

SEQ ID NO: 9253 - RNA, 18 nt, Homo sapiens
uuuccacucaaaauaugu

SEQ ID NO: 9254 - RNA, 17 nt, Homo sapiens
agaaaaugcaguuuuca

SEQ ID NO: 9255 - RNA, 16 nt, Homo sapiens
ccuaccaucucaguga

SEQ ID NO: 9256 - RNA, 16 nt, Homo sapiens
gugcagauguagcagg

SEQ ID NO: 9257 - RNA, 18 nt, Homo sapiens
uuauaaauuauuuucuca

SEQ ID NO: 9258 - RNA, 19 nt, Homo sapiens
ggggguggguggccugugg

SEQ ID NO: 9259 - RNA, 24 nt, Homo sapiens
uggagggcauccuggauggaauug

SEQ ID NO: 9260 - RNA, 21 nt, Homo sapiens
cuguggacugagacccaccuu

SEQ ID NO: 9261 - RNA, 24 nt, Homo sapiens
ggaagaggaggcugguugguacca

SEQ ID NO: 9262 - RNA, 24 nt, Homo sapiens
ccagaaggggauccucccgcuccg

SEQ ID NO: 9263 - RNA, 22 nt, Homo sapiens
ccauauuaccacagacauacua

SEQ ID NO: 9264 - RNA, 18 nt, Homo sapiens
cuuggcggccgccgguuc

SEQ ID NO: 9265 - RNA, 19 nt, Homo sapiens
ggaggaggagguaccgcca

SEQ ID NO: 9266 - RNA, 24 nt, Homo sapiens
ucccaggucguggccgucuugcuc

SEQ ID NO: 9267 - RNA, 20 nt, Homo sapiens
uuccaaaguacacuguuuca

SEQ ID NO: 9268 - RNA, 17 nt, Homo sapiens
uuugaccucugcagcaa

SEQ ID NO: 9269 - RNA, 16 nt, Homo sapiens
ccuacuggacgcugcc

SEQ ID NO: 9270 - RNA, 17 nt, Homo sapiens
gggccgcccgcucccuu

SEQ ID NO: 9271 - RNA, 21 nt, Homo sapiens
ucacgcccucuuguuuccuuu

SEQ ID NO: 9272 - RNA, 24 nt, Homo sapiens
ccaggcggccgaccuccccauucc

SEQ ID NO: 9273 - RNA, 21 nt, Homo sapiens
cuucucugcuuccuccacguc

SEQ ID NO: 9274 - RNA, 22 nt, Homo sapiens
uaggguucaguaggucucaguc

SEQ ID NO: 9275 - RNA, 18 nt, Homo sapiens
acagacugccaaauggaa

SEQ ID NO: 9276 - RNA, 22 nt, Homo sapiens
caaccagggacccucugccccu

SEQ ID NO: 9277 - RNA, 19 nt, Homo sapiens
auugacacaaagcauucca

SEQ ID NO: 9278 - RNA, 17 nt, Homo sapiens
gagcuuuacuaaaagaa

SEQ ID NO: 9279 - RNA, 20 nt, Homo sapiens
uccgaaaacugguuucuagu

SEQ ID NO: 9280 - RNA, 17 nt, Homo sapiens
uguccaucucuccaucu

SEQ ID NO: 9281 - RNA, 18 nt, Homo sapiens
uugauggacaaaaugaga

SEQ ID NO: 9282 - RNA, 19 nt, Homo sapiens
acuacuuacugauagacca

SEQ ID NO: 9283 - RNA, 21 nt, Homo sapiens
auagaccaaaaaacuacacca

SEQ ID NO: 9284 - RNA, 18 nt, Homo sapiens
ccauggcacauguauacc

SEQ ID NO: 9285 - RNA, 23 nt, Homo sapiens
ggacauuuaggguccccccugug

SEQ ID NO: 9286 - RNA, 23 nt, Homo sapiens
acauuaaaaauguagcugacuua

SEQ ID NO: 9287 - RNA, 18 nt, Homo sapiens
aauuauccaacuacauau

SEQ ID NO: 9288 - RNA, 26 nt, Homo sapiens
augguucuacucccaggaugaaauua

SEQ ID NO: 9289 - RNA, 20 nt, Homo sapiens
ccguggaugugcaaguugug

SEQ ID NO: 9290 - RNA, 22 nt, Homo sapiens
ccugggagccuuccccagugua

SEQ ID NO: 9291 - RNA, 22 nt, Homo sapiens
cgggcuccggcugggcccggcg

SEQ ID NO: 9292 - RNA, 20 nt, Homo sapiens
auuagugauuucagcaaauc

SEQ ID NO: 9293 - RNA, 17 nt, Homo sapiens
gaaacuccagauaucaa

SEQ ID NO: 9294 - RNA, 19 nt, Homo sapiens
ugccuuuuaauauaccaca

SEQ ID NO: 9295 - RNA, 19 nt, Homo sapiens
uucagcaaaucucaugaua

SEQ ID NO: 9296 - RNA, 16 nt, Homo sapiens
gaguccauuucccaca

SEQ ID NO: 9297 - RNA, 21 nt, Homo sapiens
cucucgcacaccggggcccug

SEQ ID NO: 9298 - RNA, 24 nt, Homo sapiens
gguguggugagaaggcagguugug

SEQ ID NO: 9299 - RNA, 19 nt, Homo sapiens
acagaagagucuuguucca

SEQ ID NO: 9300 - RNA, 19 nt, Homo sapiens
agcguuugcuuucgccugu

SEQ ID NO: 9301 - RNA, 18 nt, Homo sapiens
ucgaugugauguucuuuu

SEQ ID NO: 9302 - RNA, 17 nt, Homo sapiens
cuggguccugcuggucu

SEQ ID NO: 9303 - RNA, 19 nt, Homo sapiens
ccgcggcggccgccggcuc

SEQ ID NO: 9304 - RNA, 22 nt, Homo sapiens
aucauggagcgaauaauuuuca

SEQ ID NO: 9305 - RNA, 21 nt, Homo sapiens
cccaaacggauccuuccccag

SEQ ID NO: 9306 - RNA, 21 nt, Homo sapiens
ccucugcguucugccuugguu

SEQ ID NO: 9307 - RNA, 19 nt, Homo sapiens
cuuuuccuccacagcugug

SEQ ID NO: 9308 - RNA, 27 nt, Homo sapiens
ucucgacauuugguuuguuuuaauuuu

SEQ ID NO: 9309 - RNA, 25 nt, Homo sapiens
uuccaaaauaagcuguuaauggugu

SEQ ID NO: 9310 - RNA, 18 nt, Homo sapiens
agggcagcaggccugguu

SEQ ID NO: 9311 - RNA, 21 nt, Homo sapiens
cauccacaugcccuccuccuu

SEQ ID NO: 9312 - RNA, 18 nt, Homo sapiens
gagguuguuaccauuaug

SEQ ID NO: 9313 - RNA, 22 nt, Homo sapiens
acaggaagaugucuuuucuuca

SEQ ID NO: 9314 - RNA, 19 nt, Homo sapiens
cuuccucugccuuuguuca

SEQ ID NO: 9315 - RNA, 26 nt, Homo sapiens
cuugggcauagguuccaaguauuuuu

SEQ ID NO: 9316 - RNA, 18 nt, Homo sapiens
ucagucagcgagugcuug

SEQ ID NO: 9317 - RNA, 18 nt, Homo sapiens
ugaacuaguugccaguga

SEQ ID NO: 9318 - RNA, 16 nt, Homo sapiens
uucuucuguuaucuca

SEQ ID NO: 9319 - RNA, 21 nt, Homo sapiens
aggccucacucaagccugaga

SEQ ID NO: 9320 - RNA, 21 nt, Homo sapiens
cagggcugcuguggcccaguc

SEQ ID NO: 9321 - RNA, 18 nt, Homo sapiens
cauucccaagccauggca

SEQ ID NO: 9322 - RNA, 16 nt, Homo sapiens
ccaagccuggcccuua

SEQ ID NO: 9323 - RNA, 17 nt, Homo sapiens
ccuccccacuucccccc

SEQ ID NO: 9324 - RNA, 20 nt, Homo sapiens
gacagcccugccuauccucu

SEQ ID NO: 9325 - RNA, 19 nt, Homo sapiens
ggaaagcuguuccaacaca

SEQ ID NO: 9326 - RNA, 18 nt, Homo sapiens
ggaagcggcggcgguggc

SEQ ID NO: 9327 - RNA, 19 nt, Homo sapiens
acauuuucaauagaggaua

SEQ ID NO: 9328 - RNA, 17 nt, Homo sapiens
agaagaaucagcuugug

SEQ ID NO: 9329 - RNA, 21 nt, Homo sapiens
cagggauauuucugcuaugca

SEQ ID NO: 9330 - RNA, 21 nt, Homo sapiens
ccucacuccaccuuccuucca

SEQ ID NO: 9331 - RNA, 16 nt, Homo sapiens
cuauaucagccuaugc

SEQ ID NO: 9332 - RNA, 18 nt, Homo sapiens
cuccuuuacuauguugaa

SEQ ID NO: 9333 - RNA, 23 nt, Homo sapiens
cugagauacgcacucagcuccau

SEQ ID NO: 9334 - RNA, 21 nt, Homo sapiens
uaguuaauagaaauuucccuu

SEQ ID NO: 9335 - RNA, 17 nt, Homo sapiens
uauauucccaucccucu

SEQ ID NO: 9336 - RNA, 16 nt, Homo sapiens
cggggaggcuuuucca

SEQ ID NO: 9337 - RNA, 22 nt, Homo sapiens
uccaaguccaccagucucugaa

SEQ ID NO: 9338 - RNA, 22 nt, Homo sapiens
uuuuucugguagcuuuagcuuu

SEQ ID NO: 9339 - RNA, 17 nt, Homo sapiens
augcauuuaucacuucc

SEQ ID NO: 9340 - RNA, 23 nt, Homo sapiens
ccucuaugaaaucaaauguacug

SEQ ID NO: 9341 - RNA, 18 nt, Homo sapiens
guaaauaaaaauaaccuu

SEQ ID NO: 9342 - RNA, 23 nt, Homo sapiens
uacagcaauuguaguaacugaca

SEQ ID NO: 9343 - RNA, 19 nt, Homo sapiens
uucacuuguguuggauuua

SEQ ID NO: 9344 - RNA, 21 nt, Homo sapiens
aagagacuuugucacuuauuu

SEQ ID NO: 9345 - RNA, 21 nt, Homo sapiens
aauugagcacuguuuacuguu

SEQ ID NO: 9346 - RNA, 18 nt, Homo sapiens
ucuaacuugguuaugaga

SEQ ID NO: 9347 - RNA, 18 nt, Homo sapiens
cuucuccuuaguccuuca

SEQ ID NO: 9348 - RNA, 18 nt, Homo sapiens
gaaguagucuuuggcuua

SEQ ID NO: 9349 - RNA, 22 nt, Homo sapiens
ucuaaugaacuguuuuaaccuu

SEQ ID NO: 9350 - RNA, 18 nt, Homo sapiens
uuggccguugugagcucu

SEQ ID NO: 9351 - RNA, 20 nt, Homo sapiens
aacacaugcagagucacauc

SEQ ID NO: 9352 - RNA, 23 nt, Homo sapiens
uggcaguuugagaccgcuacccu

SEQ ID NO: 9353 - RNA, 21 nt, Homo sapiens
ccuagcugugccccccacuuu

SEQ ID NO: 9354 - RNA, 19 nt, Homo sapiens
aauucugucagcuauccaa

SEQ ID NO: 9355 - RNA, 17 nt, Homo sapiens
acugcuucaaucuacuu

SEQ ID NO: 9356 - RNA, 18 nt, Homo sapiens
ccacccacugcugcccca

SEQ ID NO: 9357 - RNA, 20 nt, Homo sapiens
ccagaccccgggcucgccuc

SEQ ID NO: 9358 - RNA, 19 nt, Homo sapiens
cccgaaauggggggccugc

SEQ ID NO: 9359 - RNA, 17 nt, Homo sapiens
cuugccacucccacuuu

SEQ ID NO: 9360 - RNA, 19 nt, Homo sapiens
gcuuggucuggucugugca

SEQ ID NO: 9361 - RNA, 18 nt, Homo sapiens
gugcagugcauucagaca

SEQ ID NO: 9362 - RNA, 16 nt, Homo sapiens
ucccucggcacacuuu

SEQ ID NO: 9363 - RNA, 21 nt, Homo sapiens
cacuaauaacauugcugucaa

SEQ ID NO: 9364 - RNA, 19 nt, Homo sapiens
aaggaacccggugugcaca

SEQ ID NO: 9365 - RNA, 20 nt, Homo sapiens
acaucuaacucaacugugaa

SEQ ID NO: 9366 - RNA, 21 nt, Homo sapiens
accacaggcccuuccccuucc

SEQ ID NO: 9367 - RNA, 23 nt, Homo sapiens
agaaguuuuaaacagggcuuuca

SEQ ID NO: 9368 - RNA, 20 nt, Homo sapiens
augacacuuccuugcuuugg

SEQ ID NO: 9369 - RNA, 19 nt, Homo sapiens
caccuuuugaagcagcaac

SEQ ID NO: 9370 - RNA, 21 nt, Homo sapiens
ccuuggugguugaacuuggag

SEQ ID NO: 9371 - RNA, 18 nt, Homo sapiens
ccuuuuugcaccgucacc

SEQ ID NO: 9372 - RNA, 20 nt, Homo sapiens
cucuagccuggggggcuugu

SEQ ID NO: 9373 - RNA, 18 nt, Homo sapiens
gguccucagcccugccac

SEQ ID NO: 9374 - RNA, 18 nt, Homo sapiens
uagauuguaaccccucca

SEQ ID NO: 9375 - RNA, 21 nt, Homo sapiens
gaauucagguuuacaagauga

SEQ ID NO: 9376 - RNA, 17 nt, Homo sapiens
uaaaccuggaguacucg

SEQ ID NO: 9377 - RNA, 23 nt, Homo sapiens
uauuucagaaaagaaauuaucua

SEQ ID NO: 9378 - RNA, 18 nt, Homo sapiens
cuuuuucaggacauugca

SEQ ID NO: 9379 - RNA, 20 nt, Homo sapiens
gauguucuagcaugugauua

SEQ ID NO: 9380 - RNA, 17 nt, Homo sapiens
uucauaaugacuuucca

SEQ ID NO: 9381 - RNA, 18 nt, Homo sapiens
ccaguuuuucuccaucuc

SEQ ID NO: 9382 - RNA, 17 nt, Homo sapiens
guuucgucucccaccca

SEQ ID NO: 9383 - RNA, 16 nt, Homo sapiens
aaccaagauagaucca

SEQ ID NO: 9384 - RNA, 18 nt, Homo sapiens
gaauucacaccuuaggug

SEQ ID NO: 9385 - RNA, 20 nt, Homo sapiens
gccuugggagagauuuuguc

SEQ ID NO: 9386 - RNA, 19 nt, Homo sapiens
aaauaucuaucugcuauua

SEQ ID NO: 9387 - RNA, 18 nt, Homo sapiens
acagaugaaaauuacaua

SEQ ID NO: 9388 - RNA, 19 nt, Homo sapiens
cugcaagcucugcuuccca

SEQ ID NO: 9389 - RNA, 21 nt, Homo sapiens
ucucuuuaucucccuugccuu

SEQ ID NO: 9390 - RNA, 18 nt, Homo sapiens
uuccagaaucuggcccag

SEQ ID NO: 9391 - RNA, 21 nt, Homo sapiens
cccugggcucgaaccugcgga

SEQ ID NO: 9392 - RNA, 23 nt, Homo sapiens
gguuggacuugccggcgucaccg

SEQ ID NO: 9393 - RNA, 19 nt, Homo sapiens
gauucacugguucuguaac

SEQ ID NO: 9394 - RNA, 20 nt, Homo sapiens
gugccucucggguggcgggu

SEQ ID NO: 9395 - RNA, 17 nt, Homo sapiens
guggucuccuuacaucu

SEQ ID NO: 9396 - RNA, 20 nt, Homo sapiens
ugcuuucaagauuugcuuuu

SEQ ID NO: 9397 - RNA, 19 nt, Homo sapiens
cuccccuucccucuggcuc

SEQ ID NO: 9398 - RNA, 20 nt, Homo sapiens
auaaauguauuaguucaucu

SEQ ID NO: 9399 - RNA, 19 nt, Homo sapiens
ucuuagcugaaauggccga

SEQ ID NO: 9400 - RNA, 28 nt, Homo sapiens
ugccugucauaagaaaacucuuagcuga

SEQ ID NO: 9401 - RNA, 20 nt, Homo sapiens
augaaaccuuauuuuuucca

SEQ ID NO: 9402 - RNA, 22 nt, Homo sapiens
ccaacuacaaccaagcucucug

SEQ ID NO: 9403 - RNA, 21 nt, Homo sapiens
cuaccucccugcaaccaacua

SEQ ID NO: 9404 - RNA, 23 nt, Homo sapiens
ggaugugcuuuucuccaauauca

SEQ ID NO: 9405 - RNA, 20 nt, Homo sapiens
ucuaaaagauccuuuuuaaa

SEQ ID NO: 9406 - RNA, 17 nt, Homo sapiens
ugaaggacacuuccugc

SEQ ID NO: 9407 - RNA, 19 nt, Homo sapiens
ugagccuggcuggcacaga

SEQ ID NO: 9408 - RNA, 20 nt, Homo sapiens
gccucccucaggguuucggg

SEQ ID NO: 9409 - RNA, 22 nt, Homo sapiens
gcucugaccaggaguuugggga

SEQ ID NO: 9410 - RNA, 18 nt, Homo sapiens
ccuuauuaaugaucagcu

SEQ ID NO: 9411 - RNA, 18 nt, Homo sapiens
aauucuugaaggaaaaug

SEQ ID NO: 9412 - RNA, 22 nt, Homo sapiens
ccaccgggugacauccguccca

SEQ ID NO: 9413 - RNA, 24 nt, Homo sapiens
cccuggugaugggguuacgugggg

SEQ ID NO: 9414 - RNA, 24 nt, Homo sapiens
gcgucccgagacgccggcuuccuc

SEQ ID NO: 9415 - RNA, 22 nt, Homo sapiens
auuucauaaaaaucccucuucc

SEQ ID NO: 9416 - RNA, 21 nt, Homo sapiens
ccuuuuggguuugccuuaauu

SEQ ID NO: 9417 - RNA, 22 nt, Homo sapiens
ucuuguucauguuuugcuaaug

SEQ ID NO: 9418 - RNA, 19 nt, Homo sapiens
uucagucugcagcuauuca

SEQ ID NO: 9419 - RNA, 20 nt, Homo sapiens
uuuuaaaauugcagcaguug

SEQ ID NO: 9420 - RNA, 21 nt, Homo sapiens
agagcgucuccagccccaucu

SEQ ID NO: 9421 - RNA, 18 nt, Homo sapiens
ccacgugugcacgcauga

SEQ ID NO: 9422 - RNA, 18 nt, Homo sapiens
ccccacccuccggcagcu

SEQ ID NO: 9423 - RNA, 18 nt, Homo sapiens
ccuccccuccccacagug

SEQ ID NO: 9424 - RNA, 21 nt, Homo sapiens
guggaggcagaggggauccgg

SEQ ID NO: 9425 - RNA, 17 nt, Homo sapiens
guguggccgcccgggug

SEQ ID NO: 9426 - RNA, 18 nt, Homo sapiens
aggcccagccuggacaaa

SEQ ID NO: 9427 - RNA, 19 nt, Homo sapiens
caccauccaccuucccuuc

SEQ ID NO: 9428 - RNA, 20 nt, Homo sapiens
caaggaaaaaagguauauca

SEQ ID NO: 9429 - RNA, 18 nt, Homo sapiens
caucggcucguaaacuga

SEQ ID NO: 9430 - RNA, 19 nt, Homo sapiens
ggaaggacaagaaugucau

SEQ ID NO: 9431 - RNA, 20 nt, Homo sapiens
ugaauggacuaagaugaaau

SEQ ID NO: 9432 - RNA, 23 nt, Homo sapiens
uggagccauaagaucuguaucua

SEQ ID NO: 9433 - RNA, 24 nt, Homo sapiens
agcuagucucuucucuucugugau

SEQ ID NO: 9434 - RNA, 18 nt, Homo sapiens
gcagagggaguuaagcca

SEQ ID NO: 9435 - RNA, 18 nt, Homo sapiens
uaccagagguuggagaac

SEQ ID NO: 9436 - RNA, 22 nt, Homo sapiens
agcaaaauaaacuugguuuaca

SEQ ID NO: 9437 - RNA, 22 nt, Homo sapiens
ccuccucgcccgcccgcccgca

SEQ ID NO: 9438 - RNA, 24 nt, Homo sapiens
uuuaaacccauuuuagucacuuuu

SEQ ID NO: 9439 - RNA, 18 nt, Homo sapiens
augggcauugcuggacug

SEQ ID NO: 9440 - RNA, 21 nt, Homo sapiens
uguugaucuaugggaaaucua

SEQ ID NO: 9441 - RNA, 21 nt, Homo sapiens
uuucaguagcuccuugguuuu

SEQ ID NO: 9442 - RNA, 17 nt, Homo sapiens
agguggccaauaugggg

SEQ ID NO: 9443 - RNA, 18 nt, Homo sapiens
auguauaucuguggaaua

SEQ ID NO: 9444 - RNA, 17 nt, Homo sapiens
ccuuuaaaacccuaccu

SEQ ID NO: 9445 - RNA, 19 nt, Homo sapiens
guuaagaacacguguauua

SEQ ID NO: 9446 - RNA, 23 nt, Homo sapiens
uuuugugcuuccaaaucacuuuu

SEQ ID NO: 9447 - RNA, 17 nt, Homo sapiens
cccccccacccacuuuu

SEQ ID NO: 9448 - RNA, 24 nt, Homo sapiens
ggugggugggauuguggcguugug

SEQ ID NO: 9449 - RNA, 22 nt, Homo sapiens
ugggauuguggcguuguggucu

SEQ ID NO: 9450 - RNA, 18 nt, Homo sapiens
cucuccuuucuuuaucuc

SEQ ID NO: 9451 - RNA, 24 nt, Homo sapiens
ggaugccuuaagacucuccuuucu

SEQ ID NO: 9452 - RNA, 18 nt, Homo sapiens
ugcaggagacucuugcag

SEQ ID NO: 9453 - RNA, 21 nt, Homo sapiens
aucuuggcucacugcaaccuc

SEQ ID NO: 9454 - RNA, 19 nt, Homo sapiens
caguugggcaaaaucaucu

SEQ ID NO: 9455 - RNA, 20 nt, Homo sapiens
ccucugccucccggguucaa

SEQ ID NO: 9456 - RNA, 18 nt, Homo sapiens
gcauccuagggugcuuuu

SEQ ID NO: 9457 - RNA, 20 nt, Homo sapiens
guccugaacaugauugugga

SEQ ID NO: 9458 - RNA, 16 nt, Homo sapiens
gugcaauuuuaucuca

SEQ ID NO: 9459 - RNA, 18 nt, Homo sapiens
uaugaugggguuauguca

SEQ ID NO: 9460 - RNA, 18 nt, Homo sapiens
uccgccuccuggguucaa

SEQ ID NO: 9461 - RNA, 18 nt, Homo sapiens
ucucaggaauuauuuuua

SEQ ID NO: 9462 - RNA, 18 nt, Homo sapiens
ucuugaccucaugaucca

SEQ ID NO: 9463 - RNA, 20 nt, Homo sapiens
uggccagguuggucuugaac

SEQ ID NO: 9464 - RNA, 25 nt, Homo sapiens
ccuugguauuguaaagaucugggga

SEQ ID NO: 9465 - RNA, 19 nt, Homo sapiens
cucaagaagaagcuuuuga

SEQ ID NO: 9466 - RNA, 19 nt, Homo sapiens
cccacgcuugcccuacagc

SEQ ID NO: 9467 - RNA, 24 nt, Homo sapiens
cccuuccaaaaacgauuuuuucca

SEQ ID NO: 9468 - RNA, 18 nt, Homo sapiens
ugcccuacagcccuucca

SEQ ID NO: 9469 - RNA, 23 nt, Homo sapiens
uguuggcuccaccuccagccucc

SEQ ID NO: 9470 - RNA, 25 nt, Homo sapiens
acagaugggauugugacauaucgcu

SEQ ID NO: 9471 - RNA, 20 nt, Homo sapiens
ccagaagggccacacuccag

SEQ ID NO: 9472 - RNA, 25 nt, Homo sapiens
ccuccccagaagggccacacuccag

SEQ ID NO: 9473 - RNA, 17 nt, Homo sapiens
cuguuuuccuugauggg

SEQ ID NO: 9474 - RNA, 17 nt, Homo sapiens
gacccugugugaaauua

SEQ ID NO: 9475 - RNA, 21 nt, Homo sapiens
gugccacgacaggugggcuuu

SEQ ID NO: 9476 - RNA, 23 nt, Homo sapiens
ugagugcgccgagcauggggcug

SEQ ID NO: 9477 - RNA, 20 nt, Homo sapiens
cccagaaggaaaucucugac

SEQ ID NO: 9478 - RNA, 19 nt, Homo sapiens
aggaaaugcaauuaugaua

SEQ ID NO: 9479 - RNA, 18 nt, Homo sapiens
guguagaagaccuagcug

SEQ ID NO: 9480 - RNA, 19 nt, Homo sapiens
uaauucauagaguagagug

SEQ ID NO: 9481 - RNA, 16 nt, Homo sapiens
accuccagaugccaaa

SEQ ID NO: 9482 - RNA, 19 nt, Homo sapiens
ugaaugagauguuuuagga

SEQ ID NO: 9483 - RNA, 26 nt, Homo sapiens
ugaggaucaaauuucagcaugaaauu

SEQ ID NO: 9484 - RNA, 21 nt, Homo sapiens
uugaugguauaacauaacuca

SEQ ID NO: 9485 - RNA, 18 nt, Homo sapiens
cccugaugauggcccugu

SEQ ID NO: 9486 - RNA, 16 nt, Homo sapiens
ugcaaccuccaccccc

SEQ ID NO: 9487 - RNA, 20 nt, Homo sapiens
ccauggacugaaacuucaca

SEQ ID NO: 9488 - RNA, 17 nt, Homo sapiens
acacaagccuuuucaca

SEQ ID NO: 9489 - RNA, 18 nt, Homo sapiens
ggucaguugacucugaua

SEQ ID NO: 9490 - RNA, 17 nt, Homo sapiens
ugcaauuaaucuuuaua

SEQ ID NO: 9491 - RNA, 24 nt, Homo sapiens
uuuaguuaucccugcauuauuuuu

SEQ ID NO: 9492 - RNA, 23 nt, Homo sapiens
caccuguggucccagcugccuca

SEQ ID NO: 9493 - RNA, 19 nt, Homo sapiens
gaguggauaauggaaacug

SEQ ID NO: 9494 - RNA, 21 nt, Homo sapiens
ucugucuuucccuguguguga

SEQ ID NO: 9495 - RNA, 22 nt, Homo sapiens
uguaaaacucacacuugccaaa

SEQ ID NO: 9496 - RNA, 18 nt, Homo sapiens
accagagagaaacccuac

SEQ ID NO: 9497 - RNA, 19 nt, Homo sapiens
uggagagaaacuucacaug

SEQ ID NO: 9498 - RNA, 17 nt, Homo sapiens
uuuggaugauccacaaa

SEQ ID NO: 9499 - RNA, 19 nt, Homo sapiens
ccagguuccuucuugcaca

SEQ ID NO: 9500 - RNA, 19 nt, Homo sapiens
cugcugguuucccgaggga

SEQ ID NO: 9501 - RNA, 17 nt, Homo sapiens
ggcccccugaaaucuca

SEQ ID NO: 9502 - RNA, 26 nt, Homo sapiens
ucuguccaggugccccucaucaucac

SEQ ID NO: 9503 - RNA, 18 nt, Homo sapiens
agaccuggagucuaugcu

SEQ ID NO: 9504 - RNA, 19 nt, Homo sapiens
uggugcugccucaaccuga

SEQ ID NO: 9505 - RNA, 17 nt, Homo sapiens
uuccccccacaugggga

SEQ ID NO: 9506 - RNA, 20 nt, Homo sapiens
aacaauuacagaaucaugau

SEQ ID NO: 9507 - RNA, 22 nt, Homo sapiens
auauccuaaagacugcucaaca

SEQ ID NO: 9508 - RNA, 18 nt, Homo sapiens
ggauaacugcauagaucc

SEQ ID NO: 9509 - RNA, 21 nt, Homo sapiens
guguugaaccugggacccuga

SEQ ID NO: 9510 - RNA, 26 nt, Homo sapiens
uaaguggagcacaggguaugggguua

SEQ ID NO: 9511 - RNA, 20 nt, Homo sapiens
ucuuacccauuccuuuucca

SEQ ID NO: 9512 - RNA, 16 nt, Homo sapiens
ugggugaaaugucugc

SEQ ID NO: 9513 - RNA, 21 nt, Homo sapiens
gcaggugcccccucugccucc

SEQ ID NO: 9514 - RNA, 19 nt, Homo sapiens
ugucugcagacggcggagg

SEQ ID NO: 9515 - RNA, 18 nt, Homo sapiens
uuaagaaaucugacccac

SEQ ID NO: 9516 - RNA, 18 nt, Homo sapiens
ccucugggugacaucgga

SEQ ID NO: 9517 - RNA, 22 nt, Homo sapiens
cuuucucucuucucuuggcuca

SEQ ID NO: 9518 - RNA, 20 nt, Homo sapiens
guggcuucaagcuaaguuuc

SEQ ID NO: 9519 - RNA, 20 nt, Homo sapiens
ucagguaugggcugaaugca

SEQ ID NO: 9520 - RNA, 19 nt, Homo sapiens
ucuggcaaacccuuggccc

SEQ ID NO: 9521 - RNA, 18 nt, Homo sapiens
ugcuugacccucuugcuu

SEQ ID NO: 9522 - RNA, 19 nt, Homo sapiens
uggaugggacaggaagcug

SEQ ID NO: 9523 - RNA, 21 nt, Homo sapiens
cccaugguucauguggagcca

SEQ ID NO: 9524 - RNA, 19 nt, Homo sapiens
cgcgcgccacagucgcugc

SEQ ID NO: 9525 - RNA, 25 nt, Homo sapiens
cucugguggccccgccgcccugcgg

SEQ ID NO: 9526 - RNA, 21 nt, Homo sapiens
gcccugcggggaucccggggg

SEQ ID NO: 9527 - RNA, 24 nt, Homo sapiens
gccgcccugcggggaucccggggg

SEQ ID NO: 9528 - RNA, 18 nt, Homo sapiens
gucuaucucuccaucccu

SEQ ID NO: 9529 - RNA, 20 nt, Homo sapiens
uccgcugcagcuccaccaau

SEQ ID NO: 9530 - RNA, 17 nt, Homo sapiens
agaaacugauuacugcu

SEQ ID NO: 9531 - RNA, 16 nt, Homo sapiens
auuugcuuuuuaucca

SEQ ID NO: 9532 - RNA, 20 nt, Homo sapiens
cauguagaauaugcucuuua

SEQ ID NO: 9533 - RNA, 24 nt, Homo sapiens
ccucuucauaccaguuuaacacuu

SEQ ID NO: 9534 - RNA, 23 nt, Homo sapiens
ucaccaaugaguacccgacccgu

SEQ ID NO: 9535 - RNA, 22 nt, Homo sapiens
caauaaaaauaaaucuaaauca

SEQ ID NO: 9536 - RNA, 20 nt, Homo sapiens
cacauuuguugcaccaauua

SEQ ID NO: 9537 - RNA, 22 nt, Homo sapiens
ccacuccugaaugagacuuaau

SEQ ID NO: 9538 - RNA, 18 nt, Homo sapiens
uuucuuuugugcagauca

SEQ ID NO: 9539 - RNA, 22 nt, Homo sapiens
acuuuuacauuuuggcaugaca

SEQ ID NO: 9540 - RNA, 23 nt, Homo sapiens
agucaaacuuacaaaaacuguug

SEQ ID NO: 9541 - RNA, 18 nt, Homo sapiens
uccucuugguggcagaua

SEQ ID NO: 9542 - RNA, 20 nt, Homo sapiens
ucuugguggcagauaccugc

SEQ ID NO: 9543 - RNA, 19 nt, Homo sapiens
cacuugcaaccuaccuguu

SEQ ID NO: 9544 - RNA, 24 nt, Homo sapiens
gcggcggcgcgggccgugcgcgag

SEQ ID NO: 9545 - RNA, 19 nt, Homo sapiens
uaaaacaucauuacuauaa

SEQ ID NO: 9546 - RNA, 25 nt, Homo sapiens
uacauaauucacucugaguguuuua

SEQ ID NO: 9547 - RNA, 19 nt, Homo sapiens
ccaagaaacauauguuaua

SEQ ID NO: 9548 - RNA, 18 nt, Homo sapiens
uugcuugucccaauacaa

SEQ ID NO: 9549 - RNA, 19 nt, Homo sapiens
auucaaguggauucuaaau

SEQ ID NO: 9550 - RNA, 23 nt, Homo sapiens
caaaacagcauaccugcuaagcu

SEQ ID NO: 9551 - RNA, 22 nt, Homo sapiens
cagauucuuggcuggguuuagu

SEQ ID NO: 9552 - RNA, 23 nt, Homo sapiens
cuuaagcccaccugggcacuuuu

SEQ ID NO: 9553 - RNA, 23 nt, Homo sapiens
ggagacgcagcggcggccgcagc

SEQ ID NO: 9554 - RNA, 16 nt, Homo sapiens
gugccuaaauguagua

SEQ ID NO: 9555 - RNA, 21 nt, Homo sapiens
ucacuuuccccaucacacuca

SEQ ID NO: 9556 - RNA, 20 nt, Homo sapiens
ugaauuuucaggaaccguca

SEQ ID NO: 9557 - RNA, 20 nt, Homo sapiens
uucucuccucucccauccca

SEQ ID NO: 9558 - RNA, 21 nt, Homo sapiens
aauggaacaguaagaacauca

SEQ ID NO: 9559 - RNA, 18 nt, Homo sapiens
aauggaagcaauugcuca

SEQ ID NO: 9560 - RNA, 20 nt, Homo sapiens
acccuccaagucuguaccuc

SEQ ID NO: 9561 - RNA, 22 nt, Homo sapiens
accuacuaauaguuuguugauc

SEQ ID NO: 9562 - RNA, 18 nt, Homo sapiens
accuccaccuccaccgcc

SEQ ID NO: 9563 - RNA, 17 nt, Homo sapiens
agucccaguauaccuca

SEQ ID NO: 9564 - RNA, 20 nt, Homo sapiens
ccaccgccaccuccaccucc

SEQ ID NO: 9565 - RNA, 20 nt, Homo sapiens
ccaccuccaccgccaccucc

SEQ ID NO: 9566 - RNA, 19 nt, Homo sapiens
cucucccucucccucucuc

SEQ ID NO: 9567 - RNA, 19 nt, Homo sapiens
cucucucucucucccucuc

SEQ ID NO: 9568 - RNA, 26 nt, Homo sapiens
guaguuucucaugacggcuuuuguca

SEQ ID NO: 9569 - RNA, 22 nt, Homo sapiens
gugcccgacccuaucccggcgg

SEQ ID NO: 9570 - RNA, 20 nt, Homo sapiens
uauguauuuuucuauguuuu

SEQ ID NO: 9571 - RNA, 20 nt, Homo sapiens
ucaccaucucuucauucaaa

SEQ ID NO: 9572 - RNA, 19 nt, Homo sapiens
uccucuccuccuccuccuc

SEQ ID NO: 9573 - RNA, 18 nt, Homo sapiens
uucaagggacacaauuca

SEQ ID NO: 9574 - RNA, 22 nt, Homo sapiens
uuucaggaaaucuacuuccuac

SEQ ID NO: 9575 - RNA, 19 nt, Homo sapiens
ccagccagagguggagcca

SEQ ID NO: 9576 - RNA, 20 nt, Homo sapiens
cgaagccggacacggcuuca

SEQ ID NO: 9577 - RNA, 21 nt, Homo sapiens
cugugugccccacuccagccu

SEQ ID NO: 9578 - RNA, 19 nt, Homo sapiens
ucgaacccacuccgguucc

SEQ ID NO: 9579 - RNA, 22 nt, Homo sapiens
uugcuacgacagacuugcacug

SEQ ID NO: 9580 - RNA, 22 nt, Homo sapiens
uagcacgugggggagcugcgga

SEQ ID NO: 9581 - RNA, 22 nt, Homo sapiens
uugaugauauuuaaccaguuuu

SEQ ID NO: 9582 - RNA, 23 nt, Homo sapiens
uuguaaccauuuucuauuugugc

SEQ ID NO: 9583 - RNA, 22 nt, Homo sapiens
gaaucaacagaucaaugacaua

SEQ ID NO: 9584 - RNA, 23 nt, Homo sapiens
ucccauuuuccuucaccgugaca

SEQ ID NO: 9585 - RNA, 21 nt, Homo sapiens
cgagccggccucgcccagcca

SEQ ID NO: 9586 - RNA, 23 nt, Homo sapiens
gcgccucggcccucccgaccuuu

SEQ ID NO: 9587 - RNA, 20 nt, Homo sapiens
aagccaggauucuccggucu

SEQ ID NO: 9588 - RNA, 19 nt, Homo sapiens
cuucgcuagcuuuagucuu

SEQ ID NO: 9589 - RNA, 21 nt, Homo sapiens
gcagcuucgugcuuuuguaca

SEQ ID NO: 9590 - RNA, 18 nt, Homo sapiens
ggcuccugugcuuuuuau

SEQ ID NO: 9591 - RNA, 19 nt, Homo sapiens
aaaagaauacuuuguaaua

SEQ ID NO: 9592 - RNA, 19 nt, Homo sapiens
agggaagcugcaggaccaa

SEQ ID NO: 9593 - RNA, 19 nt, Homo sapiens
cgcagaacaggagccgggg

SEQ ID NO: 9594 - RNA, 19 nt, Homo sapiens
cuaugucugucauacgcua

SEQ ID NO: 9595 - RNA, 18 nt, Homo sapiens
ucuacggggccgcggcca

SEQ ID NO: 9596 - RNA, 19 nt, Homo sapiens
ugaccacccauugauugua

SEQ ID NO: 9597 - RNA, 23 nt, Homo sapiens
ccccuccccaccuuucccacccc

SEQ ID NO: 9598 - RNA, 24 nt, Homo sapiens
cuaauacccugaaaagaagugaug

SEQ ID NO: 9599 - RNA, 23 nt, Homo sapiens
uaauguucacuugaguggaacug

SEQ ID NO: 9600 - RNA, 16 nt, Homo sapiens
ucucuccuccccugcc

SEQ ID NO: 9601 - RNA, 21 nt, Homo sapiens
aagaccuggaacaagauucug

SEQ ID NO: 9602 - RNA, 16 nt, Homo sapiens
agacccccauucuuca

SEQ ID NO: 9603 - RNA, 18 nt, Homo sapiens
uccacuccagaguugggu

SEQ ID NO: 9604 - RNA, 17 nt, Homo sapiens
uccuguucuaucccuuc

SEQ ID NO: 9605 - RNA, 19 nt, Homo sapiens
uaggucugccuucacuuua

SEQ ID NO: 9606 - RNA, 21 nt, Homo sapiens
augagacugcagccugugaca

SEQ ID NO: 9607 - RNA, 17 nt, Homo sapiens
cagcgacgccugcccag

SEQ ID NO: 9608 - RNA, 22 nt, Homo sapiens
ccuccaaaccuggccaagccca

SEQ ID NO: 9609 - RNA, 22 nt, Homo sapiens
ccuccaaaccuggccaagccca

SEQ ID NO: 9610 - RNA, 23 nt, Homo sapiens
ccuuuuugguaccuuguaaccuu

SEQ ID NO: 9611 - RNA, 18 nt, Homo sapiens
cugaaauuucauugcucc

SEQ ID NO: 9612 - RNA, 20 nt, Homo sapiens
cugugugugcaccugcucac

SEQ ID NO: 9613 - RNA, 20 nt, Homo sapiens
gccccuggaguucagaaguc

SEQ ID NO: 9614 - RNA, 19 nt, Homo sapiens
gggcggggcggccgcugcc

SEQ ID NO: 9615 - RNA, 20 nt, Homo sapiens
ggucaacaccagagaucuca

SEQ ID NO: 9616 - RNA, 25 nt, Homo sapiens
ugggagggcuuuagcaaugagacug

SEQ ID NO: 9617 - RNA, 21 nt, Homo sapiens
acagagaucaggacgccuuug

SEQ ID NO: 9618 - RNA, 18 nt, Homo sapiens
agcgccuuuuccucccuu

SEQ ID NO: 9619 - RNA, 24 nt, Homo sapiens
ggcgugagucaccgcgcccggcca

SEQ ID NO: 9620 - RNA, 20 nt, Homo sapiens
cauccucucccccaugcuua

SEQ ID NO: 9621 - RNA, 23 nt, Homo sapiens
uucugucucuccuucuucccccu

SEQ ID NO: 9622 - RNA, 18 nt, Homo sapiens
ccacaccggagcagugcu

SEQ ID NO: 9623 - RNA, 18 nt, Homo sapiens
gagucagacaacugcugg

SEQ ID NO: 9624 - RNA, 19 nt, Homo sapiens
uucaaguuaaaacucccca

SEQ ID NO: 9625 - RNA, 19 nt, Homo sapiens
uuuuucugguucacaacag

SEQ ID NO: 9626 - RNA, 21 nt, Homo sapiens
ugaguccuuuaugaaauucau

SEQ ID NO: 9627 - RNA, 22 nt, Homo sapiens
acuugagucuauugccuugccu

SEQ ID NO: 9628 - RNA, 21 nt, Homo sapiens
ugauaacucccucuggagcuu

SEQ ID NO: 9629 - RNA, 22 nt, Homo sapiens
gccugcuuuugaccuuuggcuc

SEQ ID NO: 9630 - RNA, 19 nt, Homo sapiens
agauuaggauaaguaagcu

SEQ ID NO: 9631 - RNA, 19 nt, Homo sapiens
cugaaaugcauuuuccucu

SEQ ID NO: 9632 - RNA, 19 nt, Homo sapiens
cuuuucagcacuuaauuuu

SEQ ID NO: 9633 - RNA, 19 nt, Homo sapiens
gcgcgaggggcggccggga

SEQ ID NO: 9634 - RNA, 24 nt, Homo sapiens
ucuccagcggccauguuaaccagg

SEQ ID NO: 9635 - RNA, 24 nt, Homo sapiens
ucugcuuuucuccucucuguuccu

SEQ ID NO: 9636 - RNA, 24 nt, Homo sapiens
ccaaggccuguggcccccacacug

SEQ ID NO: 9637 - RNA, 19 nt, Homo sapiens
gggaguucccaucuaguca

SEQ ID NO: 9638 - RNA, 18 nt, Homo sapiens
gggcggggcggcgcugcc

SEQ ID NO: 9639 - RNA, 18 nt, Homo sapiens
acuguugauuguuugcuu

SEQ ID NO: 9640 - RNA, 17 nt, Homo sapiens
cugauggucugugagau

SEQ ID NO: 9641 - RNA, 19 nt, Homo sapiens
ugagcucagcugacaagca

SEQ ID NO: 9642 - RNA, 18 nt, Homo sapiens
ucaagacuucaaccugca

SEQ ID NO: 9643 - RNA, 23 nt, Homo sapiens
aacuuuugguaggaaggaaaaca

SEQ ID NO: 9644 - RNA, 18 nt, Homo sapiens
cacuuuuaccauacuuga

SEQ ID NO: 9645 - RNA, 19 nt, Homo sapiens
ccaagcauacaauuugagc

SEQ ID NO: 9646 - RNA, 20 nt, Homo sapiens
ugcaaucuaaagaugcaaua

SEQ ID NO: 9647 - RNA, 20 nt, Homo sapiens
cugugagcaggggaacgcga

SEQ ID NO: 9648 - RNA, 18 nt, Homo sapiens
cagcuuuccccaggguga

SEQ ID NO: 9649 - RNA, 18 nt, Homo sapiens
ccagcguuugccuggucu

SEQ ID NO: 9650 - RNA, 22 nt, Homo sapiens
ccccucgucauuuucuuuccca

SEQ ID NO: 9651 - RNA, 21 nt, Homo sapiens
uuuauucccccaucuucaucc

SEQ ID NO: 9652 - RNA, 19 nt, Homo sapiens
aauacagugagacccuguc

SEQ ID NO: 9653 - RNA, 25 nt, Homo sapiens
aaaauaggaacacgugcucuaccuc

SEQ ID NO: 9654 - RNA, 19 nt, Homo sapiens
aagcuccacaucaauaaac

SEQ ID NO: 9655 - RNA, 22 nt, Homo sapiens
accucagugacccgucuggccc

SEQ ID NO: 9656 - RNA, 17 nt, Homo sapiens
gcccgcggaagagcaga

SEQ ID NO: 9657 - RNA, 17 nt, Homo sapiens
aaacggaggguguugca

SEQ ID NO: 9658 - RNA, 18 nt, Homo sapiens
uaaacaaucucuacaugu

SEQ ID NO: 9659 - RNA, 18 nt, Homo sapiens
ugggcauguuagaauaca

SEQ ID NO: 9660 - RNA, 19 nt, Homo sapiens
accacuugagccuauauca

SEQ ID NO: 9661 - RNA, 17 nt, Homo sapiens
caucuggugccaaauga

SEQ ID NO: 9662 - RNA, 23 nt, Homo sapiens
guuuggauugcagcauucugcuc

SEQ ID NO: 9663 - RNA, 18 nt, Homo sapiens
ucugaugaugcgcuguga

SEQ ID NO: 9664 - RNA, 23 nt, Homo sapiens
gcacggauggugaggggcugaga

SEQ ID NO: 9665 - RNA, 22 nt, Homo sapiens
gccgcaggcggcugcugggccc

SEQ ID NO: 9666 - RNA, 22 nt, Homo sapiens
aaauaaucaaagauagcauuca

SEQ ID NO: 9667 - RNA, 22 nt, Homo sapiens
aaauguaaucaucccaaagauc

SEQ ID NO: 9668 - RNA, 17 nt, Homo sapiens
aacugaaaacuaccugg

SEQ ID NO: 9669 - RNA, 21 nt, Homo sapiens
cuaauaaaggaucaugaggaa

SEQ ID NO: 9670 - RNA, 22 nt, Homo sapiens
cuuucuuuugacuacuugacug

SEQ ID NO: 9671 - RNA, 18 nt, Homo sapiens
ucagguucaaguucuuga

SEQ ID NO: 9672 - RNA, 20 nt, Homo sapiens
ugaaugggguugugaaacug

SEQ ID NO: 9673 - RNA, 19 nt, Homo sapiens
ugcuguuuaugugugacua

SEQ ID NO: 9674 - RNA, 25 nt, Homo sapiens
uguuaaaaugauggauucaacuucu

SEQ ID NO: 9675 - RNA, 24 nt, Homo sapiens
uucuaaaguguguguauguuugug

SEQ ID NO: 9676 - RNA, 21 nt, Homo sapiens
uuucuuuagaugccuugauuu

SEQ ID NO: 9677 - RNA, 23 nt, Homo sapiens
agacugugggucaaauguuucca

SEQ ID NO: 9678 - RNA, 19 nt, Homo sapiens
guaauagauuuccagcuaa

SEQ ID NO: 9679 - RNA, 24 nt, Homo sapiens
guccuaugaugcuauuaucauaga

SEQ ID NO: 9680 - RNA, 19 nt, Homo sapiens
uucccuuggaccaccuuca

SEQ ID NO: 9681 - RNA, 23 nt, Homo sapiens
ccuuuucauauuucuuuugacuu

SEQ ID NO: 9682 - RNA, 25 nt, Homo sapiens
cuuaguuuugguuuaagucauuuuu

SEQ ID NO: 9683 - RNA, 24 nt, Homo sapiens
uuuaagucauuuuugauugcuuuu

SEQ ID NO: 9684 - RNA, 24 nt, Homo sapiens
uuucugugaaacuucauauugcug

SEQ ID NO: 9685 - RNA, 19 nt, Homo sapiens
aguguucacuguagccacc

SEQ ID NO: 9686 - RNA, 24 nt, Homo sapiens
uccgcgguauggaggauuugagga

SEQ ID NO: 9687 - RNA, 19 nt, Homo sapiens
accacacaccccacugggc

SEQ ID NO: 9688 - RNA, 17 nt, Homo sapiens
ccgcccacccgccccca

SEQ ID NO: 9689 - RNA, 19 nt, Homo sapiens
gcauggccaagagccagcu

SEQ ID NO: 9690 - RNA, 19 nt, Homo sapiens
aaucuguuggagacauagg

SEQ ID NO: 9691 - RNA, 26 nt, Homo sapiens
aguuuuugugggcauauauauauaca

SEQ ID NO: 9692 - RNA, 21 nt, Homo sapiens
aacagauuccaagagaauuga

SEQ ID NO: 9693 - RNA, 23 nt, Homo sapiens
uuuuuuuauaccaguuuuggaga

SEQ ID NO: 9694 - RNA, 19 nt, Homo sapiens
gaggauauucccccauccc

SEQ ID NO: 9695 - RNA, 20 nt, Homo sapiens
acauuuugagguuuuguaaa

SEQ ID NO: 9696 - RNA, 20 nt, Homo sapiens
agcugcugcuggagauucaa

SEQ ID NO: 9697 - RNA, 22 nt, Homo sapiens
aguugugaauacauucuuugcu

SEQ ID NO: 9698 - RNA, 19 nt, Homo sapiens
ccguggagaucgcuuuucu

SEQ ID NO: 9699 - RNA, 19 nt, Homo sapiens
cuuugaagcaaauacaauu

SEQ ID NO: 9700 - RNA, 22 nt, Homo sapiens
ugggauuucaugggguuugguu

SEQ ID NO: 9701 - RNA, 23 nt, Homo sapiens
ccugguccugcugucuugguuuu

SEQ ID NO: 9702 - RNA, 18 nt, Homo sapiens
gccuacaccuccaccucc

SEQ ID NO: 9703 - RNA, 18 nt, Homo sapiens
ggauuacagcucugccca

SEQ ID NO: 9704 - RNA, 22 nt, Homo sapiens
accaaugaugagccucaugcca

SEQ ID NO: 9705 - RNA, 21 nt, Homo sapiens
ccaagucgcugccagacacca

SEQ ID NO: 9706 - RNA, 18 nt, Homo sapiens
ccucagugcaggcaccuc

SEQ ID NO: 9707 - RNA, 21 nt, Homo sapiens
cugggggucuuccuccaccuc

SEQ ID NO: 9708 - RNA, 23 nt, Homo sapiens
gccccucugucuggccaccccuc

SEQ ID NO: 9709 - RNA, 18 nt, Homo sapiens
ugagccucaugccaguga

SEQ ID NO: 9710 - RNA, 17 nt, Homo sapiens
uguaggaaaagaccuca

SEQ ID NO: 9711 - RNA, 23 nt, Homo sapiens
gaugccaccuggagccccaccca

SEQ ID NO: 9712 - RNA, 23 nt, Homo sapiens
uuucccaucuuuuuguuaccaua

SEQ ID NO: 9713 - RNA, 17 nt, Homo sapiens
acuggugggcacuggac

SEQ ID NO: 9714 - RNA, 20 nt, Homo sapiens
aguuuucugucacugguggg

SEQ ID NO: 9715 - RNA, 18 nt, Homo sapiens
gcagcuucgggggguccu

SEQ ID NO: 9716 - RNA, 20 nt, Homo sapiens
gccgccccgggcaggucccg

SEQ ID NO: 9717 - RNA, 21 nt, Homo sapiens
gggagagagcuggugauucca

SEQ ID NO: 9718 - RNA, 22 nt, Homo sapiens
uggagaggucaggauggaacua

SEQ ID NO: 9719 - RNA, 20 nt, Homo sapiens
cccgcuccccugucauuuca

SEQ ID NO: 9720 - RNA, 19 nt, Homo sapiens
cccuggucuucggccgggu

SEQ ID NO: 9721 - RNA, 23 nt, Homo sapiens
cgcuccugccccaccccaccucc

SEQ ID NO: 9722 - RNA, 21 nt, Homo sapiens
cugccuugcuuggcacccgcu

SEQ ID NO: 9723 - RNA, 22 nt, Homo sapiens
gagcgccuuccuugcccaccuc

SEQ ID NO: 9724 - RNA, 23 nt, Homo sapiens
uccuuuuuucagcaaaauacuuc

SEQ ID NO: 9725 - RNA, 18 nt, Homo sapiens
acaaaccauugcccggca

SEQ ID NO: 9726 - RNA, 17 nt, Homo sapiens
gcacuggcccgugcugc

SEQ ID NO: 9727 - RNA, 19 nt, Homo sapiens
cgccgccugcgccgcgaga

SEQ ID NO: 9728 - RNA, 21 nt, Homo sapiens
gccacaaccuuaaccaacacc

SEQ ID NO: 9729 - RNA, 21 nt, Homo sapiens
agcagucccucuuugaccuca

SEQ ID NO: 9730 - RNA, 19 nt, Homo sapiens
cauguauauauucuucuga

SEQ ID NO: 9731 - RNA, 18 nt, Homo sapiens
acauuggagccugcaaua

SEQ ID NO: 9732 - RNA, 18 nt, Homo sapiens
ccgguaaguaaacaguca

SEQ ID NO: 9733 - RNA, 19 nt, Homo sapiens
ggccggguguaguggcuca

SEQ ID NO: 9734 - RNA, 21 nt, Homo sapiens
uccugaugauggucauugggg

SEQ ID NO: 9735 - RNA, 18 nt, Homo sapiens
ugucgccaaguuggagug

SEQ ID NO: 9736 - RNA, 17 nt, Homo sapiens
aaacaaaagccacaaac

SEQ ID NO: 9737 - RNA, 17 nt, Homo sapiens
aacaccacuuaacagua

SEQ ID NO: 9738 - RNA, 21 nt, Homo sapiens
acuuguugaaaaacugauuug

SEQ ID NO: 9739 - RNA, 18 nt, Homo sapiens
agcuggaaacuuggacua

SEQ ID NO: 9740 - RNA, 21 nt, Homo sapiens
gagcuuuaauaaaaaaucuua

SEQ ID NO: 9741 - RNA, 21 nt, Homo sapiens
ucugcuuugccucugguggua

SEQ ID NO: 9742 - RNA, 21 nt, Homo sapiens
ugacuuccuggcaccacaggg

SEQ ID NO: 9743 - RNA, 18 nt, Homo sapiens
uggaagaacugcccugcu

SEQ ID NO: 9744 - RNA, 20 nt, Homo sapiens
ucucaaaacaguauuagcuu

SEQ ID NO: 9745 - RNA, 22 nt, Homo sapiens
uucuacuggaaguuugcacuuu

SEQ ID NO: 9746 - RNA, 22 nt, Homo sapiens
uucuacuggaaguuugcacuuu

SEQ ID NO: 9747 - RNA, 16 nt, Homo sapiens
aagacaaaccugguca

SEQ ID NO: 9748 - RNA, 23 nt, Homo sapiens
agaagucuuggagugcauuuuca

SEQ ID NO: 9749 - RNA, 24 nt, Homo sapiens
auccugcucuuuuggaaacguauu

SEQ ID NO: 9750 - RNA, 25 nt, Homo sapiens
cuuccgaauggaagaggucugugag

SEQ ID NO: 9751 - RNA, 19 nt, Homo sapiens
cuuccuauuuacauaaugu

SEQ ID NO: 9752 - RNA, 21 nt, Homo sapiens
aaccaagccuuggcaccgcca

SEQ ID NO: 9753 - RNA, 18 nt, Homo sapiens
cuguaggcuaauuccucu

SEQ ID NO: 9754 - RNA, 20 nt, Homo sapiens
gaauagcccccuucgauaca

SEQ ID NO: 9755 - RNA, 19 nt, Homo sapiens
gucuguggcuuugaucaga

SEQ ID NO: 9756 - RNA, 17 nt, Homo sapiens
guucccugggcuucugg

SEQ ID NO: 9757 - RNA, 19 nt, Homo sapiens
aucacauuuaaacacuguu

SEQ ID NO: 9758 - RNA, 19 nt, Homo sapiens
caaaauugcaaaagccuua

SEQ ID NO: 9759 - RNA, 24 nt, Homo sapiens
cagaagaauugaggaucugaugga

SEQ ID NO: 9760 - RNA, 19 nt, Homo sapiens
gcagcccuacuggaacaca

SEQ ID NO: 9761 - RNA, 24 nt, Homo sapiens
ggaacacagagugcuucucccgca

SEQ ID NO: 9762 - RNA, 21 nt, Homo sapiens
guccuucccuguaacauugga

SEQ ID NO: 9763 - RNA, 20 nt, Homo sapiens
caugugccuacauagacaca

SEQ ID NO: 9764 - RNA, 23 nt, Homo sapiens
gaaaaaacugaaaaagaugcugc

SEQ ID NO: 9765 - RNA, 23 nt, Homo sapiens
gagaaguaggggaaagggaauca

SEQ ID NO: 9766 - RNA, 17 nt, Homo sapiens
guuuuaguucugugaac

SEQ ID NO: 9767 - RNA, 19 nt, Homo sapiens
uuccugcuguuugcuacca

SEQ ID NO: 9768 - RNA, 19 nt, Homo sapiens
ugugcaaccacugcuucuu

SEQ ID NO: 9769 - RNA, 18 nt, Homo sapiens
aagcuauuucgccaggca

SEQ ID NO: 9770 - RNA, 18 nt, Homo sapiens
uggguggaucaccugagg

SEQ ID NO: 9771 - RNA, 24 nt, Homo sapiens
aaauuccagaaaucugcauauaau

SEQ ID NO: 9772 - RNA, 18 nt, Homo sapiens
acaaccuuuaaaauguuc

SEQ ID NO: 9773 - RNA, 20 nt, Homo sapiens
accauaaaggucuucacaua

SEQ ID NO: 9774 - RNA, 17 nt, Homo sapiens
caaaaucugugcaggga

SEQ ID NO: 9775 - RNA, 23 nt, Homo sapiens
gaacacggcucacugccgccuca

SEQ ID NO: 9776 - RNA, 18 nt, Homo sapiens
ugauccuugaacaacuca

SEQ ID NO: 9777 - RNA, 23 nt, Homo sapiens
uuuauuaucccaaguuccugcug

SEQ ID NO: 9778 - RNA, 18 nt, Homo sapiens
aaggacgaacuuggauua

SEQ ID NO: 9779 - RNA, 23 nt, Homo sapiens
cauuuuauuuucccaccuucaaa

SEQ ID NO: 9780 - RNA, 20 nt, Homo sapiens
guugugagccaccgcugcca

SEQ ID NO: 9781 - RNA, 18 nt, Homo sapiens
ucuguauuaauucacuga

SEQ ID NO: 9782 - RNA, 23 nt, Homo sapiens
uugagcugauuuaaguuguuuuu

SEQ ID NO: 9783 - RNA, 18 nt, Homo sapiens
uuguuuguuagcaggugu

SEQ ID NO: 9784 - RNA, 22 nt, Homo sapiens
agaaaugacuguaaauauuuca

SEQ ID NO: 9785 - RNA, 20 nt, Homo sapiens
aguuucacucugugaggagu

SEQ ID NO: 9786 - RNA, 17 nt, Homo sapiens
cuauuuuguguccuuga

SEQ ID NO: 9787 - RNA, 19 nt, Homo sapiens
cucccagaagaccaaacug

SEQ ID NO: 9788 - RNA, 20 nt, Homo sapiens
gucccucugagugugucuug

SEQ ID NO: 9789 - RNA, 16 nt, Homo sapiens
agacauuucuccuuuc

SEQ ID NO: 9790 - RNA, 24 nt, Homo sapiens
uuucccucagccaggucacccuca

SEQ ID NO: 9791 - RNA, 18 nt, Homo sapiens
aggcuuuuucaucuacga

SEQ ID NO: 9792 - RNA, 17 nt, Homo sapiens
cgaccgcuccccggcgg

SEQ ID NO: 9793 - RNA, 19 nt, Homo sapiens
cugggcuccaccugcucac

SEQ ID NO: 9794 - RNA, 19 nt, Homo sapiens
ggagaacugaagauugcca

SEQ ID NO: 9795 - RNA, 17 nt, Homo sapiens
uggaagacaccaacuuc

SEQ ID NO: 9796 - RNA, 19 nt, Homo sapiens
ggccccgcccguccccccu

SEQ ID NO: 9797 - RNA, 22 nt, Homo sapiens
cugagauauguacacagucauu

SEQ ID NO: 9798 - RNA, 22 nt, Homo sapiens
ggggccgccgcgggccgucugc

SEQ ID NO: 9799 - RNA, 15 nt, Homo sapiens
auguugauaauucug

SEQ ID NO: 9800 - RNA, 20 nt, Homo sapiens
cacauaaaaaguuccccucu

SEQ ID NO: 9801 - RNA, 26 nt, Homo sapiens
ggauguuggccaccaggugccuuuca

SEQ ID NO: 9802 - RNA, 18 nt, Homo sapiens
aagaaauaugggcauuuu

SEQ ID NO: 9803 - RNA, 19 nt, Homo sapiens
ugucuacaugguuaaugga

SEQ ID NO: 9804 - RNA, 21 nt, Homo sapiens
cucgugugcguguagucugug

SEQ ID NO: 9805 - RNA, 18 nt, Homo sapiens
caucuuuguacagagaca

SEQ ID NO: 9806 - RNA, 25 nt, Homo sapiens
agucuacacccucccacggggugga

SEQ ID NO: 9807 - RNA, 23 nt, Homo sapiens
auccuagacaagccugaccgugc

SEQ ID NO: 9808 - RNA, 23 nt, Homo sapiens
auccugcaauccuucugccccaa

SEQ ID NO: 9809 - RNA, 19 nt, Homo sapiens
gaucccuguacacguggug

SEQ ID NO: 9810 - RNA, 19 nt, Homo sapiens
ugacaaacaaacagcccca

SEQ ID NO: 9811 - RNA, 20 nt, Homo sapiens
gagagagagaaaagagccuc

SEQ ID NO: 9812 - RNA, 21 nt, Homo sapiens
ucagcccuccaucuaauguga

SEQ ID NO: 9813 - RNA, 21 nt, Homo sapiens
aaaagguauuauacaugugau

SEQ ID NO: 9814 - RNA, 20 nt, Homo sapiens
aaagguauuauacaugugau

SEQ ID NO: 9815 - RNA, 21 nt, Homo sapiens
cuccccuuccucuugucugau

SEQ ID NO: 9816 - RNA, 22 nt, Homo sapiens
gcauagaaaccacuagaaagug

SEQ ID NO: 9817 - RNA, 20 nt, Homo sapiens
gcuuaaaccacuuaaacgaa

SEQ ID NO: 9818 - RNA, 17 nt, Homo sapiens
aaacgcuuuuuauugcu

SEQ ID NO: 9819 - RNA, 22 nt, Homo sapiens
gucucucugucccccuccccuc

SEQ ID NO: 9820 - RNA, 19 nt, Homo sapiens
gucuguggccguccaggug

SEQ ID NO: 9821 - RNA, 24 nt, Homo sapiens
uccagaugagaccaaugcacuuca

SEQ ID NO: 9822 - RNA, 18 nt, Homo sapiens
gcugcgggcugggcccca

SEQ ID NO: 9823 - RNA, 20 nt, Homo sapiens
ccagccccugguacuccccc

SEQ ID NO: 9824 - RNA, 20 nt, Homo sapiens
ccuuuguugcugucuggcuu

SEQ ID NO: 9825 - RNA, 22 nt, Homo sapiens
ucuggcuuucccgaaucuuuuu

SEQ ID NO: 9826 - RNA, 19 nt, Homo sapiens
cugaagccucaguccuuca

SEQ ID NO: 9827 - RNA, 19 nt, Homo sapiens
cugaagccucaguccuuca

SEQ ID NO: 9828 - RNA, 19 nt, Homo sapiens
cccuccugcccgccugaga

SEQ ID NO: 9829 - RNA, 22 nt, Homo sapiens
uccugacucacagggccuggaa

SEQ ID NO: 9830 - RNA, 16 nt, Homo sapiens
ucugcuuuagaugugu

SEQ ID NO: 9831 - RNA, 20 nt, Homo sapiens
aacaacaaucaugcuuauga

SEQ ID NO: 9832 - RNA, 17 nt, Homo sapiens
aaggcuggaagcugcag

SEQ ID NO: 9833 - RNA, 19 nt, Homo sapiens
ucaaucgaaauaugcucua

SEQ ID NO: 9834 - RNA, 22 nt, Homo sapiens
aaguaacuuugucccaguccua

SEQ ID NO: 9835 - RNA, 20 nt, Homo sapiens
acauuuagauauauuugugu

SEQ ID NO: 9836 - RNA, 19 nt, Homo sapiens
cuuuuuuuuaauuacugua

SEQ ID NO: 9837 - RNA, 21 nt, Homo sapiens
gaagcagaaugaaaccacauu

SEQ ID NO: 9838 - RNA, 18 nt, Homo sapiens
uacacauacauacacaca

SEQ ID NO: 9839 - RNA, 20 nt, Homo sapiens
ucuguggaguacauugaaga

SEQ ID NO: 9840 - RNA, 19 nt, Homo sapiens
uucugucacucaagacaca

SEQ ID NO: 9841 - RNA, 16 nt, Homo sapiens
cccuuaucccucugga

SEQ ID NO: 9842 - RNA, 23 nt, Homo sapiens
gcgcggagcucgggcggccgugg

SEQ ID NO: 9843 - RNA, 19 nt, Homo sapiens
uaaccccauggacuccuuu

SEQ ID NO: 9844 - RNA, 20 nt, Homo sapiens
ucggguaauauuaaacagua

SEQ ID NO: 9845 - RNA, 17 nt, Homo sapiens
acucuggagagacugug

SEQ ID NO: 9846 - RNA, 22 nt, Homo sapiens
agaaguuaacuacaguguuuuc

SEQ ID NO: 9847 - RNA, 24 nt, Homo sapiens
ccugaguaccagcaggucccuuuu

SEQ ID NO: 9848 - RNA, 19 nt, Homo sapiens
cugcauuuuccuacauuga

SEQ ID NO: 9849 - RNA, 19 nt, Homo sapiens
cuuuuuuguggugucuagc

SEQ ID NO: 9850 - RNA, 17 nt, Homo sapiens
gaggcggcggcggcggc

SEQ ID NO: 9851 - RNA, 23 nt, Homo sapiens
uccuggcccccugggcuugugaa

SEQ ID NO: 9852 - RNA, 19 nt, Homo sapiens
uggcagaaucaaauugcua

SEQ ID NO: 9853 - RNA, 21 nt, Homo sapiens
uggcccccugggcuugugaac

SEQ ID NO: 9854 - RNA, 19 nt, Homo sapiens
auacauauaaaaagggauu

SEQ ID NO: 9855 - RNA, 22 nt, Homo sapiens
ccuggggaacuuuagguuauuu

SEQ ID NO: 9856 - RNA, 19 nt, Homo sapiens
gguuuauuauuuauucauc

SEQ ID NO: 9857 - RNA, 21 nt, Homo sapiens
auaugucuaucaaauaccucu

SEQ ID NO: 9858 - RNA, 16 nt, Homo sapiens
ccacgcaacacuuccu

SEQ ID NO: 9859 - RNA, 20 nt, Homo sapiens
cugauucuuuguuugcaaua

SEQ ID NO: 9860 - RNA, 18 nt, Homo sapiens
ucuguaguaaaaugugaa

SEQ ID NO: 9861 - RNA, 20 nt, Homo sapiens
ugcccagguaugccuuccag

SEQ ID NO: 9862 - RNA, 20 nt, Homo sapiens
uguuacagcucauuguugag

SEQ ID NO: 9863 - RNA, 19 nt, Homo sapiens
agcuugaaccuagaucuca

SEQ ID NO: 9864 - RNA, 19 nt, Homo sapiens
ccccgggacccccuggagc

SEQ ID NO: 9865 - RNA, 23 nt, Homo sapiens
gcuuggaucaguaagucugguuc

SEQ ID NO: 9866 - RNA, 19 nt, Homo sapiens
aaagaaauuaauaggacca

SEQ ID NO: 9867 - RNA, 17 nt, Homo sapiens
aagaaauuaauaggacc

SEQ ID NO: 9868 - RNA, 20 nt, Homo sapiens
aaaagcaaucgcaggaggca

SEQ ID NO: 9869 - RNA, 19 nt, Homo sapiens
acacuuuggauacugugaa

SEQ ID NO: 9870 - RNA, 20 nt, Homo sapiens
augacgugguaaaaugugaa

SEQ ID NO: 9871 - RNA, 17 nt, Homo sapiens
cacaauucuaggaugaa

SEQ ID NO: 9872 - RNA, 21 nt, Homo sapiens
cucucauauaccacuacugga

SEQ ID NO: 9873 - RNA, 18 nt, Homo sapiens
gauuucauauuauagacu

SEQ ID NO: 9874 - RNA, 24 nt, Homo sapiens
uagaugguaaaaaaugugaaauug

SEQ ID NO: 9875 - RNA, 21 nt, Homo sapiens
cguaaaaaauacgaacggauc

SEQ ID NO: 9876 - RNA, 23 nt, Homo sapiens
uaaaaugcauuucugauaugcaa

SEQ ID NO: 9877 - RNA, 19 nt, Homo sapiens
agcauuuugaauuacuuuu

SEQ ID NO: 9878 - RNA, 18 nt, Homo sapiens
auuccccgcccucugaca

SEQ ID NO: 9879 - RNA, 24 nt, Homo sapiens
caagauugugauuagacacauuua

SEQ ID NO: 9880 - RNA, 20 nt, Homo sapiens
caccacccuacaccccccuc

SEQ ID NO: 9881 - RNA, 20 nt, Homo sapiens
cagagggucucuagggucug

SEQ ID NO: 9882 - RNA, 15 nt, Homo sapiens
ccagugcaaaggcua

SEQ ID NO: 9883 - RNA, 20 nt, Homo sapiens
ccauguagacauguugcaca

SEQ ID NO: 9884 - RNA, 21 nt, Homo sapiens
cccccgucagauucccuucca

SEQ ID NO: 9885 - RNA, 18 nt, Homo sapiens
ccccuccccccggcccca

SEQ ID NO: 9886 - RNA, 18 nt, Homo sapiens
cucauuuugauuguuaua

SEQ ID NO: 9887 - RNA, 21 nt, Homo sapiens
cugugguaacucauuuugauu

SEQ ID NO: 9888 - RNA, 19 nt, Homo sapiens
ggaagucuuccugucacau

SEQ ID NO: 9889 - RNA, 19 nt, Homo sapiens
ggaucccagggcacuguca

SEQ ID NO: 9890 - RNA, 18 nt, Homo sapiens
guggcuuguguucaggga

SEQ ID NO: 9891 - RNA, 17 nt, Homo sapiens
uccagggugacucucca

SEQ ID NO: 9892 - RNA, 22 nt, Homo sapiens
uucaccugugguaacucauuuu

SEQ ID NO: 9893 - RNA, 18 nt, Homo sapiens
uugagugcacuggcagga

SEQ ID NO: 9894 - RNA, 21 nt, Homo sapiens
uuuuuguugcauguauuugua

SEQ ID NO: 9895 - RNA, 20 nt, Homo sapiens
auggucugaauuguauaugu

SEQ ID NO: 9896 - RNA, 22 nt, Homo sapiens
guuaucacaugugaaagcuuuu

SEQ ID NO: 9897 - RNA, 20 nt, Homo sapiens
ucugcuuuaccucaguggua

SEQ ID NO: 9898 - RNA, 19 nt, Homo sapiens
ccaccuccuugcuacccca

SEQ ID NO: 9899 - RNA, 19 nt, Homo sapiens
aauaaaauucuauuacagu

SEQ ID NO: 9900 - RNA, 20 nt, Homo sapiens
uaccaaaacaaacaaacaga

SEQ ID NO: 9901 - RNA, 18 nt, Homo sapiens
uguguuggcacaugccug

SEQ ID NO: 9902 - RNA, 21 nt, Homo sapiens
gugugccaccacacuuggcua

SEQ ID NO: 9903 - RNA, 21 nt, Homo sapiens
ucauccccagccuccaccucc

SEQ ID NO: 9904 - RNA, 19 nt, Homo sapiens
aaacagaaacugaguguga

SEQ ID NO: 9905 - RNA, 25 nt, Homo sapiens
acaaaacaccacaaaacagacuuca

SEQ ID NO: 9906 - RNA, 17 nt, Homo sapiens
acauguuauugcaguga

SEQ ID NO: 9907 - RNA, 21 nt, Homo sapiens
ugguuuucuuaaauaccuaca

SEQ ID NO: 9908 - RNA, 20 nt, Homo sapiens
cgggcggggcggggccggcc

SEQ ID NO: 9909 - RNA, 19 nt, Homo sapiens
gacggcacuggguggggcc

SEQ ID NO: 9910 - RNA, 21 nt, Homo sapiens
ucuggaagacaguguugccca

SEQ ID NO: 9911 - RNA, 21 nt, Homo sapiens
ugccauccauguuugugcugu

SEQ ID NO: 9912 - RNA, 19 nt, Homo sapiens
aacucacagauggauacca

SEQ ID NO: 9913 - RNA, 20 nt, Homo sapiens
acccagugguagcuccacca

SEQ ID NO: 9914 - RNA, 19 nt, Homo sapiens
agauggauaccaacacggu

SEQ ID NO: 9915 - RNA, 20 nt, Homo sapiens
cagccccagaggauuccaua

SEQ ID NO: 9916 - RNA, 21 nt, Homo sapiens
gcaucagcuguaccuacaaua

SEQ ID NO: 9917 - RNA, 18 nt, Homo sapiens
cacuaugacacugagcaa

SEQ ID NO: 9918 - RNA, 20 nt, Homo sapiens
cagcaggaagccaggcugag

SEQ ID NO: 9919 - RNA, 20 nt, Homo sapiens
gauccugaaaaguguuauga

SEQ ID NO: 9920 - RNA, 21 nt, Homo sapiens
gugugucaccacgcucggcua

SEQ ID NO: 9921 - RNA, 18 nt, Homo sapiens
uccugaaaaguguuauga

SEQ ID NO: 9922 - RNA, 22 nt, Homo sapiens
aauuugguuucagaauggcuga

SEQ ID NO: 9923 - RNA, 23 nt, Homo sapiens
ggcacgauggcucaaaccuguaa

SEQ ID NO: 9924 - RNA, 24 nt, Homo sapiens
ugaaguuaugggugacuugaaaua

SEQ ID NO: 9925 - RNA, 17 nt, Homo sapiens
gcagcucaacguccugc

SEQ ID NO: 9926 - RNA, 16 nt, Homo sapiens
uuccagaauuugucca

SEQ ID NO: 9927 - RNA, 21 nt, Homo sapiens
agaaagaaaaaaaugggcauu

SEQ ID NO: 9928 - RNA, 18 nt, Homo sapiens
accgcgaccccggccgcc

SEQ ID NO: 9929 - RNA, 19 nt, Homo sapiens
gaccucugaaauugaugau

SEQ ID NO: 9930 - RNA, 21 nt, Homo sapiens
uuugucaguguguuuuuuuaa

SEQ ID NO: 9931 - RNA, 17 nt, Homo sapiens
aguguguguucauugua

SEQ ID NO: 9932 - RNA, 21 nt, Homo sapiens
gcagaacuaagcucaguaugu

SEQ ID NO: 9933 - RNA, 19 nt, Homo sapiens
aagcgauucucccaccuca

SEQ ID NO: 9934 - RNA, 25 nt, Homo sapiens
auccaugaccaaauuaaauaugaaa

SEQ ID NO: 9935 - RNA, 21 nt, Homo sapiens
aucuuggcucagugcaaccuc

SEQ ID NO: 9936 - RNA, 18 nt, Homo sapiens
ccacaauugucacaugac

SEQ ID NO: 9937 - RNA, 17 nt, Homo sapiens
guuguccccugcacuuc

SEQ ID NO: 9938 - RNA, 17 nt, Homo sapiens
ucaagcgauucucgugc

SEQ ID NO: 9939 - RNA, 23 nt, Homo sapiens
ucagaccuucccugguuuaccuu

SEQ ID NO: 9940 - RNA, 18 nt, Homo sapiens
uccgccuccuggguucaa

SEQ ID NO: 9941 - RNA, 20 nt, Homo sapiens
ugucuguggaguuuuaggag

SEQ ID NO: 9942 - RNA, 18 nt, Homo sapiens
uuguaagauccaucuaca

SEQ ID NO: 9943 - RNA, 16 nt, Homo sapiens
gccuucuuuuuucuca

SEQ ID NO: 9944 - RNA, 20 nt, Homo sapiens
uaaucagcagaauuacuuuu

SEQ ID NO: 9945 - RNA, 22 nt, Homo sapiens
aaaccacucuccacagcuuuuu

SEQ ID NO: 9946 - RNA, 21 nt, Homo sapiens
acuuaacugagauccagcaaa

SEQ ID NO: 9947 - RNA, 22 nt, Homo sapiens
ccccaccuaagucgagacagua

SEQ ID NO: 9948 - RNA, 19 nt, Homo sapiens
aaaacauaugugauucuca

SEQ ID NO: 9949 - RNA, 15 nt, Homo sapiens
cagaauagcucuuua

SEQ ID NO: 9950 - RNA, 21 nt, Homo sapiens
uaagaguuuuaaugccagugc

SEQ ID NO: 9951 - RNA, 23 nt, Homo sapiens
ugcauuucaaguuaaaugucuua

SEQ ID NO: 9952 - RNA, 19 nt, Homo sapiens
uguaguagauauuacugaa

SEQ ID NO: 9953 - RNA, 20 nt, Homo sapiens
uugaaauauauuuugcauua

SEQ ID NO: 9954 - RNA, 18 nt, Homo sapiens
ccuggccccacgcagcuc

SEQ ID NO: 9955 - RNA, 21 nt, Homo sapiens
cgagcuuccccgcaccggcca

SEQ ID NO: 9956 - RNA, 18 nt, Homo sapiens
agcgcaccccgcugacuc

SEQ ID NO: 9957 - RNA, 19 nt, Homo sapiens
aaggaaccaagcugacaca

SEQ ID NO: 9958 - RNA, 19 nt, Homo sapiens
caccauuucggacaccccg

SEQ ID NO: 9959 - RNA, 24 nt, Homo sapiens
cccguuaauaaaaaccaauguagg

SEQ ID NO: 9960 - RNA, 22 nt, Homo sapiens
gcggcugcgagggacuuuguca

SEQ ID NO: 9961 - RNA, 22 nt, Homo sapiens
caagacucuuuggguccauuca

SEQ ID NO: 9962 - RNA, 18 nt, Homo sapiens
ccagcugcagaccaugcc

SEQ ID NO: 9963 - RNA, 23 nt, Homo sapiens
gcccccaguuaauacuccagaga

SEQ ID NO: 9964 - RNA, 24 nt, Homo sapiens
ggagacccuggcggcggcggcggc

SEQ ID NO: 9965 - RNA, 20 nt, Homo sapiens
acuacugaugguuuaugaca

SEQ ID NO: 9966 - RNA, 22 nt, Homo sapiens
gauugcaaaacaguucuuuuaa

SEQ ID NO: 9967 - RNA, 18 nt, Homo sapiens
uaguuuuuuguuuuuguu

SEQ ID NO: 9968 - RNA, 22 nt, Homo sapiens
ucauuugacuggaaaaaaauaa

SEQ ID NO: 9969 - RNA, 19 nt, Homo sapiens
ugaccaccuggugccagcu

SEQ ID NO: 9970 - RNA, 17 nt, Homo sapiens
uuugcacagugcacuua

SEQ ID NO: 9971 - RNA, 18 nt, Homo sapiens
agcacugccuuuacuuca

SEQ ID NO: 9972 - RNA, 19 nt, Homo sapiens
cagcacaaggaauuucccu

SEQ ID NO: 9973 - RNA, 19 nt, Homo sapiens
uaaaaacaaaacaaacaaa

SEQ ID NO: 9974 - RNA, 22 nt, Homo sapiens
ugagaucaaaguggugggguca

SEQ ID NO: 9975 - RNA, 20 nt, Homo sapiens
uuuccaauauccucaugaca

SEQ ID NO: 9976 - RNA, 22 nt, Homo sapiens
agcacuuaaguguuagaucuaa

SEQ ID NO: 9977 - RNA, 20 nt, Homo sapiens
ucagaacaaaacuucuauua

SEQ ID NO: 9978 - RNA, 22 nt, Homo sapiens
ugaguacaccuaugugaaacug

SEQ ID NO: 9979 - RNA, 20 nt, Homo sapiens
uugauguauuucuccauccu

SEQ ID NO: 9980 - RNA, 15 nt, Homo sapiens
uccuccagcaucuca

SEQ ID NO: 9981 - RNA, 19 nt, Homo sapiens
ccugguggaugccugguuc

SEQ ID NO: 9982 - RNA, 17 nt, Homo sapiens
cugcccugguugugugg

SEQ ID NO: 9983 - RNA, 23 nt, Homo sapiens
cuugaguuuuacaaguuauuuuu

SEQ ID NO: 9984 - RNA, 19 nt, Homo sapiens
gcucagcgcuugugcucug

SEQ ID NO: 9985 - RNA, 21 nt, Homo sapiens
uccuccaccauuggccguagc

SEQ ID NO: 9986 - RNA, 26 nt, Homo sapiens
ugaagaccaguucugaggugaagcug

SEQ ID NO: 9987 - RNA, 19 nt, Homo sapiens
agcaaaacaagugacauga

SEQ ID NO: 9988 - RNA, 20 nt, Homo sapiens
ccagcacauagcuugccuaa

SEQ ID NO: 9989 - RNA, 20 nt, Homo sapiens
ccucagcuccccggcacugc

SEQ ID NO: 9990 - RNA, 21 nt, Homo sapiens
gccugggccuuggcugggccu

SEQ ID NO: 9991 - RNA, 23 nt, Homo sapiens
agaaaaaagaagacuuuuccaac

SEQ ID NO: 9992 - RNA, 18 nt, Homo sapiens
agaaaaauuugaagucug

SEQ ID NO: 9993 - RNA, 16 nt, Homo sapiens
gcauuaagauagggug

SEQ ID NO: 9994 - RNA, 25 nt, Homo sapiens
gcuugcuguggugguugccuagccc

SEQ ID NO: 9995 - RNA, 22 nt, Homo sapiens
ggugcccaggauagauguaaua

SEQ ID NO: 9996 - RNA, 20 nt, Homo sapiens
guccugaauucuacauuauu

SEQ ID NO: 9997 - RNA, 19 nt, Homo sapiens
ucucugcaaugccucaagg

SEQ ID NO: 9998 - RNA, 23 nt, Homo sapiens
ugacuuuuaccuuuuacagcgua

SEQ ID NO: 9999 - RNA, 19 nt, Homo sapiens
aacguucaacguacaaaca

SEQ ID NO: 10000 - RNA, 24 nt, Homo sapiens
aauggugcagaaagagauaccuuu

SEQ ID NO: 10001 - RNA, 22 nt, Homo sapiens
acuuuucuaaguacuuauacau

SEQ ID NO: 10002 - RNA, 22 nt, Homo sapiens
cgcgcugccuccggugccgcug

SEQ ID NO: 10003 - RNA, 16 nt, Homo sapiens
cuuucuuuccauggca

SEQ ID NO: 10004 - RNA, 19 nt, Homo sapiens
uugaugacuucuuguggca

SEQ ID NO: 10005 - RNA, 18 nt, Homo sapiens
aggacccagaagcuccuc

SEQ ID NO: 10006 - RNA, 19 nt, Homo sapiens
cgggaguuuuguaccacuu

SEQ ID NO: 10007 - RNA, 20 nt, Homo sapiens
caccucagccucucaaguaa

SEQ ID NO: 10008 - RNA, 23 nt, Homo sapiens
cuucucagguugcuucuuacaca

SEQ ID NO: 10009 - RNA, 19 nt, Homo sapiens
uaucuuggccuaaaccuca

SEQ ID NO: 10010 - RNA, 20 nt, Homo sapiens
uggccaggcuggucuugaac

SEQ ID NO: 10011 - RNA, 20 nt, Homo sapiens
cucaggagaagcccccacua

SEQ ID NO: 10012 - RNA, 18 nt, Homo sapiens
ggagcuuggcaugggcua

SEQ ID NO: 10013 - RNA, 16 nt, Homo sapiens
acguaacuggcugcag

SEQ ID NO: 10014 - RNA, 18 nt, Homo sapiens
agugacuuucucgcaccc

SEQ ID NO: 10015 - RNA, 17 nt, Homo sapiens
ccaaguuuauuaugagg

SEQ ID NO: 10016 - RNA, 22 nt, Homo sapiens
ucuuuguuguuguuuuuauuuu

SEQ ID NO: 10017 - RNA, 18 nt, Homo sapiens
uuggguucgggucacugc

SEQ ID NO: 10018 - RNA, 22 nt, Homo sapiens
cccugauggggccugaccgcgg

SEQ ID NO: 10019 - RNA, 19 nt, Homo sapiens
ccuccucggcccgucccca

SEQ ID NO: 10020 - RNA, 21 nt, Homo sapiens
gagggcagguuccaagccaca

SEQ ID NO: 10021 - RNA, 22 nt, Homo sapiens
gccugggcccagcgagccccca

SEQ ID NO: 10022 - RNA, 19 nt, Homo sapiens
ggacagggugaggcuccca

SEQ ID NO: 10023 - RNA, 18 nt, Homo sapiens
caucacccgccucacagg

SEQ ID NO: 10024 - RNA, 16 nt, Homo sapiens
ggcccgcccugcagug

SEQ ID NO: 10025 - RNA, 22 nt, Homo sapiens
guggacgagaacacguucucca

SEQ ID NO: 10026 - RNA, 18 nt, Homo sapiens
ugccgauccggccugcga

SEQ ID NO: 10027 - RNA, 25 nt, Homo sapiens
aaaauauuccucugaugugaaauua

SEQ ID NO: 10028 - RNA, 18 nt, Homo sapiens
caaauauccuggugcgau

SEQ ID NO: 10029 - RNA, 22 nt, Homo sapiens
gagccaagaucgcgccacugca

SEQ ID NO: 10030 - RNA, 20 nt, Homo sapiens
guaacauauagucuacuaua

SEQ ID NO: 10031 - RNA, 26 nt, Homo sapiens
auccccagcuagacuaguguuggaga

SEQ ID NO: 10032 - RNA, 18 nt, Homo sapiens
aaauaagguaguacuuuu

SEQ ID NO: 10033 - RNA, 19 nt, Homo sapiens
gguaauuguaggguaauac

SEQ ID NO: 10034 - RNA, 20 nt, Homo sapiens
ucuuaaauaguguaacuaua

SEQ ID NO: 10035 - RNA, 22 nt, Homo sapiens
ucuuuuuaaaugcuuuaucuuu

SEQ ID NO: 10036 - RNA, 21 nt, Homo sapiens
ucaguccugccagcagccgca

SEQ ID NO: 10037 - RNA, 18 nt, Homo sapiens
ccagucucacaggaguca

SEQ ID NO: 10038 - RNA, 24 nt, Homo sapiens
ggcuuguuuccugaacguuggccg

SEQ ID NO: 10039 - RNA, 23 nt, Homo sapiens
uuggccggcggaggacccgcgag

SEQ ID NO: 10040 - RNA, 16 nt, Homo sapiens
cacaccccucuccccu

SEQ ID NO: 10041 - RNA, 17 nt, Homo sapiens
caggagaaacugcagcc

SEQ ID NO: 10042 - RNA, 19 nt, Homo sapiens
gaaaggcacuccaaccuca

SEQ ID NO: 10043 - RNA, 20 nt, Homo sapiens
gcccccauuucuccauuucu

SEQ ID NO: 10044 - RNA, 25 nt, Homo sapiens
uuugugugucugcaucuccaucuua

SEQ ID NO: 10045 - RNA, 19 nt, Homo sapiens
cuugggcaggaccugugag

SEQ ID NO: 10046 - RNA, 20 nt, Homo sapiens
gggcuucaggggcuccuguc

SEQ ID NO: 10047 - RNA, 20 nt, Homo sapiens
gggcuucaggggcuccuguc

SEQ ID NO: 10048 - RNA, 18 nt, Homo sapiens
ucagucguguguacugua

SEQ ID NO: 10049 - RNA, 20 nt, Homo sapiens
ucccagaacccacagugggc

SEQ ID NO: 10050 - RNA, 21 nt, Homo sapiens
uccugggccagggccugaugg

SEQ ID NO: 10051 - RNA, 20 nt, Homo sapiens
acgagcucucgcccacucgc

SEQ ID NO: 10052 - RNA, 19 nt, Homo sapiens
caccacugugacccccuuc

SEQ ID NO: 10053 - RNA, 18 nt, Homo sapiens
ccauggucacugccucag

SEQ ID NO: 10054 - RNA, 22 nt, Homo sapiens
ccccuccagggggacugcucca

SEQ ID NO: 10055 - RNA, 19 nt, Homo sapiens
cugggggacccucugaagc

SEQ ID NO: 10056 - RNA, 24 nt, Homo sapiens
gcauuucugccucacuuuauguca

SEQ ID NO: 10057 - RNA, 18 nt, Homo sapiens
uccagggggacugcucca

SEQ ID NO: 10058 - RNA, 20 nt, Homo sapiens
agucacuaucuuggguaaca

SEQ ID NO: 10059 - RNA, 17 nt, Homo sapiens
cagcaaauauuaacuua

SEQ ID NO: 10060 - RNA, 23 nt, Homo sapiens
ugagugggguugggcauaggcug

SEQ ID NO: 10061 - RNA, 17 nt, Homo sapiens
uguucuaagacugccua

SEQ ID NO: 10062 - RNA, 15 nt, Homo sapiens
cauuuccccugguga

SEQ ID NO: 10063 - RNA, 17 nt, Homo sapiens
cuugaguagacaaaggc

SEQ ID NO: 10064 - RNA, 19 nt, Homo sapiens
uggagcaaggggaggguga

SEQ ID NO: 10065 - RNA, 20 nt, Homo sapiens
aaaguuuuaaaaguccucca

SEQ ID NO: 10066 - RNA, 18 nt, Homo sapiens
aagaccacccuaccagcc

SEQ ID NO: 10067 - RNA, 18 nt, Homo sapiens
caggcuccugcugcccua

SEQ ID NO: 10068 - RNA, 19 nt, Homo sapiens
cuggcaacaaccacuuccu

SEQ ID NO: 10069 - RNA, 21 nt, Homo sapiens
aaccauaugcauuucaccuca

SEQ ID NO: 10070 - RNA, 22 nt, Homo sapiens
agaaaucacaacagcgcuggaa

SEQ ID NO: 10071 - RNA, 18 nt, Homo sapiens
ccugggccguaucugucu

SEQ ID NO: 10072 - RNA, 19 nt, Homo sapiens
aaggaucuauacccuccug

SEQ ID NO: 10073 - RNA, 20 nt, Homo sapiens
agagaggguggauaagcucc

SEQ ID NO: 10074 - RNA, 19 nt, Homo sapiens
cgagugcucaccugcccca

SEQ ID NO: 10075 - RNA, 24 nt, Homo sapiens
gcaaaagcuguggcugccaggccu

SEQ ID NO: 10076 - RNA, 24 nt, Homo sapiens
gcuuggggaccccucccugccccu

SEQ ID NO: 10077 - RNA, 23 nt, Homo sapiens
uucugcccuuucccacaccuuug

SEQ ID NO: 10078 - RNA, 19 nt, Homo sapiens
aaacacagaagaaacguga

SEQ ID NO: 10079 - RNA, 18 nt, Homo sapiens
acccaccgcaaccucauc

SEQ ID NO: 10080 - RNA, 22 nt, Homo sapiens
agggggaucccaucucuacaca

SEQ ID NO: 10081 - RNA, 21 nt, Homo sapiens
gagaagaaagccauguggcgg

SEQ ID NO: 10082 - RNA, 24 nt, Homo sapiens
gcaaccucauccccucagcacuaa

SEQ ID NO: 10083 - RNA, 17 nt, Homo sapiens
ggaucaaacucugcuuc

SEQ ID NO: 10084 - RNA, 21 nt, Homo sapiens
gugugugugcacgcauggcug

SEQ ID NO: 10085 - RNA, 19 nt, Homo sapiens
uaugauuguaccacugcac

SEQ ID NO: 10086 - RNA, 22 nt, Homo sapiens
uuucugucaaugucaccaggga

SEQ ID NO: 10087 - RNA, 19 nt, Homo sapiens
cuuaacgguccucuggucu

SEQ ID NO: 10088 - RNA, 22 nt, Homo sapiens
gggacgcggcggcggcggcggc

SEQ ID NO: 10089 - RNA, 19 nt, Homo sapiens
cagcaucacacugacacuc

SEQ ID NO: 10090 - RNA, 21 nt, Homo sapiens
cagggaucuuuuucugccccu

SEQ ID NO: 10091 - RNA, 17 nt, Homo sapiens
ccccggcccccagcaca

SEQ ID NO: 10092 - RNA, 18 nt, Homo sapiens
cuucaggcccagcacugc

SEQ ID NO: 10093 - RNA, 16 nt, Homo sapiens
augcugcaguuaacac

SEQ ID NO: 10094 - RNA, 21 nt, Homo sapiens
ccagaugcccaccucauccaa

SEQ ID NO: 10095 - RNA, 18 nt, Homo sapiens
ccugcaaccuccaccucc

SEQ ID NO: 10096 - RNA, 23 nt, Homo sapiens
gguacuucguagacucugccuca

SEQ ID NO: 10097 - RNA, 20 nt, Homo sapiens
ucgccaagcaguaucuccug

SEQ ID NO: 10098 - RNA, 20 nt, Homo sapiens
ugcuguuaguaacuguguga

SEQ ID NO: 10099 - RNA, 23 nt, Homo sapiens
uggaguacaguagugcaaucuca

SEQ ID NO: 10100 - RNA, 22 nt, Homo sapiens
uguuggcaacaguuccauguca

SEQ ID NO: 10101 - RNA, 19 nt, Homo sapiens
uuuccuucaggcucuguga

SEQ ID NO: 10102 - RNA, 25 nt, Homo sapiens
uuuucauuguguauuugcaccauca

SEQ ID NO: 10103 - RNA, 17 nt, Homo sapiens
caccagcgcuccucgca

SEQ ID NO: 10104 - RNA, 25 nt, Homo sapiens
gccuggaaguccaccugucuggucc

SEQ ID NO: 10105 - RNA, 22 nt, Homo sapiens
gcuguggaauaaguuguguuug

SEQ ID NO: 10106 - RNA, 22 nt, Homo sapiens
ggccagccgcggcccuuggccc

SEQ ID NO: 10107 - RNA, 19 nt, Homo sapiens
ucugauauacccaaugugu

SEQ ID NO: 10108 - RNA, 19 nt, Homo sapiens
ucauuugaguacccaaaua

SEQ ID NO: 10109 - RNA, 18 nt, Homo sapiens
acucaucucuuaauuugc

SEQ ID NO: 10110 - RNA, 19 nt, Homo sapiens
ccccacaaaagauaacuca

SEQ ID NO: 10111 - RNA, 20 nt, Homo sapiens
auucacaggucaccccucuc

SEQ ID NO: 10112 - RNA, 21 nt, Homo sapiens
cucagcagcuccccagcacca

SEQ ID NO: 10113 - RNA, 18 nt, Homo sapiens
gccucaaccacaauucuu

SEQ ID NO: 10114 - RNA, 21 nt, Homo sapiens
ucuaggggccugcuccucuaa

SEQ ID NO: 10115 - RNA, 19 nt, Homo sapiens
ucugagcucacgcuggcuc

SEQ ID NO: 10116 - RNA, 18 nt, Homo sapiens
auagaaaaagaauugguu

SEQ ID NO: 10117 - RNA, 21 nt, Homo sapiens
auguauuuauaaaguuuuucc

SEQ ID NO: 10118 - RNA, 22 nt, Homo sapiens
cuuaucuuugccuuacugauca

SEQ ID NO: 10119 - RNA, 19 nt, Homo sapiens
agccacgcuguuuaccuca

SEQ ID NO: 10120 - RNA, 21 nt, Homo sapiens
cuuugucguggagaucuggaa

SEQ ID NO: 10121 - RNA, 18 nt, Homo sapiens
cgcuacuguccuguccuc

SEQ ID NO: 10122 - RNA, 21 nt, Homo sapiens
ugcgggcugccucaccuccuc

SEQ ID NO: 10123 - RNA, 19 nt, Homo sapiens
accuccgacucccugguuc

SEQ ID NO: 10124 - RNA, 22 nt, Homo sapiens
acuggacaauguuacgcuagaa

SEQ ID NO: 10125 - RNA, 18 nt, Homo sapiens
cagaacauaucaucacug

SEQ ID NO: 10126 - RNA, 19 nt, Homo sapiens
cauccucuucugucccugg

SEQ ID NO: 10127 - RNA, 22 nt, Homo sapiens
ccuccucacucaggcuguugua

SEQ ID NO: 10128 - RNA, 18 nt, Homo sapiens
cuccauguagauaagagc

SEQ ID NO: 10129 - RNA, 22 nt, Homo sapiens
cucccccucccuugugguuuca

SEQ ID NO: 10130 - RNA, 19 nt, Homo sapiens
cuguuuugugaugccccca

SEQ ID NO: 10131 - RNA, 18 nt, Homo sapiens
gauaaccagcuaauccca

SEQ ID NO: 10132 - RNA, 19 nt, Homo sapiens
uaauuucacaaccguuauc

SEQ ID NO: 10133 - RNA, 22 nt, Homo sapiens
uccugauaacaagacucugugg

SEQ ID NO: 10134 - RNA, 19 nt, Homo sapiens
aggggccacacuggaccau

SEQ ID NO: 10135 - RNA, 22 nt, Homo sapiens
cccugcuccagcccaguucuca

SEQ ID NO: 10136 - RNA, 17 nt, Homo sapiens
acuucgccaacucgcca

SEQ ID NO: 10137 - RNA, 18 nt, Homo sapiens
agucgugcgccccccgcc

SEQ ID NO: 10138 - RNA, 18 nt, Homo sapiens
cucccgcuccucugccuc

SEQ ID NO: 10139 - RNA, 19 nt, Homo sapiens
cugccuugccccuaccuca

SEQ ID NO: 10140 - RNA, 22 nt, Homo sapiens
gccccucucucccucugccccu

SEQ ID NO: 10141 - RNA, 22 nt, Homo sapiens
gcuucucucccccucugucucu

SEQ ID NO: 10142 - RNA, 17 nt, Homo sapiens
acuucgccaacucgcca

SEQ ID NO: 10143 - RNA, 18 nt, Homo sapiens
agucgugcgccccccgcc

SEQ ID NO: 10144 - RNA, 18 nt, Homo sapiens
cucccgcuccucugccuc

SEQ ID NO: 10145 - RNA, 19 nt, Homo sapiens
cugccuugccccuaccuca

SEQ ID NO: 10146 - RNA, 22 nt, Homo sapiens
gccccucucucccucugccccu

SEQ ID NO: 10147 - RNA, 22 nt, Homo sapiens
gcuucucucccccucugucucu

SEQ ID NO: 10148 - RNA, 24 nt, Homo sapiens
ggcgcgcaaacuugaguuacuuuu

SEQ ID NO: 10149 - RNA, 24 nt, Homo sapiens
acauaauuccagucacaguuuuug

SEQ ID NO: 10150 - RNA, 18 nt, Homo sapiens
cgacaacuucgcagccca

SEQ ID NO: 10151 - RNA, 23 nt, Homo sapiens
caccacagccaucgccacugcca

SEQ ID NO: 10152 - RNA, 19 nt, Homo sapiens
ccugcuucccaaacuccca

SEQ ID NO: 10153 - RNA, 22 nt, Homo sapiens
cuguggauaacauugcuagcga

SEQ ID NO: 10154 - RNA, 23 nt, Homo sapiens
caacaaagaggauuagacaguaa

SEQ ID NO: 10155 - RNA, 20 nt, Homo sapiens
cugcuuuacuguguaucuca

SEQ ID NO: 10156 - RNA, 19 nt, Homo sapiens
ucuuuuugauuuuuaaauc

SEQ ID NO: 10157 - RNA, 18 nt, Homo sapiens
ugguuuuuguugcuuuuu

SEQ ID NO: 10158 - RNA, 20 nt, Homo sapiens
uuuggagagugggcugacau

SEQ ID NO: 10159 - RNA, 23 nt, Homo sapiens
caacaaagaggauuagacaguaa

SEQ ID NO: 10160 - RNA, 19 nt, Homo sapiens
ccugaacaaugucaacaag

SEQ ID NO: 10161 - RNA, 20 nt, Homo sapiens
cugcuuuacuguguaucuca

SEQ ID NO: 10162 - RNA, 22 nt, Homo sapiens
gaaaacauucacaaaaugggua

SEQ ID NO: 10163 - RNA, 19 nt, Homo sapiens
ucuuuuugauuuuuaaauc

SEQ ID NO: 10164 - RNA, 18 nt, Homo sapiens
ugguuuuuguugcuuuuu

SEQ ID NO: 10165 - RNA, 20 nt, Homo sapiens
uuuggagagugggcugacau

SEQ ID NO: 10166 - RNA, 23 nt, Homo sapiens
caacaaagaggauuagacaguaa

SEQ ID NO: 10167 - RNA, 17 nt, Homo sapiens
caacagggaaaucagca

SEQ ID NO: 10168 - RNA, 20 nt, Homo sapiens
cugcuuuacuguguaucuca

SEQ ID NO: 10169 - RNA, 19 nt, Homo sapiens
ucuuuuugauuuuuaaauc

SEQ ID NO: 10170 - RNA, 18 nt, Homo sapiens
ugguuuuuguugcuuuuu

SEQ ID NO: 10171 - RNA, 20 nt, Homo sapiens
uuuggagagugggcugacau

SEQ ID NO: 10172 - RNA, 23 nt, Homo sapiens
caacaaagaggauuagacaguaa

SEQ ID NO: 10173 - RNA, 17 nt, Homo sapiens
caacagggaaaucagca

SEQ ID NO: 10174 - RNA, 19 nt, Homo sapiens
ccugaacaaugucaacaag

SEQ ID NO: 10175 - RNA, 20 nt, Homo sapiens
cugcuuuacuguguaucuca

SEQ ID NO: 10176 - RNA, 22 nt, Homo sapiens
gaaaacauucacaaaaugggua

SEQ ID NO: 10177 - RNA, 19 nt, Homo sapiens
ucuuuuugauuuuuaaauc

SEQ ID NO: 10178 - RNA, 18 nt, Homo sapiens
ugguuuuuguugcuuuuu

SEQ ID NO: 10179 - RNA, 20 nt, Homo sapiens
uuuggagagugggcugacau

SEQ ID NO: 10180 - RNA, 23 nt, Homo sapiens
caacaaagaggauuagacaguaa

SEQ ID NO: 10181 - RNA, 20 nt, Homo sapiens
cugcuuuacuguguaucuca

SEQ ID NO: 10182 - RNA, 19 nt, Homo sapiens
ucuuuuugauuuuuaaauc

SEQ ID NO: 10183 - RNA, 18 nt, Homo sapiens
ugguuuuuguugcuuuuu

SEQ ID NO: 10184 - RNA, 20 nt, Homo sapiens
uuuggagagugggcugacau

SEQ ID NO: 10185 - RNA, 23 nt, Homo sapiens
caacaaagaggauuagacaguaa

SEQ ID NO: 10186 - RNA, 20 nt, Homo sapiens
cugcuuuacuguguaucuca

SEQ ID NO: 10187 - RNA, 19 nt, Homo sapiens
ucuuuuugauuuuuaaauc

SEQ ID NO: 10188 - RNA, 18 nt, Homo sapiens
ugguuuuuguugcuuuuu

SEQ ID NO: 10189 - RNA, 20 nt, Homo sapiens
uuuggagagugggcugacau

SEQ ID NO: 10190 - RNA, 21 nt, Homo sapiens
aaaaacagaugccaguauucu

SEQ ID NO: 10191 - RNA, 23 nt, Homo sapiens
caacaaagaggauuagacaguaa

SEQ ID NO: 10192 - RNA, 21 nt, Homo sapiens
cucuggugacacaaccugugg

SEQ ID NO: 10193 - RNA, 20 nt, Homo sapiens
cugcuuuacuguguaucuca

SEQ ID NO: 10194 - RNA, 20 nt, Homo sapiens
gcaagucaaguuacuggugg

SEQ ID NO: 10195 - RNA, 16 nt, Homo sapiens
ggacugaccacuauug

SEQ ID NO: 10196 - RNA, 19 nt, Homo sapiens
guugccccugcgccaggga

SEQ ID NO: 10197 - RNA, 19 nt, Homo sapiens
uccucaaaaacagaugcca

SEQ ID NO: 10198 - RNA, 19 nt, Homo sapiens
ucuuuuugauuuuuaaauc

SEQ ID NO: 10199 - RNA, 18 nt, Homo sapiens
ugguuuuuguugcuuuuu

SEQ ID NO: 10200 - RNA, 20 nt, Homo sapiens
ugucagacagaaaaaagagg

SEQ ID NO: 10201 - RNA, 20 nt, Homo sapiens
uuuggagagugggcugacau

SEQ ID NO: 10202 - RNA, 23 nt, Homo sapiens
caacaaagaggauuagacaguaa

SEQ ID NO: 10203 - RNA, 20 nt, Homo sapiens
cugcuuuacuguguaucuca

SEQ ID NO: 10204 - RNA, 19 nt, Homo sapiens
ucuuuuugauuuuuaaauc

SEQ ID NO: 10205 - RNA, 18 nt, Homo sapiens
ugguuuuuguugcuuuuu

SEQ ID NO: 10206 - RNA, 20 nt, Homo sapiens
uuuggagagugggcugacau

SEQ ID NO: 10207 - RNA, 23 nt, Homo sapiens
caacaaagaggauuagacaguaa

SEQ ID NO: 10208 - RNA, 20 nt, Homo sapiens
cugcuuuacuguguaucuca

SEQ ID NO: 10209 - RNA, 19 nt, Homo sapiens
ucuuuuugauuuuuaaauc

SEQ ID NO: 10210 - RNA, 18 nt, Homo sapiens
ugguuuuuguugcuuuuu

SEQ ID NO: 10211 - RNA, 20 nt, Homo sapiens
uuuggagagugggcugacau

SEQ ID NO: 10212 - RNA, 23 nt, Homo sapiens
caacaaagaggauuagacaguaa

SEQ ID NO: 10213 - RNA, 20 nt, Homo sapiens
cugcuuuacuguguaucuca

SEQ ID NO: 10214 - RNA, 19 nt, Homo sapiens
ucuuuuugauuuuuaaauc

SEQ ID NO: 10215 - RNA, 18 nt, Homo sapiens
ugguuuuuguugcuuuuu

SEQ ID NO: 10216 - RNA, 20 nt, Homo sapiens
uuuggagagugggcugacau

SEQ ID NO: 10217 - RNA, 21 nt, Homo sapiens
aaaaacagaugccaguauucu

SEQ ID NO: 10218 - RNA, 23 nt, Homo sapiens
caacaaagaggauuagacaguaa

SEQ ID NO: 10219 - RNA, 21 nt, Homo sapiens
cucuggugacacaaccugugg

SEQ ID NO: 10220 - RNA, 20 nt, Homo sapiens
cugcuuuacuguguaucuca

SEQ ID NO: 10221 - RNA, 20 nt, Homo sapiens
gcaagucaaguuacuggugg

SEQ ID NO: 10222 - RNA, 16 nt, Homo sapiens
ggacugaccacuauug

SEQ ID NO: 10223 - RNA, 19 nt, Homo sapiens
guugccccugcgccaggga

SEQ ID NO: 10224 - RNA, 19 nt, Homo sapiens
uccucaaaaacagaugcca

SEQ ID NO: 10225 - RNA, 19 nt, Homo sapiens
ucuuuuugauuuuuaaauc

SEQ ID NO: 10226 - RNA, 18 nt, Homo sapiens
ugguuuuuguugcuuuuu

SEQ ID NO: 10227 - RNA, 20 nt, Homo sapiens
ugucagacagaaaaaagagg

SEQ ID NO: 10228 - RNA, 20 nt, Homo sapiens
uuuggagagugggcugacau

SEQ ID NO: 10229 - RNA, 21 nt, Homo sapiens
aaaaacagaugccaguauucu

SEQ ID NO: 10230 - RNA, 23 nt, Homo sapiens
caacaaagaggauuagacaguaa

SEQ ID NO: 10231 - RNA, 21 nt, Homo sapiens
cucuggugacacaaccugugg

SEQ ID NO: 10232 - RNA, 20 nt, Homo sapiens
cugcuuuacuguguaucuca

SEQ ID NO: 10233 - RNA, 20 nt, Homo sapiens
gcaagucaaguuacuggugg

SEQ ID NO: 10234 - RNA, 16 nt, Homo sapiens
ggacugaccacuauug

SEQ ID NO: 10235 - RNA, 19 nt, Homo sapiens
guugccccugcgccaggga

SEQ ID NO: 10236 - RNA, 19 nt, Homo sapiens
uccucaaaaacagaugcca

SEQ ID NO: 10237 - RNA, 19 nt, Homo sapiens
ucuuuuugauuuuuaaauc

SEQ ID NO: 10238 - RNA, 18 nt, Homo sapiens
ugguuuuuguugcuuuuu

SEQ ID NO: 10239 - RNA, 20 nt, Homo sapiens
ugucagacagaaaaaagagg

SEQ ID NO: 10240 - RNA, 20 nt, Homo sapiens
uuuggagagugggcugacau

SEQ ID NO: 10241 - RNA, 18 nt, Homo sapiens
acaggccgccucuguggc

SEQ ID NO: 10242 - RNA, 19 nt, Homo sapiens
aggguugugcuuucuagca

SEQ ID NO: 10243 - RNA, 17 nt, Homo sapiens
ccugaagccauuggaga

SEQ ID NO: 10244 - RNA, 22 nt, Homo sapiens
gccccggugugucccaggaguc

SEQ ID NO: 10245 - RNA, 21 nt, Homo sapiens
ggaguccucauugaauccuca

SEQ ID NO: 10246 - RNA, 17 nt, Homo sapiens
ucaagauauucaggugg

SEQ ID NO: 10247 - RNA, 19 nt, Homo sapiens
ggcucuggcgcgccagccg

SEQ ID NO: 10248 - RNA, 18 nt, Homo sapiens
cuguagcccccucugcca

SEQ ID NO: 10249 - RNA, 21 nt, Homo sapiens
caccuagagggcacgcagcgu

SEQ ID NO: 10250 - RNA, 18 nt, Homo sapiens
cuguagcccccucugcca

SEQ ID NO: 10251 - RNA, 20 nt, Homo sapiens
guccagcgccaacagccucu

SEQ ID NO: 10252 - RNA, 18 nt, Homo sapiens
cuguagcccccucugcca

SEQ ID NO: 10253 - RNA, 17 nt, Homo sapiens
cuacauacaaucaaugu

SEQ ID NO: 10254 - RNA, 21 nt, Homo sapiens
ugcuugguuugcacauguugu

SEQ ID NO: 10255 - RNA, 19 nt, Homo sapiens
uuccagagcccucguucca

SEQ ID NO: 10256 - RNA, 18 nt, Homo sapiens
ucaagacuuugcucucca

SEQ ID NO: 10257 - RNA, 19 nt, Homo sapiens
agcugggggcuccuugcca

SEQ ID NO: 10258 - RNA, 16 nt, Homo sapiens
augcugggcugccugg

SEQ ID NO: 10259 - RNA, 18 nt, Homo sapiens
caaccccuccuuuccccu

SEQ ID NO: 10260 - RNA, 20 nt, Homo sapiens
ccuccuuuccccugcccuug

SEQ ID NO: 10261 - RNA, 24 nt, Homo sapiens
cuagaauacagucugggucccaca

SEQ ID NO: 10262 - RNA, 20 nt, Homo sapiens
gccucaggaguccuugggga

SEQ ID NO: 10263 - RNA, 22 nt, Homo sapiens
gugguuuucaaacugcuuggca

SEQ ID NO: 10264 - RNA, 20 nt, Homo sapiens
uggaugggugggcauggaac

SEQ ID NO: 10265 - RNA, 20 nt, Homo sapiens
uuguuccuucaucauccccc

SEQ ID NO: 10266 - RNA, 23 nt, Homo sapiens
uuugcauggguguuacuugucug

SEQ ID NO: 10267 - RNA, 18 nt, Homo sapiens
augcaaagcaguguguug

SEQ ID NO: 10268 - RNA, 20 nt, Homo sapiens
aggaaccagucagcuggcca

SEQ ID NO: 10269 - RNA, 18 nt, Homo sapiens
cuaccugccaugcauaca

SEQ ID NO: 10270 - RNA, 15 nt, Homo sapiens
gugcuauuucagcaa

SEQ ID NO: 10271 - RNA, 20 nt, Homo sapiens
uggccaggcuggucuugaac

SEQ ID NO: 10272 - RNA, 19 nt, Homo sapiens
aaacaacaacacaauaaca

SEQ ID NO: 10273 - RNA, 21 nt, Homo sapiens
agugcgagagaggcggucgug

SEQ ID NO: 10274 - RNA, 21 nt, Homo sapiens
gguucauguagagaaaagcac

SEQ ID NO: 10275 - RNA, 22 nt, Homo sapiens
acagccacagccagaggagccu

SEQ ID NO: 10276 - RNA, 20 nt, Homo sapiens
cagccacagccagaggagcc

SEQ ID NO: 10277 - RNA, 23 nt, Homo sapiens
acuugaacuugggcaucuggcuc

SEQ ID NO: 10278 - RNA, 19 nt, Homo sapiens
ucuaguucccugcuugaug

SEQ ID NO: 10279 - RNA, 21 nt, Homo sapiens
ucugccugaggucccacccca

SEQ ID NO: 10280 - RNA, 19 nt, Homo sapiens
uguuugaucuucucaaaca

SEQ ID NO: 10281 - RNA, 23 nt, Homo sapiens
aacacaagcauuucacuucucca

SEQ ID NO: 10282 - RNA, 22 nt, Homo sapiens
gacauacaucauucugugauua

SEQ ID NO: 10283 - RNA, 25 nt, Homo sapiens
uaguuuuaucuuaacacugaaacug

SEQ ID NO: 10284 - RNA, 17 nt, Homo sapiens
ucaagaugacugcuuca

SEQ ID NO: 10285 - RNA, 26 nt, Homo sapiens
ugcuuuuaacauuccgacauacauca

SEQ ID NO: 10286 - RNA, 18 nt, Homo sapiens
uggcucagugugagauug

SEQ ID NO: 10287 - RNA, 17 nt, Homo sapiens
cuucauacaucaccaca

SEQ ID NO: 10288 - RNA, 18 nt, Homo sapiens
cuggagaaaaauaucugu

SEQ ID NO: 10289 - RNA, 19 nt, Homo sapiens
uagaggccuuuaguuauaa

SEQ ID NO: 10290 - RNA, 17 nt, Homo sapiens
aauaaaagaaucugaua

SEQ ID NO: 10291 - RNA, 20 nt, Homo sapiens
acaaaacuauuaaguauguc

SEQ ID NO: 10292 - RNA, 22 nt, Homo sapiens
ccaaaagcaacauucguucucu

SEQ ID NO: 10293 - RNA, 19 nt, Homo sapiens
ucccccggccuccgcgcca

SEQ ID NO: 10294 - RNA, 20 nt, Homo sapiens
agguaggucagaucccccuc

SEQ ID NO: 10295 - RNA, 19 nt, Homo sapiens
auagaacacaagggauaua

SEQ ID NO: 10296 - RNA, 18 nt, Homo sapiens
cucuagaguuuaguccuu

SEQ ID NO: 10297 - RNA, 19 nt, Homo sapiens
ugcagcucacugcugcugc

SEQ ID NO: 10298 - RNA, 23 nt, Homo sapiens
uggacagcuuaccuagucuugua

SEQ ID NO: 10299 - RNA, 21 nt, Homo sapiens
guucuuuauaacaaaacaggg

SEQ ID NO: 10300 - RNA, 21 nt, Homo sapiens
cagcaacuuuuuaauuaaaca

SEQ ID NO: 10301 - RNA, 18 nt, Homo sapiens
cccggucucagucgucau

SEQ ID NO: 10302 - RNA, 22 nt, Homo sapiens
gccuggcugggaagucugggga

SEQ ID NO: 10303 - RNA, 21 nt, Homo sapiens
acccaauucaagcuuauuuua

SEQ ID NO: 10304 - RNA, 18 nt, Homo sapiens
ccacccaccucugccucc

SEQ ID NO: 10305 - RNA, 19 nt, Homo sapiens
cuagccuuccaagcaugaa

SEQ ID NO: 10306 - RNA, 20 nt, Homo sapiens
uaauguucauuuauuuucua

SEQ ID NO: 10307 - RNA, 18 nt, Homo sapiens
uccgccuccuggguucaa

SEQ ID NO: 10308 - RNA, 19 nt, Homo sapiens
gccggagaucuauuuuuua

SEQ ID NO: 10309 - RNA, 21 nt, Homo sapiens
gcuccucuuccuuuccuccuc

SEQ ID NO: 10310 - RNA, 19 nt, Homo sapiens
ccugagggaggaccugggg

SEQ ID NO: 10311 - RNA, 24 nt, Homo sapiens
cgccccugccugccauguaccucc

SEQ ID NO: 10312 - RNA, 21 nt, Homo sapiens
gacugcaaugugccgaucuua

SEQ ID NO: 10313 - RNA, 17 nt, Homo sapiens
uuccucuucggcccuca

SEQ ID NO: 10314 - RNA, 21 nt, Homo sapiens
cacacccagcggccccccgca

SEQ ID NO: 10315 - RNA, 18 nt, Homo sapiens
cauccccaccccacccca

SEQ ID NO: 10316 - RNA, 22 nt, Homo sapiens
cccgcugaguggggggucgugg

SEQ ID NO: 10317 - RNA, 19 nt, Homo sapiens
caguaagcaaaauuuucca

SEQ ID NO: 10318 - RNA, 22 nt, Homo sapiens
ugggcauuuaauauguaaagau

SEQ ID NO: 10319 - RNA, 19 nt, Homo sapiens
uuuacuuugauguaucaua

SEQ ID NO: 10320 - RNA, 23 nt, Homo sapiens
ggcagaaagcuggagccccugga

SEQ ID NO: 10321 - RNA, 21 nt, Homo sapiens
uucugucuuguucagccuuga

SEQ ID NO: 10322 - RNA, 22 nt, Homo sapiens
uuucaugcgcuguuuuuguuuu

SEQ ID NO: 10323 - RNA, 23 nt, Homo sapiens
cagacgugaaagccagaaccuca

SEQ ID NO: 10324 - RNA, 22 nt, Homo sapiens
uauggauugccaagucagcaua

SEQ ID NO: 10325 - RNA, 18 nt, Homo sapiens
ucuggcgugaguugugaa

SEQ ID NO: 10326 - RNA, 19 nt, Homo sapiens
ugauaacuaaaaucccucu

SEQ ID NO: 10327 - RNA, 19 nt, Homo sapiens
aaguucugcauagcaucua

SEQ ID NO: 10328 - RNA, 18 nt, Homo sapiens
cugguaaucacaguauua

SEQ ID NO: 10329 - RNA, 22 nt, Homo sapiens
cuuuucccuccuuuuuuaucuc

SEQ ID NO: 10330 - RNA, 25 nt, Homo sapiens
uacuuuucuccagggacuuuuugca

SEQ ID NO: 10331 - RNA, 21 nt, Homo sapiens
uguguuucaaacauuucugga

SEQ ID NO: 10332 - RNA, 19 nt, Homo sapiens
gcuuuauuuuuaacacuaa

SEQ ID NO: 10333 - RNA, 24 nt, Homo sapiens
uccuggguugcagggacuugagaa

SEQ ID NO: 10334 - RNA, 17 nt, Homo sapiens
acuuugccgucugguuu

SEQ ID NO: 10335 - RNA, 17 nt, Homo sapiens
gauuuguaaugaguaca

SEQ ID NO: 10336 - RNA, 19 nt, Homo sapiens
uccugaaacucuuuggaga

SEQ ID NO: 10337 - RNA, 23 nt, Homo sapiens
caguguucugcuuuuuaauccua

SEQ ID NO: 10338 - RNA, 18 nt, Homo sapiens
gucuguuacaguugcuag

SEQ ID NO: 10339 - RNA, 23 nt, Homo sapiens
uaccugcaguggcacccuguaca

SEQ ID NO: 10340 - RNA, 19 nt, Homo sapiens
uucagaagcagacauggca

SEQ ID NO: 10341 - RNA, 20 nt, Homo sapiens
aauaucaccaggcuucuucu

SEQ ID NO: 10342 - RNA, 20 nt, Homo sapiens
aucaaacauaccccaaguua

SEQ ID NO: 10343 - RNA, 24 nt, Homo sapiens
cccacucuccuuggcacccugaca

SEQ ID NO: 10344 - RNA, 18 nt, Homo sapiens
cucuccuuggcacccuga

SEQ ID NO: 10345 - RNA, 24 nt, Homo sapiens
uugcacaauaucaccaggcuucuu

SEQ ID NO: 10346 - RNA, 21 nt, Homo sapiens
ccuaggccaggccguguugaa

SEQ ID NO: 10347 - RNA, 22 nt, Homo sapiens
agaacaaugggaaacuuagcua

SEQ ID NO: 10348 - RNA, 17 nt, Homo sapiens
gggaagaggcugggagc

SEQ ID NO: 10349 - RNA, 21 nt, Homo sapiens
gucuugaacucuugggcucaa

SEQ ID NO: 10350 - RNA, 21 nt, Homo sapiens
accuuguauauacccugcacc

SEQ ID NO: 10351 - RNA, 18 nt, Homo sapiens
cccagcgucccugccucc

SEQ ID NO: 10352 - RNA, 19 nt, Homo sapiens
agaaaaugggagcugugcu

SEQ ID NO: 10353 - RNA, 21 nt, Homo sapiens
agcgaggcacuugcuaacucu

SEQ ID NO: 10354 - RNA, 23 nt, Homo sapiens
aggcacuugcuaacucuuggccu

SEQ ID NO: 10355 - RNA, 20 nt, Homo sapiens
cucuggcccagacccugugg

SEQ ID NO: 10356 - RNA, 16 nt, Homo sapiens
uggcacagcaacauca

SEQ ID NO: 10357 - RNA, 19 nt, Homo sapiens
aagcaauucucuugcuuca

SEQ ID NO: 10358 - RNA, 25 nt, Homo sapiens
acaaugaccagguuggacuguuuaa

SEQ ID NO: 10359 - RNA, 19 nt, Homo sapiens
acacuuauuauuuuccuuu

SEQ ID NO: 10360 - RNA, 18 nt, Homo sapiens
auaaguuauggccaucuu

SEQ ID NO: 10361 - RNA, 21 nt, Homo sapiens
ccaagcaugcaccaaacacug

SEQ ID NO: 10362 - RNA, 18 nt, Homo sapiens
ccaccuuuauuuaaaguu

SEQ ID NO: 10363 - RNA, 23 nt, Homo sapiens
ccucaagcaauccgccuaccuca

SEQ ID NO: 10364 - RNA, 24 nt, Homo sapiens
ccucuaaaaggaaaccccauccca

SEQ ID NO: 10365 - RNA, 19 nt, Homo sapiens
cuccagcccccagcaacca

SEQ ID NO: 10366 - RNA, 19 nt, Homo sapiens
gccaaauaaaauuguauua

SEQ ID NO: 10367 - RNA, 20 nt, Homo sapiens
ucauuuuuauggccaaauaa

SEQ ID NO: 10368 - RNA, 18 nt, Homo sapiens
ugagguaaacuucacaua

SEQ ID NO: 10369 - RNA, 24 nt, Homo sapiens
ugcaaccuccuccuccuggauuca

SEQ ID NO: 10370 - RNA, 19 nt, Homo sapiens
cgugcgcgaagagaccucg

SEQ ID NO: 10371 - RNA, 19 nt, Homo sapiens
gcccauuucuccacacugg

SEQ ID NO: 10372 - RNA, 20 nt, Homo sapiens
guggggagggggcuuuuguu

SEQ ID NO: 10373 - RNA, 21 nt, Homo sapiens
cccaccuccaacaccuccuga

SEQ ID NO: 10374 - RNA, 21 nt, Homo sapiens
gcuuuccugcuccaccugaga

SEQ ID NO: 10375 - RNA, 19 nt, Homo sapiens
ugaaccuggcuuucucaca

SEQ ID NO: 10376 - RNA, 18 nt, Homo sapiens
aaauccaaaauagucaug

SEQ ID NO: 10377 - RNA, 17 nt, Homo sapiens
caaguguuuuggguuuu

SEQ ID NO: 10378 - RNA, 25 nt, Homo sapiens
cuguacuucaguucucaucuuguaa

SEQ ID NO: 10379 - RNA, 22 nt, Homo sapiens
ucaaagaggccaguacuuugcc

SEQ ID NO: 10380 - RNA, 18 nt, Homo sapiens
uccaggaggacuguucua

SEQ ID NO: 10381 - RNA, 19 nt, Homo sapiens
ugaaccgucaaugugaaau

SEQ ID NO: 10382 - RNA, 18 nt, Homo sapiens
cccagacacugaagugca

SEQ ID NO: 10383 - RNA, 23 nt, Homo sapiens
gcagguuaugcaagucgccaggc

SEQ ID NO: 10384 - RNA, 15 nt, Homo sapiens
gcauaaaaguuaaca

SEQ ID NO: 10385 - RNA, 22 nt, Homo sapiens
uagauccucugauauacaauua

SEQ ID NO: 10386 - RNA, 19 nt, Homo sapiens
auaaaaauggaagcuauua

SEQ ID NO: 10387 - RNA, 21 nt, Homo sapiens
cucugacauugaggccugggg

SEQ ID NO: 10388 - RNA, 22 nt, Homo sapiens
guaaaggacauuugcuuaccug

SEQ ID NO: 10389 - RNA, 18 nt, Homo sapiens
uuggaccugacucagcua

SEQ ID NO: 10390 - RNA, 23 nt, Homo sapiens
aaaucuuaggcuaccacauucua

SEQ ID NO: 10391 - RNA, 19 nt, Homo sapiens
acacccuagaacacuccua

SEQ ID NO: 10392 - RNA, 18 nt, Homo sapiens
augcuuaacagaucauua

SEQ ID NO: 10393 - RNA, 19 nt, Homo sapiens
cuguauuggacagcacugc

SEQ ID NO: 10394 - RNA, 24 nt, Homo sapiens
uccaauucaagccucucaacucaa

SEQ ID NO: 10395 - RNA, 18 nt, Homo sapiens
cuuccccugacuguucca

SEQ ID NO: 10396 - RNA, 24 nt, Homo sapiens
gagacaaggccaguguauaugcaa

SEQ ID NO: 10397 - RNA, 20 nt, Homo sapiens
ggaggaggaaacuucacaua

SEQ ID NO: 10398 - RNA, 21 nt, Homo sapiens
gucccaccacugaagcuguug

SEQ ID NO: 10399 - RNA, 20 nt, Homo sapiens
ccuggagaggucgcuuugug

SEQ ID NO: 10400 - RNA, 21 nt, Homo sapiens
ccuccaagaagaggcagccca

SEQ ID NO: 10401 - RNA, 19 nt, Homo sapiens
gaggcucccaguccccacu

SEQ ID NO: 10402 - RNA, 22 nt, Homo sapiens
gcgccagccgggacucacccgc

SEQ ID NO: 10403 - RNA, 22 nt, Homo sapiens
aggauucuauuuuguuuaaugg

SEQ ID NO: 10404 - RNA, 21 nt, Homo sapiens
cagaaauggcagaauaaaucu

SEQ ID NO: 10405 - RNA, 18 nt, Homo sapiens
accuuggcuuccuggccc

SEQ ID NO: 10406 - RNA, 21 nt, Homo sapiens
cccucgccccaagacugggga

SEQ ID NO: 10407 - RNA, 22 nt, Homo sapiens
ccugcuuccuggcccaguccca

SEQ ID NO: 10408 - RNA, 20 nt, Homo sapiens
cuugggccacaccugcucac

SEQ ID NO: 10409 - RNA, 20 nt, Homo sapiens
uucaucagacagacaccucc

SEQ ID NO: 10410 - RNA, 18 nt, Homo sapiens
cacauggacaggcugcag

SEQ ID NO: 10411 - RNA, 18 nt, Homo sapiens
cccuugaagguuugggga

SEQ ID NO: 10412 - RNA, 17 nt, Homo sapiens
cuuuuggcaaacagugu

SEQ ID NO: 10413 - RNA, 19 nt, Homo sapiens
gcccccucagauggcuuuu

SEQ ID NO: 10414 - RNA, 23 nt, Homo sapiens
guccauguggcaccuuugugaga

SEQ ID NO: 10415 - RNA, 17 nt, Homo sapiens
gucccacuaugggucuc

SEQ ID NO: 10416 - RNA, 22 nt, Homo sapiens
gugguuuuggguuuuuuuuguu

SEQ ID NO: 10417 - RNA, 20 nt, Homo sapiens
auagcggguuucacccucca

SEQ ID NO: 10418 - RNA, 19 nt, Homo sapiens
ucugucucucucgggccuu

SEQ ID NO: 10419 - RNA, 21 nt, Homo sapiens
cggacggacacaccucaugga

SEQ ID NO: 10420 - RNA, 18 nt, Homo sapiens
uguucugacccucugugc

SEQ ID NO: 10421 - RNA, 19 nt, Homo sapiens
guaaaaguggauccugcca

SEQ ID NO: 10422 - RNA, 22 nt, Homo sapiens
aaagacccagguaaaagaccca

SEQ ID NO: 10423 - RNA, 17 nt, Homo sapiens
auguccagaagcauuuc

SEQ ID NO: 10424 - RNA, 19 nt, Homo sapiens
uuucuguugccuucguuuu

SEQ ID NO: 10425 - RNA, 19 nt, Homo sapiens
aaaaacauauacaaauaaa

SEQ ID NO: 10426 - RNA, 25 nt, Homo sapiens
acuugggcccuucccuucuugguuu

SEQ ID NO: 10427 - RNA, 22 nt, Homo sapiens
uuuuuaccucugucuuggcuuu

SEQ ID NO: 10428 - RNA, 19 nt, Homo sapiens
guaugauuuuuagugucag

SEQ ID NO: 10429 - RNA, 21 nt, Homo sapiens
gcccauggccgcgcgcgcucc

SEQ ID NO: 10430 - RNA, 22 nt, Homo sapiens
cuaaacguacaacaucauagua

SEQ ID NO: 10431 - RNA, 19 nt, Homo sapiens
guccuuaaggcaacagugc

SEQ ID NO: 10432 - RNA, 18 nt, Homo sapiens
uguguccguauauuucug

SEQ ID NO: 10433 - RNA, 18 nt, Homo sapiens
uugcaaaaugucaauucu

SEQ ID NO: 10434 - RNA, 17 nt, Homo sapiens
caugcuggacaucccuu

SEQ ID NO: 10435 - RNA, 21 nt, Homo sapiens
ccauggagaacacacaaccag

SEQ ID NO: 10436 - RNA, 18 nt, Homo sapiens
aucucccaagaggcuuca

SEQ ID NO: 10437 - RNA, 21 nt, Homo sapiens
ccugcucccuacagugggcug

SEQ ID NO: 10438 - RNA, 19 nt, Homo sapiens
cuccccugccccaucuggu

SEQ ID NO: 10439 - RNA, 19 nt, Homo sapiens
cuugggaguuguuggguuc

SEQ ID NO: 10440 - RNA, 21 nt, Homo sapiens
gcccuggaguagggggccaga

SEQ ID NO: 10441 - RNA, 18 nt, Homo sapiens
guacaucaaacuguauua

SEQ ID NO: 10442 - RNA, 19 nt, Homo sapiens
accaccaucugagacagga

SEQ ID NO: 10443 - RNA, 19 nt, Homo sapiens
caaucccagacugggaacc

SEQ ID NO: 10444 - RNA, 21 nt, Homo sapiens
gaaaggguagaggucuuuuca

SEQ ID NO: 10445 - RNA, 17 nt, Homo sapiens
ggccaggacccacaggg

SEQ ID NO: 10446 - RNA, 21 nt, Homo sapiens
agaaaaaagcgaggaaaucag

SEQ ID NO: 10447 - RNA, 22 nt, Homo sapiens
auguggagcaaagugucaguga

SEQ ID NO: 10448 - RNA, 19 nt, Homo sapiens
ccuggauugaauugggccc

SEQ ID NO: 10449 - RNA, 16 nt, Homo sapiens
cugagggcugcuuggu

SEQ ID NO: 10450 - RNA, 20 nt, Homo sapiens
gggcaccuggcagugaggga

SEQ ID NO: 10451 - RNA, 21 nt, Homo sapiens
ucuguauuggcuacuguucuu

SEQ ID NO: 10452 - RNA, 26 nt, Homo sapiens
aucugaauuuggaauucuucugguuu

SEQ ID NO: 10453 - RNA, 19 nt, Homo sapiens
caacagauugccugcuccu

SEQ ID NO: 10454 - RNA, 20 nt, Homo sapiens
ucuaaauuagagagguuaac

SEQ ID NO: 10455 - RNA, 25 nt, Homo sapiens
caaaguuaaaggaccacugcccuga

SEQ ID NO: 10456 - RNA, 19 nt, Homo sapiens
ccuggucuuggccugugaa

SEQ ID NO: 10457 - RNA, 20 nt, Homo sapiens
cuggaagacuguuguggccu

SEQ ID NO: 10458 - RNA, 19 nt, Homo sapiens
cuuggcagcagccugugaa

SEQ ID NO: 10459 - RNA, 21 nt, Homo sapiens
gcaaaucagggcuucccccua

SEQ ID NO: 10460 - RNA, 22 nt, Homo sapiens
ucaucccuggcccccuaucuug

SEQ ID NO: 10461 - RNA, 18 nt, Homo sapiens
uggucuuggccugugaau

SEQ ID NO: 10462 - RNA, 17 nt, Homo sapiens
uuggggugguucugcuu

SEQ ID NO: 10463 - RNA, 23 nt, Homo sapiens
aauaauuugugucagcauuuuca

SEQ ID NO: 10464 - RNA, 22 nt, Homo sapiens
agaacauacuuccacuacauca

SEQ ID NO: 10465 - RNA, 15 nt, Homo sapiens
gaccagaacauacuu

SEQ ID NO: 10466 - RNA, 26 nt, Homo sapiens
gcccucaugggaccugcccucccuca

SEQ ID NO: 10467 - RNA, 23 nt, Homo sapiens
gcuuuuccucaggguguccugag

SEQ ID NO: 10468 - RNA, 17 nt, Homo sapiens
ggaccaggguggagcug

SEQ ID NO: 10469 - RNA, 19 nt, Homo sapiens
ggagcaaucugacccuucu

SEQ ID NO: 10470 - RNA, 21 nt, Homo sapiens
ucccucagccgucagccauca

SEQ ID NO: 10471 - RNA, 20 nt, Homo sapiens
cugagcguugcguucgguuu

SEQ ID NO: 10472 - RNA, 23 nt, Homo sapiens
aaccagcagggagcacuuggcuc

SEQ ID NO: 10473 - RNA, 17 nt, Homo sapiens
aagugcuggccguucuu

SEQ ID NO: 10474 - RNA, 25 nt, Homo sapiens
acaccccuucacagcauacacugcc

SEQ ID NO: 10475 - RNA, 21 nt, Homo sapiens
acgcguuaaagggccaugaca

SEQ ID NO: 10476 - RNA, 19 nt, Homo sapiens
caggaauccgccgccgcua

SEQ ID NO: 10477 - RNA, 22 nt, Homo sapiens
caguagggcccccagccagcgc

SEQ ID NO: 10478 - RNA, 21 nt, Homo sapiens
cauacauagacaagcaucaua

SEQ ID NO: 10479 - RNA, 19 nt, Homo sapiens
ccacggccccaccuuuccc

SEQ ID NO: 10480 - RNA, 19 nt, Homo sapiens
cucccaucucugccaucug

SEQ ID NO: 10481 - RNA, 19 nt, Homo sapiens
cuggacaauuucucuguca

SEQ ID NO: 10482 - RNA, 15 nt, Homo sapiens
cuuauagagcugcaa

SEQ ID NO: 10483 - RNA, 24 nt, Homo sapiens
gauaugauuuucagcuuggagcug

SEQ ID NO: 10484 - RNA, 22 nt, Homo sapiens
gucggggccgccgguggagucu

SEQ ID NO: 10485 - RNA, 27 nt, Homo sapiens
ugaguacagccgcaucaccugucaacu

SEQ ID NO: 10486 - RNA, 21 nt, Homo sapiens
uggaagcugcucuuuaccuca

SEQ ID NO: 10487 - RNA, 17 nt, Homo sapiens
uuugaaaagaagagaca

SEQ ID NO: 10488 - RNA, 18 nt, Homo sapiens
aacccugaagauaaucaa

SEQ ID NO: 10489 - RNA, 16 nt, Homo sapiens
ccuccccaagcaugaa

SEQ ID NO: 10490 - RNA, 17 nt, Homo sapiens
gucuucaucaucauaca

SEQ ID NO: 10491 - RNA, 19 nt, Homo sapiens
uaucugcuuaguauuaaca

SEQ ID NO: 10492 - RNA, 23 nt, Homo sapiens
uugggauaugguauuauuuuaca

SEQ ID NO: 10493 - RNA, 19 nt, Homo sapiens
agaaguuucuagccggcca

SEQ ID NO: 10494 - RNA, 16 nt, Homo sapiens
ccagaagugccuucca

SEQ ID NO: 10495 - RNA, 19 nt, Homo sapiens
cccggugggaggcugcgga

SEQ ID NO: 10496 - RNA, 18 nt, Homo sapiens
gccguggcugccagguuc

SEQ ID NO: 10497 - RNA, 19 nt, Homo sapiens
cuccugcuugcggacugcu

SEQ ID NO: 10498 - RNA, 23 nt, Homo sapiens
ggcuuugacucggacugcagcga

SEQ ID NO: 10499 - RNA, 18 nt, Homo sapiens
ugggauuuggugucugcu

SEQ ID NO: 10500 - RNA, 25 nt, Homo sapiens
acaaucgauugugguguccuuucaa

SEQ ID NO: 10501 - RNA, 23 nt, Homo sapiens
uuuaugcuucuuaaaucauuuuu

SEQ ID NO: 10502 - RNA, 18 nt, Homo sapiens
augugcccaaagcucuga

SEQ ID NO: 10503 - RNA, 22 nt, Homo sapiens
cagggcguuucuaggccugguc

SEQ ID NO: 10504 - RNA, 22 nt, Homo sapiens
ccuaacuuucugaauuauuuuu

SEQ ID NO: 10505 - RNA, 22 nt, Homo sapiens
ugcccaaagcucugaauaguua

SEQ ID NO: 10506 - RNA, 21 nt, Homo sapiens
uuucuuugcaacagcaguguu

SEQ ID NO: 10507 - RNA, 17 nt, Homo sapiens
aggcaguuccccgguga

SEQ ID NO: 10508 - RNA, 16 nt, Homo sapiens
ccccacccccgcagcu

SEQ ID NO: 10509 - RNA, 18 nt, Homo sapiens
ccuuccuccuccagguac

SEQ ID NO: 10510 - RNA, 19 nt, Homo sapiens
ucaacaucuaagccuguug

SEQ ID NO: 10511 - RNA, 22 nt, Homo sapiens
cagaagugcagccccucucaca

SEQ ID NO: 10512 - RNA, 20 nt, Homo sapiens
ucccccagagccccucaugc

SEQ ID NO: 10513 - RNA, 18 nt, Homo sapiens
aaccaugaugccuuaaca

SEQ ID NO: 10514 - RNA, 23 nt, Homo sapiens
ccaggcucucagugccaccaccc

SEQ ID NO: 10515 - RNA, 22 nt, Homo sapiens
cccccuccucagcccuccccca

SEQ ID NO: 10516 - RNA, 18 nt, Homo sapiens
ugugcugcagcugcccac

SEQ ID NO: 10517 - RNA, 24 nt, Homo sapiens
cuuugacauuuggggaucuggugg

SEQ ID NO: 10518 - RNA, 20 nt, Homo sapiens
gugaacuccaccuccgugga

SEQ ID NO: 10519 - RNA, 26 nt, Homo sapiens
ucuagaauucacugaguuuuguuuca

SEQ ID NO: 10520 - RNA, 19 nt, Homo sapiens
cauccccucccucauccuc

SEQ ID NO: 10521 - RNA, 17 nt, Homo sapiens
accaaacuacgaccuca

SEQ ID NO: 10522 - RNA, 20 nt, Homo sapiens
acugcaagcucaggauuuca

SEQ ID NO: 10523 - RNA, 21 nt, Homo sapiens
gcuucucugucuuuuuucccc

SEQ ID NO: 10524 - RNA, 20 nt, Homo sapiens
guucuuccgugucccgaugu

SEQ ID NO: 10525 - RNA, 18 nt, Homo sapiens
ucugucuuuuuucccccu

SEQ ID NO: 10526 - RNA, 18 nt, Homo sapiens
uuugguacaaaaccacuc

SEQ ID NO: 10527 - RNA, 18 nt, Homo sapiens
ggaggcggcggcggcggc

SEQ ID NO: 10528 - RNA, 22 nt, Homo sapiens
gaaaaucagaaguacaguuuua

SEQ ID NO: 10529 - RNA, 21 nt, Homo sapiens
uaaguggguuuuuaugaacug

SEQ ID NO: 10530 - RNA, 18 nt, Homo sapiens
acaaauagaaacacugcc

SEQ ID NO: 10531 - RNA, 23 nt, Homo sapiens
gcgucugcaccccggcagcgcga

SEQ ID NO: 10532 - RNA, 18 nt, Homo sapiens
guugaaagaccguuuaca

SEQ ID NO: 10533 - RNA, 23 nt, Homo sapiens
uguacuggcuugaauuuucugga

SEQ ID NO: 10534 - RNA, 19 nt, Homo sapiens
cuuggagugccuuaauuuu

SEQ ID NO: 10535 - RNA, 17 nt, Homo sapiens
gcucuccaguggcacug

SEQ ID NO: 10536 - RNA, 17 nt, Homo sapiens
guugacugcucgugugc

SEQ ID NO: 10537 - RNA, 18 nt, Homo sapiens
uccuucugccucauggga

SEQ ID NO: 10538 - RNA, 22 nt, Homo sapiens
ugagugggcuucucugggagcu

SEQ ID NO: 10539 - RNA, 30 nt, Homo sapiens
ugcuugaauuauaaaugugguguuuggccu

SEQ ID NO: 10540 - RNA, 18 nt, Homo sapiens
uuguauuaaauagcauug

SEQ ID NO: 10541 - RNA, 17 nt, Homo sapiens
gaaccacuaugaagcua

SEQ ID NO: 10542 - RNA, 18 nt, Homo sapiens
caagaagaugaauggcgu

SEQ ID NO: 10543 - RNA, 19 nt, Homo sapiens
cgcccagcacccugccucc

SEQ ID NO: 10544 - RNA, 22 nt, Homo sapiens
cugugagguuucccaauggugu

SEQ ID NO: 10545 - RNA, 19 nt, Homo sapiens
guaucuuucuaugcugcuu

SEQ ID NO: 10546 - RNA, 22 nt, Homo sapiens
agguccuagcagaaggcauuga

SEQ ID NO: 10547 - RNA, 18 nt, Homo sapiens
caucaaugucccuguccc

SEQ ID NO: 10548 - RNA, 17 nt, Homo sapiens
ccagagacacacuggca

SEQ ID NO: 10549 - RNA, 25 nt, Homo sapiens
ccuagguggucucauaauuccauuu

SEQ ID NO: 10550 - RNA, 20 nt, Homo sapiens
cuuuccccuagguggucuca

SEQ ID NO: 10551 - RNA, 23 nt, Homo sapiens
uagguccuagcagaaggcauuga

SEQ ID NO: 10552 - RNA, 24 nt, Homo sapiens
ggacaauccaaagcaugguucuuc

SEQ ID NO: 10553 - RNA, 24 nt, Homo sapiens
uucuucgggagcgagcuguucuca

SEQ ID NO: 10554 - RNA, 19 nt, Homo sapiens
aaaucugauauauuacaca

SEQ ID NO: 10555 - RNA, 18 nt, Homo sapiens
cucgccucccccauucca

SEQ ID NO: 10556 - RNA, 18 nt, Homo sapiens
gaaaucuuucucccuagc

SEQ ID NO: 10557 - RNA, 20 nt, Homo sapiens
gccgcggcaccccugaggcc

SEQ ID NO: 10558 - RNA, 18 nt, Homo sapiens
gcggcggcggacgugcgc

SEQ ID NO: 10559 - RNA, 21 nt, Homo sapiens
agccagguaccuucucaccug

SEQ ID NO: 10560 - RNA, 20 nt, Homo sapiens
gaaggugcugauaccuucaa

SEQ ID NO: 10561 - RNA, 19 nt, Homo sapiens
cgcgcggccccgcgcugcu

SEQ ID NO: 10562 - RNA, 20 nt, Homo sapiens
cggggucucccuguguuacc

SEQ ID NO: 10563 - RNA, 22 nt, Homo sapiens
cucaagcuauccuugcaccuca

SEQ ID NO: 10564 - RNA, 23 nt, Homo sapiens
cuuuuuggaauugucuugauuuu

SEQ ID NO: 10565 - RNA, 19 nt, Homo sapiens
ucacccagcaccuugcaga

SEQ ID NO: 10566 - RNA, 18 nt, Homo sapiens
ugcccagcuccccaacuc

SEQ ID NO: 10567 - RNA, 18 nt, Homo sapiens
uuucaacuuuugacaauc

SEQ ID NO: 10568 - RNA, 16 nt, Homo sapiens
gaggaaaaagaagcaa

SEQ ID NO: 10569 - RNA, 18 nt, Homo sapiens
guuucuaauaucuagcaa

SEQ ID NO: 10570 - RNA, 16 nt, Homo sapiens
guuuugguuuguacag

SEQ ID NO: 10571 - RNA, 18 nt, Homo sapiens
accaagaucaagcagaga

SEQ ID NO: 10572 - RNA, 16 nt, Homo sapiens
cgccucucccaccucc

SEQ ID NO: 10573 - RNA, 18 nt, Homo sapiens
uuuguuugguuuucucgg

SEQ ID NO: 10574 - RNA, 19 nt, Homo sapiens
aauggaagccaacacauca

SEQ ID NO: 10575 - RNA, 20 nt, Homo sapiens
acauacuuuauuucuucuua

SEQ ID NO: 10576 - RNA, 15 nt, Homo sapiens
gauuuuaacagcucu

SEQ ID NO: 10577 - RNA, 17 nt, Homo sapiens
gcugaagacuuuuguua

SEQ ID NO: 10578 - RNA, 18 nt, Homo sapiens
ucucuacuaaaaauacaa

SEQ ID NO: 10579 - RNA, 20 nt, Homo sapiens
ucucuuccugagccuuaacu

SEQ ID NO: 10580 - RNA, 17 nt, Homo sapiens
ugaugugaucuaugaag

SEQ ID NO: 10581 - RNA, 20 nt, Homo sapiens
uggggcccggagugaggcug

SEQ ID NO: 10582 - RNA, 18 nt, Homo sapiens
uggguggaucacuugagg

SEQ ID NO: 10583 - RNA, 24 nt, Homo sapiens
cuuuugucagcugagcaguuugug

SEQ ID NO: 10584 - RNA, 20 nt, Homo sapiens
gcacagggaccccccaccca

SEQ ID NO: 10585 - RNA, 22 nt, Homo sapiens
uuuuuuccccuuugccuugauc

SEQ ID NO: 10586 - RNA, 23 nt, Homo sapiens
ccguucaguucuccugggcucca

SEQ ID NO: 10587 - RNA, 18 nt, Homo sapiens
cgggagggaacauccugc

SEQ ID NO: 10588 - RNA, 18 nt, Homo sapiens
cuguugcaggcaaaugua

SEQ ID NO: 10589 - RNA, 18 nt, Homo sapiens
gccacagaagaugucaug

SEQ ID NO: 10590 - RNA, 21 nt, Homo sapiens
ugaaugagacaaaagcagugg

SEQ ID NO: 10591 - RNA, 18 nt, Homo sapiens
ucaccugcuaguaggacg

SEQ ID NO: 10592 - RNA, 18 nt, Homo sapiens
aguucuguugaaaucuca

SEQ ID NO: 10593 - RNA, 24 nt, Homo sapiens
gacuauucaauaccauacugaaga

SEQ ID NO: 10594 - RNA, 24 nt, Homo sapiens
ucuaaauguaggaaggccugugaa

SEQ ID NO: 10595 - RNA, 18 nt, Homo sapiens
ugaaacuguaguaucaua

SEQ ID NO: 10596 - RNA, 18 nt, Homo sapiens
ugacuauucaauaccaua

SEQ ID NO: 10597 - RNA, 22 nt, Homo sapiens
uuuaagugaguauuuguuccaa

SEQ ID NO: 10598 - RNA, 19 nt, Homo sapiens
aagauauugauggccacua

SEQ ID NO: 10599 - RNA, 24 nt, Homo sapiens
aagcaagauauugauggccacuaa

SEQ ID NO: 10600 - RNA, 17 nt, Homo sapiens
uuggauauaccuagauu

SEQ ID NO: 10601 - RNA, 19 nt, Homo sapiens
gaagaaguguugauugcca

SEQ ID NO: 10602 - RNA, 22 nt, Homo sapiens
ugcuguacugcaauauuuggau

SEQ ID NO: 10603 - RNA, 21 nt, Homo sapiens
cacacccacacacaucuaucu

SEQ ID NO: 10604 - RNA, 19 nt, Homo sapiens
acauuuaguacccugcagg

SEQ ID NO: 10605 - RNA, 18 nt, Homo sapiens
accaagggcccucacuca

SEQ ID NO: 10606 - RNA, 18 nt, Homo sapiens
cagucaccuccugcuccu

SEQ ID NO: 10607 - RNA, 21 nt, Homo sapiens
ccaggcucccugaccacccug

SEQ ID NO: 10608 - RNA, 21 nt, Homo sapiens
ccuucccccgccuuucuuccc

SEQ ID NO: 10609 - RNA, 17 nt, Homo sapiens
agccuaaagaaaucuca

SEQ ID NO: 10610 - RNA, 22 nt, Homo sapiens
aguauuacugaugguacuguua

SEQ ID NO: 10611 - RNA, 21 nt, Homo sapiens
gcagaaaacuuuggaugugcc

SEQ ID NO: 10612 - RNA, 18 nt, Homo sapiens
ucuggacacagacagauc

SEQ ID NO: 10613 - RNA, 19 nt, Homo sapiens
aggaaagaaaaauaagcaa

SEQ ID NO: 10614 - RNA, 19 nt, Homo sapiens
caugucuguuacucacuuu

SEQ ID NO: 10615 - RNA, 18 nt, Homo sapiens
guguuaaaacugaaacac

SEQ ID NO: 10616 - RNA, 24 nt, Homo sapiens
uuuuuuggggggucuugguuuaug

SEQ ID NO: 10617 - RNA, 24 nt, Homo sapiens
augaauugaacaauuuaaccuuga

SEQ ID NO: 10618 - RNA, 19 nt, Homo sapiens
cucuacaaaagcaaacucu

SEQ ID NO: 10619 - RNA, 19 nt, Homo sapiens
aagcaauucuccugccuca

SEQ ID NO: 10620 - RNA, 20 nt, Homo sapiens
agucucacucuguugcccag

SEQ ID NO: 10621 - RNA, 22 nt, Homo sapiens
aucuuggcucacuacaaccucu

SEQ ID NO: 10622 - RNA, 19 nt, Homo sapiens
augaucauugcugaacuca

SEQ ID NO: 10623 - RNA, 19 nt, Homo sapiens
caaagcucucuggcaccca

SEQ ID NO: 10624 - RNA, 20 nt, Homo sapiens
ccucugccucccggguucaa

SEQ ID NO: 10625 - RNA, 23 nt, Homo sapiens
ggaagccuuccuggauuucacgc

SEQ ID NO: 10626 - RNA, 22 nt, Homo sapiens
ucucccagcuugcuuuaguuuu

SEQ ID NO: 10627 - RNA, 21 nt, Homo sapiens
uggaagccuuccuggauuuca

SEQ ID NO: 10628 - RNA, 18 nt, Homo sapiens
uguacccuccuccccucu

SEQ ID NO: 10629 - RNA, 17 nt, Homo sapiens
uugcaaacaucagccuc

SEQ ID NO: 10630 - RNA, 23 nt, Homo sapiens
acuugaccuuggccgcuuugucc

SEQ ID NO: 10631 - RNA, 18 nt, Homo sapiens
caccugaccuagcacaca

SEQ ID NO: 10632 - RNA, 20 nt, Homo sapiens
gauuuaaaauggugaugcuu

SEQ ID NO: 10633 - RNA, 22 nt, Homo sapiens
gcccacgaccaaggggucuuca

SEQ ID NO: 10634 - RNA, 20 nt, Homo sapiens
gccgggcggcccccuggcuc

SEQ ID NO: 10635 - RNA, 19 nt, Homo sapiens
gccuuuaacacuaacugua

SEQ ID NO: 10636 - RNA, 21 nt, Homo sapiens
gcuuuguccuaacaguccaca

SEQ ID NO: 10637 - RNA, 26 nt, Homo sapiens
ucugaagcguuauuuuggguacuuuu

SEQ ID NO: 10638 - RNA, 20 nt, Homo sapiens
ccuaggcgcgguucagguca

SEQ ID NO: 10639 - RNA, 16 nt, Homo sapiens
cuccccaacuccuucc

SEQ ID NO: 10640 - RNA, 20 nt, Homo sapiens
uggccccuccccaacuccuu

SEQ ID NO: 10641 - RNA, 16 nt, Homo sapiens
agagccuuggcccucu

SEQ ID NO: 10642 - RNA, 18 nt, Homo sapiens
aucccaaguaaaaauuuc

SEQ ID NO: 10643 - RNA, 22 nt, Homo sapiens
caguaccagcuuugguaauguu

SEQ ID NO: 10644 - RNA, 18 nt, Homo sapiens
ccuuuuaacccaguguac

SEQ ID NO: 10645 - RNA, 20 nt, Homo sapiens
gagagcaaguuacugcugcu

SEQ ID NO: 10646 - RNA, 22 nt, Homo sapiens
gccagaacagagaacccuguua

SEQ ID NO: 10647 - RNA, 18 nt, Homo sapiens
guugcacuaacugcuggu

SEQ ID NO: 10648 - RNA, 18 nt, Homo sapiens
uagcccuaacuccuuaac

SEQ ID NO: 10649 - RNA, 23 nt, Homo sapiens
ucucuuuguggguuuuucaucuu

SEQ ID NO: 10650 - RNA, 22 nt, Homo sapiens
uuggagaucaaaauccugcaga

SEQ ID NO: 10651 - RNA, 18 nt, Homo sapiens
auccugaaugaacagugg

SEQ ID NO: 10652 - RNA, 17 nt, Homo sapiens
cuuccccuccuccuucc

SEQ ID NO: 10653 - RNA, 23 nt, Homo sapiens
gccuggauuuguauccuuggcuu

SEQ ID NO: 10654 - RNA, 21 nt, Homo sapiens
aacaguaacacaccccugcuu

SEQ ID NO: 10655 - RNA, 21 nt, Homo sapiens
cugcuugggacccuagcuaua

SEQ ID NO: 10656 - RNA, 20 nt, Homo sapiens
ucuuuaaacaguuuuccuua

SEQ ID NO: 10657 - RNA, 17 nt, Homo sapiens
ccgcacucccgccacca

SEQ ID NO: 10658 - RNA, 22 nt, Homo sapiens
guguuuugugaggugaaugucu

SEQ ID NO: 10659 - RNA, 19 nt, Homo sapiens
uauguuuguacacaacacc

SEQ ID NO: 10660 - RNA, 19 nt, Homo sapiens
ggcuaugaacacgauauca

SEQ ID NO: 10661 - RNA, 18 nt, Homo sapiens
cauccuccacgcaccccc

SEQ ID NO: 10662 - RNA, 19 nt, Homo sapiens
caugcauucccccuacucu

SEQ ID NO: 10663 - RNA, 15 nt, Homo sapiens
ccagcccucaccccc

SEQ ID NO: 10664 - RNA, 22 nt, Homo sapiens
cccaccuaucguugguucgcaa

SEQ ID NO: 10665 - RNA, 20 nt, Homo sapiens
gcaaagugcaaagcuuucuu

SEQ ID NO: 10666 - RNA, 24 nt, Homo sapiens
gccuggacaggggcugccaggccc

SEQ ID NO: 10667 - RNA, 21 nt, Homo sapiens
guccuguguaccgggcccgcc

SEQ ID NO: 10668 - RNA, 20 nt, Homo sapiens
uggccagagaggcccagggg

SEQ ID NO: 10669 - RNA, 20 nt, Homo sapiens
aaucauauuacaagauuuua

SEQ ID NO: 10670 - RNA, 19 nt, Homo sapiens
gagccuauuacaagucuca

SEQ ID NO: 10671 - RNA, 21 nt, Homo sapiens
gguggauggggaggaugguug

SEQ ID NO: 10672 - RNA, 24 nt, Homo sapiens
guaucuaccagugucauucaauua

SEQ ID NO: 10673 - RNA, 22 nt, Homo sapiens
uugaacagauauuuguacacca

SEQ ID NO: 10674 - RNA, 22 nt, Homo sapiens
cucacagccugaagcucauccu

SEQ ID NO: 10675 - RNA, 19 nt, Homo sapiens
gcgacgaggacgcauucca

SEQ ID NO: 10676 - RNA, 19 nt, Homo sapiens
uccugauggaauuguuaua

SEQ ID NO: 10677 - RNA, 21 nt, Homo sapiens
ucucuucuguguuucgauuuu

SEQ ID NO: 10678 - RNA, 20 nt, Homo sapiens
uguauuaggagaaaauuacc

SEQ ID NO: 10679 - RNA, 21 nt, Homo sapiens
gcuguuuccuccggcauaaga

SEQ ID NO: 10680 - RNA, 18 nt, Homo sapiens
acauaccuaccaguauua

SEQ ID NO: 10681 - RNA, 23 nt, Homo sapiens
accaauauauaguggguacauca

SEQ ID NO: 10682 - RNA, 21 nt, Homo sapiens
ugcuaccuccucagaguuuca

SEQ ID NO: 10683 - RNA, 17 nt, Homo sapiens
auggacauuucauaccu

SEQ ID NO: 10684 - RNA, 18 nt, Homo sapiens
ccugaaauguuguguaga

SEQ ID NO: 10685 - RNA, 18 nt, Homo sapiens
cugugauuuuuguuuuua

SEQ ID NO: 10686 - RNA, 21 nt, Homo sapiens
ugaguggucaccaggcuugca

SEQ ID NO: 10687 - RNA, 20 nt, Homo sapiens
aaaagcaaacuaacaaagaa

SEQ ID NO: 10688 - RNA, 26 nt, Homo sapiens
auaacuuucucuuuaagccucugcua

SEQ ID NO: 10689 - RNA, 18 nt, Homo sapiens
auuuauucagcuacauca

SEQ ID NO: 10690 - RNA, 20 nt, Homo sapiens
caaucuugccugccuucugg

SEQ ID NO: 10691 - RNA, 21 nt, Homo sapiens
caccccaucaggcacgugugc

SEQ ID NO: 10692 - RNA, 18 nt, Homo sapiens
cccacauuacugaaacca

SEQ ID NO: 10693 - RNA, 19 nt, Homo sapiens
ccccuuacuccccucugca

SEQ ID NO: 10694 - RNA, 23 nt, Homo sapiens
cccuuuugucucugggaccagac

SEQ ID NO: 10695 - RNA, 22 nt, Homo sapiens
ccucuuuagcucucuuuaucuu

SEQ ID NO: 10696 - RNA, 22 nt, Homo sapiens
ccugauguccucaauugcugcu

SEQ ID NO: 10697 - RNA, 20 nt, Homo sapiens
ccugcuucagcagccccuca

SEQ ID NO: 10698 - RNA, 18 nt, Homo sapiens
gcgcgccgccgccgucug

SEQ ID NO: 10699 - RNA, 23 nt, Homo sapiens
gcucucuuuaucuuucucucuca

SEQ ID NO: 10700 - RNA, 23 nt, Homo sapiens
ugggucucaggcugggcucagca

SEQ ID NO: 10701 - RNA, 17 nt, Homo sapiens
cagguuauaaccuggua

SEQ ID NO: 10702 - RNA, 18 nt, Homo sapiens
gguuauaaccugguacca

SEQ ID NO: 10703 - RNA, 22 nt, Homo sapiens
gaccucaucuguggagcugcca

SEQ ID NO: 10704 - RNA, 22 nt, Homo sapiens
acagcgaucccgggacggucga

SEQ ID NO: 10705 - RNA, 19 nt, Homo sapiens
acagguggguaacccccac

SEQ ID NO: 10706 - RNA, 16 nt, Homo sapiens
cccacccaacccagcu

SEQ ID NO: 10707 - RNA, 25 nt, Homo sapiens
cccuucuuggaaggcagggcuggac

SEQ ID NO: 10708 - RNA, 16 nt, Homo sapiens
ccucccagagcagcca

SEQ ID NO: 10709 - RNA, 19 nt, Homo sapiens
ccuccccaggcuuugugag

SEQ ID NO: 10710 - RNA, 26 nt, Homo sapiens
cuggacagcagugggagguuugugag

SEQ ID NO: 10711 - RNA, 19 nt, Homo sapiens
cuugggcuggggccuggaa

SEQ ID NO: 10712 - RNA, 21 nt, Homo sapiens
gcagucggaaggguuuuuguu

SEQ ID NO: 10713 - RNA, 23 nt, Homo sapiens
uaguuuuguaguuucuuggcuuu

SEQ ID NO: 10714 - RNA, 22 nt, Homo sapiens
gccaaguaaacaggguaccuca

SEQ ID NO: 10715 - RNA, 27 nt, Homo sapiens
gugccaugcugggccacuggggacuuu

SEQ ID NO: 10716 - RNA, 20 nt, Homo sapiens
ucccacaugaggccaucuca

SEQ ID NO: 10717 - RNA, 21 nt, Homo sapiens
gagaugcagcagcuuacuccu

SEQ ID NO: 10718 - RNA, 20 nt, Homo sapiens
uugggagaacugcaccguua

SEQ ID NO: 10719 - RNA, 19 nt, Homo sapiens
ccccuccccacuccucucc

SEQ ID NO: 10720 - RNA, 18 nt, Homo sapiens
cuuggcaguguuugugag

SEQ ID NO: 10721 - RNA, 18 nt, Homo sapiens
caagaacaaggagcggac

SEQ ID NO: 10722 - RNA, 20 nt, Homo sapiens
gaagagggugaggaagccau

SEQ ID NO: 10723 - RNA, 16 nt, Homo sapiens
aaucuguaacauuacu

SEQ ID NO: 10724 - RNA, 20 nt, Homo sapiens
guggagcagccgaucgggga

SEQ ID NO: 10725 - RNA, 21 nt, Homo sapiens
uccaaacaccuugagcucucu

SEQ ID NO: 10726 - RNA, 20 nt, Homo sapiens
aaacccagcuccugagucuc

SEQ ID NO: 10727 - RNA, 18 nt, Homo sapiens
aacccagcucccacucuc

SEQ ID NO: 10728 - RNA, 17 nt, Homo sapiens
cucagugggcugcaguu

SEQ ID NO: 10729 - RNA, 21 nt, Homo sapiens
aagugugugauuucucuccca

SEQ ID NO: 10730 - RNA, 19 nt, Homo sapiens
acguuugacuggugugcug

SEQ ID NO: 10731 - RNA, 19 nt, Homo sapiens
agacuaacagcagaucucu

SEQ ID NO: 10732 - RNA, 17 nt, Homo sapiens
cagacucccuccuguga

SEQ ID NO: 10733 - RNA, 19 nt, Homo sapiens
cagucuagggaucuggcca

SEQ ID NO: 10734 - RNA, 22 nt, Homo sapiens
ccaaguuggaaaacacucuuca

SEQ ID NO: 10735 - RNA, 19 nt, Homo sapiens
gaauuuuucugucuuugga

SEQ ID NO: 10736 - RNA, 23 nt, Homo sapiens
aggaccgugcagggaugccaagc

SEQ ID NO: 10737 - RNA, 19 nt, Homo sapiens
uccagcaggggauccccac

SEQ ID NO: 10738 - RNA, 20 nt, Homo sapiens
ccagggacaccgccucccca

SEQ ID NO: 10739 - RNA, 21 nt, Homo sapiens
gagagugugacucccuugcca

SEQ ID NO: 10740 - RNA, 18 nt, Homo sapiens
guccaccccggaauccca

SEQ ID NO: 10741 - RNA, 20 nt, Homo sapiens
acauuugaaugaacuguaaa

SEQ ID NO: 10742 - RNA, 21 nt, Homo sapiens
caggauuugcuucuaggccca

SEQ ID NO: 10743 - RNA, 21 nt, Homo sapiens
gauccgagaacacacaaguga

SEQ ID NO: 10744 - RNA, 23 nt, Homo sapiens
cacacccacuuuguccauuugca

SEQ ID NO: 10745 - RNA, 23 nt, Homo sapiens
cugaaaccuaguacugcccccca

SEQ ID NO: 10746 - RNA, 18 nt, Homo sapiens
gcacuggggagucuuugu

SEQ ID NO: 10747 - RNA, 15 nt, Homo sapiens
ccuuggccaugugaa

SEQ ID NO: 10748 - RNA, 19 nt, Homo sapiens
cuagagcuagcaguuccca

SEQ ID NO: 10749 - RNA, 19 nt, Homo sapiens
ggggaggcucaaaccauua

SEQ ID NO: 10750 - RNA, 18 nt, Homo sapiens
ucugaugagguuucuggg

SEQ ID NO: 10751 - RNA, 17 nt, Homo sapiens
aucugaagaacagcccc

SEQ ID NO: 10752 - RNA, 21 nt, Homo sapiens
ccuggccucugcacugugaua

SEQ ID NO: 10753 - RNA, 17 nt, Homo sapiens
gcacuaccaaggccgac

SEQ ID NO: 10754 - RNA, 26 nt, Homo sapiens
gcacuaccaaggccgaccacuagagg

SEQ ID NO: 10755 - RNA, 19 nt, Homo sapiens
gcagacagcccuccucuca

SEQ ID NO: 10756 - RNA, 17 nt, Homo sapiens
gccucggccgucugccc

SEQ ID NO: 10757 - RNA, 19 nt, Homo sapiens
gcucuggucucccgcccca

SEQ ID NO: 10758 - RNA, 21 nt, Homo sapiens
uaggguuuggggggcuuggca

SEQ ID NO: 10759 - RNA, 23 nt, Homo sapiens
acaaggguauugauaugaaauua

SEQ ID NO: 10760 - RNA, 18 nt, Homo sapiens
agguaaaaaguuaacagg

SEQ ID NO: 10761 - RNA, 20 nt, Homo sapiens
caccaccgcgcgcccccgcu

SEQ ID NO: 10762 - RNA, 21 nt, Homo sapiens
caccaccgcgcgcccccgcuc

SEQ ID NO: 10763 - RNA, 22 nt, Homo sapiens
ccuuucauuuugcuuuaaguuu

SEQ ID NO: 10764 - RNA, 18 nt, Homo sapiens
guguaugugaguauucuc

SEQ ID NO: 10765 - RNA, 21 nt, Homo sapiens
aacgcccccaaaaucuguuuc

SEQ ID NO: 10766 - RNA, 17 nt, Homo sapiens
acuuggcacgguauuca

SEQ ID NO: 10767 - RNA, 22 nt, Homo sapiens
caguauuuuaucguccagaccc

SEQ ID NO: 10768 - RNA, 20 nt, Homo sapiens
ucaauacccuaccacagauc

SEQ ID NO: 10769 - RNA, 22 nt, Homo sapiens
acuaguaaacauauguuccuaa

SEQ ID NO: 10770 - RNA, 23 nt, Homo sapiens
aucaaugguuuaacaguuaucca

SEQ ID NO: 10771 - RNA, 20 nt, Homo sapiens
caauccaacuguacuggcca

SEQ ID NO: 10772 - RNA, 19 nt, Homo sapiens
cacaugcacacaugugcca

SEQ ID NO: 10773 - RNA, 18 nt, Homo sapiens
caucaguauaguguuuua

SEQ ID NO: 10774 - RNA, 20 nt, Homo sapiens
cugcacccaccaaccuguca

SEQ ID NO: 10775 - RNA, 19 nt, Homo sapiens
gucugucacacaugcacac

SEQ ID NO: 10776 - RNA, 20 nt, Homo sapiens
uaugacucucugcuauccca

SEQ ID NO: 10777 - RNA, 23 nt, Homo sapiens
ucugcauugagcauauuuucuua

SEQ ID NO: 10778 - RNA, 20 nt, Homo sapiens
cccgcccgggccccgccacc

SEQ ID NO: 10779 - RNA, 17 nt, Homo sapiens
ccucagcugacggggca

SEQ ID NO: 10780 - RNA, 16 nt, Homo sapiens
caguaauccuaaacua

SEQ ID NO: 10781 - RNA, 20 nt, Homo sapiens
cgccgcugcccgccucgaga

SEQ ID NO: 10782 - RNA, 19 nt, Homo sapiens
gaagggccgagcguccguu

SEQ ID NO: 10783 - RNA, 17 nt, Homo sapiens
gcacuccagucccauca

SEQ ID NO: 10784 - RNA, 20 nt, Homo sapiens
gggacgccaggcccgccccc

SEQ ID NO: 10785 - RNA, 22 nt, Homo sapiens
uccaauaacucucccccuuucc

SEQ ID NO: 10786 - RNA, 25 nt, Homo sapiens
agaauauggcuacacuuauacauca

SEQ ID NO: 10787 - RNA, 20 nt, Homo sapiens
agacaaaugccguuuccaca

SEQ ID NO: 10788 - RNA, 22 nt, Homo sapiens
ggagaguggcggcggcggcggc

SEQ ID NO: 10789 - RNA, 22 nt, Homo sapiens
gggucucccuuucugccuuucc

SEQ ID NO: 10790 - RNA, 18 nt, Homo sapiens
ggguggggaccgccgcca

SEQ ID NO: 10791 - RNA, 19 nt, Homo sapiens
uucugugaaaaggguugca

SEQ ID NO: 10792 - RNA, 21 nt, Homo sapiens
caacccaauccucugucuccu

SEQ ID NO: 10793 - RNA, 19 nt, Homo sapiens
gcuucuguuccuccgcgcc

SEQ ID NO: 10794 - RNA, 20 nt, Homo sapiens
aagaucggaacagcuccuua

SEQ ID NO: 10795 - RNA, 19 nt, Homo sapiens
cgcgccgccucgcgcucug

SEQ ID NO: 10796 - RNA, 17 nt, Homo sapiens
gggaacugacauaggcu

SEQ ID NO: 10797 - RNA, 24 nt, Homo sapiens
aucugagcccugcacgcugggccu

SEQ ID NO: 10798 - RNA, 18 nt, Homo sapiens
ccaagaugacugcuucag

SEQ ID NO: 10799 - RNA, 18 nt, Homo sapiens
cugcccucccccuccucu

SEQ ID NO: 10800 - RNA, 17 nt, Homo sapiens
gcagcugucacacgcua

SEQ ID NO: 10801 - RNA, 18 nt, Homo sapiens
ugucuuccuccccggcgg

SEQ ID NO: 10802 - RNA, 18 nt, Homo sapiens
auccucaacacuauugua

SEQ ID NO: 10803 - RNA, 25 nt, Homo sapiens
cuuaagucuuccuuaaaugacuuuu

SEQ ID NO: 10804 - RNA, 24 nt, Homo sapiens
cuuggcaaauuuuaaaacauuuuu

SEQ ID NO: 10805 - RNA, 22 nt, Homo sapiens
uguuuccuuaaacaugaaacug

SEQ ID NO: 10806 - RNA, 21 nt, Homo sapiens
augccaccucuuccugcuccc

SEQ ID NO: 10807 - RNA, 20 nt, Homo sapiens
caaauaacaaaugugccaug

SEQ ID NO: 10808 - RNA, 19 nt, Homo sapiens
ccguggaaugguuuucuua

SEQ ID NO: 10809 - RNA, 19 nt, Homo sapiens
ccucgccggccccuggucc

SEQ ID NO: 10810 - RNA, 19 nt, Homo sapiens
cgcgccaccacacccagcu

SEQ ID NO: 10811 - RNA, 18 nt, Homo sapiens
gaagggcacccccgccuc

SEQ ID NO: 10812 - RNA, 19 nt, Homo sapiens
gagcauuggugugcauuaa

SEQ ID NO: 10813 - RNA, 18 nt, Homo sapiens
uccaccuccuggguucaa

SEQ ID NO: 10814 - RNA, 20 nt, Homo sapiens
ugcaggagugaggcauggug

SEQ ID NO: 10815 - RNA, 17 nt, Homo sapiens
caaccccuccucucucu

SEQ ID NO: 10816 - RNA, 22 nt, Homo sapiens
caaccccuccucucucuguccc

SEQ ID NO: 10817 - RNA, 17 nt, Homo sapiens
cccuccccacuccuccu

SEQ ID NO: 10818 - RNA, 18 nt, Homo sapiens
guaagcaugguucaucuu

SEQ ID NO: 10819 - RNA, 18 nt, Homo sapiens
uccgcccuccagguucaa

SEQ ID NO: 10820 - RNA, 22 nt, Homo sapiens
uggagcaguuaacaugugacug

SEQ ID NO: 10821 - RNA, 23 nt, Homo sapiens
uggugcagccaaccaaccuggca

SEQ ID NO: 10822 - RNA, 18 nt, Homo sapiens
uucaagugauucucaugc

SEQ ID NO: 10823 - RNA, 23 nt, Homo sapiens
uuguaaacugugguugccugccu

SEQ ID NO: 10824 - RNA, 20 nt, Homo sapiens
caaggggacauggagaaagc

SEQ ID NO: 10825 - RNA, 21 nt, Homo sapiens
cugaagaccuggaauucccca

SEQ ID NO: 10826 - RNA, 17 nt, Homo sapiens
cuucccugcuucugccu

SEQ ID NO: 10827 - RNA, 19 nt, Homo sapiens
gguggauggagaggauaug

SEQ ID NO: 10828 - RNA, 21 nt, Homo sapiens
uggauggagaggauauggggc

SEQ ID NO: 10829 - RNA, 17 nt, Homo sapiens
gagcaaugccaguggcc

SEQ ID NO: 10830 - RNA, 27 nt, Homo sapiens
accuggauggggcaggccaccuggcuc

SEQ ID NO: 10831 - RNA, 18 nt, Homo sapiens
agugcucaaggccagcuu

SEQ ID NO: 10832 - RNA, 21 nt, Homo sapiens
ccuuccccaucguugccccca

SEQ ID NO: 10833 - RNA, 27 nt, Homo sapiens
ucuuuuuguagcuggggcuuugauguu

SEQ ID NO: 10834 - RNA, 21 nt, Homo sapiens
ccgcgcagcgcgagcgccuca

SEQ ID NO: 10835 - RNA, 20 nt, Homo sapiens
aagagaaccucagcauugug

SEQ ID NO: 10836 - RNA, 19 nt, Homo sapiens
ucagcauugugcacgauaa

SEQ ID NO: 10837 - RNA, 29 nt, Homo sapiens
gucuggacuaacccugugguugccugccc

SEQ ID NO: 10838 - RNA, 22 nt, Homo sapiens
uucaaauggccauuuuucucca

SEQ ID NO: 10839 - RNA, 20 nt, Homo sapiens
augaaaaauacaguuuguca

SEQ ID NO: 10840 - RNA, 26 nt, Homo sapiens
gcgagagagcugcugccacugcugcu

SEQ ID NO: 10841 - RNA, 15 nt, Homo sapiens
ugcaaagucaugcaa

SEQ ID NO: 10842 - RNA, 18 nt, Homo sapiens
uuggaaguugcauggcau

SEQ ID NO: 10843 - RNA, 18 nt, Homo sapiens
ggggucuugggcauuuca

SEQ ID NO: 10844 - RNA, 21 nt, Homo sapiens
ugagugggucucccaagacua

SEQ ID NO: 10845 - RNA, 18 nt, Homo sapiens
ccauggacaaggcagcua

SEQ ID NO: 10846 - RNA, 20 nt, Homo sapiens
ggcucgggcuaccaguccca

SEQ ID NO: 10847 - RNA, 22 nt, Homo sapiens
gguggguggggaggggcgcgcg

SEQ ID NO: 10848 - RNA, 19 nt, Homo sapiens
caguuuuaaauccuuugcg

SEQ ID NO: 10849 - RNA, 17 nt, Homo sapiens
ggaacuaaagucuguga

SEQ ID NO: 10850 - RNA, 20 nt, Homo sapiens
gcggcgcagcugacugcugc

SEQ ID NO: 10851 - RNA, 22 nt, Homo sapiens
auguaucuguacaguagcuuuc

SEQ ID NO: 10852 - RNA, 18 nt, Homo sapiens
auuaccaccgacucggcc

SEQ ID NO: 10853 - RNA, 20 nt, Homo sapiens
cugccucaacugucugguuu

SEQ ID NO: 10854 - RNA, 20 nt, Homo sapiens
cuuguccgggggguuugagg

SEQ ID NO: 10855 - RNA, 19 nt, Homo sapiens
gauuguuuuagauucuuuc

SEQ ID NO: 10856 - RNA, 19 nt, Homo sapiens
uaucagugccagcccaaua

SEQ ID NO: 10857 - RNA, 21 nt, Homo sapiens
ucugaucguucugaagcuugc

SEQ ID NO: 10858 - RNA, 26 nt, Homo sapiens
ugcugaagaaauccaacaucauucca

SEQ ID NO: 10859 - RNA, 19 nt, Homo sapiens
uggcugcuuucucuaacca

SEQ ID NO: 10860 - RNA, 18 nt, Homo sapiens
uuguuaauauccaucaua

SEQ ID NO: 10861 - RNA, 17 nt, Homo sapiens
agaguucacaaaaagcc

SEQ ID NO: 10862 - RNA, 21 nt, Homo sapiens
auaagaacuguacucuucuca

SEQ ID NO: 10863 - RNA, 20 nt, Homo sapiens
auuuaaaacuuguugcccca

SEQ ID NO: 10864 - RNA, 18 nt, Homo sapiens
cuggacaccaccuggccu

SEQ ID NO: 10865 - RNA, 20 nt, Homo sapiens
gacucuuggauaugaaacug

SEQ ID NO: 10866 - RNA, 24 nt, Homo sapiens
acaggacgaaugcauauucaacac

SEQ ID NO: 10867 - RNA, 20 nt, Homo sapiens
gaacagcucaucuucaaagu

SEQ ID NO: 10868 - RNA, 19 nt, Homo sapiens
gcggaggagggggggguac

SEQ ID NO: 10869 - RNA, 18 nt, Homo sapiens
guggugguucauuccaca

SEQ ID NO: 10870 - RNA, 18 nt, Homo sapiens
uagaaaaugcaccaaaua

SEQ ID NO: 10871 - RNA, 20 nt, Homo sapiens
uaugaauugcugucuagccu

SEQ ID NO: 10872 - RNA, 18 nt, Homo sapiens
aaaccaagccguggcuuc

SEQ ID NO: 10873 - RNA, 19 nt, Homo sapiens
aagaaauaaaagcguugca

SEQ ID NO: 10874 - RNA, 23 nt, Homo sapiens
cuguggauuucuacacccuugau

SEQ ID NO: 10875 - RNA, 16 nt, Homo sapiens
cccagaagugucccag

SEQ ID NO: 10876 - RNA, 17 nt, Homo sapiens
cccgcacgcaggcuucc

SEQ ID NO: 10877 - RNA, 24 nt, Homo sapiens
ggcccccgacccaucacugccaca

SEQ ID NO: 10878 - RNA, 23 nt, Homo sapiens
uuugaugcaaccaaguuauuuuu

SEQ ID NO: 10879 - RNA, 19 nt, Homo sapiens
aaagucaacuccccucccc

SEQ ID NO: 10880 - RNA, 19 nt, Homo sapiens
acuuucauacauggaugaa

SEQ ID NO: 10881 - RNA, 17 nt, Homo sapiens
caaaaaacaaaaccacu

SEQ ID NO: 10882 - RNA, 20 nt, Homo sapiens
caaaacauguugaacaucca

SEQ ID NO: 10883 - RNA, 21 nt, Homo sapiens
cauuaagaauuucugaauaug

SEQ ID NO: 10884 - RNA, 19 nt, Homo sapiens
ccauucgaaauucaugaua

SEQ ID NO: 10885 - RNA, 19 nt, Homo sapiens
ccucuucgacugccuguuc

SEQ ID NO: 10886 - RNA, 22 nt, Homo sapiens
gagccaagauggcgccacugca

SEQ ID NO: 10887 - RNA, 20 nt, Homo sapiens
ggccccggguauugacccca

SEQ ID NO: 10888 - RNA, 20 nt, Homo sapiens
uugcuugugguaaccauuua

SEQ ID NO: 10889 - RNA, 18 nt, Homo sapiens
gcaugucauguauucuca

SEQ ID NO: 10890 - RNA, 19 nt, Homo sapiens
uaucguauaaaaaucugcu

SEQ ID NO: 10891 - RNA, 23 nt, Homo sapiens
ucaccauuaaauauaauuggcua

SEQ ID NO: 10892 - RNA, 26 nt, Homo sapiens
ucuuuucauagucuucuuuguauuuu

SEQ ID NO: 10893 - RNA, 19 nt, Homo sapiens
aagcaauucuccugccuca

SEQ ID NO: 10894 - RNA, 18 nt, Homo sapiens
ccugcaaccuccaccucc

SEQ ID NO: 10895 - RNA, 18 nt, Homo sapiens
uccaccuccuggguucaa

SEQ ID NO: 10896 - RNA, 18 nt, Homo sapiens
gccugagaaaagagggua

SEQ ID NO: 10897 - RNA, 28 nt, Homo sapiens
uugccguggagucgcgaccucuuggccc

SEQ ID NO: 10898 - RNA, 16 nt, Homo sapiens
cccgcgccccggcccg

SEQ ID NO: 10899 - RNA, 20 nt, Homo sapiens
uuuuuugggaauucaaggga

SEQ ID NO: 10900 - RNA, 21 nt, Homo sapiens
ucccacugcccccgccucuca

SEQ ID NO: 10901 - RNA, 19 nt, Homo sapiens
acagccaaauugcagaaga

SEQ ID NO: 10902 - RNA, 20 nt, Homo sapiens
acauuuggcuccacuguaaa

SEQ ID NO: 10903 - RNA, 19 nt, Homo sapiens
accacuaucuuuuguucua

SEQ ID NO: 10904 - RNA, 21 nt, Homo sapiens
ccagggcggccgggcgcccca

SEQ ID NO: 10905 - RNA, 20 nt, Homo sapiens
gauucaagugcaauccaugu

SEQ ID NO: 10906 - RNA, 21 nt, Homo sapiens
guagcuggagagagaguucuc

SEQ ID NO: 10907 - RNA, 21 nt, Homo sapiens
ucaaaagauuaacaacacugc

SEQ ID NO: 10908 - RNA, 18 nt, Homo sapiens
augcaacacuguguccag

SEQ ID NO: 10909 - RNA, 20 nt, Homo sapiens
gcccagcauggaccugguga

SEQ ID NO: 10910 - RNA, 22 nt, Homo sapiens
gguguucacucucgccagcuca

SEQ ID NO: 10911 - RNA, 21 nt, Homo sapiens
auguuaacaaagaauaaauaa

SEQ ID NO: 10912 - RNA, 17 nt, Homo sapiens
cagagcccuccugcuca

SEQ ID NO: 10913 - RNA, 17 nt, Homo sapiens
cauuuuacacaguuuua

SEQ ID NO: 10914 - RNA, 20 nt, Homo sapiens
uaggacuucuguuuccuggu

SEQ ID NO: 10915 - RNA, 20 nt, Homo sapiens
uuugcaaguuugccaccagu

SEQ ID NO: 10916 - RNA, 20 nt, Homo sapiens
auuugagcccagcuuggcuc

SEQ ID NO: 10917 - RNA, 19 nt, Homo sapiens
ccaucccacugggacauuu

SEQ ID NO: 10918 - RNA, 19 nt, Homo sapiens
gccugccugugucugcuga

SEQ ID NO: 10919 - RNA, 19 nt, Homo sapiens
augugauagagacaucucu

SEQ ID NO: 10920 - RNA, 17 nt, Homo sapiens
ccuuuuccuucucugaa

SEQ ID NO: 10921 - RNA, 19 nt, Homo sapiens
aaagagagcacuuucgaca

SEQ ID NO: 10922 - RNA, 20 nt, Homo sapiens
aggcacuucuaacucacccc

SEQ ID NO: 10923 - RNA, 21 nt, Homo sapiens
ccacgcaaguaagccugcugu

SEQ ID NO: 10924 - RNA, 19 nt, Homo sapiens
cugcaagcucugccuccca

SEQ ID NO: 10925 - RNA, 21 nt, Homo sapiens
cauguaagcuggggccgcuca

SEQ ID NO: 10926 - RNA, 18 nt, Homo sapiens
uucuguuucauauuuuuc

SEQ ID NO: 10927 - RNA, 17 nt, Homo sapiens
agauuaaugggcauugu

SEQ ID NO: 10928 - RNA, 21 nt, Homo sapiens
cccagacuuuacgacuacaca

SEQ ID NO: 10929 - RNA, 22 nt, Homo sapiens
gcuauauucccauugcucugaa

SEQ ID NO: 10930 - RNA, 22 nt, Homo sapiens
cacuucucuccucagacuucaa

SEQ ID NO: 10931 - RNA, 18 nt, Homo sapiens
gccaaucaggacuuucca

SEQ ID NO: 10932 - RNA, 18 nt, Homo sapiens
uuuggcgcugacuuggaa

SEQ ID NO: 10933 - RNA, 20 nt, Homo sapiens
aauauauuucacauccuucu

SEQ ID NO: 10934 - RNA, 23 nt, Homo sapiens
ccucacccuugggcuuugcugcc

SEQ ID NO: 10935 - RNA, 18 nt, Homo sapiens
cugccccaauccucccca

SEQ ID NO: 10936 - RNA, 21 nt, Homo sapiens
ucccugcuccuaaccccugcc

SEQ ID NO: 10937 - RNA, 18 nt, Homo sapiens
uggucauguucguggugu

SEQ ID NO: 10938 - RNA, 19 nt, Homo sapiens
aaaucccaacauauauacu

SEQ ID NO: 10939 - RNA, 22 nt, Homo sapiens
acaaagaucauauccaugugua

SEQ ID NO: 10940 - RNA, 18 nt, Homo sapiens
ccugcaaccuccaccucc

SEQ ID NO: 10941 - RNA, 18 nt, Homo sapiens
ccuugaauaagucuccca

SEQ ID NO: 10942 - RNA, 22 nt, Homo sapiens
cuuccauucauuguuuacgcug

SEQ ID NO: 10943 - RNA, 23 nt, Homo sapiens
gacccaacuuuucuagugugcca

SEQ ID NO: 10944 - RNA, 26 nt, Homo sapiens
uccacggccacuccgccucuucccuc

SEQ ID NO: 10945 - RNA, 22 nt, Homo sapiens
ccccaugcucccuucucugcca

SEQ ID NO: 10946 - RNA, 18 nt, Homo sapiens
cccccaaccccuucacca

SEQ ID NO: 10947 - RNA, 22 nt, Homo sapiens
gacggagccucuggcggcucgu

SEQ ID NO: 10948 - RNA, 19 nt, Homo sapiens
aaacuccugaccucaggug

SEQ ID NO: 10949 - RNA, 18 nt, Homo sapiens
uccgccuccuggguucaa

SEQ ID NO: 10950 - RNA, 17 nt, Homo sapiens
uaggacuacccaaguca

SEQ ID NO: 10951 - RNA, 18 nt, Homo sapiens
uggucuuaacuuuaggua

SEQ ID NO: 10952 - RNA, 15 nt, Homo sapiens
cagagcagagucugg

SEQ ID NO: 10953 - RNA, 23 nt, Homo sapiens
cccaagguccccuccacauccca

SEQ ID NO: 10954 - RNA, 18 nt, Homo sapiens
ccuuuggaaagccauuga

SEQ ID NO: 10955 - RNA, 18 nt, Homo sapiens
gccugcugagagccccca

SEQ ID NO: 10956 - RNA, 19 nt, Homo sapiens
gcuccaggggcccuuggga

SEQ ID NO: 10957 - RNA, 21 nt, Homo sapiens
agcuggggcaaggggcagcca

SEQ ID NO: 10958 - RNA, 21 nt, Homo sapiens
aucuucauguggacauugaga

SEQ ID NO: 10959 - RNA, 15 nt, Homo sapiens
gcaccuguugugugc

SEQ ID NO: 10960 - RNA, 21 nt, Homo sapiens
ugcugccaaguuagcuauugg

SEQ ID NO: 10961 - RNA, 22 nt, Homo sapiens
auuugagccucaucucuggcuu

SEQ ID NO: 10962 - RNA, 20 nt, Homo sapiens
aaaaugccaaguuguccuga

SEQ ID NO: 10963 - RNA, 18 nt, Homo sapiens
aaagcagaaaguacugca

SEQ ID NO: 10964 - RNA, 19 nt, Homo sapiens
acgguugcucaacacauca

SEQ ID NO: 10965 - RNA, 19 nt, Homo sapiens
agcccgcgcgccgagcccc

SEQ ID NO: 10966 - RNA, 21 nt, Homo sapiens
cuggugaugaccaugcaccuu

SEQ ID NO: 10967 - RNA, 19 nt, Homo sapiens
gugucacugcuggugaacu

SEQ ID NO: 10968 - RNA, 17 nt, Homo sapiens
ucaagugauucuccugc

SEQ ID NO: 10969 - RNA, 21 nt, Homo sapiens
acuggauccagaguuugccgu

SEQ ID NO: 10970 - RNA, 21 nt, Homo sapiens
uuuccugggaauccacacguu

SEQ ID NO: 10971 - RNA, 19 nt, Homo sapiens
aggaaaauuaugcccaguu

SEQ ID NO: 10972 - RNA, 23 nt, Homo sapiens
caaacacugugguuguuugguuc

SEQ ID NO: 10973 - RNA, 18 nt, Homo sapiens
ccugcuucaccgucgucc

SEQ ID NO: 10974 - RNA, 16 nt, Homo sapiens
cgggccagugggcgag

SEQ ID NO: 10975 - RNA, 21 nt, Homo sapiens
gaacccuccgcaccggguccc

SEQ ID NO: 10976 - RNA, 20 nt, Homo sapiens
gcgucugcacccccugcuuc

SEQ ID NO: 10977 - RNA, 22 nt, Homo sapiens
uacgcuucgcuaccaccagcgg

SEQ ID NO: 10978 - RNA, 17 nt, Homo sapiens
ucaaaugcaaaucuuua

SEQ ID NO: 10979 - RNA, 19 nt, Homo sapiens
ucuguugacauaguaacuc

SEQ ID NO: 10980 - RNA, 19 nt, Homo sapiens
uggacauuaacuggaacug

SEQ ID NO: 10981 - RNA, 23 nt, Homo sapiens
uuccuucuugccugcucugugga

SEQ ID NO: 10982 - RNA, 23 nt, Homo sapiens
auauucugcuauugcagcaauua

SEQ ID NO: 10983 - RNA, 24 nt, Homo sapiens
augguuacacuaaccaaaagacac

SEQ ID NO: 10984 - RNA, 19 nt, Homo sapiens
augugaugcuugauauuuu

SEQ ID NO: 10985 - RNA, 21 nt, Homo sapiens
cacuuggggagauuugccaca

SEQ ID NO: 10986 - RNA, 22 nt, Homo sapiens
ggacccuagcgacggucguggc

SEQ ID NO: 10987 - RNA, 17 nt, Homo sapiens
uuaaaacaccucugcuu

SEQ ID NO: 10988 - RNA, 20 nt, Homo sapiens
uucugcuauugcagcaauua

SEQ ID NO: 10989 - RNA, 23 nt, Homo sapiens
uuuaguauaccggaauuacuuuu

SEQ ID NO: 10990 - RNA, 19 nt, Homo sapiens
uuucugauguugccuuaau

SEQ ID NO: 10991 - RNA, 18 nt, Homo sapiens
cugcaacaggcuugugca

SEQ ID NO: 10992 - RNA, 23 nt, Homo sapiens
gagcugcccuccuuguccaccca

SEQ ID NO: 10993 - RNA, 18 nt, Homo sapiens
ggcauuugacugaagaug

SEQ ID NO: 10994 - RNA, 20 nt, Homo sapiens
ggucaccagcaccaacacca

SEQ ID NO: 10995 - RNA, 22 nt, Homo sapiens
uccuacccacaccucugccaga

SEQ ID NO: 10996 - RNA, 17 nt, Homo sapiens
cugagccugcugggccc

SEQ ID NO: 10997 - RNA, 20 nt, Homo sapiens
accguccucgaucuguacga

SEQ ID NO: 10998 - RNA, 18 nt, Homo sapiens
uuuaaguaaguucuuuga

SEQ ID NO: 10999 - RNA, 22 nt, Homo sapiens
ccacuacaggccccacaccugc

SEQ ID NO: 11000 - RNA, 22 nt, Homo sapiens
caagaggaccaaccgcagccca

SEQ ID NO: 11001 - RNA, 24 nt, Homo sapiens
cccuccccccgggaggcuugcgaa

SEQ ID NO: 11002 - RNA, 23 nt, Homo sapiens
gcaaagcagccugaguuauuuuu

SEQ ID NO: 11003 - RNA, 20 nt, Homo sapiens
gugcgcgcugcgacaccucc

SEQ ID NO: 11004 - RNA, 17 nt, Homo sapiens
auguggggaaacauuuu

SEQ ID NO: 11005 - RNA, 23 nt, Homo sapiens
ccuaccagggcuuucuuggcuuu

SEQ ID NO: 11006 - RNA, 19 nt, Homo sapiens
ccuucgugccucauggaau

SEQ ID NO: 11007 - RNA, 27 nt, Homo sapiens
cucuguguguguauguguguguuuaua

SEQ ID NO: 11008 - RNA, 18 nt, Homo sapiens
cuucuucaauuucuuuca

SEQ ID NO: 11009 - RNA, 26 nt, Homo sapiens
ugaauggguuucuauauaugggucug

SEQ ID NO: 11010 - RNA, 19 nt, Homo sapiens
gccccaccccaccauggua

SEQ ID NO: 11011 - RNA, 17 nt, Homo sapiens
ucauggcugaucagagc

SEQ ID NO: 11012 - RNA, 18 nt, Homo sapiens
gcgacgcgcccggcccgg

SEQ ID NO: 11013 - RNA, 18 nt, Homo sapiens
ugcccccaacacauucaa

SEQ ID NO: 11014 - RNA, 20 nt, Homo sapiens
uacgcgcucucccuguuuag

SEQ ID NO: 11015 - RNA, 24 nt, Homo sapiens
ucuuuguuuuccuuugcuguuccu

SEQ ID NO: 11016 - RNA, 20 nt, Homo sapiens
guauguauuuauuacuugau

SEQ ID NO: 11017 - RNA, 23 nt, Homo sapiens
uuuaaaagaugcacggaaaguua

SEQ ID NO: 11018 - RNA, 21 nt, Homo sapiens
gugguaggaggguuuuuuuua

SEQ ID NO: 11019 - RNA, 19 nt, Homo sapiens
uccucccugcuuucuggug

SEQ ID NO: 11020 - RNA, 21 nt, Homo sapiens
cccucaaggaggacuggugga

SEQ ID NO: 11021 - RNA, 19 nt, Homo sapiens
ggucuagagcauggccagc

SEQ ID NO: 11022 - RNA, 18 nt, Homo sapiens
aagccaggucuucucucu

SEQ ID NO: 11023 - RNA, 16 nt, Homo sapiens
ccauggccucugccag

SEQ ID NO: 11024 - RNA, 21 nt, Homo sapiens
augagagaaacaggaaacaaa

SEQ ID NO: 11025 - RNA, 19 nt, Homo sapiens
aacucuuccccuccugcuu

SEQ ID NO: 11026 - RNA, 18 nt, Homo sapiens
aggcacuugggaacuuac

SEQ ID NO: 11027 - RNA, 19 nt, Homo sapiens
cagcuugcaaauacguacu

SEQ ID NO: 11028 - RNA, 20 nt, Homo sapiens
ucaaacaugguuauuucugu

SEQ ID NO: 11029 - RNA, 18 nt, Homo sapiens
ugacuuuaacuuuagaca

SEQ ID NO: 11030 - RNA, 19 nt, Homo sapiens
ugguuauuucugucaguga

SEQ ID NO: 11031 - RNA, 26 nt, Homo sapiens
aguuagaaguacuucugucucacuua

SEQ ID NO: 11032 - RNA, 21 nt, Homo sapiens
uacaagggcaaagacacuaca

SEQ ID NO: 11033 - RNA, 19 nt, Homo sapiens
cuugaucacuugaagcuca

SEQ ID NO: 11034 - RNA, 24 nt, Homo sapiens
guaugugugggcuugcuuagauua

SEQ ID NO: 11035 - RNA, 22 nt, Homo sapiens
uaguaaacacaaaagauuguua

SEQ ID NO: 11036 - RNA, 23 nt, Homo sapiens
uuuguaauucuugugucacuuuu

SEQ ID NO: 11037 - RNA, 20 nt, Homo sapiens
caccaccaccaccuuccuuc

SEQ ID NO: 11038 - RNA, 18 nt, Homo sapiens
cacacacaccagauaaua

SEQ ID NO: 11039 - RNA, 18 nt, Homo sapiens
ucaagacuccaauagaca

SEQ ID NO: 11040 - RNA, 17 nt, Homo sapiens
ugacauuacacaacuca

SEQ ID NO: 11041 - RNA, 19 nt, Homo sapiens
ugauggauugauagugaaa

SEQ ID NO: 11042 - RNA, 21 nt, Homo sapiens
agaagcguccguccucgagcc

SEQ ID NO: 11043 - RNA, 18 nt, Homo sapiens
cucucacuaaagauguua

SEQ ID NO: 11044 - RNA, 18 nt, Homo sapiens
uaaguacacacaaacaaa

SEQ ID NO: 11045 - RNA, 20 nt, Homo sapiens
cuggggugccauuuuguuuu

SEQ ID NO: 11046 - RNA, 20 nt, Homo sapiens
ucugaaauacucucuggugc

SEQ ID NO: 11047 - RNA, 18 nt, Homo sapiens
uccgccuccuggguucaa

SEQ ID NO: 11048 - RNA, 18 nt, Homo sapiens
accacuaauuguguacau

SEQ ID NO: 11049 - RNA, 30 nt, Homo sapiens
auagaugaacaugguguucaaccugugcuc

SEQ ID NO: 11050 - RNA, 21 nt, Homo sapiens
cuaagcaaacaaguuggaauu

SEQ ID NO: 11051 - RNA, 18 nt, Homo sapiens
acaagaaauuaccggaga

SEQ ID NO: 11052 - RNA, 22 nt, Homo sapiens
aacgaauugcaugcauguugaa

SEQ ID NO: 11053 - RNA, 20 nt, Homo sapiens
aaugauugugcaaaaaguca

SEQ ID NO: 11054 - RNA, 20 nt, Homo sapiens
ccagacaauucucccagucc

SEQ ID NO: 11055 - RNA, 16 nt, Homo sapiens
cuaucauagcacagua

SEQ ID NO: 11056 - RNA, 18 nt, Homo sapiens
guaugaacacaauugcua

SEQ ID NO: 11057 - RNA, 21 nt, Homo sapiens
uuugcuuaaaacagagcccac

SEQ ID NO: 11058 - RNA, 18 nt, Homo sapiens
aguagcaccauuaucccc

SEQ ID NO: 11059 - RNA, 20 nt, Homo sapiens
auugugucaucaagcauucc

SEQ ID NO: 11060 - RNA, 18 nt, Homo sapiens
cacagacgcuuguuccag

SEQ ID NO: 11061 - RNA, 18 nt, Homo sapiens
caccaccauccccccauc

SEQ ID NO: 11062 - RNA, 23 nt, Homo sapiens
ccaccaaaagccucuccugcuga

SEQ ID NO: 11063 - RNA, 18 nt, Homo sapiens
ccccacucuagacccccc

SEQ ID NO: 11064 - RNA, 16 nt, Homo sapiens
cgaggucacggugagu

SEQ ID NO: 11065 - RNA, 18 nt, Homo sapiens
cugaucacuguccuugcc

SEQ ID NO: 11066 - RNA, 20 nt, Homo sapiens
gccacagugaccgccugccc

SEQ ID NO: 11067 - RNA, 21 nt, Homo sapiens
gcccaccacaagaggcuguga

SEQ ID NO: 11068 - RNA, 21 nt, Homo sapiens
ugcccaggcugcccugcccag

SEQ ID NO: 11069 - RNA, 19 nt, Homo sapiens
aucaggauuuccgcauuau

SEQ ID NO: 11070 - RNA, 19 nt, Homo sapiens
aucuaauauauauauuaca

SEQ ID NO: 11071 - RNA, 20 nt, Homo sapiens
gccaaaugaacuaaacauug

SEQ ID NO: 11072 - RNA, 22 nt, Homo sapiens
uaggaaaucaccuggcuugguu

SEQ ID NO: 11073 - RNA, 20 nt, Homo sapiens
uccccggaccagcccucagu

SEQ ID NO: 11074 - RNA, 19 nt, Homo sapiens
ccaaaauaaaaaccuucca

SEQ ID NO: 11075 - RNA, 21 nt, Homo sapiens
ccaggagcucaaccucaugua

SEQ ID NO: 11076 - RNA, 22 nt, Homo sapiens
gggaggcggcggcagcugcggc

SEQ ID NO: 11077 - RNA, 19 nt, Homo sapiens
uaaaaaccuuccaaacaaa

SEQ ID NO: 11078 - RNA, 25 nt, Homo sapiens
acaauucuacuguaacuacccauca

SEQ ID NO: 11079 - RNA, 17 nt, Homo sapiens
cuaccugagaccaugcc

SEQ ID NO: 11080 - RNA, 18 nt, Homo sapiens
ggaaaaaaaaaacagcaa

SEQ ID NO: 11081 - RNA, 18 nt, Homo sapiens
ucauuggaauguugcaca

SEQ ID NO: 11082 - RNA, 21 nt, Homo sapiens
aaauauaggucugcacugcaa

SEQ ID NO: 11083 - RNA, 15 nt, Homo sapiens
aacauguaccauuaa

SEQ ID NO: 11084 - RNA, 21 nt, Homo sapiens
agaagucuccuuucuguuuca

SEQ ID NO: 11085 - RNA, 18 nt, Homo sapiens
aguuucacucuguugcag

SEQ ID NO: 11086 - RNA, 16 nt, Homo sapiens
auguuguacaugagaa

SEQ ID NO: 11087 - RNA, 22 nt, Homo sapiens
ccuuccccuccacccuccccca

SEQ ID NO: 11088 - RNA, 15 nt, Homo sapiens
guucuuuuguuccgg

SEQ ID NO: 11089 - RNA, 18 nt, Homo sapiens
auuagagaucgaagccuc

SEQ ID NO: 11090 - RNA, 18 nt, Homo sapiens
ccuuucuccucuccccuc

SEQ ID NO: 11091 - RNA, 18 nt, Homo sapiens
guggaacccuugccccca

SEQ ID NO: 11092 - RNA, 16 nt, Homo sapiens
uaggccacaacacccc

SEQ ID NO: 11093 - RNA, 21 nt, Homo sapiens
uccuaucuccacaucucugaa

SEQ ID NO: 11094 - RNA, 20 nt, Homo sapiens
cuaauaucauuuugugacug

SEQ ID NO: 11095 - RNA, 21 nt, Homo sapiens
gcaguuuugagaaucaguuuu

SEQ ID NO: 11096 - RNA, 19 nt, Homo sapiens
uguuucuaucucuaaauga

SEQ ID NO: 11097 - RNA, 24 nt, Homo sapiens
caacacaguuuuacauugcccuga

SEQ ID NO: 11098 - RNA, 18 nt, Homo sapiens
ggaggcgguggcuguggc

SEQ ID NO: 11099 - RNA, 19 nt, Homo sapiens
aagcaauucuccugccuca

SEQ ID NO: 11100 - RNA, 18 nt, Homo sapiens
caaacacacgcugcaauu

SEQ ID NO: 11101 - RNA, 18 nt, Homo sapiens
gaaugugaucugagacua

SEQ ID NO: 11102 - RNA, 23 nt, Homo sapiens
guccagcuucagacccacucuuu

SEQ ID NO: 11103 - RNA, 19 nt, Homo sapiens
uuuauaauuugcccuugaa

SEQ ID NO: 11104 - RNA, 22 nt, Homo sapiens
gagccaagacuacgccacugca

SEQ ID NO: 11105 - RNA, 18 nt, Homo sapiens
ggaacuaccugccuuuca

SEQ ID NO: 11106 - RNA, 19 nt, Homo sapiens
guaagcugagaucgcugca

SEQ ID NO: 11107 - RNA, 25 nt, Homo sapiens
ugucuaggagggaugaccccacuca

SEQ ID NO: 11108 - RNA, 18 nt, Homo sapiens
uuucacuuugcggaguug

SEQ ID NO: 11109 - RNA, 21 nt, Homo sapiens
uuugccuugucaauguauuua

SEQ ID NO: 11110 - RNA, 19 nt, Homo sapiens
aaaaguaagauuucaguca

SEQ ID NO: 11111 - RNA, 20 nt, Homo sapiens
aggaaauagauggugccccc

SEQ ID NO: 11112 - RNA, 21 nt, Homo sapiens
cacaugaccaaucauauggua

SEQ ID NO: 11113 - RNA, 18 nt, Homo sapiens
ccagaaaugcugcuucca

SEQ ID NO: 11114 - RNA, 20 nt, Homo sapiens
ccccgccgccgccccccagc

SEQ ID NO: 11115 - RNA, 22 nt, Homo sapiens
gcgcuccagcagcugcugccgc

SEQ ID NO: 11116 - RNA, 18 nt, Homo sapiens
gcuaggggguguuucuca

SEQ ID NO: 11117 - RNA, 20 nt, Homo sapiens
ggaucccagcacaucacugu

SEQ ID NO: 11118 - RNA, 17 nt, Homo sapiens
uggaccgugugaagcua

SEQ ID NO: 11119 - RNA, 23 nt, Homo sapiens
cgccuguaaucccagccacucca

SEQ ID NO: 11120 - RNA, 20 nt, Homo sapiens
cugcaguauuugagcaggga

SEQ ID NO: 11121 - RNA, 23 nt, Homo sapiens
uuugagcagggacagucauuuuu

SEQ ID NO: 11122 - RNA, 18 nt, Homo sapiens
acccaaaugaaaauuuca

SEQ ID NO: 11123 - RNA, 22 nt, Homo sapiens
cauuggauuucaugccauccca

SEQ ID NO: 11124 - RNA, 18 nt, Homo sapiens
ucaggagacaacuugcac

SEQ ID NO: 11125 - RNA, 22 nt, Homo sapiens
ucuuuucuucugguuuaauuuu

SEQ ID NO: 11126 - RNA, 22 nt, Homo sapiens
uucaaaacaaauauuuacuuca

SEQ ID NO: 11127 - RNA, 18 nt, Homo sapiens
aagaagcccaccacuagg

SEQ ID NO: 11128 - RNA, 20 nt, Homo sapiens
ccaaagucacuccuguuuug

SEQ ID NO: 11129 - RNA, 22 nt, Homo sapiens
gaaggaacuacuucagugcaca

SEQ ID NO: 11130 - RNA, 23 nt, Homo sapiens
uuuaggauguucuggaugcuuuu

SEQ ID NO: 11131 - RNA, 19 nt, Homo sapiens
agcaucuugaaaagaaaaa

SEQ ID NO: 11132 - RNA, 19 nt, Homo sapiens
ccaagcuaaauuuguauug

SEQ ID NO: 11133 - RNA, 19 nt, Homo sapiens
ucaaccauuacucacacuu

SEQ ID NO: 11134 - RNA, 20 nt, Homo sapiens
ugaguaaugccacaauggca

SEQ ID NO: 11135 - RNA, 17 nt, Homo sapiens
accgcgacggcugaggc

SEQ ID NO: 11136 - RNA, 22 nt, Homo sapiens
agcccugcccccgcgagccucc

SEQ ID NO: 11137 - RNA, 24 nt, Homo sapiens
guuaccaccucgagacuugucuca

SEQ ID NO: 11138 - RNA, 19 nt, Homo sapiens
gaaaucucuacacauuuca

SEQ ID NO: 11139 - RNA, 17 nt, Homo sapiens
caccgccgccgagccgc

SEQ ID NO: 11140 - RNA, 17 nt, Homo sapiens
ugucagaaaauaccuuu

SEQ ID NO: 11141 - RNA, 22 nt, Homo sapiens
auuggaaucugccuccuaauga

SEQ ID NO: 11142 - RNA, 22 nt, Homo sapiens
cagaaaacaaguacuaugugau

SEQ ID NO: 11143 - RNA, 20 nt, Homo sapiens
cugugcuucauauuuguaca

SEQ ID NO: 11144 - RNA, 19 nt, Homo sapiens
uaugugaugaaaacauuuc

SEQ ID NO: 11145 - RNA, 19 nt, Homo sapiens
aagugggccccacccugcc

SEQ ID NO: 11146 - RNA, 21 nt, Homo sapiens
ccaaggggaagcagcuccuca

SEQ ID NO: 11147 - RNA, 22 nt, Homo sapiens
ccugagaggcccccagaucacu

SEQ ID NO: 11148 - RNA, 21 nt, Homo sapiens
ccuggugcugccgugccccca

SEQ ID NO: 11149 - RNA, 25 nt, Homo sapiens
cucagggaacagcagcagugccaua

SEQ ID NO: 11150 - RNA, 25 nt, Homo sapiens
ggccgucccaaaagcggccgcuucc

SEQ ID NO: 11151 - RNA, 19 nt, Homo sapiens
gugccuuggccacaaugcg

SEQ ID NO: 11152 - RNA, 20 nt, Homo sapiens
uaggauugaacaguucaguu

SEQ ID NO: 11153 - RNA, 19 nt, Homo sapiens
uucuacacugaaaauguua

SEQ ID NO: 11154 - RNA, 19 nt, Homo sapiens
ggggaugggcccgcggcug

SEQ ID NO: 11155 - RNA, 22 nt, Homo sapiens
guagaagucaacuucaucugaa

SEQ ID NO: 11156 - RNA, 19 nt, Homo sapiens
uaaaaacauuaaaaauaaa

SEQ ID NO: 11157 - RNA, 18 nt, Homo sapiens
auucccacaucuacauca

SEQ ID NO: 11158 - RNA, 17 nt, Homo sapiens
ccaauaaauuuguguua

SEQ ID NO: 11159 - RNA, 18 nt, Homo sapiens
ugauggaucuacuuaugg

SEQ ID NO: 11160 - RNA, 21 nt, Homo sapiens
uguugauguacaguuucugaa

SEQ ID NO: 11161 - RNA, 18 nt, Homo sapiens
gucuacaaaaucaugaua

SEQ ID NO: 11162 - RNA, 19 nt, Homo sapiens
ucuuccuuuccguagccuc

SEQ ID NO: 11163 - RNA, 17 nt, Homo sapiens
uuuagcucuucuuuuga

SEQ ID NO: 11164 - RNA, 28 nt, Homo sapiens
uaaauggcauggcuuugacaucaagcug

SEQ ID NO: 11165 - RNA, 19 nt, Homo sapiens
aacccaugaugaacuguga

SEQ ID NO: 11166 - RNA, 18 nt, Homo sapiens
aagaaagcaguccgauga

SEQ ID NO: 11167 - RNA, 19 nt, Homo sapiens
caaacugugggagugauug

SEQ ID NO: 11168 - RNA, 20 nt, Homo sapiens
cguacagccaggcccgugug

SEQ ID NO: 11169 - RNA, 21 nt, Homo sapiens
cuuugucccugccuuggcuuu

SEQ ID NO: 11170 - RNA, 20 nt, Homo sapiens
gcccaggugcacugcucaca

SEQ ID NO: 11171 - RNA, 18 nt, Homo sapiens
uugauaccuuugcgguca

SEQ ID NO: 11172 - RNA, 18 nt, Homo sapiens
uugcauugcaaagcucuu

SEQ ID NO: 11173 - RNA, 21 nt, Homo sapiens
agcaacucuaagacuacagca

SEQ ID NO: 11174 - RNA, 25 nt, Homo sapiens
cccaaagugcuuccaaggcagaagc

SEQ ID NO: 11175 - RNA, 22 nt, Homo sapiens
ggcaguggagucggaagggcac

SEQ ID NO: 11176 - RNA, 16 nt, Homo sapiens
uugaugugccugugaa

SEQ ID NO: 11177 - RNA, 18 nt, Homo sapiens
acuuuuccuuccagcaaa

SEQ ID NO: 11178 - RNA, 21 nt, Homo sapiens
auuugaaauuuuuguacaaua

SEQ ID NO: 11179 - RNA, 16 nt, Homo sapiens
caggccuccacucccc

SEQ ID NO: 11180 - RNA, 17 nt, Homo sapiens
cuuccuuccccucaggu

SEQ ID NO: 11181 - RNA, 17 nt, Homo sapiens
ucaagugaaugaauggu

SEQ ID NO: 11182 - RNA, 21 nt, Homo sapiens
uuuggguucuugaguuguuuu

SEQ ID NO: 11183 - RNA, 21 nt, Homo sapiens
uuuugggucaugucuguugua

SEQ ID NO: 11184 - RNA, 24 nt, Homo sapiens
augaacccgggaugcagagcagcu

SEQ ID NO: 11185 - RNA, 18 nt, Homo sapiens
caccucagggauucugau

SEQ ID NO: 11186 - RNA, 18 nt, Homo sapiens
ccaaguucuuccagcaaa

SEQ ID NO: 11187 - RNA, 22 nt, Homo sapiens
cuggcccaugugaccuuugcca

SEQ ID NO: 11188 - RNA, 22 nt, Homo sapiens
ucugagcacaguagccuggccc

SEQ ID NO: 11189 - RNA, 28 nt, Homo sapiens
augggagccccucucagcuguggggcug

SEQ ID NO: 11190 - RNA, 18 nt, Homo sapiens
ccuggagggcacugagcu

SEQ ID NO: 11191 - RNA, 19 nt, Homo sapiens
ggcccucagaccugccaca

SEQ ID NO: 11192 - RNA, 17 nt, Homo sapiens
ugccuuguuccauauua

SEQ ID NO: 11193 - RNA, 18 nt, Homo sapiens
acagaguaacuucacaua

SEQ ID NO: 11194 - RNA, 20 nt, Homo sapiens
agaaaugggugucacugcuu

SEQ ID NO: 11195 - RNA, 19 nt, Homo sapiens
caacccccaugcugccucc

SEQ ID NO: 11196 - RNA, 20 nt, Homo sapiens
cagaauguaagauucauuca

SEQ ID NO: 11197 - RNA, 22 nt, Homo sapiens
cuaauaucaacaguauaucuca

SEQ ID NO: 11198 - RNA, 18 nt, Homo sapiens
gugcagcuuaauaugcug

SEQ ID NO: 11199 - RNA, 23 nt, Homo sapiens
ccaccccaccaggcaaccccuga

SEQ ID NO: 11200 - RNA, 15 nt, Homo sapiens
accccaccuugcaga

SEQ ID NO: 11201 - RNA, 21 nt, Homo sapiens
ucaccaaagaagauucucuua

SEQ ID NO: 11202 - RNA, 20 nt, Homo sapiens
uucuggcggcgguagauuug

SEQ ID NO: 11203 - RNA, 18 nt, Homo sapiens
uacaccauuuuugagcag

SEQ ID NO: 11204 - RNA, 19 nt, Homo sapiens
uuuugauaaguaucugcgg

SEQ ID NO: 11205 - RNA, 18 nt, Homo sapiens
acugaggucaagauuuca

SEQ ID NO: 11206 - RNA, 20 nt, Homo sapiens
caaacucuuaaugcuguguu

SEQ ID NO: 11207 - RNA, 20 nt, Homo sapiens
caguccuggggagcuucaca

SEQ ID NO: 11208 - RNA, 18 nt, Homo sapiens
cccauggaggaauucuga

SEQ ID NO: 11209 - RNA, 20 nt, Homo sapiens
ccuuugccucccagguuuaa

SEQ ID NO: 11210 - RNA, 23 nt, Homo sapiens
gacgggguuucaccacauucguc

SEQ ID NO: 11211 - RNA, 19 nt, Homo sapiens
gagagggaugaagagguga

SEQ ID NO: 11212 - RNA, 23 nt, Homo sapiens
gcaacugcccaggaaggacugug

SEQ ID NO: 11213 - RNA, 19 nt, Homo sapiens
gguuucccucccgauauca

SEQ ID NO: 11214 - RNA, 21 nt, Homo sapiens
acuugaauaggugccuguucu

SEQ ID NO: 11215 - RNA, 16 nt, Homo sapiens
auggagaucuguuguc

SEQ ID NO: 11216 - RNA, 16 nt, Homo sapiens
cuuucucuccucucuc

SEQ ID NO: 11217 - RNA, 19 nt, Homo sapiens
ggccggguauggugacuca

SEQ ID NO: 11218 - RNA, 21 nt, Homo sapiens
ucauuugucaccaucuuuucc

SEQ ID NO: 11219 - RNA, 21 nt, Homo sapiens
uggguggaccaccugagguua

SEQ ID NO: 11220 - RNA, 20 nt, Homo sapiens
cugguggugcagcagacauc

SEQ ID NO: 11221 - RNA, 27 nt, Homo sapiens
acaaagacucagcuacuucuuuucuua

SEQ ID NO: 11222 - RNA, 20 nt, Homo sapiens
caaaauauaucucugcucuu

SEQ ID NO: 11223 - RNA, 20 nt, Homo sapiens
uauguugcuggaacauuucu

SEQ ID NO: 11224 - RNA, 19 nt, Homo sapiens
cuccccaucccgggcacac

SEQ ID NO: 11225 - RNA, 22 nt, Homo sapiens
gcuugcgggggccgccuguccu

SEQ ID NO: 11226 - RNA, 21 nt, Homo sapiens
gcggaacggggagccucuguc

SEQ ID NO: 11227 - RNA, 16 nt, Homo sapiens
acaucacugcugcucg

SEQ ID NO: 11228 - RNA, 16 nt, Homo sapiens
auccccaggcauaaca

SEQ ID NO: 11229 - RNA, 22 nt, Homo sapiens
ccccacccacucccuacagucc

SEQ ID NO: 11230 - RNA, 20 nt, Homo sapiens
cugcccccaaugccccgagg

SEQ ID NO: 11231 - RNA, 21 nt, Homo sapiens
ugggugacagagcgugagacu

SEQ ID NO: 11232 - RNA, 24 nt, Homo sapiens
gccugacagcagcugguuuggucc

SEQ ID NO: 11233 - RNA, 22 nt, Homo sapiens
uccccuacagugguucucugga

SEQ ID NO: 11234 - RNA, 23 nt, Homo sapiens
ugaauggaggcugcaggaggcug

SEQ ID NO: 11235 - RNA, 21 nt, Homo sapiens
gagcugcgcugacagcagcca

SEQ ID NO: 11236 - RNA, 19 nt, Homo sapiens
gagaaagagaaauauauau

SEQ ID NO: 11237 - RNA, 17 nt, Homo sapiens
uuccacccuuuuggagc

SEQ ID NO: 11238 - RNA, 21 nt, Homo sapiens
cacccuggacaagugacugcc

SEQ ID NO: 11239 - RNA, 16 nt, Homo sapiens
uagacagugcuggaga

SEQ ID NO: 11240 - RNA, 23 nt, Homo sapiens
ugggugugccuggccugggacug

SEQ ID NO: 11241 - RNA, 22 nt, Homo sapiens
acgguguuugugucccugggua

SEQ ID NO: 11242 - RNA, 19 nt, Homo sapiens
agagaacauuccucugcag

SEQ ID NO: 11243 - RNA, 18 nt, Homo sapiens
gauuguucuguccaguuu

SEQ ID NO: 11244 - RNA, 21 nt, Homo sapiens
uuagcuacuuuucagaauuga

SEQ ID NO: 11245 - RNA, 18 nt, Homo sapiens
uggaucauauauauuaca

SEQ ID NO: 11246 - RNA, 21 nt, Homo sapiens
aauguccaccagacaccagcc

SEQ ID NO: 11247 - RNA, 20 nt, Homo sapiens
ccuuuucuugguuuuaauuu

SEQ ID NO: 11248 - RNA, 19 nt, Homo sapiens
gagagaacaacauuccucu

SEQ ID NO: 11249 - RNA, 22 nt, Homo sapiens
gcuuuucccccacaucucuaug

SEQ ID NO: 11250 - RNA, 19 nt, Homo sapiens
guaaaguaggaauguugug

SEQ ID NO: 11251 - RNA, 19 nt, Homo sapiens
guacagaaaauaucacugu

SEQ ID NO: 11252 - RNA, 23 nt, Homo sapiens
acacagcuaucaagugcuaaguu

SEQ ID NO: 11253 - RNA, 18 nt, Homo sapiens
caaaccaacauuugguga

SEQ ID NO: 11254 - RNA, 18 nt, Homo sapiens
ucuggugcaaucugugaa

SEQ ID NO: 11255 - RNA, 20 nt, Homo sapiens
caucaaaaacaaaaacaauu

SEQ ID NO: 11256 - RNA, 18 nt, Homo sapiens
uguguguguguaugguug

SEQ ID NO: 11257 - RNA, 21 nt, Homo sapiens
cucuuucucuucucacccuca

SEQ ID NO: 11258 - RNA, 18 nt, Homo sapiens
ccuccccggaggcuggac

SEQ ID NO: 11259 - RNA, 20 nt, Homo sapiens
ggguuccucucaauccugca

SEQ ID NO: 11260 - RNA, 21 nt, Homo sapiens
ucuccccauagccacagugga

SEQ ID NO: 11261 - RNA, 19 nt, Homo sapiens
agugucaggccuuugcagu

SEQ ID NO: 11262 - RNA, 19 nt, Homo sapiens
cuucugaucuagauuugaa

SEQ ID NO: 11263 - RNA, 22 nt, Homo sapiens
gccucugggauuuuaccaguca

SEQ ID NO: 11264 - RNA, 15 nt, Homo sapiens
gcugccagggauccg

SEQ ID NO: 11265 - RNA, 17 nt, Homo sapiens
agaaggaagagucagug

SEQ ID NO: 11266 - RNA, 22 nt, Homo sapiens
uuugaguaaucucaaauaaucu

SEQ ID NO: 11267 - RNA, 21 nt, Homo sapiens
cuucugucuguucuuaauuuu

SEQ ID NO: 11268 - RNA, 19 nt, Homo sapiens
aaagagcaccaugauucca

SEQ ID NO: 11269 - RNA, 23 nt, Homo sapiens
acagggucauacccccucccucu

SEQ ID NO: 11270 - RNA, 21 nt, Homo sapiens
ggcgggcaccccgcgagcgca

SEQ ID NO: 11271 - RNA, 23 nt, Homo sapiens
agaacuuuaauaagcccuugaga

SEQ ID NO: 11272 - RNA, 20 nt, Homo sapiens
aguuuaacacagccugauuc

SEQ ID NO: 11273 - RNA, 19 nt, Homo sapiens
aucguaaacauucaugaua

SEQ ID NO: 11274 - RNA, 18 nt, Homo sapiens
augagccaagaucacacc

SEQ ID NO: 11275 - RNA, 22 nt, Homo sapiens
ccauuaaaaaaacauuuuauuu

SEQ ID NO: 11276 - RNA, 21 nt, Homo sapiens
cccgucucuacuaaaaagaca

SEQ ID NO: 11277 - RNA, 24 nt, Homo sapiens
cucaaaaaaaaaaaagucauguua

SEQ ID NO: 11278 - RNA, 22 nt, Homo sapiens
cuguugguaaauccucugcuca

SEQ ID NO: 11279 - RNA, 23 nt, Homo sapiens
cuuaagcuagcuccuuuggcuuu

SEQ ID NO: 11280 - RNA, 25 nt, Homo sapiens
cuuuuucaacuuuuugcuuugcuuu

SEQ ID NO: 11281 - RNA, 22 nt, Homo sapiens
gagccaagaucacaccacugca

SEQ ID NO: 11282 - RNA, 21 nt, Homo sapiens
gccuggauacuuaccuggccc

SEQ ID NO: 11283 - RNA, 21 nt, Homo sapiens
guuuaacacagccugauucaa

SEQ ID NO: 11284 - RNA, 22 nt, Homo sapiens
guuuucauacuauaaccaggua

SEQ ID NO: 11285 - RNA, 20 nt, Homo sapiens
uaggguuaugggcaguuguu

SEQ ID NO: 11286 - RNA, 23 nt, Homo sapiens
ugaguaugaguuauguuuaguca

SEQ ID NO: 11287 - RNA, 16 nt, Homo sapiens
ugucaucagcugugau

SEQ ID NO: 11288 - RNA, 16 nt, Homo sapiens
uuauuaauuuaggccu

SEQ ID NO: 11289 - RNA, 20 nt, Homo sapiens
gccaccgcucccucuuccca

SEQ ID NO: 11290 - RNA, 18 nt, Homo sapiens
cucuaauuugcaugggca

SEQ ID NO: 11291 - RNA, 18 nt, Homo sapiens
uaugugcauuuuguagua

SEQ ID NO: 11292 - RNA, 18 nt, Homo sapiens
aaacagaaauuacccagu

SEQ ID NO: 11293 - RNA, 22 nt, Homo sapiens
ccuccccaguuugagggcuguu

SEQ ID NO: 11294 - RNA, 19 nt, Homo sapiens
gaugaacuagauucccuaa

SEQ ID NO: 11295 - RNA, 18 nt, Homo sapiens
uggguggaucaccugagg

SEQ ID NO: 11296 - RNA, 27 nt, Homo sapiens
uuuggguuuucuguacagauuguuuuu

SEQ ID NO: 11297 - RNA, 22 nt, Homo sapiens
cuccccaucugagccagccugc

SEQ ID NO: 11298 - RNA, 19 nt, Homo sapiens
gggacugggaggcuguggc

SEQ ID NO: 11299 - RNA, 18 nt, Homo sapiens
caacgucacccaucugua

SEQ ID NO: 11300 - RNA, 18 nt, Homo sapiens
uuccacccagucccccca

SEQ ID NO: 11301 - RNA, 20 nt, Homo sapiens
aguauuucccaaucaugaaa

SEQ ID NO: 11302 - RNA, 18 nt, Homo sapiens
ccugcaaccuccaccucc

SEQ ID NO: 11303 - RNA, 19 nt, Homo sapiens
cugcaaccuccaccuccca

SEQ ID NO: 11304 - RNA, 17 nt, Homo sapiens
cuuccaccgucauuuug

SEQ ID NO: 11305 - RNA, 22 nt, Homo sapiens
gagaaaggggaaauuuuugguu

SEQ ID NO: 11306 - RNA, 18 nt, Homo sapiens
gcaucugcauuuucccca

SEQ ID NO: 11307 - RNA, 20 nt, Homo sapiens
ggaccagcaauaauaccuug

SEQ ID NO: 11308 - RNA, 19 nt, Homo sapiens
ggugcuguuuuacaacgug

SEQ ID NO: 11309 - RNA, 18 nt, Homo sapiens
uccaccucccagguucaa

SEQ ID NO: 11310 - RNA, 17 nt, Homo sapiens
ucuuaaggaacacggug

SEQ ID NO: 11311 - RNA, 20 nt, Homo sapiens
aucuggaguuuuaaaaggcu

SEQ ID NO: 11312 - RNA, 18 nt, Homo sapiens
ccagaaauucuggcccag

SEQ ID NO: 11313 - RNA, 18 nt, Homo sapiens
uccgccucccggguucaa

SEQ ID NO: 11314 - RNA, 19 nt, Homo sapiens
acaaagugccacuacaaca

SEQ ID NO: 11315 - RNA, 24 nt, Homo sapiens
ccguugguggugggaggccagcgg

SEQ ID NO: 11316 - RNA, 22 nt, Homo sapiens
guaaaggagugucccaguugcu

SEQ ID NO: 11317 - RNA, 20 nt, Homo sapiens
gggcagcgaggcgcuggccg

SEQ ID NO: 11318 - RNA, 21 nt, Homo sapiens
accuccccgggcugccggugg

SEQ ID NO: 11319 - RNA, 20 nt, Homo sapiens
aagaaaagagaugcccugaa

SEQ ID NO: 11320 - RNA, 21 nt, Homo sapiens
aucuuggcucacugcagccuc

SEQ ID NO: 11321 - RNA, 21 nt, Homo sapiens
gaaaccuuuuuuccauggcuc

SEQ ID NO: 11322 - RNA, 18 nt, Homo sapiens
uccaccucccggguucaa

SEQ ID NO: 11323 - RNA, 15 nt, Homo sapiens
aaggguccauguacc

SEQ ID NO: 11324 - RNA, 21 nt, Homo sapiens
accuguuuuacuacuauggca

SEQ ID NO: 11325 - RNA, 22 nt, Homo sapiens
acuuuggcuaguuaaacucaua

SEQ ID NO: 11326 - RNA, 18 nt, Homo sapiens
ccucaaauugugcaacca

SEQ ID NO: 11327 - RNA, 20 nt, Homo sapiens
gauuuaaaacauggcaucuc

SEQ ID NO: 11328 - RNA, 22 nt, Homo sapiens
ucuggguaauuucauguuuauu

SEQ ID NO: 11329 - RNA, 21 nt, Homo sapiens
uuuuaacauauguguuugaga

SEQ ID NO: 11330 - RNA, 22 nt, Homo sapiens
caaaauaucucaguuggaccau

SEQ ID NO: 11331 - RNA, 18 nt, Homo sapiens
agaaaauucuaccuggcu

SEQ ID NO: 11332 - RNA, 17 nt, Homo sapiens
cauagugccuugauuuu

SEQ ID NO: 11333 - RNA, 19 nt, Homo sapiens
ccucccccaaccccucucc

SEQ ID NO: 11334 - RNA, 20 nt, Homo sapiens
uaugccuucacuacaacauu

SEQ ID NO: 11335 - RNA, 27 nt, Homo sapiens
cuugagaauucaucuugaguuaucuuu

SEQ ID NO: 11336 - RNA, 19 nt, Homo sapiens
ucuuuuuaagcucugugag

SEQ ID NO: 11337 - RNA, 23 nt, Homo sapiens
accaucagaccuggccuccaaga

SEQ ID NO: 11338 - RNA, 24 nt, Homo sapiens
ccuggaagacuccucaguucuuca

SEQ ID NO: 11339 - RNA, 18 nt, Homo sapiens
ccuuugccugaaacauug

SEQ ID NO: 11340 - RNA, 19 nt, Homo sapiens
caucagagaaugacuauca

SEQ ID NO: 11341 - RNA, 17 nt, Homo sapiens
cguccucuccugucacc

SEQ ID NO: 11342 - RNA, 22 nt, Homo sapiens
uugcuauaaaaaaauuugugau

SEQ ID NO: 11343 - RNA, 18 nt, Homo sapiens
aguuggacucauugaugg

SEQ ID NO: 11344 - RNA, 17 nt, Homo sapiens
aguuucaguguuagaua

SEQ ID NO: 11345 - RNA, 21 nt, Homo sapiens
gcauucguacucaugcuguua

SEQ ID NO: 11346 - RNA, 16 nt, Homo sapiens
gagcuacguggagcug

SEQ ID NO: 11347 - RNA, 23 nt, Homo sapiens
ggaagagggggccaugagccggc

SEQ ID NO: 11348 - RNA, 20 nt, Homo sapiens
agcccuugaacauggcacug

SEQ ID NO: 11349 - RNA, 19 nt, Homo sapiens
cuaucucuggcaccucuga

SEQ ID NO: 11350 - RNA, 18 nt, Homo sapiens
gcggggguggguguggug

SEQ ID NO: 11351 - RNA, 24 nt, Homo sapiens
agacguggacaccaucuccacuga

SEQ ID NO: 11352 - RNA, 19 nt, Homo sapiens
ugaagaaugauucagggua

SEQ ID NO: 11353 - RNA, 28 nt, Homo sapiens
auauagaaaaugaagagggacaucaagu

SEQ ID NO: 11354 - RNA, 16 nt, Homo sapiens
gggacaucaaguaaca

SEQ ID NO: 11355 - RNA, 19 nt, Homo sapiens
ucagagguuucaaacauug

SEQ ID NO: 11356 - RNA, 19 nt, Homo sapiens
ugaagagggacaucaagua

SEQ ID NO: 11357 - RNA, 23 nt, Homo sapiens
gagaggcacacugucagagguga

SEQ ID NO: 11358 - RNA, 21 nt, Homo sapiens
acuugaauuguggaaaagcuc

SEQ ID NO: 11359 - RNA, 24 nt, Homo sapiens
gccugagcauuguuugucuggccc

SEQ ID NO: 11360 - RNA, 18 nt, Homo sapiens
ugcagcaacaaccaggcu

SEQ ID NO: 11361 - RNA, 19 nt, Homo sapiens
aagucaauuugucaguagc

SEQ ID NO: 11362 - RNA, 21 nt, Homo sapiens
acugcaccuucccucauuuca

SEQ ID NO: 11363 - RNA, 23 nt, Homo sapiens
cccuacccugcacccacauccca

SEQ ID NO: 11364 - RNA, 19 nt, Homo sapiens
cuuauuccuccuccccucu

SEQ ID NO: 11365 - RNA, 17 nt, Homo sapiens
guaaaaguucugugaca

SEQ ID NO: 11366 - RNA, 17 nt, Homo sapiens
ugcaaauugaguuucuu

SEQ ID NO: 11367 - RNA, 18 nt, Homo sapiens
aauguaaaauucauagca

SEQ ID NO: 11368 - RNA, 18 nt, Homo sapiens
agcuauaauguuucccuc

SEQ ID NO: 11369 - RNA, 20 nt, Homo sapiens
auuaaauuuaauauacugca

SEQ ID NO: 11370 - RNA, 21 nt, Homo sapiens
ugagcuauaauguuucccuca

SEQ ID NO: 11371 - RNA, 20 nt, Homo sapiens
accucaaauccacccauaug

SEQ ID NO: 11372 - RNA, 19 nt, Homo sapiens
cuaauccuucuggcagauu

SEQ ID NO: 11373 - RNA, 22 nt, Homo sapiens
gacaucuggaaaccucuacaua

SEQ ID NO: 11374 - RNA, 22 nt, Homo sapiens
gcgaccgcggcggcggcggcgg

SEQ ID NO: 11375 - RNA, 18 nt, Homo sapiens
uaguuauuauccagagga

SEQ ID NO: 11376 - RNA, 21 nt, Homo sapiens
ucuggcagauucaaaucguuu

SEQ ID NO: 11377 - RNA, 22 nt, Homo sapiens
uggauaaacaacauugagauua

SEQ ID NO: 11378 - RNA, 26 nt, Homo sapiens
uuuccaauacgacacugaaauaugug

SEQ ID NO: 11379 - RNA, 22 nt, Homo sapiens
uuuuuucauuguuuuuaacuuu

SEQ ID NO: 11380 - RNA, 18 nt, Homo sapiens
uuugauuuuccaaguggu

SEQ ID NO: 11381 - RNA, 21 nt, Homo sapiens
aaaccuccuucccucugccca

SEQ ID NO: 11382 - RNA, 19 nt, Homo sapiens
agcauaguaacuccuuuca

SEQ ID NO: 11383 - RNA, 17 nt, Homo sapiens
cauagcucucuccugcu

SEQ ID NO: 11384 - RNA, 23 nt, Homo sapiens
ccugggggcgcucagauugcuuu

SEQ ID NO: 11385 - RNA, 18 nt, Homo sapiens
guccacugaguuuccuuc

SEQ ID NO: 11386 - RNA, 20 nt, Homo sapiens
agcaaguuuucuuccaugau

SEQ ID NO: 11387 - RNA, 21 nt, Homo sapiens
ggugguggcggggggucuugg

SEQ ID NO: 11388 - RNA, 19 nt, Homo sapiens
gugggcccagggcggccuc

SEQ ID NO: 11389 - RNA, 22 nt, Homo sapiens
uaaauacuuuagcaaaaacauu

SEQ ID NO: 11390 - RNA, 17 nt, Homo sapiens
uuugcaaacugauguua

SEQ ID NO: 11391 - RNA, 21 nt, Homo sapiens
aaaaaaauuacaaaccaagaa

SEQ ID NO: 11392 - RNA, 20 nt, Homo sapiens
gaauuuuuggauaauuugga

SEQ ID NO: 11393 - RNA, 20 nt, Homo sapiens
ggguauaaugacaacagcca

SEQ ID NO: 11394 - RNA, 21 nt, Homo sapiens
accugggggacccccuggccc

SEQ ID NO: 11395 - RNA, 21 nt, Homo sapiens
ccucuuuaacccccugaccuu

SEQ ID NO: 11396 - RNA, 21 nt, Homo sapiens
cucaagggguuucuggcaccu

SEQ ID NO: 11397 - RNA, 21 nt, Homo sapiens
uccugcuucccacucaucuua

SEQ ID NO: 11398 - RNA, 21 nt, Homo sapiens
ccugaguggucuggcgguuuu

SEQ ID NO: 11399 - RNA, 18 nt, Homo sapiens
cugucagacugucugccu

SEQ ID NO: 11400 - RNA, 25 nt, Homo sapiens
gcuugaguuucuccacucuuggcuc

SEQ ID NO: 11401 - RNA, 20 nt, Homo sapiens
ugguuugaccugauauacuc

SEQ ID NO: 11402 - RNA, 16 nt, Homo sapiens
gcccagagcccggugg

SEQ ID NO: 11403 - RNA, 18 nt, Homo sapiens
auggaggugcugaacaca

SEQ ID NO: 11404 - RNA, 17 nt, Homo sapiens
caucacguuuuuucuga

SEQ ID NO: 11405 - RNA, 17 nt, Homo sapiens
guguagccaugucuaga

SEQ ID NO: 11406 - RNA, 20 nt, Homo sapiens
accuucuagaccacaugaua

SEQ ID NO: 11407 - RNA, 18 nt, Homo sapiens
caucuuucgucugcacua

SEQ ID NO: 11408 - RNA, 20 nt, Homo sapiens
gaggggggggcagcaagaga

SEQ ID NO: 11409 - RNA, 19 nt, Homo sapiens
ucccucuccuuuggucaga

SEQ ID NO: 11410 - RNA, 17 nt, Homo sapiens
gcccgggugccugcucc

SEQ ID NO: 11411 - RNA, 23 nt, Homo sapiens
acaaagcauauuaaauggcaaua

SEQ ID NO: 11412 - RNA, 21 nt, Homo sapiens
aucccaccucaucccauuuuu

SEQ ID NO: 11413 - RNA, 17 nt, Homo sapiens
uuccaaauuuuaagcug

SEQ ID NO: 11414 - RNA, 19 nt, Homo sapiens
accugcaacuuaugugcac

SEQ ID NO: 11415 - RNA, 18 nt, Homo sapiens
gccacacccaagaucacc

SEQ ID NO: 11416 - RNA, 18 nt, Homo sapiens
agaaaauucauaacgugu

SEQ ID NO: 11417 - RNA, 25 nt, Homo sapiens
ugaauguguuuuuuaaauggaacua

SEQ ID NO: 11418 - RNA, 18 nt, Homo sapiens
aauuucggauuuauuuca

SEQ ID NO: 11419 - RNA, 21 nt, Homo sapiens
uccaaugugguuguccgguuu

SEQ ID NO: 11420 - RNA, 18 nt, Homo sapiens
aucugauuccccaagggc

SEQ ID NO: 11421 - RNA, 19 nt, Homo sapiens
ggucccccccgccccuucc

SEQ ID NO: 11422 - RNA, 18 nt, Homo sapiens
ccuuuuuccucccuguag

SEQ ID NO: 11423 - RNA, 21 nt, Homo sapiens
cuuauuuagucuucauagauc

SEQ ID NO: 11424 - RNA, 19 nt, Homo sapiens
gaaaugagaaacuuccucc

SEQ ID NO: 11425 - RNA, 16 nt, Homo sapiens
gcaccccuucugcccc

SEQ ID NO: 11426 - RNA, 24 nt, Homo sapiens
uaggcagucccaagacaccuuuca

SEQ ID NO: 11427 - RNA, 23 nt, Homo sapiens
ucuagacgcccccagacaccucu

SEQ ID NO: 11428 - RNA, 20 nt, Homo sapiens
ucuaggcagucccaagacac

SEQ ID NO: 11429 - RNA, 20 nt, Homo sapiens
ggagaggcaggugagaggga

SEQ ID NO: 11430 - RNA, 18 nt, Homo sapiens
ccuucggggggcccgugg

SEQ ID NO: 11431 - RNA, 21 nt, Homo sapiens
gccaccccccaggggucucug

SEQ ID NO: 11432 - RNA, 17 nt, Homo sapiens
gccuaggcgcccagcga

SEQ ID NO: 11433 - RNA, 23 nt, Homo sapiens
aaaacucagagagggucuucguu

SEQ ID NO: 11434 - RNA, 23 nt, Homo sapiens
cacuuugaggaacaauccccuuu

SEQ ID NO: 11435 - RNA, 18 nt, Homo sapiens
ccaccgccggcccgccca

SEQ ID NO: 11436 - RNA, 22 nt, Homo sapiens
cugccccggcauugcaucuucc

SEQ ID NO: 11437 - RNA, 20 nt, Homo sapiens
agagcuggcauaucugguca

SEQ ID NO: 11438 - RNA, 20 nt, Homo sapiens
agagugagcaaccagcugga

SEQ ID NO: 11439 - RNA, 19 nt, Homo sapiens
auaucuggucagaacugca

SEQ ID NO: 11440 - RNA, 20 nt, Homo sapiens
gcgcccagggaggagucagu

SEQ ID NO: 11441 - RNA, 20 nt, Homo sapiens
auggaguccccucuaggguu

SEQ ID NO: 11442 - RNA, 21 nt, Homo sapiens
gcccagaagacugcguuccag

SEQ ID NO: 11443 - RNA, 21 nt, Homo sapiens
uugaaauuaugguuaaccuca

SEQ ID NO: 11444 - RNA, 21 nt, Homo sapiens
gguggacacuuggcaccagcu

SEQ ID NO: 11445 - RNA, 24 nt, Homo sapiens
guguucugugagguuguucggcua

SEQ ID NO: 11446 - RNA, 21 nt, Homo sapiens
aaauagugaacuuuucuacgu

SEQ ID NO: 11447 - RNA, 23 nt, Homo sapiens
aagacaguuuauuagaaauagca

SEQ ID NO: 11448 - RNA, 24 nt, Homo sapiens
ccaacgguccaagggauuacaucu

SEQ ID NO: 11449 - RNA, 23 nt, Homo sapiens
cguuucacaaaaucuuuugugaa

SEQ ID NO: 11450 - RNA, 24 nt, Homo sapiens
cuauguauagcugucguuagucuu

SEQ ID NO: 11451 - RNA, 21 nt, Homo sapiens
gcccucucauacuaugaacau

SEQ ID NO: 11452 - RNA, 17 nt, Homo sapiens
ugacuggauuucccuca

SEQ ID NO: 11453 - RNA, 19 nt, Homo sapiens
ugagucucagcaggaguua

SEQ ID NO: 11454 - RNA, 20 nt, Homo sapiens
uggacauuguugugaaauug

SEQ ID NO: 11455 - RNA, 17 nt, Homo sapiens
ucagaauaccaaaacaa

SEQ ID NO: 11456 - RNA, 17 nt, Homo sapiens
uccaucccccuagcuca

SEQ ID NO: 11457 - RNA, 22 nt, Homo sapiens
agcuuuguacaucagcacuguu

SEQ ID NO: 11458 - RNA, 19 nt, Homo sapiens
acauucaucaccgcaaaga

SEQ ID NO: 11459 - RNA, 23 nt, Homo sapiens
gacauccuggauaugcugggaga

SEQ ID NO: 11460 - RNA, 22 nt, Homo sapiens
gaggccugaaaaaagccacaca

SEQ ID NO: 11461 - RNA, 17 nt, Homo sapiens
ccacuggagaugcuggg

SEQ ID NO: 11462 - RNA, 18 nt, Homo sapiens
ccugauaccaucugccag

SEQ ID NO: 11463 - RNA, 24 nt, Homo sapiens
ccucccgagggaaccuucuuccca

SEQ ID NO: 11464 - RNA, 18 nt, Homo sapiens
ucaagugauucuucuugc

SEQ ID NO: 11465 - RNA, 18 nt, Homo sapiens
uccgccucccagguucaa

SEQ ID NO: 11466 - RNA, 19 nt, Homo sapiens
uccauguuggggguccuaa

SEQ ID NO: 11467 - RNA, 19 nt, Homo sapiens
ucugucuuucuuggccccu

SEQ ID NO: 11468 - RNA, 22 nt, Homo sapiens
ugcugcuuccgagaaccucggc

SEQ ID NO: 11469 - RNA, 22 nt, Homo sapiens
cgagccgagcgcagucugccgg

SEQ ID NO: 11470 - RNA, 20 nt, Homo sapiens
ggccgggugcccggccccug

SEQ ID NO: 11471 - RNA, 20 nt, Homo sapiens
augaauauuauuagacagua

SEQ ID NO: 11472 - RNA, 21 nt, Homo sapiens
auguaauagaagcuuuucuua

SEQ ID NO: 11473 - RNA, 17 nt, Homo sapiens
uguuauuucuugcucug

SEQ ID NO: 11474 - RNA, 21 nt, Homo sapiens
uuuccugugaacuugugucuc

SEQ ID NO: 11475 - RNA, 17 nt, Homo sapiens
accaaaacaaauaaaga

SEQ ID NO: 11476 - RNA, 21 nt, Homo sapiens
aucuuggcucacugcaaccuc

SEQ ID NO: 11477 - RNA, 18 nt, Homo sapiens
uccgccuccuggguucaa

SEQ ID NO: 11478 - RNA, 20 nt, Homo sapiens
uggccagcguggucuugaac

SEQ ID NO: 11479 - RNA, 18 nt, Homo sapiens
uuaaaaaugauacuuaga

SEQ ID NO: 11480 - RNA, 24 nt, Homo sapiens
cuuuccccaagaauuaucauggaa

SEQ ID NO: 11481 - RNA, 18 nt, Homo sapiens
ucaugcugcaucuauauc

SEQ ID NO: 11482 - RNA, 20 nt, Homo sapiens
uugugaccagccagaccuca

SEQ ID NO: 11483 - RNA, 21 nt, Homo sapiens
uaggugggcccaccacuugag

SEQ ID NO: 11484 - RNA, 21 nt, Homo sapiens
agaauuuaaauacugugcuua

SEQ ID NO: 11485 - RNA, 18 nt, Homo sapiens
ccucuccccagauaccuc

SEQ ID NO: 11486 - RNA, 24 nt, Homo sapiens
cucucaggaaugaagauuugugaa

SEQ ID NO: 11487 - RNA, 19 nt, Homo sapiens
aaagcuucuaaagcaggua

SEQ ID NO: 11488 - RNA, 19 nt, Homo sapiens
ccaaccacugugccacuga

SEQ ID NO: 11489 - RNA, 23 nt, Homo sapiens
ccgcggcuagcgccgacaaccag

SEQ ID NO: 11490 - RNA, 20 nt, Homo sapiens
gcaagaggaaccucucgcca

SEQ ID NO: 11491 - RNA, 19 nt, Homo sapiens
gcagugaugacuugcuguc

SEQ ID NO: 11492 - RNA, 27 nt, Homo sapiens
ggugccucaguuuuccuucuguuaaaa

SEQ ID NO: 11493 - RNA, 21 nt, Homo sapiens
guaauaagauggcuguggcau

SEQ ID NO: 11494 - RNA, 15 nt, Homo sapiens
uagauggaauggaaa

SEQ ID NO: 11495 - RNA, 21 nt, Homo sapiens
uccacaguguugugccccuuc

SEQ ID NO: 11496 - RNA, 26 nt, Homo sapiens
uccacaguguugugccccuucacuca

SEQ ID NO: 11497 - RNA, 21 nt, Homo sapiens
uucaagccccaccacauagca

SEQ ID NO: 11498 - RNA, 25 nt, Homo sapiens
uucaagugacacauuaaugauaaac

SEQ ID NO: 11499 - RNA, 18 nt, Homo sapiens
uuuggcugagaccuggga

SEQ ID NO: 11500 - RNA, 22 nt, Homo sapiens
accuuggaucaguggucaccuc

SEQ ID NO: 11501 - RNA, 24 nt, Homo sapiens
aguuuuggaaaccccugccaguga

SEQ ID NO: 11502 - RNA, 18 nt, Homo sapiens
ccacuauaaauauguaga

SEQ ID NO: 11503 - RNA, 23 nt, Homo sapiens
ggacuaagugggagaaauuagaa

SEQ ID NO: 11504 - RNA, 20 nt, Homo sapiens
guuuuggaacugcgauaacu

SEQ ID NO: 11505 - RNA, 18 nt, Homo sapiens
uuuuuuguuuagauacca

SEQ ID NO: 11506 - RNA, 21 nt, Homo sapiens
aaagaacauauuuuccguuca

SEQ ID NO: 11507 - RNA, 20 nt, Homo sapiens
aagaacauauuuuccguuca

SEQ ID NO: 11508 - RNA, 20 nt, Homo sapiens
aaggaccaggauugcacuga

SEQ ID NO: 11509 - RNA, 19 nt, Homo sapiens
agugugcauauauacuaca

SEQ ID NO: 11510 - RNA, 18 nt, Homo sapiens
ccucaaacacacaaacua

SEQ ID NO: 11511 - RNA, 24 nt, Homo sapiens
gccugggcucuaguuuccugguuu

SEQ ID NO: 11512 - RNA, 20 nt, Homo sapiens
uauggaaauauaggcuaugu

SEQ ID NO: 11513 - RNA, 17 nt, Homo sapiens
ugugcauauauacuaca

SEQ ID NO: 11514 - RNA, 22 nt, Homo sapiens
uuuuggcccuaccuguaacuua

SEQ ID NO: 11515 - RNA, 21 nt, Homo sapiens
acagguaaacagaaauccuuu

SEQ ID NO: 11516 - RNA, 15 nt, Homo sapiens
accagcaguguuuaa

SEQ ID NO: 11517 - RNA, 22 nt, Homo sapiens
ccaaauacauuaacaagcucuu

SEQ ID NO: 11518 - RNA, 21 nt, Homo sapiens
cucuggcccacacagaucugu

SEQ ID NO: 11519 - RNA, 18 nt, Homo sapiens
uuuugcuuaaagaucuca

SEQ ID NO: 11520 - RNA, 19 nt, Homo sapiens
acauuggucaucuucccua

SEQ ID NO: 11521 - RNA, 19 nt, Homo sapiens
cugcaaccuccgccuccca

SEQ ID NO: 11522 - RNA, 18 nt, Homo sapiens
uccgccucccagguucaa

SEQ ID NO: 11523 - RNA, 19 nt, Homo sapiens
acaacccaggugacgaugc

SEQ ID NO: 11524 - RNA, 22 nt, Homo sapiens
gcucccagacggccuuggacug

SEQ ID NO: 11525 - RNA, 17 nt, Homo sapiens
ggacacagccagccccu

SEQ ID NO: 11526 - RNA, 24 nt, Homo sapiens
uccugguauugggagguuucuggg

SEQ ID NO: 11527 - RNA, 25 nt, Homo sapiens
ucugagauagucacaacccagguga

SEQ ID NO: 11528 - RNA, 23 nt, Homo sapiens
aaaaugaaaauaucuucaccucu

SEQ ID NO: 11529 - RNA, 20 nt, Homo sapiens
acaucuugucaacaugcauu

SEQ ID NO: 11530 - RNA, 23 nt, Homo sapiens
caaggaaagaacuacuagcuaca

SEQ ID NO: 11531 - RNA, 17 nt, Homo sapiens
ccugucuccuacuuuga

SEQ ID NO: 11532 - RNA, 15 nt, Homo sapiens
uaaggaaugauccaa

SEQ ID NO: 11533 - RNA, 19 nt, Homo sapiens
ucuuuugacauccagcagu

SEQ ID NO: 11534 - RNA, 18 nt, Homo sapiens
cuugggucgcguuggugc

SEQ ID NO: 11535 - RNA, 18 nt, Homo sapiens
aaggaaagaauggcauag

SEQ ID NO: 11536 - RNA, 21 nt, Homo sapiens
guaaguggaucacuugccaaa

SEQ ID NO: 11537 - RNA, 21 nt, Homo sapiens
ucucuucagcucccuuagcuu

SEQ ID NO: 11538 - RNA, 18 nt, Homo sapiens
ucuucuuuccuguuaguc

SEQ ID NO: 11539 - RNA, 18 nt, Homo sapiens
agaaaggacacccgguca

SEQ ID NO: 11540 - RNA, 17 nt, Homo sapiens
agccaagacccuucugc

SEQ ID NO: 11541 - RNA, 20 nt, Homo sapiens
ggagcggcggcggcugcagg

SEQ ID NO: 11542 - RNA, 21 nt, Homo sapiens
guccuuuaagaucaaaacuca

SEQ ID NO: 11543 - RNA, 21 nt, Homo sapiens
uccccacggccuguccgggaa

SEQ ID NO: 11544 - RNA, 18 nt, Homo sapiens
ugcaaagccaagacccuu

SEQ ID NO: 11545 - RNA, 19 nt, Homo sapiens
aaaccccggaccucaggug

SEQ ID NO: 11546 - RNA, 23 nt, Homo sapiens
auuaggguuggaugcccauuucu

SEQ ID NO: 11547 - RNA, 19 nt, Homo sapiens
cagcaccacagagugcuug

SEQ ID NO: 11548 - RNA, 24 nt, Homo sapiens
cuuguguccccuccucccccucca

SEQ ID NO: 11549 - RNA, 19 nt, Homo sapiens
gagagaaugaggcucaguu

SEQ ID NO: 11550 - RNA, 21 nt, Homo sapiens
gcugugggcaucuucugccca

SEQ ID NO: 11551 - RNA, 18 nt, Homo sapiens
ggacacaucuugccacca

SEQ ID NO: 11552 - RNA, 19 nt, Homo sapiens
ucccaggucaguagaccaa

SEQ ID NO: 11553 - RNA, 20 nt, Homo sapiens
ucuggguaguucuagaggau

SEQ ID NO: 11554 - RNA, 17 nt, Homo sapiens
ugccucccacauucuuc

SEQ ID NO: 11555 - RNA, 23 nt, Homo sapiens
ugcuguggaacacauaagcccca

SEQ ID NO: 11556 - RNA, 19 nt, Homo sapiens
aguccaucucccucaucuc

SEQ ID NO: 11557 - RNA, 22 nt, Homo sapiens
ucaucuccauucucaguuucuu

SEQ ID NO: 11558 - RNA, 18 nt, Homo sapiens
uguguuugucauuucuga

SEQ ID NO: 11559 - RNA, 23 nt, Homo sapiens
uuacugagaacacccaauaccca

SEQ ID NO: 11560 - RNA, 21 nt, Homo sapiens
uuucucccguuguuuuaccuu

SEQ ID NO: 11561 - RNA, 15 nt, Homo sapiens
aaugaaagcgaugag

SEQ ID NO: 11562 - RNA, 21 nt, Homo sapiens
acuuggguugaggcuggguuc

SEQ ID NO: 11563 - RNA, 20 nt, Homo sapiens
ucuugcauuggaggucccag

SEQ ID NO: 11564 - RNA, 19 nt, Homo sapiens
ugaccuguucuuagagcaa

SEQ ID NO: 11565 - RNA, 18 nt, Homo sapiens
agcaauucuccugccuca

SEQ ID NO: 11566 - RNA, 20 nt, Homo sapiens
gccagaccccugggcaccuc

SEQ ID NO: 11567 - RNA, 17 nt, Homo sapiens
guggauggaaggggcug

SEQ ID NO: 11568 - RNA, 19 nt, Homo sapiens
ucugaaaacuuugccucug

SEQ ID NO: 11569 - RNA, 22 nt, Homo sapiens
ugagauuauaggcaccuaccac

SEQ ID NO: 11570 - RNA, 18 nt, Homo sapiens
uucaagugauucucaugc

SEQ ID NO: 11571 - RNA, 22 nt, Homo sapiens
acuuguuaugguuguuuggacc

SEQ ID NO: 11572 - RNA, 20 nt, Homo sapiens
auccugaggcaaaguaguga

SEQ ID NO: 11573 - RNA, 17 nt, Homo sapiens
uacuggauuguguuugu

SEQ ID NO: 11574 - RNA, 21 nt, Homo sapiens
ccugcagaccaacagcgggcu

SEQ ID NO: 11575 - RNA, 18 nt, Homo sapiens
ucggggaccgucuuuuga

SEQ ID NO: 11576 - RNA, 23 nt, Homo sapiens
ucuuuugaagagucagucccucc

SEQ ID NO: 11577 - RNA, 20 nt, Homo sapiens
agauagauguuauagaaaug

SEQ ID NO: 11578 - RNA, 24 nt, Homo sapiens
auuugaguugcgaauaaauguucc

SEQ ID NO: 11579 - RNA, 24 nt, Homo sapiens
caccuaugucauacugucuccucc

SEQ ID NO: 11580 - RNA, 20 nt, Homo sapiens
gccauuuugcagggacucug

SEQ ID NO: 11581 - RNA, 19 nt, Homo sapiens
guaauaagguguccagcag

SEQ ID NO: 11582 - RNA, 19 nt, Homo sapiens
uucaaacucuugggcucaa

SEQ ID NO: 11583 - RNA, 19 nt, Homo sapiens
caaaacaaacaaagcaaua

SEQ ID NO: 11584 - RNA, 26 nt, Homo sapiens
ccucuuuaucccuccuguuuuacuuu

SEQ ID NO: 11585 - RNA, 19 nt, Homo sapiens
aaagauacacaaagauggg

SEQ ID NO: 11586 - RNA, 18 nt, Homo sapiens
agaacccagcaacaaacc

SEQ ID NO: 11587 - RNA, 19 nt, Homo sapiens
agaauaguggcuuaccgcu

SEQ ID NO: 11588 - RNA, 17 nt, Homo sapiens
agaggggcugggcccag

SEQ ID NO: 11589 - RNA, 22 nt, Homo sapiens
ccuccuuuuuuuggacuuugua

SEQ ID NO: 11590 - RNA, 21 nt, Homo sapiens
cguuaguaaacuuacuucaua

SEQ ID NO: 11591 - RNA, 20 nt, Homo sapiens
cuguguucuuguuuuguuca

SEQ ID NO: 11592 - RNA, 19 nt, Homo sapiens
uggcccgugcguggggcug

SEQ ID NO: 11593 - RNA, 19 nt, Homo sapiens
ggccaaacuguucauccua

SEQ ID NO: 11594 - RNA, 21 nt, Homo sapiens
ggcccacaucccuccacuucu

SEQ ID NO: 11595 - RNA, 24 nt, Homo sapiens
uccagggaccauuugcccuuccca

SEQ ID NO: 11596 - RNA, 18 nt, Homo sapiens
uuuaugcccccaaauuau

SEQ ID NO: 11597 - RNA, 21 nt, Homo sapiens
aaacacagaagaauaggggga

SEQ ID NO: 11598 - RNA, 19 nt, Homo sapiens
acaagacagacuccacuca

SEQ ID NO: 11599 - RNA, 25 nt, Homo sapiens
auuugaagggucuggugccuggccu

SEQ ID NO: 11600 - RNA, 20 nt, Homo sapiens
cauacguaaacaagagaggc

SEQ ID NO: 11601 - RNA, 16 nt, Homo sapiens
cucugccaccgaguuc

SEQ ID NO: 11602 - RNA, 20 nt, Homo sapiens
uucaagaccagccugaccaa

SEQ ID NO: 11603 - RNA, 20 nt, Homo sapiens
ugcugcggguguucuuuugg

SEQ ID NO: 11604 - RNA, 16 nt, Homo sapiens
acugccuucuugcuuu

SEQ ID NO: 11605 - RNA, 21 nt, Homo sapiens
cuccuuauaauagacacuuca

SEQ ID NO: 11606 - RNA, 20 nt, Homo sapiens
ggagucugugacagccaccc

SEQ ID NO: 11607 - RNA, 24 nt, Homo sapiens
agugagugaguuggguguauugug

SEQ ID NO: 11608 - RNA, 18 nt, Homo sapiens
ccacaccgcggccgccca

SEQ ID NO: 11609 - RNA, 18 nt, Homo sapiens
ugcaguaggcggcccggg

SEQ ID NO: 11610 - RNA, 23 nt, Homo sapiens
gcucugaggugcaacuucuucac

SEQ ID NO: 11611 - RNA, 22 nt, Homo sapiens
agagcuggacucgcucaucugu

SEQ ID NO: 11612 - RNA, 21 nt, Homo sapiens
cuuuucuuaagaugcugugag

SEQ ID NO: 11613 - RNA, 19 nt, Homo sapiens
gcacgucacuggcgggcuc

SEQ ID NO: 11614 - RNA, 19 nt, Homo sapiens
gcaguccccagucugacca

SEQ ID NO: 11615 - RNA, 21 nt, Homo sapiens
accacagugccaccaagcuca

SEQ ID NO: 11616 - RNA, 20 nt, Homo sapiens
gccccgggggagccucuguc

SEQ ID NO: 11617 - RNA, 22 nt, Homo sapiens
ggaggaggaaaccggcggagca

SEQ ID NO: 11618 - RNA, 22 nt, Homo sapiens
ggccacgacgaccgccaccgcc

SEQ ID NO: 11619 - RNA, 19 nt, Homo sapiens
gugaggagaggguggcauc

SEQ ID NO: 11620 - RNA, 18 nt, Homo sapiens
caagacacugccuaaggu

SEQ ID NO: 11621 - RNA, 20 nt, Homo sapiens
cugggcccuaggccuagccc

SEQ ID NO: 11622 - RNA, 18 nt, Homo sapiens
aacaaaaagaauaaagcu

SEQ ID NO: 11623 - RNA, 24 nt, Homo sapiens
ccaccauuuucuucugcacuccca

SEQ ID NO: 11624 - RNA, 16 nt, Homo sapiens
ucucccuauuagacug

SEQ ID NO: 11625 - RNA, 21 nt, Homo sapiens
ucugaacauucauugcacuuu

SEQ ID NO: 11626 - RNA, 17 nt, Homo sapiens
acauagguggguuuaug

SEQ ID NO: 11627 - RNA, 20 nt, Homo sapiens
ccacucugugcaccaaccua

SEQ ID NO: 11628 - RNA, 18 nt, Homo sapiens
agcuacauuaaaaucuua

SEQ ID NO: 11629 - RNA, 21 nt, Homo sapiens
aucacuuacagguaccauuua

SEQ ID NO: 11630 - RNA, 21 nt, Homo sapiens
ccuuuucacuguuauggccuu

SEQ ID NO: 11631 - RNA, 20 nt, Homo sapiens
gauugcuuuuuuucuuucag

SEQ ID NO: 11632 - RNA, 18 nt, Homo sapiens
uuuauugcauacuugcac

SEQ ID NO: 11633 - RNA, 19 nt, Homo sapiens
cugugaccaccucauugcu

SEQ ID NO: 11634 - RNA, 19 nt, Homo sapiens
uaucuguggccuaugaggc

SEQ ID NO: 11635 - RNA, 19 nt, Homo sapiens
acagcuggugccaaauagc

SEQ ID NO: 11636 - RNA, 17 nt, Homo sapiens
augcacacggcugguca

SEQ ID NO: 11637 - RNA, 18 nt, Homo sapiens
ccacaaacggagccccug

SEQ ID NO: 11638 - RNA, 19 nt, Homo sapiens
ccccacuccucuaagacaa

SEQ ID NO: 11639 - RNA, 23 nt, Homo sapiens
ggaggggguuaaggcgcaggcgg

SEQ ID NO: 11640 - RNA, 21 nt, Homo sapiens
uguccacauccccagagccca

SEQ ID NO: 11641 - RNA, 21 nt, Homo sapiens
aacagauugcccuaagcauug

SEQ ID NO: 11642 - RNA, 24 nt, Homo sapiens
acaaaagcaggucuguuuuauguc

SEQ ID NO: 11643 - RNA, 20 nt, Homo sapiens
gcauuagaaacuacugaaga

SEQ ID NO: 11644 - RNA, 22 nt, Homo sapiens
agggcuucccucaucuuccuca

SEQ ID NO: 11645 - RNA, 20 nt, Homo sapiens
ccagaggaaagcccaucucc

SEQ ID NO: 11646 - RNA, 19 nt, Homo sapiens
gacacuccagaggccccug

SEQ ID NO: 11647 - RNA, 22 nt, Homo sapiens
gugccucuguuggcugagcucu

SEQ ID NO: 11648 - RNA, 24 nt, Homo sapiens
uguuuaaacacugaacucuggugu

SEQ ID NO: 11649 - RNA, 24 nt, Homo sapiens
augcaaccucacuaugguaugcug

SEQ ID NO: 11650 - RNA, 19 nt, Homo sapiens
cuugaccuuuucgacgcuu

SEQ ID NO: 11651 - RNA, 19 nt, Homo sapiens
cuuuucgacgcuuaaccuu

SEQ ID NO: 11652 - RNA, 18 nt, Homo sapiens
gcacagggccaucuguca

SEQ ID NO: 11653 - RNA, 18 nt, Homo sapiens
gcugucugucaccagcua

SEQ ID NO: 11654 - RNA, 18 nt, Homo sapiens
ucuccggguguggccuca

SEQ ID NO: 11655 - RNA, 18 nt, Homo sapiens
uucuuggugacuguccca

SEQ ID NO: 11656 - RNA, 20 nt, Homo sapiens
aaggaugagucuacauuuua

SEQ ID NO: 11657 - RNA, 21 nt, Homo sapiens
aggaaguauaugaucugacuu

SEQ ID NO: 11658 - RNA, 24 nt, Homo sapiens
cuauuuuuccuacuuugcuuuuga

SEQ ID NO: 11659 - RNA, 19 nt, Homo sapiens
ggaagcugcgaggauucca

SEQ ID NO: 11660 - RNA, 22 nt, Homo sapiens
guacaaaauagcugacaguuuu

SEQ ID NO: 11661 - RNA, 18 nt, Homo sapiens
aagggaaaagggguuuca

SEQ ID NO: 11662 - RNA, 17 nt, Homo sapiens
gacccaccaccaccucc

SEQ ID NO: 11663 - RNA, 19 nt, Homo sapiens
gagcucccuuuuccgugga

SEQ ID NO: 11664 - RNA, 26 nt, Homo sapiens
ucccagagcgccccggggggcugcga

SEQ ID NO: 11665 - RNA, 20 nt, Homo sapiens
aaaaggugucuugguuugau

SEQ ID NO: 11666 - RNA, 19 nt, Homo sapiens
agaaagcacaguuugugag

SEQ ID NO: 11667 - RNA, 23 nt, Homo sapiens
agauauuuuugaccaguuccuuu

SEQ ID NO: 11668 - RNA, 18 nt, Homo sapiens
guugugugauuuuuugcc

SEQ ID NO: 11669 - RNA, 21 nt, Homo sapiens
ucuuuuuggaauccugaccuu

SEQ ID NO: 11670 - RNA, 16 nt, Homo sapiens
uugcucaauguaauau

SEQ ID NO: 11671 - RNA, 15 nt, Homo sapiens
ggcgacggcggcggc

SEQ ID NO: 11672 - RNA, 20 nt, Homo sapiens
ccaccugcugaccugcuguu

SEQ ID NO: 11673 - RNA, 19 nt, Homo sapiens
ucaagacucacaucccuuu

SEQ ID NO: 11674 - RNA, 20 nt, Homo sapiens
uucuggccugggaggucugu

SEQ ID NO: 11675 - RNA, 21 nt, Homo sapiens
cagugcacagggcuucccucu

SEQ ID NO: 11676 - RNA, 19 nt, Homo sapiens
ccugcagccugccuggcuc

SEQ ID NO: 11677 - RNA, 21 nt, Homo sapiens
gaugucuucagugugggacug

SEQ ID NO: 11678 - RNA, 16 nt, Homo sapiens
gcccaccuccgccccc

SEQ ID NO: 11679 - RNA, 21 nt, Homo sapiens
ucauuuuuccacacugagcaa

SEQ ID NO: 11680 - RNA, 21 nt, Homo sapiens
ugaccuaauaaggccaugcaa

SEQ ID NO: 11681 - RNA, 20 nt, Homo sapiens
uuccuugccuccuucuggug

SEQ ID NO: 11682 - RNA, 16 nt, Homo sapiens
ccaauugauugacuga

SEQ ID NO: 11683 - RNA, 19 nt, Homo sapiens
ccaccccaccccccacccc

SEQ ID NO: 11684 - RNA, 22 nt, Homo sapiens
cguccugguccgccagcaccuc

SEQ ID NO: 11685 - RNA, 19 nt, Homo sapiens
ucaagagaaacgcaccugc

SEQ ID NO: 11686 - RNA, 18 nt, Homo sapiens
accacaccaggccacccc

SEQ ID NO: 11687 - RNA, 21 nt, Homo sapiens
cccaucgccccaccgcagcua

SEQ ID NO: 11688 - RNA, 18 nt, Homo sapiens
cccugcccacccucccuc

SEQ ID NO: 11689 - RNA, 17 nt, Homo sapiens
ccggacacaccucugcu

SEQ ID NO: 11690 - RNA, 21 nt, Homo sapiens
gcauucagugcaccugccuca

SEQ ID NO: 11691 - RNA, 23 nt, Homo sapiens
gccuggccuccgaugccuggccu

SEQ ID NO: 11692 - RNA, 18 nt, Homo sapiens
guggcuaucaggaguucu

SEQ ID NO: 11693 - RNA, 21 nt, Homo sapiens
uccuguaauguuaaacucuuu

SEQ ID NO: 11694 - RNA, 18 nt, Homo sapiens
ugcguucgccucuggccc

SEQ ID NO: 11695 - RNA, 23 nt, Homo sapiens
acuuggguccaaauuguuggcuu

SEQ ID NO: 11696 - RNA, 19 nt, Homo sapiens
aauaaugguacagaucuuu

SEQ ID NO: 11697 - RNA, 20 nt, Homo sapiens
ccaaaagccauaagccugaa

SEQ ID NO: 11698 - RNA, 23 nt, Homo sapiens
ugcagcaacaaggaaaugacgca

SEQ ID NO: 11699 - RNA, 19 nt, Homo sapiens
ugccuugguuuuuacugcu

SEQ ID NO: 11700 - RNA, 19 nt, Homo sapiens
aaaaagugccuguagauga

SEQ ID NO: 11701 - RNA, 18 nt, Homo sapiens
uacagcagcacgcauuca

SEQ ID NO: 11702 - RNA, 21 nt, Homo sapiens
agagccggucagauuccccua

SEQ ID NO: 11703 - RNA, 17 nt, Homo sapiens
cgacccaccucugccca

SEQ ID NO: 11704 - RNA, 16 nt, Homo sapiens
aacuugaagauuguag

SEQ ID NO: 11705 - RNA, 22 nt, Homo sapiens
cccggcgugcucggcucccaca

SEQ ID NO: 11706 - RNA, 20 nt, Homo sapiens
ucccaguggcccggcgugcu

SEQ ID NO: 11707 - RNA, 19 nt, Homo sapiens
cccccggcucugccgugca

SEQ ID NO: 11708 - RNA, 23 nt, Homo sapiens
ggugaagacccgucgagcugcgg

SEQ ID NO: 11709 - RNA, 22 nt, Homo sapiens
ggcgacacggggagaacauaca

SEQ ID NO: 11710 - RNA, 16 nt, Homo sapiens
ucggcccagcucugaa

SEQ ID NO: 11711 - RNA, 23 nt, Homo sapiens
ccagugaugcuaaagguuguauu

SEQ ID NO: 11712 - RNA, 21 nt, Homo sapiens
ucuaaaauagggacguggcca

SEQ ID NO: 11713 - RNA, 18 nt, Homo sapiens
cuccauuugcaccuuugg

SEQ ID NO: 11714 - RNA, 18 nt, Homo sapiens
ggccacagagcagucaug

SEQ ID NO: 11715 - RNA, 19 nt, Homo sapiens
gggcuuuggccucuuuguc

SEQ ID NO: 11716 - RNA, 18 nt, Homo sapiens
ugccugugcaggauccgg

SEQ ID NO: 11717 - RNA, 18 nt, Homo sapiens
uucuucauagacuacuuu

SEQ ID NO: 11718 - RNA, 20 nt, Homo sapiens
accacacacucaccacuccc

SEQ ID NO: 11719 - RNA, 22 nt, Homo sapiens
aaagugucucugccuugaguca

SEQ ID NO: 11720 - RNA, 21 nt, Homo sapiens
acaaggaagaagcuugcuggu

SEQ ID NO: 11721 - RNA, 22 nt, Homo sapiens
agaaaguauuugauuuuugucu

SEQ ID NO: 11722 - RNA, 17 nt, Homo sapiens
agcugcucugaaaucuc

SEQ ID NO: 11723 - RNA, 21 nt, Homo sapiens
cccuaaaaauccagacucuuu

SEQ ID NO: 11724 - RNA, 22 nt, Homo sapiens
gacugguuuugcaacguuuaca

SEQ ID NO: 11725 - RNA, 18 nt, Homo sapiens
ggugcgaaugacaguagc

SEQ ID NO: 11726 - RNA, 22 nt, Homo sapiens
guauaugugaggauuuuuauug

SEQ ID NO: 11727 - RNA, 17 nt, Homo sapiens
ugggcucuuccaacaag

SEQ ID NO: 11728 - RNA, 23 nt, Homo sapiens
aucucccccaccuccccacuuuu

SEQ ID NO: 11729 - RNA, 22 nt, Homo sapiens
caccaccaccaccaccccuucu

SEQ ID NO: 11730 - RNA, 20 nt, Homo sapiens
ccaccaccaccuccaccgcc

SEQ ID NO: 11731 - RNA, 20 nt, Homo sapiens
ccaccgccaccaccaccucc

SEQ ID NO: 11732 - RNA, 20 nt, Homo sapiens
ccucccccaaccuuucucuc

SEQ ID NO: 11733 - RNA, 22 nt, Homo sapiens
uccugcucucacacacaccaga

SEQ ID NO: 11734 - RNA, 22 nt, Homo sapiens
acccagagcacaggagcugcca

SEQ ID NO: 11735 - RNA, 17 nt, Homo sapiens
ccauccccugaugccca

SEQ ID NO: 11736 - RNA, 21 nt, Homo sapiens
ccccaagguccccccacagcu

SEQ ID NO: 11737 - RNA, 19 nt, Homo sapiens
gcuguccuggcauuugugg

SEQ ID NO: 11738 - RNA, 25 nt, Homo sapiens
aaucaagccauguauaaaugugaua

SEQ ID NO: 11739 - RNA, 19 nt, Homo sapiens
agugccaaaugcucucuca

SEQ ID NO: 11740 - RNA, 16 nt, Homo sapiens
auugacaacacagccu

SEQ ID NO: 11741 - RNA, 18 nt, Homo sapiens
cgcacgcugaagacggca

SEQ ID NO: 11742 - RNA, 30 nt, Homo sapiens
gucucuuuguacaggaacugcauugacuuu

SEQ ID NO: 11743 - RNA, 18 nt, Homo sapiens
ucacuuacuauuguugcu

SEQ ID NO: 11744 - RNA, 19 nt, Homo sapiens
ccugcuccaauuuccccac

SEQ ID NO: 11745 - RNA, 19 nt, Homo sapiens
cuuccuucuaccccaaggc

SEQ ID NO: 11746 - RNA, 30 nt, Homo sapiens
uagcaagaaauauuuuaauauagugaaaug

SEQ ID NO: 11747 - RNA, 22 nt, Homo sapiens
uggaauuucuaguaugagacua

SEQ ID NO: 11748 - RNA, 21 nt, Homo sapiens
aucugggcuuauaucuggccu

SEQ ID NO: 11749 - RNA, 20 nt, Homo sapiens
ucuggcuguuugagauucuc

SEQ ID NO: 11750 - RNA, 17 nt, Homo sapiens
aaccacagauaguacca

SEQ ID NO: 11751 - RNA, 16 nt, Homo sapiens
gcuccccacauucucu

SEQ ID NO: 11752 - RNA, 18 nt, Homo sapiens
ggcaguucaagcuguuga

SEQ ID NO: 11753 - RNA, 19 nt, Homo sapiens
ugaaccuagaggugaugug

SEQ ID NO: 11754 - RNA, 19 nt, Homo sapiens
aaggcaugaccagcaauga

SEQ ID NO: 11755 - RNA, 20 nt, Homo sapiens
auccuacuguuacugaucac

SEQ ID NO: 11756 - RNA, 21 nt, Homo sapiens
ugaccauuuucgcuagacuuc

SEQ ID NO: 11757 - RNA, 16 nt, Homo sapiens
cucuccuuuuaucuca

SEQ ID NO: 11758 - RNA, 21 nt, Homo sapiens
cgcgccgcccgcgcgccgcug

SEQ ID NO: 11759 - RNA, 21 nt, Homo sapiens
aauagcgcccugugcagcuga

SEQ ID NO: 11760 - RNA, 18 nt, Homo sapiens
augucuaauguaacuucu

SEQ ID NO: 11761 - RNA, 19 nt, Homo sapiens
ugcaaaaucugugcuuuuu

SEQ ID NO: 11762 - RNA, 19 nt, Homo sapiens
uggacugaugcuggaauua

SEQ ID NO: 11763 - RNA, 21 nt, Homo sapiens
aagaauaaacugaugcuaucu

SEQ ID NO: 11764 - RNA, 22 nt, Homo sapiens
agaauaaacugaugcuaucuca

SEQ ID NO: 11765 - RNA, 19 nt, Homo sapiens
aggagaucaaauuacauuu

SEQ ID NO: 11766 - RNA, 15 nt, Homo sapiens
gauaaacugaugcua

SEQ ID NO: 11767 - RNA, 19 nt, Homo sapiens
uuugauggcccuuguugaa

SEQ ID NO: 11768 - RNA, 18 nt, Homo sapiens
caaccccugacugcuccu

SEQ ID NO: 11769 - RNA, 22 nt, Homo sapiens
ccccacaguccuucccauuucc

SEQ ID NO: 11770 - RNA, 16 nt, Homo sapiens
cugaacaguuacuuca

SEQ ID NO: 11771 - RNA, 17 nt, Homo sapiens
aggagggggcggggaca

SEQ ID NO: 11772 - RNA, 21 nt, Homo sapiens
cagaagaaaucuggccucgga

SEQ ID NO: 11773 - RNA, 20 nt, Homo sapiens
cccagaaaaaaaccacuugg

SEQ ID NO: 11774 - RNA, 17 nt, Homo sapiens
cuuucucuccugacuca

SEQ ID NO: 11775 - RNA, 19 nt, Homo sapiens
gugggcugaaaacauccuu

SEQ ID NO: 11776 - RNA, 21 nt, Homo sapiens
uguggcuuuucccaacacaau

SEQ ID NO: 11777 - RNA, 18 nt, Homo sapiens
cauccgcgccgccgccgc

SEQ ID NO: 11778 - RNA, 24 nt, Homo sapiens
gugcuucucaucaaugauauguaa

SEQ ID NO: 11779 - RNA, 19 nt, Homo sapiens
gugcuugcaaaauguaaua

SEQ ID NO: 11780 - RNA, 17 nt, Homo sapiens
uauuugaaaaggcuucc

SEQ ID NO: 11781 - RNA, 17 nt, Homo sapiens
uccuauccagccuuuuu

SEQ ID NO: 11782 - RNA, 19 nt, Homo sapiens
uuuuucugauauaugcagu

SEQ ID NO: 11783 - RNA, 18 nt, Homo sapiens
aacagaagcaacucaaag

SEQ ID NO: 11784 - RNA, 19 nt, Homo sapiens
agacagugcuacagagcca

SEQ ID NO: 11785 - RNA, 21 nt, Homo sapiens
auggguccccaaauguuccca

SEQ ID NO: 11786 - RNA, 21 nt, Homo sapiens
gcuugaguugucacuuggucc

SEQ ID NO: 11787 - RNA, 22 nt, Homo sapiens
ggcgucccugcagccccgggug

SEQ ID NO: 11788 - RNA, 18 nt, Homo sapiens
uuuguauugaucacuuuu

SEQ ID NO: 11789 - RNA, 19 nt, Homo sapiens
accggugguuuucugguuu

SEQ ID NO: 11790 - RNA, 20 nt, Homo sapiens
gccagccgcuuccugccucc

SEQ ID NO: 11791 - RNA, 21 nt, Homo sapiens
ccuuuuuguggcuaaguuuug

SEQ ID NO: 11792 - RNA, 20 nt, Homo sapiens
gggagacuguugcucaacca

SEQ ID NO: 11793 - RNA, 24 nt, Homo sapiens
ucaaccaucaggaaacaguuguca

SEQ ID NO: 11794 - RNA, 24 nt, Homo sapiens
caccaccaccuuuugcccccuucu

SEQ ID NO: 11795 - RNA, 16 nt, Homo sapiens
guggggagucuuguca

SEQ ID NO: 11796 - RNA, 23 nt, Homo sapiens
uaagaugguguuggguuagguua

SEQ ID NO: 11797 - RNA, 19 nt, Homo sapiens
uucuugcuucucaugaugc

SEQ ID NO: 11798 - RNA, 23 nt, Homo sapiens
aucugaaugauuacugucugucu

SEQ ID NO: 11799 - RNA, 19 nt, Homo sapiens
gugauuauuacaccaguua

SEQ ID NO: 11800 - RNA, 19 nt, Homo sapiens
aguauuguggcaucagaua

SEQ ID NO: 11801 - RNA, 18 nt, Homo sapiens
caccaaaggagacauauc

SEQ ID NO: 11802 - RNA, 21 nt, Homo sapiens
caagugcagaguucagacuuc

SEQ ID NO: 11803 - RNA, 17 nt, Homo sapiens
cacuuucuucaaagcca

SEQ ID NO: 11804 - RNA, 23 nt, Homo sapiens
ucccccagaugcagggcugcagg

SEQ ID NO: 11805 - RNA, 18 nt, Homo sapiens
cagcugcaaucacuagca

SEQ ID NO: 11806 - RNA, 23 nt, Homo sapiens
gcuggccgcggccgguuuggucu

SEQ ID NO: 11807 - RNA, 17 nt, Homo sapiens
ccaucaucauguccuca

SEQ ID NO: 11808 - RNA, 19 nt, Homo sapiens
ucauguauaugaacuucuc

SEQ ID NO: 11809 - RNA, 22 nt, Homo sapiens
aaaacagcugcaucuguuacuu

SEQ ID NO: 11810 - RNA, 16 nt, Homo sapiens
cacugaccaagugcug

SEQ ID NO: 11811 - RNA, 24 nt, Homo sapiens
uagauggaccccagcauuuaagug

SEQ ID NO: 11812 - RNA, 20 nt, Homo sapiens
ucccggcggaaagccucugu

SEQ ID NO: 11813 - RNA, 18 nt, Homo sapiens
ugagccaugauuucccac

SEQ ID NO: 11814 - RNA, 21 nt, Homo sapiens
cccaacuuaguuuuucaguga

SEQ ID NO: 11815 - RNA, 19 nt, Homo sapiens
ucauuugacuucucaauaa

SEQ ID NO: 11816 - RNA, 21 nt, Homo sapiens
aacacgauucgcaacguucug

SEQ ID NO: 11817 - RNA, 18 nt, Homo sapiens
ccuccuguacuuaaacac

SEQ ID NO: 11818 - RNA, 20 nt, Homo sapiens
guuaaauaaacaguauuaca

SEQ ID NO: 11819 - RNA, 20 nt, Homo sapiens
cagucucagagcggagccca

SEQ ID NO: 11820 - RNA, 17 nt, Homo sapiens
cggcacuccagccuggc

SEQ ID NO: 11821 - RNA, 19 nt, Homo sapiens
cuaguagaacuggauccca

SEQ ID NO: 11822 - RNA, 21 nt, Homo sapiens
uggauggugacauugaaacua

SEQ ID NO: 11823 - RNA, 19 nt, Homo sapiens
cccucugauugauaagaca

SEQ ID NO: 11824 - RNA, 26 nt, Homo sapiens
gccugggucuggagccguccuggccu

SEQ ID NO: 11825 - RNA, 18 nt, Homo sapiens
acauaguccccuccuauu

SEQ ID NO: 11826 - RNA, 23 nt, Homo sapiens
agccuccauacgaaagcacuguu

SEQ ID NO: 11827 - RNA, 16 nt, Homo sapiens
gauucuaccacuuuug

SEQ ID NO: 11828 - RNA, 18 nt, Homo sapiens
gucuggauguguuuacug

SEQ ID NO: 11829 - RNA, 20 nt, Homo sapiens
aagguggcaaugcuuaaacu

SEQ ID NO: 11830 - RNA, 21 nt, Homo sapiens
accuauguuauuuuguguaca

SEQ ID NO: 11831 - RNA, 19 nt, Homo sapiens
cccacuccccucgccaccg

SEQ ID NO: 11832 - RNA, 18 nt, Homo sapiens
cuggucgucgucgccgcu

SEQ ID NO: 11833 - RNA, 21 nt, Homo sapiens
cuuuuguucugcuuuaucuuu

SEQ ID NO: 11834 - RNA, 22 nt, Homo sapiens
gauuugaugugacuuuuuuugg

SEQ ID NO: 11835 - RNA, 20 nt, Homo sapiens
cucuccugcagcccaucugg

SEQ ID NO: 11836 - RNA, 15 nt, Homo sapiens
cuucgccgccgcagc

SEQ ID NO: 11837 - RNA, 21 nt, Homo sapiens
gcuuggcucccccuccccccu

SEQ ID NO: 11838 - RNA, 21 nt, Homo sapiens
uagcuguagcucgggcugcuu

SEQ ID NO: 11839 - RNA, 23 nt, Homo sapiens
gcacugaaggagaagaucugcca

SEQ ID NO: 11840 - RNA, 21 nt, Homo sapiens
caaguaaagcacaacauuaug

SEQ ID NO: 11841 - RNA, 19 nt, Homo sapiens
uguaauugcguacaggcga

SEQ ID NO: 11842 - RNA, 19 nt, Homo sapiens
caagacacaaggcauucca

SEQ ID NO: 11843 - RNA, 22 nt, Homo sapiens
cauuggcaucaucguuucuuuu

SEQ ID NO: 11844 - RNA, 21 nt, Homo sapiens
ccacuuccaccucuucucuca

SEQ ID NO: 11845 - RNA, 17 nt, Homo sapiens
ccuccuuaagcugcugu

SEQ ID NO: 11846 - RNA, 16 nt, Homo sapiens
gggcccacggccacca

SEQ ID NO: 11847 - RNA, 22 nt, Homo sapiens
cccuacuacacuuugcuaguga

SEQ ID NO: 11848 - RNA, 20 nt, Homo sapiens
ccucugccucccggguucaa

SEQ ID NO: 11849 - RNA, 18 nt, Homo sapiens
ccugcaaccuccaccucc

SEQ ID NO: 11850 - RNA, 19 nt, Homo sapiens
cuggacagagcuaaacucu

SEQ ID NO: 11851 - RNA, 17 nt, Homo sapiens
ucaagcgauucuugugc

SEQ ID NO: 11852 - RNA, 21 nt, Homo sapiens
cgugccuccccaccaccacuu

SEQ ID NO: 11853 - RNA, 23 nt, Homo sapiens
uuugaugauuauuggagccccag

SEQ ID NO: 11854 - RNA, 16 nt, Homo sapiens
acccagcucucucucu

SEQ ID NO: 11855 - RNA, 20 nt, Homo sapiens
ccucugccucccggguucaa

SEQ ID NO: 11856 - RNA, 19 nt, Homo sapiens
ggcugacagaugguaugca

SEQ ID NO: 11857 - RNA, 21 nt, Homo sapiens
ucccacucucaaugcugugac

SEQ ID NO: 11858 - RNA, 18 nt, Homo sapiens
uucuccugccugagccuu

SEQ ID NO: 11859 - RNA, 23 nt, Homo sapiens
uugggcccucgcaccagccugca

SEQ ID NO: 11860 - RNA, 24 nt, Homo sapiens
ccuggguaaugagagguggcuuuu

SEQ ID NO: 11861 - RNA, 17 nt, Homo sapiens
gccuuuuucccagcuuc

SEQ ID NO: 11862 - RNA, 18 nt, Homo sapiens
auuuugaaguuauuuuuu

SEQ ID NO: 11863 - RNA, 24 nt, Homo sapiens
gcucucagcuggaggccccucucu

SEQ ID NO: 11864 - RNA, 19 nt, Homo sapiens
ggucaucauacaucccaca

SEQ ID NO: 11865 - RNA, 18 nt, Homo sapiens
ccugcaaccuccaccucc

SEQ ID NO: 11866 - RNA, 18 nt, Homo sapiens
uccaccuccuggguucaa

SEQ ID NO: 11867 - RNA, 21 nt, Homo sapiens
uuuuuguuuaacaagguaacu

SEQ ID NO: 11868 - RNA, 20 nt, Homo sapiens
aacccagcccuccacugcca

SEQ ID NO: 11869 - RNA, 17 nt, Homo sapiens
acuggaauuuacugaga

SEQ ID NO: 11870 - RNA, 18 nt, Homo sapiens
agaacuggucuucucaca

SEQ ID NO: 11871 - RNA, 18 nt, Homo sapiens
ccagcgaguuucccagga

SEQ ID NO: 11872 - RNA, 18 nt, Homo sapiens
ccaggacaccuaugucaa

SEQ ID NO: 11873 - RNA, 16 nt, Homo sapiens
cucaggucugcugcaa

SEQ ID NO: 11874 - RNA, 18 nt, Homo sapiens
cucuuguaaaauaaccca

SEQ ID NO: 11875 - RNA, 15 nt, Homo sapiens
gaacacuagaagcuc

SEQ ID NO: 11876 - RNA, 21 nt, Homo sapiens
gggcaggggugaaacuccagc

SEQ ID NO: 11877 - RNA, 18 nt, Homo sapiens
uggucuugacuugucaua

SEQ ID NO: 11878 - RNA, 22 nt, Homo sapiens
augucauagaaauauugacuca

SEQ ID NO: 11879 - RNA, 17 nt, Homo sapiens
ccugagccuccuuauuc

SEQ ID NO: 11880 - RNA, 18 nt, Homo sapiens
cugccuccucauuuuuca

SEQ ID NO: 11881 - RNA, 21 nt, Homo sapiens
uggacauuuauugugaaauua

SEQ ID NO: 11882 - RNA, 20 nt, Homo sapiens
gccccucucuccucuuccuc

SEQ ID NO: 11883 - RNA, 19 nt, Homo sapiens
auugacccuggacaucuuu

SEQ ID NO: 11884 - RNA, 21 nt, Homo sapiens
ccagauuauaaggagaaccaa

SEQ ID NO: 11885 - RNA, 24 nt, Homo sapiens
uaagucgcaaaauuuauuaauuua

SEQ ID NO: 11886 - RNA, 20 nt, Homo sapiens
acauguuguacauuucacca

SEQ ID NO: 11887 - RNA, 21 nt, Homo sapiens
cauggccucugcaacugcuca

SEQ ID NO: 11888 - RNA, 19 nt, Homo sapiens
ccugggggaccccuggcuc

SEQ ID NO: 11889 - RNA, 16 nt, Homo sapiens
gccgggugcuuuccug

SEQ ID NO: 11890 - RNA, 23 nt, Homo sapiens
uaccagucuccuccccuacucug

SEQ ID NO: 11891 - RNA, 23 nt, Homo sapiens
ucuuuucauaucucuuugcccuu

SEQ ID NO: 11892 - RNA, 19 nt, Homo sapiens
uggcuguaccuguuccucc

SEQ ID NO: 11893 - RNA, 18 nt, Homo sapiens
ugguggggagcacagaca

SEQ ID NO: 11894 - RNA, 23 nt, Homo sapiens
gaacgaaguucgcuucuuccuuc

SEQ ID NO: 11895 - RNA, 19 nt, Homo sapiens
ccaccuccaacccaaccca

SEQ ID NO: 11896 - RNA, 18 nt, Homo sapiens
cccaucucucccacuucc

SEQ ID NO: 11897 - RNA, 18 nt, Homo sapiens
ucucugccucucuucuuc

SEQ ID NO: 11898 - RNA, 23 nt, Homo sapiens
ucugccucucuucuuccccuuug

SEQ ID NO: 11899 - RNA, 18 nt, Homo sapiens
aaacuaaagagcugcaca

SEQ ID NO: 11900 - RNA, 21 nt, Homo sapiens
aggauuacaggcccgugccca

SEQ ID NO: 11901 - RNA, 20 nt, Homo sapiens
ccucugccucuuggguucaa

SEQ ID NO: 11902 - RNA, 18 nt, Homo sapiens
cuuuguauuaauuuacca

SEQ ID NO: 11903 - RNA, 19 nt, Homo sapiens
guugcagcacugcccauca

SEQ ID NO: 11904 - RNA, 22 nt, Homo sapiens
uaaaaaggaacaagacugacug

SEQ ID NO: 11905 - RNA, 19 nt, Homo sapiens
acacuguggccaggccuua

SEQ ID NO: 11906 - RNA, 22 nt, Homo sapiens
cacugugccccacaaaacuuca

SEQ ID NO: 11907 - RNA, 22 nt, Homo sapiens
ccaccccccacucagugccucc

SEQ ID NO: 11908 - RNA, 20 nt, Homo sapiens
gccugggccguggcacagcu

SEQ ID NO: 11909 - RNA, 18 nt, Homo sapiens
uccacaugcugccuggca

SEQ ID NO: 11910 - RNA, 20 nt, Homo sapiens
uggaagcccaacugggguug

SEQ ID NO: 11911 - RNA, 18 nt, Homo sapiens
caccauucuccugccuca

SEQ ID NO: 11912 - RNA, 21 nt, Homo sapiens
cauguuuuuaaugguaaacug

SEQ ID NO: 11913 - RNA, 19 nt, Homo sapiens
cccaaguauuaaacucuaa

SEQ ID NO: 11914 - RNA, 19 nt, Homo sapiens
cugcaagcucugccuccca

SEQ ID NO: 11915 - RNA, 20 nt, Homo sapiens
gugguuugagugucuagcaa

SEQ ID NO: 11916 - RNA, 20 nt, Homo sapiens
ucagggacuugaaugcacuu

SEQ ID NO: 11917 - RNA, 20 nt, Homo sapiens
aaauaccauuagaaaauacu

SEQ ID NO: 11918 - RNA, 22 nt, Homo sapiens
uauauuuuaugacaagaaugug

SEQ ID NO: 11919 - RNA, 19 nt, Homo sapiens
uccgauuuuugccuucgaa

SEQ ID NO: 11920 - RNA, 20 nt, Homo sapiens
uguggcguaccuucuccaca

SEQ ID NO: 11921 - RNA, 18 nt, Homo sapiens
aaaugcagcaucuuugug

SEQ ID NO: 11922 - RNA, 17 nt, Homo sapiens
agcaaauaggcaaaaga

SEQ ID NO: 11923 - RNA, 22 nt, Homo sapiens
cacaagccuccaaggcuccuua

SEQ ID NO: 11924 - RNA, 18 nt, Homo sapiens
gggauaaagucauccucu

SEQ ID NO: 11925 - RNA, 18 nt, Homo sapiens
cuucucugccuuuauuuu

SEQ ID NO: 11926 - RNA, 16 nt, Homo sapiens
aauucacuucagucca

SEQ ID NO: 11927 - RNA, 23 nt, Homo sapiens
cagacguggggagccugacccca

SEQ ID NO: 11928 - RNA, 21 nt, Homo sapiens
ccagcaggcaccuguauugca

SEQ ID NO: 11929 - RNA, 23 nt, Homo sapiens
ccccgugggggugccugugccag

SEQ ID NO: 11930 - RNA, 22 nt, Homo sapiens
cccugggggugggaggcugugg

SEQ ID NO: 11931 - RNA, 18 nt, Homo sapiens
cuugguagggugcugccu

SEQ ID NO: 11932 - RNA, 21 nt, Homo sapiens
gccuggcaccuacucuuuaga

SEQ ID NO: 11933 - RNA, 20 nt, Homo sapiens
uagcagagguaugcuuacca

SEQ ID NO: 11934 - RNA, 22 nt, Homo sapiens
uuuugccauggaggucugggag

SEQ ID NO: 11935 - RNA, 20 nt, Homo sapiens
acgaggauuuccucaucguc

SEQ ID NO: 11936 - RNA, 22 nt, Homo sapiens
uggaaggggaaccacaguuuca

SEQ ID NO: 11937 - RNA, 22 nt, Homo sapiens
aaaaugaaagcaaaauaucuua

SEQ ID NO: 11938 - RNA, 26 nt, Homo sapiens
aaagucauuauuuuuccuauucauuu

SEQ ID NO: 11939 - RNA, 21 nt, Homo sapiens
aagaaucuugugaugucuaca

SEQ ID NO: 11940 - RNA, 18 nt, Homo sapiens
auuuuugucauuuccaaa

SEQ ID NO: 11941 - RNA, 19 nt, Homo sapiens
ugcaagugcccgcccugcc

SEQ ID NO: 11942 - RNA, 23 nt, Homo sapiens
acuuuagcauguuguugaucaug

SEQ ID NO: 11943 - RNA, 23 nt, Homo sapiens
gcagcaagcugagggucuuuguu

SEQ ID NO: 11944 - RNA, 21 nt, Homo sapiens
ugacccuggcagugcacuggu

SEQ ID NO: 11945 - RNA, 18 nt, Homo sapiens
cuagagcaccaccuuaag

SEQ ID NO: 11946 - RNA, 20 nt, Homo sapiens
aaaagguaucuugguuauga

SEQ ID NO: 11947 - RNA, 22 nt, Homo sapiens
aaacagcgggaacuucauugca

SEQ ID NO: 11948 - RNA, 17 nt, Homo sapiens
aagucauuacaaaugug

SEQ ID NO: 11949 - RNA, 19 nt, Homo sapiens
caaaacugguaaguuucuu

SEQ ID NO: 11950 - RNA, 20 nt, Homo sapiens
ccagaaaacgcuguccugug

SEQ ID NO: 11951 - RNA, 19 nt, Homo sapiens
ccauuguguccaacuguau

SEQ ID NO: 11952 - RNA, 21 nt, Homo sapiens
ccucuucuccaauuuguaggu

SEQ ID NO: 11953 - RNA, 24 nt, Homo sapiens
cugagauuucuaccacaccuuuga

SEQ ID NO: 11954 - RNA, 19 nt, Homo sapiens
ggcuucaucuucucccugu

SEQ ID NO: 11955 - RNA, 26 nt, Homo sapiens
uaggugacgaguugacauugagauug

SEQ ID NO: 11956 - RNA, 20 nt, Homo sapiens
ucaucuucucccuguaacug

SEQ ID NO: 11957 - RNA, 19 nt, Homo sapiens
acauuuaucaccucugaug

SEQ ID NO: 11958 - RNA, 19 nt, Homo sapiens
gaaaaugauuccuggacau

SEQ ID NO: 11959 - RNA, 20 nt, Homo sapiens
ucaccaaaauuucuacacca

SEQ ID NO: 11960 - RNA, 16 nt, Homo sapiens
ugaaacguuaugauga

SEQ ID NO: 11961 - RNA, 19 nt, Homo sapiens
uucugcuacuucacuguca

SEQ ID NO: 11962 - RNA, 22 nt, Homo sapiens
auaaaauauguuucuauuuaga

SEQ ID NO: 11963 - RNA, 21 nt, Homo sapiens
uaacuuucaauaaaugcaaua

SEQ ID NO: 11964 - RNA, 23 nt, Homo sapiens
ucuuuucaugucauguuuugauu

SEQ ID NO: 11965 - RNA, 23 nt, Homo sapiens
agccaugguucacacauaugaca

SEQ ID NO: 11966 - RNA, 20 nt, Homo sapiens
cucuccuuacacgcacugau

SEQ ID NO: 11967 - RNA, 22 nt, Homo sapiens
ucuugagaguccuucuugcaca

SEQ ID NO: 11968 - RNA, 19 nt, Homo sapiens
acugauccagauuugcagu

SEQ ID NO: 11969 - RNA, 21 nt, Homo sapiens
acuggacaguagacaucauga

SEQ ID NO: 11970 - RNA, 25 nt, Homo sapiens
acuguuucaacuaacacccaugcua

SEQ ID NO: 11971 - RNA, 19 nt, Homo sapiens
cauaacaguuucuuaaccu

SEQ ID NO: 11972 - RNA, 22 nt, Homo sapiens
ccagacugcuucccguccaagu

SEQ ID NO: 11973 - RNA, 18 nt, Homo sapiens
cucuccuuccaguccuga

SEQ ID NO: 11974 - RNA, 20 nt, Homo sapiens
cugagccagcaugcuggcuu

SEQ ID NO: 11975 - RNA, 18 nt, Homo sapiens
gggcccgcccgcccccuc

SEQ ID NO: 11976 - RNA, 19 nt, Homo sapiens
acuucauccugaaguuugc

SEQ ID NO: 11977 - RNA, 20 nt, Homo sapiens
uggccaggcuggucuugaac

SEQ ID NO: 11978 - RNA, 17 nt, Homo sapiens
cccagccgggcccggga

SEQ ID NO: 11979 - RNA, 22 nt, Homo sapiens
ucucuccccaucucuggucuca

SEQ ID NO: 11980 - RNA, 24 nt, Homo sapiens
ugcccccagaaaggggcugcccug

SEQ ID NO: 11981 - RNA, 19 nt, Homo sapiens
gcccgcacagcuccgggug

SEQ ID NO: 11982 - RNA, 19 nt, Homo sapiens
ucaaacaugcggugccaug

SEQ ID NO: 11983 - RNA, 22 nt, Homo sapiens
cugacaacagcgugagauuuca

SEQ ID NO: 11984 - RNA, 21 nt, Homo sapiens
acccugcagcccaggucccca

SEQ ID NO: 11985 - RNA, 19 nt, Homo sapiens
ccauccuuccucuguuccu

SEQ ID NO: 11986 - RNA, 15 nt, Homo sapiens
cucccucccuccucu

SEQ ID NO: 11987 - RNA, 17 nt, Homo sapiens
gcugcagugggaucugg

SEQ ID NO: 11988 - RNA, 18 nt, Homo sapiens
guuccuucuggccgggca

SEQ ID NO: 11989 - RNA, 20 nt, Homo sapiens
aagucaccuccaaguguagc

SEQ ID NO: 11990 - RNA, 18 nt, Homo sapiens
cuauugccuugugugauu

SEQ ID NO: 11991 - RNA, 20 nt, Homo sapiens
cuuugaugguuucuaucugc

SEQ ID NO: 11992 - RNA, 20 nt, Homo sapiens
gcccgguacagggcccggug

SEQ ID NO: 11993 - RNA, 19 nt, Homo sapiens
gccucaggcagagcccggu

SEQ ID NO: 11994 - RNA, 22 nt, Homo sapiens
uccagcccccagugucccaucc

SEQ ID NO: 11995 - RNA, 21 nt, Homo sapiens
ugggugugcaacuugaggcug

SEQ ID NO: 11996 - RNA, 18 nt, Homo sapiens
uucgagccacgcauccaa

SEQ ID NO: 11997 - RNA, 22 nt, Homo sapiens
aagaacaauaaugauuccauca

SEQ ID NO: 11998 - RNA, 20 nt, Homo sapiens
aucauuguuuucccucacag

SEQ ID NO: 11999 - RNA, 23 nt, Homo sapiens
uaggauucaauucaauguggaac

SEQ ID NO: 12000 - RNA, 19 nt, Homo sapiens
ucugcuuuuuggcuuugug

SEQ ID NO: 12001 - RNA, 26 nt, Homo sapiens
caagguugugcuaucaaggcucagca

SEQ ID NO: 12002 - RNA, 17 nt, Homo sapiens
uaaaacaacacaaugca

SEQ ID NO: 12003 - RNA, 16 nt, Homo sapiens
augauccuaccaguug

SEQ ID NO: 12004 - RNA, 22 nt, Homo sapiens
cuuccaagcaccccucugcccu

SEQ ID NO: 12005 - RNA, 22 nt, Homo sapiens
cuugucuuucaaggccagguuc

SEQ ID NO: 12006 - RNA, 25 nt, Homo sapiens
guguuucacauauguugugaauuuu

SEQ ID NO: 12007 - RNA, 16 nt, Homo sapiens
auccagccagacccca

SEQ ID NO: 12008 - RNA, 24 nt, Homo sapiens
cccucccccaugggcuguguccua

SEQ ID NO: 12009 - RNA, 23 nt, Homo sapiens
gaggaggggaccaauucuggaca

SEQ ID NO: 12010 - RNA, 17 nt, Homo sapiens
ggaauucccucccccuc

SEQ ID NO: 12011 - RNA, 22 nt, Homo sapiens
acugaaagcaaaugcuuuguga

SEQ ID NO: 12012 - RNA, 17 nt, Homo sapiens
auacauaaaugcccagc

SEQ ID NO: 12013 - RNA, 19 nt, Homo sapiens
cgucccugcugugagcucu

SEQ ID NO: 12014 - RNA, 23 nt, Homo sapiens
cuauuauggaacccaauggacau

SEQ ID NO: 12015 - RNA, 19 nt, Homo sapiens
gcuuugauucccucugaua

SEQ ID NO: 12016 - RNA, 23 nt, Homo sapiens
caccccagccuggccacgcagcc

SEQ ID NO: 12017 - RNA, 19 nt, Homo sapiens
ccuggccacgcagccagga

SEQ ID NO: 12018 - RNA, 21 nt, Homo sapiens
gcagccgucaccccugccucc

SEQ ID NO: 12019 - RNA, 25 nt, Homo sapiens
gcccuuuuccuccagccuaaacuga

SEQ ID NO: 12020 - RNA, 20 nt, Homo sapiens
auuuugugaccacuauugug

SEQ ID NO: 12021 - RNA, 22 nt, Homo sapiens
ccgaaaccgaguccgggcccgu

SEQ ID NO: 12022 - RNA, 21 nt, Homo sapiens
aaggaugaacuaaauauuuua

SEQ ID NO: 12023 - RNA, 17 nt, Homo sapiens
aaucaagauucaaacag

SEQ ID NO: 12024 - RNA, 23 nt, Homo sapiens
uugagacgucagugauaaaugag

SEQ ID NO: 12025 - RNA, 20 nt, Homo sapiens
uuuuuugcaacugugcuuuu

SEQ ID NO: 12026 - RNA, 19 nt, Homo sapiens
aaacuccugaccucaggug

SEQ ID NO: 12027 - RNA, 21 nt, Homo sapiens
aucuuggcucaccauaaccuc

SEQ ID NO: 12028 - RNA, 18 nt, Homo sapiens
uccgccucccagguucaa

SEQ ID NO: 12029 - RNA, 17 nt, Homo sapiens
uucuccugccuuagccu

SEQ ID NO: 12030 - RNA, 19 nt, Homo sapiens
cagggccugaucuuuacca

SEQ ID NO: 12031 - RNA, 20 nt, Homo sapiens
caguccugguugggaucaca

SEQ ID NO: 12032 - RNA, 18 nt, Homo sapiens
cucaaggucacacaguga

SEQ ID NO: 12033 - RNA, 21 nt, Homo sapiens
gcuuggcccacagucuggcuc

SEQ ID NO: 12034 - RNA, 20 nt, Homo sapiens
ggucuccaaauuacagccca

SEQ ID NO: 12035 - RNA, 21 nt, Homo sapiens
uguugaccugucagaucaaca

SEQ ID NO: 12036 - RNA, 20 nt, Homo sapiens
ccucugccuccuggguucaa

SEQ ID NO: 12037 - RNA, 18 nt, Homo sapiens
uccugaccucaugaucca

SEQ ID NO: 12038 - RNA, 16 nt, Homo sapiens
ugucacuacaguauua

SEQ ID NO: 12039 - RNA, 26 nt, Homo sapiens
uucccauccaucuguuuacuacaaua

SEQ ID NO: 12040 - RNA, 20 nt, Homo sapiens
aguuguuaaacaacaugcua

SEQ ID NO: 12041 - RNA, 23 nt, Homo sapiens
ggacuuuccagugaugccacuga

SEQ ID NO: 12042 - RNA, 18 nt, Homo sapiens
acacaucccagcccaauc

SEQ ID NO: 12043 - RNA, 17 nt, Homo sapiens
aggggugacacagacuc

SEQ ID NO: 12044 - RNA, 22 nt, Homo sapiens
aucuguccucggcuucuggccu

SEQ ID NO: 12045 - RNA, 27 nt, Homo sapiens
gccugaacuaccguccugccuaggccu

SEQ ID NO: 12046 - RNA, 17 nt, Homo sapiens
uaggauuuuacuucuug

SEQ ID NO: 12047 - RNA, 22 nt, Homo sapiens
uuugcccugggaaaccccuucu

SEQ ID NO: 12048 - RNA, 19 nt, Homo sapiens
uaaaagagacacaaacaaa

SEQ ID NO: 12049 - RNA, 18 nt, Homo sapiens
gcagggggcuggcaggug

SEQ ID NO: 12050 - RNA, 19 nt, Homo sapiens
aaaagagugaaugugguau

SEQ ID NO: 12051 - RNA, 19 nt, Homo sapiens
caguggcucuuggguucaa

SEQ ID NO: 12052 - RNA, 22 nt, Homo sapiens
gcuugggcuuaggcuugggcuc

SEQ ID NO: 12053 - RNA, 20 nt, Homo sapiens
uucauuuucacuggauacau

SEQ ID NO: 12054 - RNA, 20 nt, Homo sapiens
gcucugggaggccggcugcg

SEQ ID NO: 12055 - RNA, 19 nt, Homo sapiens
agccucauagucaauccca

SEQ ID NO: 12056 - RNA, 20 nt, Homo sapiens
auguacuuaaaacaucugau

SEQ ID NO: 12057 - RNA, 26 nt, Homo sapiens
ccucauagucaaucccaguugcuuuu

SEQ ID NO: 12058 - RNA, 26 nt, Homo sapiens
guaugugugauacuaagguuugacug

SEQ ID NO: 12059 - RNA, 15 nt, Homo sapiens
ucauagucaauccca

SEQ ID NO: 12060 - RNA, 21 nt, Homo sapiens
auuuuguauuauuguucucac

SEQ ID NO: 12061 - RNA, 25 nt, Homo sapiens
uccaaaugaacuugcacuuguuaua

SEQ ID NO: 12062 - RNA, 19 nt, Homo sapiens
uguauauuuuuaaagaaug

SEQ ID NO: 12063 - RNA, 26 nt, Homo sapiens
accugagcuccccugcccucuggcuu

SEQ ID NO: 12064 - RNA, 20 nt, Homo sapiens
caagaugaguugacacaacc

SEQ ID NO: 12065 - RNA, 17 nt, Homo sapiens
cagcuguguguccauca

SEQ ID NO: 12066 - RNA, 19 nt, Homo sapiens
ccgaauacgcacucuugaa

SEQ ID NO: 12067 - RNA, 23 nt, Homo sapiens
aaaagaguagaauaggguaugau

SEQ ID NO: 12068 - RNA, 21 nt, Homo sapiens
gggacuuggcaacccgccucc

SEQ ID NO: 12069 - RNA, 19 nt, Homo sapiens
guuggguggagagaguauu

SEQ ID NO: 12070 - RNA, 18 nt, Homo sapiens
ugggcccggauggggcug

SEQ ID NO: 12071 - RNA, 20 nt, Homo sapiens
cuccugcuccuugcuguuuu

SEQ ID NO: 12072 - RNA, 21 nt, Homo sapiens
gaagccucagugguggaauuc

SEQ ID NO: 12073 - RNA, 25 nt, Homo sapiens
uucugaugauuugggggcuugggag

SEQ ID NO: 12074 - RNA, 25 nt, Homo sapiens
caugcuuggagcauuggguaucuga

SEQ ID NO: 12075 - RNA, 23 nt, Homo sapiens
cucugacgguggagaaccaugug

SEQ ID NO: 12076 - RNA, 18 nt, Homo sapiens
gagcuucaaagcaacuuu

SEQ ID NO: 12077 - RNA, 20 nt, Homo sapiens
gcuuauccaaaauuaucucu

SEQ ID NO: 12078 - RNA, 21 nt, Homo sapiens
gucuagaaagaaaacauugga

SEQ ID NO: 12079 - RNA, 21 nt, Homo sapiens
uucagaagaugauuuuacuca

SEQ ID NO: 12080 - RNA, 22 nt, Homo sapiens
aauggcagcccuccccgccccu

SEQ ID NO: 12081 - RNA, 22 nt, Homo sapiens
cccucgcugcggggccugugga

SEQ ID NO: 12082 - RNA, 17 nt, Homo sapiens
gccccgccccagcccca

SEQ ID NO: 12083 - RNA, 15 nt, Homo sapiens
aagcugugguuuaca

SEQ ID NO: 12084 - RNA, 21 nt, Homo sapiens
acagcagcacccuuuccucuc

SEQ ID NO: 12085 - RNA, 18 nt, Homo sapiens
ccccacaagcccccucca

SEQ ID NO: 12086 - RNA, 22 nt, Homo sapiens
ccuuccccacaagcccccucca

SEQ ID NO: 12087 - RNA, 20 nt, Homo sapiens
cuugcggccucgcggccggg

SEQ ID NO: 12088 - RNA, 19 nt, Homo sapiens
gcggccgggccggccuggg

SEQ ID NO: 12089 - RNA, 18 nt, Homo sapiens
agggaaaauccuaagaca

SEQ ID NO: 12090 - RNA, 21 nt, Homo sapiens
ggauggaaagacaaacugcac

SEQ ID NO: 12091 - RNA, 19 nt, Homo sapiens
cagguggggcauguccuca

SEQ ID NO: 12092 - RNA, 21 nt, Homo sapiens
guguuucuagagaacaguuga

SEQ ID NO: 12093 - RNA, 17 nt, Homo sapiens
ggccgaguguguguccu

SEQ ID NO: 12094 - RNA, 18 nt, Homo sapiens
ccuggcaguggauugugg

SEQ ID NO: 12095 - RNA, 23 nt, Homo sapiens
gaaaaccuccaucuuggcuccca

SEQ ID NO: 12096 - RNA, 21 nt, Homo sapiens
gugaaccugccugugaacucu

SEQ ID NO: 12097 - RNA, 16 nt, Homo sapiens
augaugcagccucuga

SEQ ID NO: 12098 - RNA, 18 nt, Homo sapiens
auuacagaaacagucugu

SEQ ID NO: 12099 - RNA, 17 nt, Homo sapiens
gcaagccgagagccagc

SEQ ID NO: 12100 - RNA, 23 nt, Homo sapiens
ggccagccccgcgccacaaaggg

SEQ ID NO: 12101 - RNA, 16 nt, Homo sapiens
ggccgccgcccccucu

SEQ ID NO: 12102 - RNA, 23 nt, Homo sapiens
ggccgggcgggcgcacaccaucc

SEQ ID NO: 12103 - RNA, 18 nt, Homo sapiens
ggcgacggcggcggcggc

SEQ ID NO: 12104 - RNA, 25 nt, Homo sapiens
aaguuguuaccaaauacacauuuca

SEQ ID NO: 12105 - RNA, 21 nt, Homo sapiens
agagagaaaaagauuguauua

SEQ ID NO: 12106 - RNA, 20 nt, Homo sapiens
gaaaaagauaagaaauacua

SEQ ID NO: 12107 - RNA, 17 nt, Homo sapiens
gaaacacuugcuugcca

SEQ ID NO: 12108 - RNA, 21 nt, Homo sapiens
uuucauuguuccacuggacgc

SEQ ID NO: 12109 - RNA, 24 nt, Homo sapiens
acagugcuggggugaguaccccca

SEQ ID NO: 12110 - RNA, 18 nt, Homo sapiens
aaguuuacauuuuguuuc

SEQ ID NO: 12111 - RNA, 18 nt, Homo sapiens
cacuuuuccuccauuuga

SEQ ID NO: 12112 - RNA, 21 nt, Homo sapiens
ccgaaauuauuacccuucuca

SEQ ID NO: 12113 - RNA, 18 nt, Homo sapiens
ggaucccacagcuuacug

SEQ ID NO: 12114 - RNA, 25 nt, Homo sapiens
uugaaauguuauuuaaauauauuca

SEQ ID NO: 12115 - RNA, 23 nt, Homo sapiens
aauacuguacauaaaaugucauu

SEQ ID NO: 12116 - RNA, 19 nt, Homo sapiens
uacugcagugaccugcccu

SEQ ID NO: 12117 - RNA, 17 nt, Homo sapiens
ucaagugauucucguac

SEQ ID NO: 12118 - RNA, 17 nt, Homo sapiens
uccgccuccagguucaa

SEQ ID NO: 12119 - RNA, 18 nt, Homo sapiens
uggaccucagaucuugua

SEQ ID NO: 12120 - RNA, 22 nt, Homo sapiens
agauaauagaccagcaauugca

SEQ ID NO: 12121 - RNA, 23 nt, Homo sapiens
gugacagagccaugagccagcca

SEQ ID NO: 12122 - RNA, 20 nt, Homo sapiens
uaaggaggacuggguuuguu

SEQ ID NO: 12123 - RNA, 20 nt, Homo sapiens
acuucugcuuccucaucuca

SEQ ID NO: 12124 - RNA, 19 nt, Homo sapiens
cacucugaaaaugugcagc

SEQ ID NO: 12125 - RNA, 18 nt, Homo sapiens
cuuccucaacucccucca

SEQ ID NO: 12126 - RNA, 19 nt, Homo sapiens
ugugugugaguguggcugg

SEQ ID NO: 12127 - RNA, 18 nt, Homo sapiens
gaaggcggcggccgcggc

SEQ ID NO: 12128 - RNA, 22 nt, Homo sapiens
augccucaguuucucccaccgc

SEQ ID NO: 12129 - RNA, 21 nt, Homo sapiens
uccucuccuccccuugcccuc

SEQ ID NO: 12130 - RNA, 19 nt, Homo sapiens
ucucccuccccucuccucu

SEQ ID NO: 12131 - RNA, 19 nt, Homo sapiens
cuccccuuuuuucuucuca

SEQ ID NO: 12132 - RNA, 19 nt, Homo sapiens
gcucuggcaaagcuuuuag

SEQ ID NO: 12133 - RNA, 23 nt, Homo sapiens
uuucuuuaaguugguuuagccuu

SEQ ID NO: 12134 - RNA, 21 nt, Homo sapiens
gguccucgacgccugccgaca

SEQ ID NO: 12135 - RNA, 19 nt, Homo sapiens
ccugacuccuccuugcaaa

SEQ ID NO: 12136 - RNA, 18 nt, Homo sapiens
uaagauuauguaaccuag

SEQ ID NO: 12137 - RNA, 18 nt, Homo sapiens
uuaggaugacuguuacag

SEQ ID NO: 12138 - RNA, 18 nt, Homo sapiens
ccgccagcugacaggaca

SEQ ID NO: 12139 - RNA, 20 nt, Homo sapiens
cugauaauuguauguauugu

SEQ ID NO: 12140 - RNA, 20 nt, Homo sapiens
acucccagggacucugggga

SEQ ID NO: 12141 - RNA, 17 nt, Homo sapiens
cagauucuggcauccca

SEQ ID NO: 12142 - RNA, 18 nt, Homo sapiens
gcccgcaucccacccucc

SEQ ID NO: 12143 - RNA, 24 nt, Homo sapiens
uccccaccgugaccugccuggccu

SEQ ID NO: 12144 - RNA, 21 nt, Homo sapiens
uuuuggcggcuguaguugugg

SEQ ID NO: 12145 - RNA, 19 nt, Homo sapiens
acacacaugagauucuuca

SEQ ID NO: 12146 - RNA, 21 nt, Homo sapiens
ccccacccacagugcugcacu

SEQ ID NO: 12147 - RNA, 19 nt, Homo sapiens
cccccugcccaccucucca

SEQ ID NO: 12148 - RNA, 25 nt, Homo sapiens
cgcccacccccugcccaccucucca

SEQ ID NO: 12149 - RNA, 17 nt, Homo sapiens
cugugagcccuaccuua

SEQ ID NO: 12150 - RNA, 17 nt, Homo sapiens
cuuaccccucugccccu

SEQ ID NO: 12151 - RNA, 23 nt, Homo sapiens
gcucaccucugguagccauagca

SEQ ID NO: 12152 - RNA, 21 nt, Homo sapiens
ucugggcugcuaaccuggccu

SEQ ID NO: 12153 - RNA, 20 nt, Homo sapiens
ugaggguggcgggccugcgg

SEQ ID NO: 12154 - RNA, 18 nt, Homo sapiens
acccugggccacugccug

SEQ ID NO: 12155 - RNA, 18 nt, Homo sapiens
agagacagaagccaacga

SEQ ID NO: 12156 - RNA, 23 nt, Homo sapiens
agcuucccucagcucuuaccuca

SEQ ID NO: 12157 - RNA, 19 nt, Homo sapiens
caaagccaccucauuucca

SEQ ID NO: 12158 - RNA, 21 nt, Homo sapiens
ccauccauggcccccagacug

SEQ ID NO: 12159 - RNA, 21 nt, Homo sapiens
ucauuuccaaacaucucacuc

SEQ ID NO: 12160 - RNA, 18 nt, Homo sapiens
uucccucagcucuuaccu

SEQ ID NO: 12161 - RNA, 21 nt, Homo sapiens
caccucuaacccccuccccuc

SEQ ID NO: 12162 - RNA, 21 nt, Homo sapiens
uagacuugaggggcuacccug

SEQ ID NO: 12163 - RNA, 22 nt, Homo sapiens
cacugggugauucacgugugcc

SEQ ID NO: 12164 - RNA, 19 nt, Homo sapiens
cugcaaccuccgccuccca

SEQ ID NO: 12165 - RNA, 18 nt, Homo sapiens
uccgccucccagguucaa

SEQ ID NO: 12166 - RNA, 22 nt, Homo sapiens
uuggaaaauacaucuguuccag

SEQ ID NO: 12167 - RNA, 18 nt, Homo sapiens
aguaucgucugcauucca

SEQ ID NO: 12168 - RNA, 20 nt, Homo sapiens
auauuuacaaagcuaaaaua

SEQ ID NO: 12169 - RNA, 20 nt, Homo sapiens
gauauuguaacaauacugcc

SEQ ID NO: 12170 - RNA, 17 nt, Homo sapiens
gugugugugcacauuug

SEQ ID NO: 12171 - RNA, 15 nt, Homo sapiens
guucugaaugcacuu

SEQ ID NO: 12172 - RNA, 23 nt, Homo sapiens
uaaaugacacuauuaugaagcua

SEQ ID NO: 12173 - RNA, 23 nt, Homo sapiens
uuccagauuucacaccuacaaua

SEQ ID NO: 12174 - RNA, 24 nt, Homo sapiens
gcgucucggcugccgcuagaguuu

SEQ ID NO: 12175 - RNA, 21 nt, Homo sapiens
cccggacggagggccggcgag

SEQ ID NO: 12176 - RNA, 19 nt, Homo sapiens
ccggacggagggccggcga

SEQ ID NO: 12177 - RNA, 24 nt, Homo sapiens
cuuuguuccgggagaguuugugag

SEQ ID NO: 12178 - RNA, 22 nt, Homo sapiens
acauuuaagauucuccugugga

SEQ ID NO: 12179 - RNA, 18 nt, Homo sapiens
cagcuagcacccuucaua

SEQ ID NO: 12180 - RNA, 18 nt, Homo sapiens
ccccgccaccuguacuca

SEQ ID NO: 12181 - RNA, 21 nt, Homo sapiens
ccucuccuccccuugcgcucg

SEQ ID NO: 12182 - RNA, 18 nt, Homo sapiens
cuagaaucuucuuuguuc

SEQ ID NO: 12183 - RNA, 19 nt, Homo sapiens
cucuuucucucucucucuc

SEQ ID NO: 12184 - RNA, 18 nt, Homo sapiens
gacaugaagacacaaucu

SEQ ID NO: 12185 - RNA, 19 nt, Homo sapiens
gcagggcaggggggccuuu

SEQ ID NO: 12186 - RNA, 22 nt, Homo sapiens
gcaguuuuuauugucuguguca

SEQ ID NO: 12187 - RNA, 21 nt, Homo sapiens
gccugagggagccccuggcuu

SEQ ID NO: 12188 - RNA, 21 nt, Homo sapiens
caugagccaccgcgccuggca

SEQ ID NO: 12189 - RNA, 15 nt, Homo sapiens
cuguccccugccucu

SEQ ID NO: 12190 - RNA, 19 nt, Homo sapiens
cuuuucccaauucccuucc

SEQ ID NO: 12191 - RNA, 22 nt, Homo sapiens
guaguuuucuugguuugcguua

SEQ ID NO: 12192 - RNA, 20 nt, Homo sapiens
ugggaagcagcaagccacca

SEQ ID NO: 12193 - RNA, 22 nt, Homo sapiens
agauuugaaaauuguauaccaa

SEQ ID NO: 12194 - RNA, 18 nt, Homo sapiens
acuggcggucaagugugg

SEQ ID NO: 12195 - RNA, 18 nt, Homo sapiens
uggaugagcauggagcug

SEQ ID NO: 12196 - RNA, 20 nt, Homo sapiens
uggugcaggucuccaccugc

SEQ ID NO: 12197 - RNA, 23 nt, Homo sapiens
acauccugugccuccaucagcua

SEQ ID NO: 12198 - RNA, 18 nt, Homo sapiens
ccaagcagagaagcucuc

SEQ ID NO: 12199 - RNA, 22 nt, Homo sapiens
gaaccaggcuuggaaccguagg

SEQ ID NO: 12200 - RNA, 18 nt, Homo sapiens
uuggaggugaacaagcaa

SEQ ID NO: 12201 - RNA, 21 nt, Homo sapiens
aaauaccacugaagaggacac

SEQ ID NO: 12202 - RNA, 22 nt, Homo sapiens
caaagaauuguaauccucccca

SEQ ID NO: 12203 - RNA, 25 nt, Homo sapiens
cccacgaccuuggcccgagccccuc

SEQ ID NO: 12204 - RNA, 24 nt, Homo sapiens
ucuuuagcuacuccuuuuccuaca

SEQ ID NO: 12205 - RNA, 19 nt, Homo sapiens
aaacuucugaccucaggug

SEQ ID NO: 12206 - RNA, 21 nt, Homo sapiens
agacagagauucaguuuguca

SEQ ID NO: 12207 - RNA, 27 nt, Homo sapiens
agagccaagauuuuaaccuagaucucc

SEQ ID NO: 12208 - RNA, 20 nt, Homo sapiens
agugaagugagaugaugcau

SEQ ID NO: 12209 - RNA, 18 nt, Homo sapiens
cauuauugcuuugaccuu

SEQ ID NO: 12210 - RNA, 17 nt, Homo sapiens
ccagaaagcuaucaaug

SEQ ID NO: 12211 - RNA, 17 nt, Homo sapiens
gcuaagguccaagaaac

SEQ ID NO: 12212 - RNA, 21 nt, Homo sapiens
gguguuaaaagaaucauggua

SEQ ID NO: 12213 - RNA, 17 nt, Homo sapiens
gucuuaucugccuuuuu

SEQ ID NO: 12214 - RNA, 20 nt, Homo sapiens
uaccacugauuuaccauugc

SEQ ID NO: 12215 - RNA, 18 nt, Homo sapiens
uccgcuucccagguucaa

SEQ ID NO: 12216 - RNA, 21 nt, Homo sapiens
uugaccaaaacauacauuuga

SEQ ID NO: 12217 - RNA, 18 nt, Homo sapiens
uugcaaaaugacugcuuu

SEQ ID NO: 12218 - RNA, 21 nt, Homo sapiens
aucugaguuauuuuuuggucu

SEQ ID NO: 12219 - RNA, 24 nt, Homo sapiens
ccugggcggaucugaguuauuuuu

SEQ ID NO: 12220 - RNA, 20 nt, Homo sapiens
gccgcggaguccggccccca

SEQ ID NO: 12221 - RNA, 17 nt, Homo sapiens
gggauggccggccagug

SEQ ID NO: 12222 - RNA, 21 nt, Homo sapiens
aaauaccugcaaagugcucua

SEQ ID NO: 12223 - RNA, 17 nt, Homo sapiens
cccccgcgacuaucucc

SEQ ID NO: 12224 - RNA, 20 nt, Homo sapiens
agggcaagcuggaguuaaua

SEQ ID NO: 12225 - RNA, 17 nt, Homo sapiens
cacaacuuguuuuccca

SEQ ID NO: 12226 - RNA, 19 nt, Homo sapiens
cuggacgaucgccuggcuu

SEQ ID NO: 12227 - RNA, 19 nt, Homo sapiens
gucagccugcuucugcccc

SEQ ID NO: 12228 - RNA, 19 nt, Homo sapiens
ucucauuaucuccaugaua

SEQ ID NO: 12229 - RNA, 17 nt, Homo sapiens
aacuuggaagaagcuuc

SEQ ID NO: 12230 - RNA, 25 nt, Homo sapiens
uaccacacaauauuucaugauucaa

SEQ ID NO: 12231 - RNA, 16 nt, Homo sapiens
aucuccaaggugaggu

SEQ ID NO: 12232 - RNA, 18 nt, Homo sapiens
aucuugaccucuuggcuc

SEQ ID NO: 12233 - RNA, 18 nt, Homo sapiens
caucaccauuuuuccuga

SEQ ID NO: 12234 - RNA, 19 nt, Homo sapiens
acaaggugggcugcccuca

SEQ ID NO: 12235 - RNA, 19 nt, Homo sapiens
augccuaagggagacauuu

SEQ ID NO: 12236 - RNA, 20 nt, Homo sapiens
gccaguguggugcuuggucc

SEQ ID NO: 12237 - RNA, 20 nt, Homo sapiens
uccaaaccggaagaccgugg

SEQ ID NO: 12238 - RNA, 17 nt, Homo sapiens
gcccccucccucccuca

SEQ ID NO: 12239 - RNA, 18 nt, Homo sapiens
uccaccucccggguucaa

SEQ ID NO: 12240 - RNA, 18 nt, Homo sapiens
uucaagugauucucaugc

SEQ ID NO: 12241 - RNA, 26 nt, Homo sapiens
cccaacucgaugggcacagccagcca

SEQ ID NO: 12242 - RNA, 20 nt, Homo sapiens
cccuccccuucacucccucc

SEQ ID NO: 12243 - RNA, 15 nt, Homo sapiens
ccugugcccucugga

SEQ ID NO: 12244 - RNA, 24 nt, Homo sapiens
gugccucggccuccaaggggcuuu

SEQ ID NO: 12245 - RNA, 18 nt, Homo sapiens
ucuguguguccuugugug

SEQ ID NO: 12246 - RNA, 19 nt, Homo sapiens
uucugucucucucuguccu

SEQ ID NO: 12247 - RNA, 21 nt, Homo sapiens
uggugucugugugugaagcug

SEQ ID NO: 12248 - RNA, 21 nt, Homo sapiens
cggugccagguuuucugggug

SEQ ID NO: 12249 - RNA, 18 nt, Homo sapiens
guguagcuauaucuauau

SEQ ID NO: 12250 - RNA, 22 nt, Homo sapiens
cagaaaccaccaagacuguuga

SEQ ID NO: 12251 - RNA, 25 nt, Homo sapiens
ccuucacucuaauggacuguuccag

SEQ ID NO: 12252 - RNA, 22 nt, Homo sapiens
cgccccugucuggauccccucc

SEQ ID NO: 12253 - RNA, 20 nt, Homo sapiens
aaaauggggcaggccacacc

SEQ ID NO: 12254 - RNA, 19 nt, Homo sapiens
ccccacugcccccugcagc

SEQ ID NO: 12255 - RNA, 25 nt, Homo sapiens
gaaugaagucaccucgccccccucu

SEQ ID NO: 12256 - RNA, 19 nt, Homo sapiens
gccccuuggcaccauccug

SEQ ID NO: 12257 - RNA, 22 nt, Homo sapiens
ggacuuggcauuuaggauucca

SEQ ID NO: 12258 - RNA, 24 nt, Homo sapiens
aagagagguguggcguggcccugg

SEQ ID NO: 12259 - RNA, 18 nt, Homo sapiens
ugaacagaggccaugccg

SEQ ID NO: 12260 - RNA, 24 nt, Homo sapiens
gcgccgcugccucuggcgggcuuu

SEQ ID NO: 12261 - RNA, 21 nt, Homo sapiens
gggcaaggugaagagcgcacc

SEQ ID NO: 12262 - RNA, 18 nt, Homo sapiens
gguuggugggaguugcga

SEQ ID NO: 12263 - RNA, 19 nt, Homo sapiens
acggccccacccuuaucuc

SEQ ID NO: 12264 - RNA, 22 nt, Homo sapiens
agacccccacuccugcccgcca

SEQ ID NO: 12265 - RNA, 19 nt, Homo sapiens
caauaucaccccuuaccac

SEQ ID NO: 12266 - RNA, 22 nt, Homo sapiens
cccuucaccccgaggacugggc

SEQ ID NO: 12267 - RNA, 26 nt, Homo sapiens
ggggucacggcgacggcggcggcggc

SEQ ID NO: 12268 - RNA, 21 nt, Homo sapiens
gccaguucccacagcacccca

SEQ ID NO: 12269 - RNA, 17 nt, Homo sapiens
aaauaccuuuuaagcua

SEQ ID NO: 12270 - RNA, 18 nt, Homo sapiens
caccucccacugccccuc

SEQ ID NO: 12271 - RNA, 23 nt, Homo sapiens
ggaaccugccgagugagcacuga

SEQ ID NO: 12272 - RNA, 22 nt, Homo sapiens
cuaauacugagagauuugguca

SEQ ID NO: 12273 - RNA, 25 nt, Homo sapiens
gagacuagccucaugagacuuggca

SEQ ID NO: 12274 - RNA, 20 nt, Homo sapiens
cuuaauaaaacaagcaggua

SEQ ID NO: 12275 - RNA, 18 nt, Homo sapiens
ccugcuuucucgcggcca

SEQ ID NO: 12276 - RNA, 18 nt, Homo sapiens
cggcuucccugcuuucuc

SEQ ID NO: 12277 - RNA, 18 nt, Homo sapiens
auguagacuagcaaaaua

SEQ ID NO: 12278 - RNA, 20 nt, Homo sapiens
aauuuucaauguuuuuuugg

SEQ ID NO: 12279 - RNA, 20 nt, Homo sapiens
acaugcuuuuaaaugucuca

SEQ ID NO: 12280 - RNA, 23 nt, Homo sapiens
agugauaaugggucaguuucuca

SEQ ID NO: 12281 - RNA, 24 nt, Homo sapiens
uacaugugaaaacacaagucuuug

SEQ ID NO: 12282 - RNA, 16 nt, Homo sapiens
agcaguugaaccuggg

SEQ ID NO: 12283 - RNA, 15 nt, Homo sapiens
ugcaacacuaacuuc

SEQ ID NO: 12284 - RNA, 20 nt, Homo sapiens
ugggaacaaaccucacuuga

SEQ ID NO: 12285 - RNA, 22 nt, Homo sapiens
uugaaccugggaacaaaccuca

SEQ ID NO: 12286 - RNA, 18 nt, Homo sapiens
cccaaacugaggagcccg

SEQ ID NO: 12287 - RNA, 20 nt, Homo sapiens
ccccgcccaggccccccagc

SEQ ID NO: 12288 - RNA, 17 nt, Homo sapiens
cugugccuuuacgauca

SEQ ID NO: 12289 - RNA, 23 nt, Homo sapiens
gagguuuucucccugcccgggaa

SEQ ID NO: 12290 - RNA, 16 nt, Homo sapiens
gguaaguccauuuucc

SEQ ID NO: 12291 - RNA, 21 nt, Homo sapiens
ugccaggaaucugccuaccug

SEQ ID NO: 12292 - RNA, 18 nt, Homo sapiens
agauaauuacugccuuga

SEQ ID NO: 12293 - RNA, 21 nt, Homo sapiens
caguacccaccaccuucuucu

SEQ ID NO: 12294 - RNA, 18 nt, Homo sapiens
cauaucccuuccagaugg

SEQ ID NO: 12295 - RNA, 22 nt, Homo sapiens
ggcuccaucccccgcccccucu

SEQ ID NO: 12296 - RNA, 18 nt, Homo sapiens
uaagaaacuuauuucuca

SEQ ID NO: 12297 - RNA, 23 nt, Homo sapiens
uaucccaagaaugcaagauuuca

SEQ ID NO: 12298 - RNA, 18 nt, Homo sapiens
gaagagaaaagcauuuca

SEQ ID NO: 12299 - RNA, 19 nt, Homo sapiens
gcguagaaacgccugccaa

SEQ ID NO: 12300 - RNA, 21 nt, Homo sapiens
aaacuaaagccaauagcacca

SEQ ID NO: 12301 - RNA, 22 nt, Homo sapiens
auuuaggaauucucuuugauga

SEQ ID NO: 12302 - RNA, 20 nt, Homo sapiens
ccugaggaacuuuacacuga

SEQ ID NO: 12303 - RNA, 20 nt, Homo sapiens
ugccugggcaccuauucaca

SEQ ID NO: 12304 - RNA, 19 nt, Homo sapiens
aagaaggagaugauucuuu

SEQ ID NO: 12305 - RNA, 18 nt, Homo sapiens
agugcucucaccacgagg

SEQ ID NO: 12306 - RNA, 22 nt, Homo sapiens
ccaggcucucaaccgucucccu

SEQ ID NO: 12307 - RNA, 21 nt, Homo sapiens
aaauaaaacauggccuuaaca

SEQ ID NO: 12308 - RNA, 19 nt, Homo sapiens
uuuaggugaucucaaauua

SEQ ID NO: 12309 - RNA, 20 nt, Homo sapiens
ugcaucauuuuucauuugcc

SEQ ID NO: 12310 - RNA, 17 nt, Homo sapiens
ccagaaaacaagcccug

SEQ ID NO: 12311 - RNA, 20 nt, Homo sapiens
ccugccagccuccuaccuca

SEQ ID NO: 12312 - RNA, 18 nt, Homo sapiens
ugccagccuccuaccuca

SEQ ID NO: 12313 - RNA, 17 nt, Homo sapiens
ccguggagcuugccguc

SEQ ID NO: 12314 - RNA, 20 nt, Homo sapiens
aaauacagaaaccucaguga

SEQ ID NO: 12315 - RNA, 18 nt, Homo sapiens
augcuugacagugugaaa

SEQ ID NO: 12316 - RNA, 20 nt, Homo sapiens
cauacagugccuuugagcaa

SEQ ID NO: 12317 - RNA, 18 nt, Homo sapiens
aagugugguguuugguuu

SEQ ID NO: 12318 - RNA, 18 nt, Homo sapiens
gccucggccacuugguuc

SEQ ID NO: 12319 - RNA, 17 nt, Homo sapiens
ucuggacagaccacaac

SEQ ID NO: 12320 - RNA, 20 nt, Homo sapiens
uuacugucaugucauuuacc

SEQ ID NO: 12321 - RNA, 21 nt, Homo sapiens
uugaugagugauugccugucc

SEQ ID NO: 12322 - RNA, 20 nt, Homo sapiens
cagcaaucaaauuauggaca

SEQ ID NO: 12323 - RNA, 19 nt, Homo sapiens
gcauuugugaauuuaauag

SEQ ID NO: 12324 - RNA, 22 nt, Homo sapiens
uccaaaauaaccuaacugcagc

SEQ ID NO: 12325 - RNA, 22 nt, Homo sapiens
uccuacguuagaaaccauucuu

SEQ ID NO: 12326 - RNA, 21 nt, Homo sapiens
ucuuuuaucuguuguagcuuu

SEQ ID NO: 12327 - RNA, 19 nt, Homo sapiens
gugaaaaucauauuugggc

SEQ ID NO: 12328 - RNA, 21 nt, Homo sapiens
ucuguuuaaugaauuuggaaa

SEQ ID NO: 12329 - RNA, 21 nt, Homo sapiens
acgaggguuaccccuuugcuu

SEQ ID NO: 12330 - RNA, 20 nt, Homo sapiens
ucaccgcaaccuccaccucc

SEQ ID NO: 12331 - RNA, 18 nt, Homo sapiens
uccaccuccuggguucaa

SEQ ID NO: 12332 - RNA, 23 nt, Homo sapiens
uccagcugugccucugcugccag

SEQ ID NO: 12333 - RNA, 18 nt, Homo sapiens
ucuccccaucuagccagg

SEQ ID NO: 12334 - RNA, 22 nt, Homo sapiens
agagcaagcucuuaaguucaca

SEQ ID NO: 12335 - RNA, 23 nt, Homo sapiens
caaagagcucaccagcauuuucc

SEQ ID NO: 12336 - RNA, 23 nt, Homo sapiens
ccaccuggugucagccucaguca

SEQ ID NO: 12337 - RNA, 17 nt, Homo sapiens
cugccaccuggugucag

SEQ ID NO: 12338 - RNA, 19 nt, Homo sapiens
gcacaucccaccagugaaa

SEQ ID NO: 12339 - RNA, 17 nt, Homo sapiens
ugcuuccucauuugcuu

SEQ ID NO: 12340 - RNA, 19 nt, Homo sapiens
uucuucuuuucuugaucuu

SEQ ID NO: 12341 - RNA, 20 nt, Homo sapiens
acuuugaauuccuggauuca

SEQ ID NO: 12342 - RNA, 23 nt, Homo sapiens
gcccgcgguuccaccgcucugaa

SEQ ID NO: 12343 - RNA, 19 nt, Homo sapiens
aaggacucaccuccuugag

SEQ ID NO: 12344 - RNA, 19 nt, Homo sapiens
cagacaaagcagaagcugc

SEQ ID NO: 12345 - RNA, 21 nt, Homo sapiens
uaucuccaugagaaaauucau

SEQ ID NO: 12346 - RNA, 21 nt, Homo sapiens
acuucagaagcaaugggggca

SEQ ID NO: 12347 - RNA, 17 nt, Homo sapiens
cacccaugucaacaucu

SEQ ID NO: 12348 - RNA, 18 nt, Homo sapiens
cacugaacaaaggcuuca

SEQ ID NO: 12349 - RNA, 24 nt, Homo sapiens
accagaccccaagucccccacccc

SEQ ID NO: 12350 - RNA, 20 nt, Homo sapiens
ggacccccgcccacauccuc

SEQ ID NO: 12351 - RNA, 23 nt, Homo sapiens
gguuccucuaaccagaaccagcu

SEQ ID NO: 12352 - RNA, 18 nt, Homo sapiens
acacacagaagaauuggu

SEQ ID NO: 12353 - RNA, 18 nt, Homo sapiens
caucugucaugucgauga

SEQ ID NO: 12354 - RNA, 18 nt, Homo sapiens
ucuauccagcaagauccu

SEQ ID NO: 12355 - RNA, 20 nt, Homo sapiens
ugcugaauuacuugugaaga

SEQ ID NO: 12356 - RNA, 16 nt, Homo sapiens
caaggguuuggguuuu

SEQ ID NO: 12357 - RNA, 18 nt, Homo sapiens
uuuaguuccucaacauau

SEQ ID NO: 12358 - RNA, 24 nt, Homo sapiens
acuugaaugggacuuggcuggccu

SEQ ID NO: 12359 - RNA, 25 nt, Homo sapiens
cccugguccugggcggggccugugg

SEQ ID NO: 12360 - RNA, 17 nt, Homo sapiens
gcgcagggaggggccgg

SEQ ID NO: 12361 - RNA, 23 nt, Homo sapiens
ggaggaggagguggugacuggca

SEQ ID NO: 12362 - RNA, 18 nt, Homo sapiens
gaaaacuauuccaggacu

SEQ ID NO: 12363 - RNA, 19 nt, Homo sapiens
ugucuauacauuggucacc

SEQ ID NO: 12364 - RNA, 19 nt, Homo sapiens
cuacugccccccccccucu

SEQ ID NO: 12365 - RNA, 18 nt, Homo sapiens
cuccuccaaaaccaggga

SEQ ID NO: 12366 - RNA, 21 nt, Homo sapiens
uagggucccugguuccaguua

SEQ ID NO: 12367 - RNA, 28 nt, Homo sapiens
uaggugugauuauuuuaauaugaaggug

SEQ ID NO: 12368 - RNA, 18 nt, Homo sapiens
ucuggaaaaauuuccucc

SEQ ID NO: 12369 - RNA, 19 nt, Homo sapiens
aaacugguccccuccacca

SEQ ID NO: 12370 - RNA, 16 nt, Homo sapiens
acacagacuccuacuc

SEQ ID NO: 12371 - RNA, 21 nt, Homo sapiens
gcaagggcggucgggucccga

SEQ ID NO: 12372 - RNA, 23 nt, Homo sapiens
ucacaugagguuacuguuucuuu

SEQ ID NO: 12373 - RNA, 19 nt, Homo sapiens
uccacagcgccuccggugu

SEQ ID NO: 12374 - RNA, 19 nt, Homo sapiens
gaaugcaccgagaggaaug

SEQ ID NO: 12375 - RNA, 21 nt, Homo sapiens
acaaaacaccuugucaaccuc

SEQ ID NO: 12376 - RNA, 18 nt, Homo sapiens
cagcacaccauugaugaa

SEQ ID NO: 12377 - RNA, 20 nt, Homo sapiens
uaaacaaauuagcaaucauu

SEQ ID NO: 12378 - RNA, 19 nt, Homo sapiens
aaaagguuacauagauaug

SEQ ID NO: 12379 - RNA, 22 nt, Homo sapiens
agcacagugcuccuccauauca

SEQ ID NO: 12380 - RNA, 19 nt, Homo sapiens
uguauggacaguuuuuccg

SEQ ID NO: 12381 - RNA, 24 nt, Homo sapiens
accugaucgagcgcugucuggcuu

SEQ ID NO: 12382 - RNA, 20 nt, Homo sapiens
gcugucuggcuuuaaccuga

SEQ ID NO: 12383 - RNA, 18 nt, Homo sapiens
aucuuaauuuggauuuaa

SEQ ID NO: 12384 - RNA, 21 nt, Homo sapiens
cuguaaaagaaaaaagaauca

SEQ ID NO: 12385 - RNA, 18 nt, Homo sapiens
aucagauccuguuugaua

SEQ ID NO: 12386 - RNA, 20 nt, Homo sapiens
aucugcaauuguguggcuca

SEQ ID NO: 12387 - RNA, 15 nt, Homo sapiens
cuuucauauuggcac

SEQ ID NO: 12388 - RNA, 17 nt, Homo sapiens
gccucugaggguucugg

SEQ ID NO: 12389 - RNA, 15 nt, Homo sapiens
ucccauugcagccuc

SEQ ID NO: 12390 - RNA, 18 nt, Homo sapiens
uggauacacauggagcug

SEQ ID NO: 12391 - RNA, 19 nt, Homo sapiens
aaaacccggucuuaacuga

SEQ ID NO: 12392 - RNA, 19 nt, Homo sapiens
cguaaugcaaaaacccggu

SEQ ID NO: 12393 - RNA, 22 nt, Homo sapiens
ugaaugaaccaaugugugauug

SEQ ID NO: 12394 - RNA, 21 nt, Homo sapiens
aacaaaccauagaggcauuga

SEQ ID NO: 12395 - RNA, 21 nt, Homo sapiens
aauuagggacaaaugauguua

SEQ ID NO: 12396 - RNA, 20 nt, Homo sapiens
agaaaaguuuuaccugguug

SEQ ID NO: 12397 - RNA, 19 nt, Homo sapiens
aguacuggauuccagcauu

SEQ ID NO: 12398 - RNA, 19 nt, Homo sapiens
cauagcuccacucugcugc

SEQ ID NO: 12399 - RNA, 17 nt, Homo sapiens
ccuuuuuggaguugcuc

SEQ ID NO: 12400 - RNA, 18 nt, Homo sapiens
cuagcuccacucugcugc

SEQ ID NO: 12401 - RNA, 17 nt, Homo sapiens
uagcuccacucugcugc

SEQ ID NO: 12402 - RNA, 18 nt, Homo sapiens
agugaacacacacaaggg

SEQ ID NO: 12403 - RNA, 23 nt, Homo sapiens
cuccagcucccacucccuuucca

SEQ ID NO: 12404 - RNA, 16 nt, Homo sapiens
gcuggcgcccauccua

SEQ ID NO: 12405 - RNA, 26 nt, Homo sapiens
gcuugggcccugcauuggccuggccu

SEQ ID NO: 12406 - RNA, 22 nt, Homo sapiens
ucccacucccuuuccaaccuca

SEQ ID NO: 12407 - RNA, 23 nt, Homo sapiens
uugcccacacacuuuccaucucu

SEQ ID NO: 12408 - RNA, 20 nt, Homo sapiens
auaauaagugcuuauuguuu

SEQ ID NO: 12409 - RNA, 22 nt, Homo sapiens
ccacauuuucaauccuccuuca

SEQ ID NO: 12410 - RNA, 22 nt, Homo sapiens
ccccauggcagaacucugcugg

SEQ ID NO: 12411 - RNA, 19 nt, Homo sapiens
cucucuuugaccauacuga

SEQ ID NO: 12412 - RNA, 17 nt, Homo sapiens
cucuuugaccauacuga

SEQ ID NO: 12413 - RNA, 21 nt, Homo sapiens
ggaaacagaauacuuugcaca

SEQ ID NO: 12414 - RNA, 19 nt, Homo sapiens
guaugcuuauccuugacug

SEQ ID NO: 12415 - RNA, 21 nt, Homo sapiens
ucuguguggacuuuaguccca

SEQ ID NO: 12416 - RNA, 18 nt, Homo sapiens
aaaaaaaucagggauaua

SEQ ID NO: 12417 - RNA, 23 nt, Homo sapiens
cugagccucacccuaucagucag

SEQ ID NO: 12418 - RNA, 20 nt, Homo sapiens
uaagugggccuccuggggau

SEQ ID NO: 12419 - RNA, 19 nt, Homo sapiens
acagugcaccgcuguccca

SEQ ID NO: 12420 - RNA, 21 nt, Homo sapiens
aucuuuggcagcucuuuucuu

SEQ ID NO: 12421 - RNA, 18 nt, Homo sapiens
ucguuucccauugcugua

SEQ ID NO: 12422 - RNA, 20 nt, Homo sapiens
aaaaauaccuaacuaugguu

SEQ ID NO: 12423 - RNA, 21 nt, Homo sapiens
agaagaggucccaauccccca

SEQ ID NO: 12424 - RNA, 19 nt, Homo sapiens
gcggccagcaggcaccugg

SEQ ID NO: 12425 - RNA, 20 nt, Homo sapiens
gcuggaagcccaggaagcac

SEQ ID NO: 12426 - RNA, 18 nt, Homo sapiens
uuccgcccuaauggaggu

SEQ ID NO: 12427 - RNA, 21 nt, Homo sapiens
aaacacacaagaacaauaaca

SEQ ID NO: 12428 - RNA, 22 nt, Homo sapiens
ccaauauauacaugguuagcca

SEQ ID NO: 12429 - RNA, 19 nt, Homo sapiens
gauuauugggaugaagcua

SEQ ID NO: 12430 - RNA, 19 nt, Homo sapiens
gguauacucacuauuguga

SEQ ID NO: 12431 - RNA, 18 nt, Homo sapiens
uaagaaauggaaagacuc

SEQ ID NO: 12432 - RNA, 19 nt, Homo sapiens
uuccagaaugcagguucua

SEQ ID NO: 12433 - RNA, 18 nt, Homo sapiens
aucuggugauaugcaauu

SEQ ID NO: 12434 - RNA, 21 nt, Homo sapiens
auuuucuauacugguguuaga

SEQ ID NO: 12435 - RNA, 17 nt, Homo sapiens
uccauuccccaaguuca

SEQ ID NO: 12436 - RNA, 20 nt, Homo sapiens
uucucuggagaacuuccuca

SEQ ID NO: 12437 - RNA, 17 nt, Homo sapiens
uuguuccgucuguaaca

SEQ ID NO: 12438 - RNA, 17 nt, Homo sapiens
cagaauuaugacucuuc

SEQ ID NO: 12439 - RNA, 16 nt, Homo sapiens
gaauaugcuucccgca

SEQ ID NO: 12440 - RNA, 20 nt, Homo sapiens
ucuggggaagacuguuuggc

SEQ ID NO: 12441 - RNA, 22 nt, Homo sapiens
agcuguaucauccucucaccug

SEQ ID NO: 12442 - RNA, 19 nt, Homo sapiens
aguggaguuaugucacuga

SEQ ID NO: 12443 - RNA, 20 nt, Homo sapiens
ccucugccucccagguucaa

SEQ ID NO: 12444 - RNA, 18 nt, Homo sapiens
ggcuucugcugccauccu

SEQ ID NO: 12445 - RNA, 17 nt, Homo sapiens
ucaagcgauucucaugc

SEQ ID NO: 12446 - RNA, 16 nt, Homo sapiens
ucagaauaaugagaca

SEQ ID NO: 12447 - RNA, 19 nt, Homo sapiens
guuugacuuuucauaagca

SEQ ID NO: 12448 - RNA, 22 nt, Homo sapiens
agaaauaagaccacuguuuuga

SEQ ID NO: 12449 - RNA, 20 nt, Homo sapiens
agugaagcugaagauaaccu

SEQ ID NO: 12450 - RNA, 19 nt, Homo sapiens
ccccugcagccauugcagc

SEQ ID NO: 12451 - RNA, 24 nt, Homo sapiens
gaaaggauccuucaguuacauaca

SEQ ID NO: 12452 - RNA, 21 nt, Homo sapiens
ugccuguggagucucugcuga

SEQ ID NO: 12453 - RNA, 21 nt, Homo sapiens
aucacggaguucagauguguu

SEQ ID NO: 12454 - RNA, 18 nt, Homo sapiens
gaaaaaagaggaaauacu

SEQ ID NO: 12455 - RNA, 19 nt, Homo sapiens
gcuuuuuguccaugugccg

SEQ ID NO: 12456 - RNA, 19 nt, Homo sapiens
ugcuuguuagaacucagcu

SEQ ID NO: 12457 - RNA, 20 nt, Homo sapiens
aacagucaugccaacuguga

SEQ ID NO: 12458 - RNA, 20 nt, Homo sapiens
ccaaacagucaugccaacug

SEQ ID NO: 12459 - RNA, 21 nt, Homo sapiens
gccguagcggccgccugaccc

SEQ ID NO: 12460 - RNA, 20 nt, Homo sapiens
ucgguguguuguuuuuuuaa

SEQ ID NO: 12461 - RNA, 24 nt, Homo sapiens
uuugaagucaaucuuuucaucaga

SEQ ID NO: 12462 - RNA, 17 nt, Homo sapiens
gaugaaucucugugaca

SEQ ID NO: 12463 - RNA, 21 nt, Homo sapiens
ugugacugaagacauuucuga

SEQ ID NO: 12464 - RNA, 25 nt, Homo sapiens
cuuuuuuauuuuuuuccuuaauuuu

SEQ ID NO: 12465 - RNA, 25 nt, Homo sapiens
ggaaagaaaacuugaugugauugcc

SEQ ID NO: 12466 - RNA, 26 nt, Homo sapiens
uagguggaauaauccaacauaaauug

SEQ ID NO: 12467 - RNA, 21 nt, Homo sapiens
ccaccauucccugccagccca

SEQ ID NO: 12468 - RNA, 18 nt, Homo sapiens
ccugacgauauccuggaa

SEQ ID NO: 12469 - RNA, 23 nt, Homo sapiens
gcccaccccacccuggggcccug

SEQ ID NO: 12470 - RNA, 22 nt, Homo sapiens
gugccccuagguuggugggucu

SEQ ID NO: 12471 - RNA, 23 nt, Homo sapiens
uaaaccacagccucagaccagcu

SEQ ID NO: 12472 - RNA, 23 nt, Homo sapiens
ugacgauauccuggaaggacuga

SEQ ID NO: 12473 - RNA, 21 nt, Homo sapiens
ugcccagaaaagugccccuag

SEQ ID NO: 12474 - RNA, 24 nt, Homo sapiens
gguuguucuuuuuucuuuuuuuaa

SEQ ID NO: 12475 - RNA, 20 nt, Homo sapiens
uggaauguaugucuggagua

SEQ ID NO: 12476 - RNA, 19 nt, Homo sapiens
uuugccuugguuugcaaua

SEQ ID NO: 12477 - RNA, 18 nt, Homo sapiens
cucccugacucugcuucu

SEQ ID NO: 12478 - RNA, 24 nt, Homo sapiens
gcucuggggcagugaggaacuaga

SEQ ID NO: 12479 - RNA, 18 nt, Homo sapiens
uaaauaaaaacauaaacc

SEQ ID NO: 12480 - RNA, 19 nt, Homo sapiens
uuucuucaacaacuauuca

SEQ ID NO: 12481 - RNA, 19 nt, Homo sapiens
ucaccaucuuuucccacaa

SEQ ID NO: 12482 - RNA, 18 nt, Homo sapiens
ucucucuuauuuagucuu

SEQ ID NO: 12483 - RNA, 21 nt, Homo sapiens
uuuugaauguuaaaugucaaa

SEQ ID NO: 12484 - RNA, 21 nt, Homo sapiens
ccccuucaccugcagcuauga

SEQ ID NO: 12485 - RNA, 20 nt, Homo sapiens
ccugaaggaagaccugcgga

SEQ ID NO: 12486 - RNA, 17 nt, Homo sapiens
gaggccuuuccauagcu

SEQ ID NO: 12487 - RNA, 17 nt, Homo sapiens
uuccagaaagaccccca

SEQ ID NO: 12488 - RNA, 23 nt, Homo sapiens
gguuuuugggaagggugugcgug

SEQ ID NO: 12489 - RNA, 18 nt, Homo sapiens
agcaauucauuggaacac

SEQ ID NO: 12490 - RNA, 18 nt, Homo sapiens
ccugcuaaaagagaucuu

SEQ ID NO: 12491 - RNA, 20 nt, Homo sapiens
cccucaucggcccgcagcug

SEQ ID NO: 12492 - RNA, 18 nt, Homo sapiens
cacugccacacgcagcuc

SEQ ID NO: 12493 - RNA, 18 nt, Homo sapiens
cagaacaagcuguucuca

SEQ ID NO: 12494 - RNA, 18 nt, Homo sapiens
aaaacauuuggauuggua

SEQ ID NO: 12495 - RNA, 21 nt, Homo sapiens
aaggaaaccccagccccacca

SEQ ID NO: 12496 - RNA, 24 nt, Homo sapiens
caccccgaguccugagcucacuuu

SEQ ID NO: 12497 - RNA, 18 nt, Homo sapiens
ccaagcgcuccggcggag

SEQ ID NO: 12498 - RNA, 20 nt, Homo sapiens
ccgccucccacccccacccc

SEQ ID NO: 12499 - RNA, 19 nt, Homo sapiens
cuucucugaaugcauguca

SEQ ID NO: 12500 - RNA, 18 nt, Homo sapiens
cuugggucuggcuggcuc

SEQ ID NO: 12501 - RNA, 21 nt, Homo sapiens
gcauuaccucacccggcccca

SEQ ID NO: 12502 - RNA, 21 nt, Homo sapiens
gccaccgauggagggucgugg

SEQ ID NO: 12503 - RNA, 16 nt, Homo sapiens
ucagugcccaggaccg

SEQ ID NO: 12504 - RNA, 22 nt, Homo sapiens
ugugggagugcgggugggggug

SEQ ID NO: 12505 - RNA, 19 nt, Homo sapiens
caggccucccacuccuccc

SEQ ID NO: 12506 - RNA, 19 nt, Homo sapiens
cccagcccccucucccccu

SEQ ID NO: 12507 - RNA, 22 nt, Homo sapiens
uggagagaacacuaagagguga

SEQ ID NO: 12508 - RNA, 17 nt, Homo sapiens
ccuguuuaaagauuuca

SEQ ID NO: 12509 - RNA, 22 nt, Homo sapiens
gacuucaucuucaaaacugcca

SEQ ID NO: 12510 - RNA, 20 nt, Homo sapiens
gcaaaaacaccaccaaucac

SEQ ID NO: 12511 - RNA, 20 nt, Homo sapiens
ccccgccucucccuggcagc

SEQ ID NO: 12512 - RNA, 16 nt, Homo sapiens
cccgccaccgccacca

SEQ ID NO: 12513 - RNA, 18 nt, Homo sapiens
accggaagguccagguga

SEQ ID NO: 12514 - RNA, 19 nt, Homo sapiens
cugcaagcuccgccuccca

SEQ ID NO: 12515 - RNA, 19 nt, Homo sapiens
agcuuuuccaguuaaauug

SEQ ID NO: 12516 - RNA, 17 nt, Homo sapiens
auuauguuuaaucgcca

SEQ ID NO: 12517 - RNA, 19 nt, Homo sapiens
gcuuugacacagcacuguu

SEQ ID NO: 12518 - RNA, 27 nt, Homo sapiens
ggaaguccucaaggaaaagauaccaaa

SEQ ID NO: 12519 - RNA, 17 nt, Homo sapiens
ucgaguuauucaaugau

SEQ ID NO: 12520 - RNA, 19 nt, Homo sapiens
uaacacccagagcaugaua

SEQ ID NO: 12521 - RNA, 18 nt, Homo sapiens
agagagaaaacagcacuu

SEQ ID NO: 12522 - RNA, 18 nt, Homo sapiens
caccaccggcacccuccc

SEQ ID NO: 12523 - RNA, 26 nt, Homo sapiens
cuuugaguuacaggaaggucuccgaa

SEQ ID NO: 12524 - RNA, 17 nt, Homo sapiens
gacuuuaacauaagcua

SEQ ID NO: 12525 - RNA, 27 nt, Homo sapiens
gugugugugagugugagugugcggcug

SEQ ID NO: 12526 - RNA, 19 nt, Homo sapiens
aaacuccugaccucaggug

SEQ ID NO: 12527 - RNA, 21 nt, Homo sapiens
aucuuggcuuacugcaaccuc

SEQ ID NO: 12528 - RNA, 22 nt, Homo sapiens
cacugacucagcucugaccuuc

SEQ ID NO: 12529 - RNA, 21 nt, Homo sapiens
ucaacaacuucugcugcauua

SEQ ID NO: 12530 - RNA, 17 nt, Homo sapiens
ucaagugauucuccugc

SEQ ID NO: 12531 - RNA, 18 nt, Homo sapiens
uccaccuccuggguucaa

SEQ ID NO: 12532 - RNA, 23 nt, Homo sapiens
agaggagcggccggagcgagaca

SEQ ID NO: 12533 - RNA, 19 nt, Homo sapiens
aggcaguaggcauucuuua

SEQ ID NO: 12534 - RNA, 22 nt, Homo sapiens
gaggagcggccggagcgagaca

SEQ ID NO: 12535 - RNA, 17 nt, Homo sapiens
gccuuucacagcuucuu

SEQ ID NO: 12536 - RNA, 16 nt, Homo sapiens
ugcguguugaauccca

SEQ ID NO: 12537 - RNA, 20 nt, Homo sapiens
acugccuauaccccucauca

SEQ ID NO: 12538 - RNA, 17 nt, Homo sapiens
caccacagccaccuucu

SEQ ID NO: 12539 - RNA, 21 nt, Homo sapiens
cacugccuauaccccucauca

SEQ ID NO: 12540 - RNA, 23 nt, Homo sapiens
cccaccuucugccgccgccacca

SEQ ID NO: 12541 - RNA, 19 nt, Homo sapiens
cugagcggccgccuguccu

SEQ ID NO: 12542 - RNA, 20 nt, Homo sapiens
gagcccccuguccuucccac

SEQ ID NO: 12543 - RNA, 26 nt, Homo sapiens
cagcacuagccaaaccucaccaacuc

SEQ ID NO: 12544 - RNA, 23 nt, Homo sapiens
agaucauuccacucagccuggga

SEQ ID NO: 12545 - RNA, 18 nt, Homo sapiens
aaaauuaaagagacucuc

SEQ ID NO: 12546 - RNA, 17 nt, Homo sapiens
aaacacacugaaauuuc

SEQ ID NO: 12547 - RNA, 17 nt, Homo sapiens
ggaggcggcggcgcggc

SEQ ID NO: 12548 - RNA, 19 nt, Homo sapiens
cagaggaccagcuccauuc

SEQ ID NO: 12549 - RNA, 21 nt, Homo sapiens
cuaucaagaauaaaccaugaa

SEQ ID NO: 12550 - RNA, 21 nt, Homo sapiens
cuaucaagagcaaacuaugaa

SEQ ID NO: 12551 - RNA, 18 nt, Homo sapiens
cugauugacaacaguguu

SEQ ID NO: 12552 - RNA, 19 nt, Homo sapiens
ucaaguggauaaaaagugu

SEQ ID NO: 12553 - RNA, 23 nt, Homo sapiens
aaagcacugaacuaagaguccca

SEQ ID NO: 12554 - RNA, 20 nt, Homo sapiens
ccucugucaacccuccugcc

SEQ ID NO: 12555 - RNA, 25 nt, Homo sapiens
cucaagcagugcgaaaagcagauua

SEQ ID NO: 12556 - RNA, 22 nt, Homo sapiens
accacacagucaccccucccuc

SEQ ID NO: 12557 - RNA, 22 nt, Homo sapiens
caccaccacacagucaccccuc

SEQ ID NO: 12558 - RNA, 20 nt, Homo sapiens
ccagccccuaagccccgucc

SEQ ID NO: 12559 - RNA, 19 nt, Homo sapiens
ccccagcuccccccgcagc

SEQ ID NO: 12560 - RNA, 18 nt, Homo sapiens
cccgcagccggcuccgca

SEQ ID NO: 12561 - RNA, 20 nt, Homo sapiens
cuguagugaaugauguguca

SEQ ID NO: 12562 - RNA, 18 nt, Homo sapiens
uuaagugauuacacuuuu

SEQ ID NO: 12563 - RNA, 19 nt, Homo sapiens
aaacuccugaccucaggug

SEQ ID NO: 12564 - RNA, 20 nt, Homo sapiens
ccucugccucccagguucaa

SEQ ID NO: 12565 - RNA, 19 nt, Homo sapiens
cugcaaccucugccuccca

SEQ ID NO: 12566 - RNA, 18 nt, Homo sapiens
agggcagucacuguugac

SEQ ID NO: 12567 - RNA, 20 nt, Homo sapiens
aucggggcgccgcgccggga

SEQ ID NO: 12568 - RNA, 19 nt, Homo sapiens
cacagauuuuucuuuuuca

SEQ ID NO: 12569 - RNA, 17 nt, Homo sapiens
gaaggcaacccccgcuc

SEQ ID NO: 12570 - RNA, 18 nt, Homo sapiens
gcaaaagaucuuuccaaa

SEQ ID NO: 12571 - RNA, 16 nt, Homo sapiens
gucuagaaacauuucu

SEQ ID NO: 12572 - RNA, 20 nt, Homo sapiens
uccuuuaauuucaggucuca

SEQ ID NO: 12573 - RNA, 19 nt, Homo sapiens
ucuuuuucauugaaacuuu

SEQ ID NO: 12574 - RNA, 16 nt, Homo sapiens
uugccuagagcgcugc

SEQ ID NO: 12575 - RNA, 22 nt, Homo sapiens
ccagcccccaaagcagcccuuc

SEQ ID NO: 12576 - RNA, 17 nt, Homo sapiens
cccccucucaggagcca

SEQ ID NO: 12577 - RNA, 18 nt, Homo sapiens
ccccugccuuugggagca

SEQ ID NO: 12578 - RNA, 19 nt, Homo sapiens
gggcagggaggcuuuggca

SEQ ID NO: 12579 - RNA, 21 nt, Homo sapiens
ugggcaccaggcaugggacug

SEQ ID NO: 12580 - RNA, 24 nt, Homo sapiens
uuuugucaggugggagauuuggaa

SEQ ID NO: 12581 - RNA, 23 nt, Homo sapiens
ggcaugagguacaaugccugcca

SEQ ID NO: 12582 - RNA, 20 nt, Homo sapiens
ugagcaaauggaacaauuuu

SEQ ID NO: 12583 - RNA, 20 nt, Homo sapiens
acagcagcauuuuuauuuca

SEQ ID NO: 12584 - RNA, 25 nt, Homo sapiens
ccuuaccccuggcuguuuggacuuu

SEQ ID NO: 12585 - RNA, 24 nt, Homo sapiens
gucaaugcuauuuuuguuuuuaga

SEQ ID NO: 12586 - RNA, 19 nt, Homo sapiens
ugacaucuuuuuaaagcuu

SEQ ID NO: 12587 - RNA, 18 nt, Homo sapiens
ggauaauacuccaucaua

SEQ ID NO: 12588 - RNA, 17 nt, Homo sapiens
uuuuucuacaccuuuga

SEQ ID NO: 12589 - RNA, 20 nt, Homo sapiens
gcagccggggauggccgugu

SEQ ID NO: 12590 - RNA, 23 nt, Homo sapiens
ggaagaaacgccgcucccugcca

SEQ ID NO: 12591 - RNA, 16 nt, Homo sapiens
ggaucuggaaccucuc

SEQ ID NO: 12592 - RNA, 23 nt, Homo sapiens
gagaacuuccaacaagccucaaa

SEQ ID NO: 12593 - RNA, 23 nt, Homo sapiens
gcacaggcccgcccucugccucc

SEQ ID NO: 12594 - RNA, 18 nt, Homo sapiens
uuauuacaagaucuuucc

SEQ ID NO: 12595 - RNA, 21 nt, Homo sapiens
accugaaaguuuuuuugguuu

SEQ ID NO: 12596 - RNA, 22 nt, Homo sapiens
agcugucgcugcccugauucca

SEQ ID NO: 12597 - RNA, 17 nt, Homo sapiens
aucccagcuacguggga

SEQ ID NO: 12598 - RNA, 20 nt, Homo sapiens
caccugugcccccgcagcuc

SEQ ID NO: 12599 - RNA, 17 nt, Homo sapiens
ccugcgcugacaagggc

SEQ ID NO: 12600 - RNA, 22 nt, Homo sapiens
cgggagguccuccucccccucu

SEQ ID NO: 12601 - RNA, 20 nt, Homo sapiens
gcgugugaaauaguaaguca

SEQ ID NO: 12602 - RNA, 21 nt, Homo sapiens
ugugggugcuggguguggcug

SEQ ID NO: 12603 - RNA, 17 nt, Homo sapiens
aguaucuuuucaugaaa

SEQ ID NO: 12604 - RNA, 20 nt, Homo sapiens
ccucugccucccggguucaa

SEQ ID NO: 12605 - RNA, 21 nt, Homo sapiens
gaaaaaggaaaggccccuugu

SEQ ID NO: 12606 - RNA, 17 nt, Homo sapiens
cacaggacuuugaugaa

SEQ ID NO: 12607 - RNA, 21 nt, Homo sapiens
cccacaaggaacccucaggcc

SEQ ID NO: 12608 - RNA, 22 nt, Homo sapiens
ucaggggaccccacuccccuca

SEQ ID NO: 12609 - RNA, 22 nt, Homo sapiens
aagacaucaaaggcaacauaug

SEQ ID NO: 12610 - RNA, 18 nt, Homo sapiens
aucaaaggcaacauauga

SEQ ID NO: 12611 - RNA, 19 nt, Homo sapiens
ggccgggugcgguggcuca

SEQ ID NO: 12612 - RNA, 20 nt, Homo sapiens
acacaggacuuggucugcug

SEQ ID NO: 12613 - RNA, 22 nt, Homo sapiens
acuuggucugcuggccuggccu

SEQ ID NO: 12614 - RNA, 16 nt, Homo sapiens
ccucuugcgucugugc

SEQ ID NO: 12615 - RNA, 17 nt, Homo sapiens
uguuggacuucucuuca

SEQ ID NO: 12616 - RNA, 27 nt, Homo sapiens
uagaugauuacuugugaugugaaacug

SEQ ID NO: 12617 - RNA, 23 nt, Homo sapiens
agccccgccacgcagagcccaga

SEQ ID NO: 12618 - RNA, 24 nt, Homo sapiens
gcgcucccggccgcucucgccucc

SEQ ID NO: 12619 - RNA, 18 nt, Homo sapiens
auguaguucccaugugcc

SEQ ID NO: 12620 - RNA, 19 nt, Homo sapiens
gaggaucagaccuucuuuc

SEQ ID NO: 12621 - RNA, 20 nt, Homo sapiens
aaacacugaagugcuuuuca

SEQ ID NO: 12622 - RNA, 22 nt, Homo sapiens
accuggguucacacagcuuuuu

SEQ ID NO: 12623 - RNA, 19 nt, Homo sapiens
cugaccaaaggucuaggcu

SEQ ID NO: 12624 - RNA, 24 nt, Homo sapiens
ccucuuagaacugguuuuaaccuu

SEQ ID NO: 12625 - RNA, 24 nt, Homo sapiens
gcgccucggccgccgccgccgccu

SEQ ID NO: 12626 - RNA, 24 nt, Homo sapiens
gcuuuucccccaaaguaucaugug

SEQ ID NO: 12627 - RNA, 18 nt, Homo sapiens
uugagauuuuuucaguga

SEQ ID NO: 12628 - RNA, 18 nt, Homo sapiens
aaccaaucuguaucaugu

SEQ ID NO: 12629 - RNA, 18 nt, Homo sapiens
acugauguaauugucauu

SEQ ID NO: 12630 - RNA, 17 nt, Homo sapiens
gaagugaccaauguaau

SEQ ID NO: 12631 - RNA, 15 nt, Homo sapiens
ugauuuguucuuuga

SEQ ID NO: 12632 - RNA, 22 nt, Homo sapiens
uucuaggucauuaacguuuuuu

SEQ ID NO: 12633 - RNA, 21 nt, Homo sapiens
aucugguguccagcauggaug

SEQ ID NO: 12634 - RNA, 20 nt, Homo sapiens
auguuggaucugucauuauc

SEQ ID NO: 12635 - RNA, 22 nt, Homo sapiens
cggcaccauuggucucugggua

SEQ ID NO: 12636 - RNA, 22 nt, Homo sapiens
cugggucuacaaggacuuucca

SEQ ID NO: 12637 - RNA, 15 nt, Homo sapiens
ggccuucuucccaca

SEQ ID NO: 12638 - RNA, 24 nt, Homo sapiens
caaucuagcgggagagacaggaua

SEQ ID NO: 12639 - RNA, 18 nt, Homo sapiens
uggacccuuguguuuuga

SEQ ID NO: 12640 - RNA, 15 nt, Homo sapiens
cucucuccucuccuc

SEQ ID NO: 12641 - RNA, 20 nt, Homo sapiens
ggaaaggcagcagcggcggc

SEQ ID NO: 12642 - RNA, 21 nt, Homo sapiens
ucuggagacaccagcuccaca

SEQ ID NO: 12643 - RNA, 20 nt, Homo sapiens
ugaaugggcugggggugggg

SEQ ID NO: 12644 - RNA, 22 nt, Homo sapiens
cugagauauguacacagucauu

SEQ ID NO: 12645 - RNA, 17 nt, Homo sapiens
cugcaguuacggagcug

SEQ ID NO: 12646 - RNA, 22 nt, Homo sapiens
acugaaggaccugagcuggcca

SEQ ID NO: 12647 - RNA, 15 nt, Homo sapiens
aggaccugagcuggc

SEQ ID NO: 12648 - RNA, 20 nt, Homo sapiens
aucugagcugcagccuggcu

SEQ ID NO: 12649 - RNA, 19 nt, Homo sapiens
ccaccccaccuccacuccc

SEQ ID NO: 12650 - RNA, 19 nt, Homo sapiens
ccaccuccacucccaccuc

SEQ ID NO: 12651 - RNA, 18 nt, Homo sapiens
ccugagcuggccaggccc

SEQ ID NO: 12652 - RNA, 19 nt, Homo sapiens
ccugccccaccccaccucc

SEQ ID NO: 12653 - RNA, 17 nt, Homo sapiens
acuucuuggaaaagcca

SEQ ID NO: 12654 - RNA, 18 nt, Homo sapiens
ccagagcaccaaguccag

SEQ ID NO: 12655 - RNA, 22 nt, Homo sapiens
guuaugacauauguaauacaca

SEQ ID NO: 12656 - RNA, 20 nt, Homo sapiens
uccccagcucacucucugaa

SEQ ID NO: 12657 - RNA, 16 nt, Homo sapiens
acaauuuaccugucaa

SEQ ID NO: 12658 - RNA, 21 nt, Homo sapiens
agucuuuucccuaguuccuga

SEQ ID NO: 12659 - RNA, 18 nt, Homo sapiens
augcaucaucucacuuuu

SEQ ID NO: 12660 - RNA, 19 nt, Homo sapiens
auucaguugacacgaggca

SEQ ID NO: 12661 - RNA, 24 nt, Homo sapiens
cccugcaaauggauggcuugugaa

SEQ ID NO: 12662 - RNA, 27 nt, Homo sapiens
ccuuuuccgcacagcuguguugacuuu

SEQ ID NO: 12663 - RNA, 20 nt, Homo sapiens
cgcgcacccgcccgcgccgc

SEQ ID NO: 12664 - RNA, 17 nt, Homo sapiens
cugcagccacguggcca

SEQ ID NO: 12665 - RNA, 19 nt, Homo sapiens
gagcuaucguuuccgugga

SEQ ID NO: 12666 - RNA, 17 nt, Homo sapiens
ggacacccagcgugcaa

SEQ ID NO: 12667 - RNA, 18 nt, Homo sapiens
ggucccuguuuugcuuua

SEQ ID NO: 12668 - RNA, 22 nt, Homo sapiens
guccagggcagauggcagagga

SEQ ID NO: 12669 - RNA, 20 nt, Homo sapiens
uauguggaaacaguguuuua

SEQ ID NO: 12670 - RNA, 22 nt, Homo sapiens
cagcauuacaguaacuaacucu

SEQ ID NO: 12671 - RNA, 18 nt, Homo sapiens
gugaugccacguaacuua

SEQ ID NO: 12672 - RNA, 18 nt, Homo sapiens
uauucagcucuugagcaa

SEQ ID NO: 12673 - RNA, 17 nt, Homo sapiens
ucaauccucuucucuuc

SEQ ID NO: 12674 - RNA, 19 nt, Homo sapiens
agcauccaucacuccugug

SEQ ID NO: 12675 - RNA, 18 nt, Homo sapiens
caggaggagcagcacccg

SEQ ID NO: 12676 - RNA, 17 nt, Homo sapiens
gauguggccuccgucca

SEQ ID NO: 12677 - RNA, 23 nt, Homo sapiens
ggccuccguccagcgcgcuggcc

SEQ ID NO: 12678 - RNA, 16 nt, Homo sapiens
ggguccaggccuagca

SEQ ID NO: 12679 - RNA, 21 nt, Homo sapiens
uccuuggccgagagaaccuga

SEQ ID NO: 12680 - RNA, 21 nt, Homo sapiens
uaauuccaaguggcauguauc

SEQ ID NO: 12681 - RNA, 23 nt, Homo sapiens
ccaaauguggcaaaccaacccca

SEQ ID NO: 12682 - RNA, 19 nt, Homo sapiens
ggccaaauguggcaaacca

SEQ ID NO: 12683 - RNA, 19 nt, Homo sapiens
agaauauauuuaaaugcaa

SEQ ID NO: 12684 - RNA, 18 nt, Homo sapiens
ccugcaaccuccaccucc

SEQ ID NO: 12685 - RNA, 19 nt, Homo sapiens
cugcaaccuccaccuccca

SEQ ID NO: 12686 - RNA, 19 nt, Homo sapiens
gaacugccauaaaaucuca

SEQ ID NO: 12687 - RNA, 15 nt, Homo sapiens
guuucugaagucuca

SEQ ID NO: 12688 - RNA, 18 nt, Homo sapiens
uccaccucccagguucaa

SEQ ID NO: 12689 - RNA, 20 nt, Homo sapiens
uggccaggcuggucuugaac

SEQ ID NO: 12690 - RNA, 22 nt, Homo sapiens
uccugcccggggggccuggugg

SEQ ID NO: 12691 - RNA, 20 nt, Homo sapiens
uggccccgccuccuccuuca

SEQ ID NO: 12692 - RNA, 20 nt, Homo sapiens
aagggaauacuaucuaacca

SEQ ID NO: 12693 - RNA, 22 nt, Homo sapiens
caauuuucugacuugcuuuucu

SEQ ID NO: 12694 - RNA, 22 nt, Homo sapiens
cacugaauuccaauuucauuuc

SEQ ID NO: 12695 - RNA, 17 nt, Homo sapiens
cuaccuugugccucuca

SEQ ID NO: 12696 - RNA, 19 nt, Homo sapiens
uaacagucuguguuuucuc

SEQ ID NO: 12697 - RNA, 15 nt, Homo sapiens
agagggggcgggaca

SEQ ID NO: 12698 - RNA, 19 nt, Homo sapiens
agccacacuccuggcaucc

SEQ ID NO: 12699 - RNA, 20 nt, Homo sapiens
caugaagucacugauuaguu

SEQ ID NO: 12700 - RNA, 18 nt, Homo sapiens
gucccuuguuuuugauca

SEQ ID NO: 12701 - RNA, 17 nt, Homo sapiens
ucgacuugaaccacucc

SEQ ID NO: 12702 - RNA, 18 nt, Homo sapiens
ggccaugccagccacguc

SEQ ID NO: 12703 - RNA, 17 nt, Homo sapiens
ucugugaggagcugugg

SEQ ID NO: 12704 - RNA, 26 nt, Homo sapiens
uucacuaaaaucagugacucacuucc

SEQ ID NO: 12705 - RNA, 18 nt, Homo sapiens
agugcuugaccuuuuugu

SEQ ID NO: 12706 - RNA, 20 nt, Homo sapiens
caccuccaccaccccucccu

SEQ ID NO: 12707 - RNA, 20 nt, Homo sapiens
cacugacucauggcaccucc

SEQ ID NO: 12708 - RNA, 18 nt, Homo sapiens
gagaaggagcuggcgaga

SEQ ID NO: 12709 - RNA, 22 nt, Homo sapiens
uaaauguauccagaugagguug

SEQ ID NO: 12710 - RNA, 17 nt, Homo sapiens
ucaagugauucuccugc

SEQ ID NO: 12711 - RNA, 18 nt, Homo sapiens
ucccugucccagccagca

SEQ ID NO: 12712 - RNA, 16 nt, Homo sapiens
ugcauguguccacuua

SEQ ID NO: 12713 - RNA, 20 nt, Homo sapiens
ggagaggcggcggccgcggc

SEQ ID NO: 12714 - RNA, 24 nt, Homo sapiens
aucuggggagacagcaggaucaca

SEQ ID NO: 12715 - RNA, 19 nt, Homo sapiens
augccacuuuaagcuuuau

SEQ ID NO: 12716 - RNA, 21 nt, Homo sapiens
uucuuuggugccugcaguuua

SEQ ID NO: 12717 - RNA, 20 nt, Homo sapiens
ucuguuauguguguuugcug

SEQ ID NO: 12718 - RNA, 19 nt, Homo sapiens
cugugggcuggaaauccca

SEQ ID NO: 12719 - RNA, 16 nt, Homo sapiens
ucaagacuauaucuaa

SEQ ID NO: 12720 - RNA, 18 nt, Homo sapiens
caggugaaagguggcugc

SEQ ID NO: 12721 - RNA, 23 nt, Homo sapiens
cucuggugaccacuugccugugg

SEQ ID NO: 12722 - RNA, 18 nt, Homo sapiens
aguucucaaaucguuuuu

SEQ ID NO: 12723 - RNA, 19 nt, Homo sapiens
cucaaaaacaugaacaagu

SEQ ID NO: 12724 - RNA, 20 nt, Homo sapiens
ucauacauauauccauuaua

SEQ ID NO: 12725 - RNA, 18 nt, Homo sapiens
cacuuucuccagugcuca

SEQ ID NO: 12726 - RNA, 22 nt, Homo sapiens
cccucacuuucuccagugcuca

SEQ ID NO: 12727 - RNA, 21 nt, Homo sapiens
uaauaggguguggaaugucgu

SEQ ID NO: 12728 - RNA, 21 nt, Homo sapiens
cacccucuaugagucccauuu

SEQ ID NO: 12729 - RNA, 24 nt, Homo sapiens
ccuuuaacuuugcagaccuuccuu

SEQ ID NO: 12730 - RNA, 18 nt, Homo sapiens
ucuaugagucccauuuua

SEQ ID NO: 12731 - RNA, 16 nt, Homo sapiens
uggcuccccuuugagc

SEQ ID NO: 12732 - RNA, 18 nt, Homo sapiens
uucccugccucacccuca

SEQ ID NO: 12733 - RNA, 19 nt, Homo sapiens
aaacuccugaccucaggug

SEQ ID NO: 12734 - RNA, 19 nt, Homo sapiens
aagcaauucuccugccuca

SEQ ID NO: 12735 - RNA, 21 nt, Homo sapiens
cuacacuuugaaagauauauu

SEQ ID NO: 12736 - RNA, 17 nt, Homo sapiens
gcuaaaucccaaagggg

SEQ ID NO: 12737 - RNA, 17 nt, Homo sapiens
gaccuugaauuuggauu

SEQ ID NO: 12738 - RNA, 19 nt, Homo sapiens
uguaauuauccuggauuca

SEQ ID NO: 12739 - RNA, 24 nt, Homo sapiens
caacgggagcgaguuggucaccgc

SEQ ID NO: 12740 - RNA, 22 nt, Homo sapiens
gcgccaagacucaggggaucgg

SEQ ID NO: 12741 - RNA, 19 nt, Homo sapiens
ucugggaagacaaguugcu

SEQ ID NO: 12742 - RNA, 18 nt, Homo sapiens
uuuucauugaagaguuga

SEQ ID NO: 12743 - RNA, 19 nt, Homo sapiens
gagcgagggcgcuucgcuc

SEQ ID NO: 12744 - RNA, 21 nt, Homo sapiens
gacccugugcccuccuuccca

SEQ ID NO: 12745 - RNA, 24 nt, Homo sapiens
ucugccugacaaggccagcaccca

SEQ ID NO: 12746 - RNA, 21 nt, Homo sapiens
ccugggccucggcgggucacu

SEQ ID NO: 12747 - RNA, 22 nt, Homo sapiens
aaaaugcaaucacuguguugua

SEQ ID NO: 12748 - RNA, 25 nt, Homo sapiens
aacuggguauucuugaauugcuuuu

SEQ ID NO: 12749 - RNA, 17 nt, Homo sapiens
aucuuccaaagcacuau

SEQ ID NO: 12750 - RNA, 23 nt, Homo sapiens
cagcuguucuagaguuucaguca

SEQ ID NO: 12751 - RNA, 23 nt, Homo sapiens
cagggucgguggggggguugguu

SEQ ID NO: 12752 - RNA, 17 nt, Homo sapiens
cauuaacgacuagauua

SEQ ID NO: 12753 - RNA, 22 nt, Homo sapiens
ccuggcacagugcuuugaucuu

SEQ ID NO: 12754 - RNA, 17 nt, Homo sapiens
guccagcaagauacuuu

SEQ ID NO: 12755 - RNA, 19 nt, Homo sapiens
ugcuguuaauguauugcug

SEQ ID NO: 12756 - RNA, 19 nt, Homo sapiens
accucccccgcacacacac

SEQ ID NO: 12757 - RNA, 18 nt, Homo sapiens
agaaagagggucagugga

SEQ ID NO: 12758 - RNA, 22 nt, Homo sapiens
ccauucaccagauuauuugaug

SEQ ID NO: 12759 - RNA, 20 nt, Homo sapiens
cugauggaaauauuuccucc

SEQ ID NO: 12760 - RNA, 24 nt, Homo sapiens
gcuucucucagagucucccccucu

SEQ ID NO: 12761 - RNA, 17 nt, Homo sapiens
gccaggcgugcgggaga

SEQ ID NO: 12762 - RNA, 15 nt, Homo sapiens
gugccccauccucug

SEQ ID NO: 12763 - RNA, 21 nt, Homo sapiens
ugaguuagacuauuucccaca

SEQ ID NO: 12764 - RNA, 22 nt, Homo sapiens
acagugucaggaucgcgggcuu

SEQ ID NO: 12765 - RNA, 23 nt, Homo sapiens
ccaggacgcacagaagcgccuca

SEQ ID NO: 12766 - RNA, 19 nt, Homo sapiens
ccugaauucucuuuggcuu

SEQ ID NO: 12767 - RNA, 18 nt, Homo sapiens
gagcgccugaccuuccuc

SEQ ID NO: 12768 - RNA, 18 nt, Homo sapiens
ccaggccacccugccucc

SEQ ID NO: 12769 - RNA, 20 nt, Homo sapiens
ccccacccaguaccgcaucu

SEQ ID NO: 12770 - RNA, 21 nt, Homo sapiens
gaugccaccuuccuugucccc

SEQ ID NO: 12771 - RNA, 21 nt, Homo sapiens
gcccccucggggacgccccca

SEQ ID NO: 12772 - RNA, 20 nt, Homo sapiens
ccccacccaguaccgcaucu

SEQ ID NO: 12773 - RNA, 17 nt, Homo sapiens
cggggugaaaccuccca

SEQ ID NO: 12774 - RNA, 21 nt, Homo sapiens
gcccccucggggacgccccca

SEQ ID NO: 12775 - RNA, 21 nt, Homo sapiens
caggguuguggcgcagcaguc

SEQ ID NO: 12776 - RNA, 19 nt, Homo sapiens
cuuccugcgcgcgcgccug

SEQ ID NO: 12777 - RNA, 20 nt, Homo sapiens
aucagcauuauaaaaagugu

SEQ ID NO: 12778 - RNA, 24 nt, Homo sapiens
cuaacuauaaauccuauuugugug

SEQ ID NO: 12779 - RNA, 21 nt, Homo sapiens
gaagaaaaaugagacauuuuu

SEQ ID NO: 12780 - RNA, 26 nt, Homo sapiens
acguagacuugguucaagucucguua

SEQ ID NO: 12781 - RNA, 18 nt, Homo sapiens
agcaaagugugguaucca

SEQ ID NO: 12782 - RNA, 23 nt, Homo sapiens
uaagugggcuuccauuccaugga

SEQ ID NO: 12783 - RNA, 18 nt, Homo sapiens
ugaagagagcaucagagu

SEQ ID NO: 12784 - RNA, 23 nt, Homo sapiens
ugagaucaggaccagccugguca

SEQ ID NO: 12785 - RNA, 18 nt, Homo sapiens
uggauauuuuucuaccua

SEQ ID NO: 12786 - RNA, 21 nt, Homo sapiens
ugugucuuuugaagagagcau

SEQ ID NO: 12787 - RNA, 19 nt, Homo sapiens
ccuuccugaccucuggcuc

SEQ ID NO: 12788 - RNA, 18 nt, Homo sapiens
gcaauaccucucguucca

SEQ ID NO: 12789 - RNA, 19 nt, Homo sapiens
gcccagggagggcuuucgu

SEQ ID NO: 12790 - RNA, 19 nt, Homo sapiens
acacuuguacccacaggug

SEQ ID NO: 12791 - RNA, 24 nt, Homo sapiens
ccaggcauauguuuccccaucucu

SEQ ID NO: 12792 - RNA, 20 nt, Homo sapiens
ccauuuucauccugagccca

SEQ ID NO: 12793 - RNA, 18 nt, Homo sapiens
cccucuguucucuccccu

SEQ ID NO: 12794 - RNA, 16 nt, Homo sapiens
cccuggccucacuuga

SEQ ID NO: 12795 - RNA, 18 nt, Homo sapiens
cuggaaugggagaccugu

SEQ ID NO: 12796 - RNA, 17 nt, Homo sapiens
cuggccucacuugauuc

SEQ ID NO: 12797 - RNA, 19 nt, Homo sapiens
cuugauucaucucugguuu

SEQ ID NO: 12798 - RNA, 21 nt, Homo sapiens
gaaacagaaaugaccacguga

SEQ ID NO: 12799 - RNA, 20 nt, Homo sapiens
gaggucuuucagcucauuua

SEQ ID NO: 12800 - RNA, 20 nt, Homo sapiens
gcgauuugggggcucgggga

SEQ ID NO: 12801 - RNA, 20 nt, Homo sapiens
ggaaagaggcaucaaagcua

SEQ ID NO: 12802 - RNA, 21 nt, Homo sapiens
ucaaaccuuucuggccuguua

SEQ ID NO: 12803 - RNA, 19 nt, Homo sapiens
ucugggaguccccauccca

SEQ ID NO: 12804 - RNA, 22 nt, Homo sapiens
ugggugggguuaugugagggua

SEQ ID NO: 12805 - RNA, 18 nt, Homo sapiens
uuuucuuacacaccccca

SEQ ID NO: 12806 - RNA, 18 nt, Homo sapiens
auuuucaguuuugccugc

SEQ ID NO: 12807 - RNA, 19 nt, Homo sapiens
cacaccucugcuggaugcc

SEQ ID NO: 12808 - RNA, 22 nt, Homo sapiens
auaccaaguauauugugucugc

SEQ ID NO: 12809 - RNA, 20 nt, Homo sapiens
auuugucacaggccauugua

SEQ ID NO: 12810 - RNA, 19 nt, Homo sapiens
cuauauaugacauaugcua

SEQ ID NO: 12811 - RNA, 22 nt, Homo sapiens
ugagaaaauguuggguccaguc

SEQ ID NO: 12812 - RNA, 18 nt, Homo sapiens
agaauguucuuucauuaa

SEQ ID NO: 12813 - RNA, 19 nt, Homo sapiens
aaccggcauccguuuugga

SEQ ID NO: 12814 - RNA, 23 nt, Homo sapiens
ccugguaccacucagaaccucca

SEQ ID NO: 12815 - RNA, 17 nt, Homo sapiens
ggaacggccuguaccgu

SEQ ID NO: 12816 - RNA, 19 nt, Homo sapiens
uccagcacgagcacccacu

SEQ ID NO: 12817 - RNA, 22 nt, Homo sapiens
ugcugccuuacacagugcauuu

SEQ ID NO: 12818 - RNA, 21 nt, Homo sapiens
accuggaccagacucuggccc

SEQ ID NO: 12819 - RNA, 17 nt, Homo sapiens
auuccuucauccucuga

SEQ ID NO: 12820 - RNA, 15 nt, Homo sapiens
gcgggccggccuggg

SEQ ID NO: 12821 - RNA, 21 nt, Homo sapiens
ggcucuucuuccuucaucuca

SEQ ID NO: 12822 - RNA, 20 nt, Homo sapiens
guuccagaacugaugucaga

SEQ ID NO: 12823 - RNA, 21 nt, Homo sapiens
uccgccucgucgagcgcugcu

SEQ ID NO: 12824 - RNA, 19 nt, Homo sapiens
uuuccgagacggacacuuu

SEQ ID NO: 12825 - RNA, 21 nt, Homo sapiens
aaguuaauagaaaguuggcca

SEQ ID NO: 12826 - RNA, 24 nt, Homo sapiens
gagggccgggccaggagaaucucc

SEQ ID NO: 12827 - RNA, 19 nt, Homo sapiens
gcaggcuuacugagcuguc

SEQ ID NO: 12828 - RNA, 19 nt, Homo sapiens
gccugaauugcuuucugcu

SEQ ID NO: 12829 - RNA, 19 nt, Homo sapiens
ggaaaaccauucuaaaaca

SEQ ID NO: 12830 - RNA, 20 nt, Homo sapiens
gggagcaagaggugugcaca

SEQ ID NO: 12831 - RNA, 19 nt, Homo sapiens
uuccuuuuugcagcaauua

SEQ ID NO: 12832 - RNA, 21 nt, Homo sapiens
ccaucagcaaagacgagccuc

SEQ ID NO: 12833 - RNA, 20 nt, Homo sapiens
gagaggaaguuuguucacca

SEQ ID NO: 12834 - RNA, 19 nt, Homo sapiens
gguguuggcuggaccccuc

SEQ ID NO: 12835 - RNA, 18 nt, Homo sapiens
cccgcccacccugccgga

SEQ ID NO: 12836 - RNA, 21 nt, Homo sapiens
uccacggccccgccccgcccu

SEQ ID NO: 12837 - RNA, 24 nt, Homo sapiens
gaaguccccaagacaaucucgcca

SEQ ID NO: 12838 - RNA, 24 nt, Homo sapiens
ugcacagggugcuccugccaccuc

SEQ ID NO: 12839 - RNA, 20 nt, Homo sapiens
uucaagauuucaauauccaa

SEQ ID NO: 12840 - RNA, 24 nt, Homo sapiens
uuuucaagauuucaauauccaaca

SEQ ID NO: 12841 - RNA, 22 nt, Homo sapiens
aaaagaaaacuuguguucaauc

SEQ ID NO: 12842 - RNA, 16 nt, Homo sapiens
cucuccuucacucuga

SEQ ID NO: 12843 - RNA, 21 nt, Homo sapiens
cucuuucucucuuuccaucuc

SEQ ID NO: 12844 - RNA, 18 nt, Homo sapiens
gacuccgagaagcucucg

SEQ ID NO: 12845 - RNA, 21 nt, Homo sapiens
gauggcuuaagccuguguaua

SEQ ID NO: 12846 - RNA, 21 nt, Homo sapiens
gccucgcuggcugcuucgcuc

SEQ ID NO: 12847 - RNA, 24 nt, Homo sapiens
gguuguuccuuuuucuuuuuuuaa

SEQ ID NO: 12848 - RNA, 19 nt, Homo sapiens
uggaggccaccaagcugcu

SEQ ID NO: 12849 - RNA, 19 nt, Homo sapiens
uugucacuucugcuguaca

SEQ ID NO: 12850 - RNA, 18 nt, Homo sapiens
uuuucccaucaccagaaa

SEQ ID NO: 12851 - RNA, 18 nt, Homo sapiens
agcccucaggauuccuga

SEQ ID NO: 12852 - RNA, 23 nt, Homo sapiens
gccuggguuguggccgcccuagc

SEQ ID NO: 12853 - RNA, 19 nt, Homo sapiens
acauuuucucaauuguaaa

SEQ ID NO: 12854 - RNA, 18 nt, Homo sapiens
caguucagacaaauguaa

SEQ ID NO: 12855 - RNA, 23 nt, Homo sapiens
cccaagcacuucaaaggaacugg

SEQ ID NO: 12856 - RNA, 17 nt, Homo sapiens
gaaaacaaacaaacaaa

SEQ ID NO: 12857 - RNA, 25 nt, Homo sapiens
gccuguccagccggccgccuguccc

SEQ ID NO: 12858 - RNA, 19 nt, Homo sapiens
ccaagggaagcuccucuga

SEQ ID NO: 12859 - RNA, 21 nt, Homo sapiens
ccagcugagaaugcccccucc

SEQ ID NO: 12860 - RNA, 17 nt, Homo sapiens
cucuagagcaaggccca

SEQ ID NO: 12861 - RNA, 17 nt, Homo sapiens
cucuccuugccaaaucu

SEQ ID NO: 12862 - RNA, 22 nt, Homo sapiens
gcagagaguucccaucucaucu

SEQ ID NO: 12863 - RNA, 24 nt, Homo sapiens
uaaaaacacccacauaugcuuuuc

SEQ ID NO: 12864 - RNA, 21 nt, Homo sapiens
uuuguuugcuauucugugugu

SEQ ID NO: 12865 - RNA, 22 nt, Homo sapiens
ugcauauguauuuuguauuugc

SEQ ID NO: 12866 - RNA, 18 nt, Homo sapiens
cagacuuccuuuuacuuc

SEQ ID NO: 12867 - RNA, 18 nt, Homo sapiens
cuguaaaaccuugucuua

SEQ ID NO: 12868 - RNA, 17 nt, Homo sapiens
guccuguagcuauuuua

SEQ ID NO: 12869 - RNA, 21 nt, Homo sapiens
ggacucccgcccgcucccgcu

SEQ ID NO: 12870 - RNA, 21 nt, Homo sapiens
gcgcucccgccggcgaguucu

SEQ ID NO: 12871 - RNA, 23 nt, Homo sapiens
cagccagggguccagagcuagcc

SEQ ID NO: 12872 - RNA, 22 nt, Homo sapiens
cucuuucucuccugcagucccg

SEQ ID NO: 12873 - RNA, 21 nt, Homo sapiens
cugccugccccaccugccuca

SEQ ID NO: 12874 - RNA, 21 nt, Homo sapiens
cccuccccucaccuuccccca

SEQ ID NO: 12875 - RNA, 21 nt, Homo sapiens
cugcccggcacccccucccca

SEQ ID NO: 12876 - RNA, 18 nt, Homo sapiens
uccuccggaccccaccuu

SEQ ID NO: 12877 - RNA, 20 nt, Homo sapiens
uugccuagccucucccucuc

SEQ ID NO: 12878 - RNA, 18 nt, Homo sapiens
aagauaaaaugauguuau

SEQ ID NO: 12879 - RNA, 24 nt, Homo sapiens
aucuauguuuauaauacuacuacu

SEQ ID NO: 12880 - RNA, 23 nt, Homo sapiens
augaggccggaugaaacuucuca

SEQ ID NO: 12881 - RNA, 20 nt, Homo sapiens
cagaagaaaauuugccaauc

SEQ ID NO: 12882 - RNA, 21 nt, Homo sapiens
cucccacuccauaccccgcca

SEQ ID NO: 12883 - RNA, 21 nt, Homo sapiens
cuucucauguauauuacccaa

SEQ ID NO: 12884 - RNA, 16 nt, Homo sapiens
gauacuuacauguucc

SEQ ID NO: 12885 - RNA, 20 nt, Homo sapiens
gucagcugcuguugaacuuu

SEQ ID NO: 12886 - RNA, 18 nt, Homo sapiens
ugguccuauuuuugugaa

SEQ ID NO: 12887 - RNA, 21 nt, Homo sapiens
uguccuuaaaauguggucugc

SEQ ID NO: 12888 - RNA, 21 nt, Homo sapiens
aaacagaugaugagaauuucu

SEQ ID NO: 12889 - RNA, 20 nt, Homo sapiens
aaguucaagugauucuccug

SEQ ID NO: 12890 - RNA, 21 nt, Homo sapiens
caagggccuacccugaugcca

SEQ ID NO: 12891 - RNA, 25 nt, Homo sapiens
cuggcucacccaccugcuaauagca

SEQ ID NO: 12892 - RNA, 21 nt, Homo sapiens
gauuuacaguccaggcagcaa

SEQ ID NO: 12893 - RNA, 17 nt, Homo sapiens
ucaagugauucuccugc

SEQ ID NO: 12894 - RNA, 19 nt, Homo sapiens
ugagcugucaguucccaca

SEQ ID NO: 12895 - RNA, 21 nt, Homo sapiens
ugcuguggaggccaagacccc

SEQ ID NO: 12896 - RNA, 22 nt, Homo sapiens
acccgagcagggguuuuaagga

SEQ ID NO: 12897 - RNA, 23 nt, Homo sapiens
aguguucauccugaaaugucuca

SEQ ID NO: 12898 - RNA, 22 nt, Homo sapiens
caacccuacacgcacgaacuga

SEQ ID NO: 12899 - RNA, 20 nt, Homo sapiens
cuucuaucagaaccaauucu

SEQ ID NO: 12900 - RNA, 25 nt, Homo sapiens
gccgcgaccgccgcggcugcagccu

SEQ ID NO: 12901 - RNA, 23 nt, Homo sapiens
uccugguagaaccuuucaacaaa

SEQ ID NO: 12902 - RNA, 19 nt, Homo sapiens
uuucaaaauaagcuuuucc

SEQ ID NO: 12903 - RNA, 21 nt, Homo sapiens
uuuccuccacccauucucuga

SEQ ID NO: 12904 - RNA, 19 nt, Homo sapiens
gguggguugggguguugug

SEQ ID NO: 12905 - RNA, 20 nt, Homo sapiens
uggucaggcuggucuugaac

SEQ ID NO: 12906 - RNA, 19 nt, Homo sapiens
acuuagagacugauuagac

SEQ ID NO: 12907 - RNA, 22 nt, Homo sapiens
aauucauuccuccucuuccucu

SEQ ID NO: 12908 - RNA, 22 nt, Homo sapiens
aggugaauuacccagcuugccu

SEQ ID NO: 12909 - RNA, 21 nt, Homo sapiens
cuaguugucacugccuggcuu

SEQ ID NO: 12910 - RNA, 19 nt, Homo sapiens
cuuccaccgucugcgcgcc

SEQ ID NO: 12911 - RNA, 18 nt, Homo sapiens
gaauaucccccuuccucu

SEQ ID NO: 12912 - RNA, 23 nt, Homo sapiens
uaaauggaaaaauauauggacua

SEQ ID NO: 12913 - RNA, 16 nt, Homo sapiens
cccacccucugcuccu

SEQ ID NO: 12914 - RNA, 18 nt, Homo sapiens
ggcuucugaggacuccca

SEQ ID NO: 12915 - RNA, 19 nt, Homo sapiens
uguccaggggcccagagag

SEQ ID NO: 12916 - RNA, 20 nt, Homo sapiens
ccagguaucuccccuccucu

SEQ ID NO: 12917 - RNA, 16 nt, Homo sapiens
gccaaccccccugcag

SEQ ID NO: 12918 - RNA, 20 nt, Homo sapiens
ucacagacauggaagggacc

SEQ ID NO: 12919 - RNA, 20 nt, Homo sapiens
ugugcuggcagauaggguug

SEQ ID NO: 12920 - RNA, 22 nt, Homo sapiens
agguaguccugguacuccuuua

SEQ ID NO: 12921 - RNA, 19 nt, Homo sapiens
cauccuccucuggauaacu

SEQ ID NO: 12922 - RNA, 18 nt, Homo sapiens
gagguucggguccggccg

SEQ ID NO: 12923 - RNA, 20 nt, Homo sapiens
uagauggacuucucagaacu

SEQ ID NO: 12924 - RNA, 20 nt, Homo sapiens
uguugccuuacuuuuuaaua

SEQ ID NO: 12925 - RNA, 17 nt, Homo sapiens
uuacagcagcacuguau

SEQ ID NO: 12926 - RNA, 21 nt, Homo sapiens
aaaccugccuccaagauuuca

SEQ ID NO: 12927 - RNA, 21 nt, Homo sapiens
aaugcuauugaaauuacugaa

SEQ ID NO: 12928 - RNA, 16 nt, Homo sapiens
cacaauuuucagguuu

SEQ ID NO: 12929 - RNA, 21 nt, Homo sapiens
uggcgaaccaucucaauguaa

SEQ ID NO: 12930 - RNA, 20 nt, Homo sapiens
gcacgaggaagcgguuggga

SEQ ID NO: 12931 - RNA, 18 nt, Homo sapiens
ggccuggcuauggaacua

SEQ ID NO: 12932 - RNA, 20 nt, Homo sapiens
ucauaauaggugacaguguu

SEQ ID NO: 12933 - RNA, 16 nt, Homo sapiens
ucgauuuuucuuaagc

SEQ ID NO: 12934 - RNA, 20 nt, Homo sapiens
gacgggacucccgguucucc

SEQ ID NO: 12935 - RNA, 20 nt, Homo sapiens
aaaaacaacaaacaaacaaa

SEQ ID NO: 12936 - RNA, 19 nt, Homo sapiens
aguaacuacaguggcauua

SEQ ID NO: 12937 - RNA, 20 nt, Homo sapiens
gaaaaugucaagcugauuua

SEQ ID NO: 12938 - RNA, 18 nt, Homo sapiens
ugcugcuccaguaacuac

SEQ ID NO: 12939 - RNA, 21 nt, Homo sapiens
aagcaagaaauauuuucucuc

SEQ ID NO: 12940 - RNA, 22 nt, Homo sapiens
cuucucguuugaguacuacuaa

SEQ ID NO: 12941 - RNA, 18 nt, Homo sapiens
gaaaaaaaaguaaagcaa

SEQ ID NO: 12942 - RNA, 19 nt, Homo sapiens
uggcaccauuuccuaaagu

SEQ ID NO: 12943 - RNA, 23 nt, Homo sapiens
ccagccccuagcuacaucucucc

SEQ ID NO: 12944 - RNA, 22 nt, Homo sapiens
ccucccccuguaaccucuuccc

SEQ ID NO: 12945 - RNA, 21 nt, Homo sapiens
gagcaaagcuaggccugauua

SEQ ID NO: 12946 - RNA, 18 nt, Homo sapiens
ggaggcgccggcuguggc

SEQ ID NO: 12947 - RNA, 16 nt, Homo sapiens
aacacuggugauuuca

SEQ ID NO: 12948 - RNA, 18 nt, Homo sapiens
guuaaagauuugcuuuau

SEQ ID NO: 12949 - RNA, 18 nt, Homo sapiens
cagcugguaaggucuuca

SEQ ID NO: 12950 - RNA, 22 nt, Homo sapiens
ccuuucuucccuugcacgcucg

SEQ ID NO: 12951 - RNA, 19 nt, Homo sapiens
cuucucuguguucugccuc

SEQ ID NO: 12952 - RNA, 21 nt, Homo sapiens
gucccauuccaccccacccca

SEQ ID NO: 12953 - RNA, 17 nt, Homo sapiens
ugcuuaguggcacugac

SEQ ID NO: 12954 - RNA, 21 nt, Homo sapiens
aacuccaucagaacucgcaau

SEQ ID NO: 12955 - RNA, 17 nt, Homo sapiens
acuccaucagaacucgc

SEQ ID NO: 12956 - RNA, 21 nt, Homo sapiens
guucuuuaaaugcguuccuca

SEQ ID NO: 12957 - RNA, 18 nt, Homo sapiens
acuugggagcugacugug

SEQ ID NO: 12958 - RNA, 17 nt, Homo sapiens
uuuaauuaagggguagg

SEQ ID NO: 12959 - RNA, 16 nt, Homo sapiens
aaaccuuuuguucugu

SEQ ID NO: 12960 - RNA, 17 nt, Homo sapiens
agacuauuugccaugac

SEQ ID NO: 12961 - RNA, 23 nt, Homo sapiens
augguuauaguucuaauauggag

SEQ ID NO: 12962 - RNA, 20 nt, Homo sapiens
cacaguaauuucccuuuuua

SEQ ID NO: 12963 - RNA, 18 nt, Homo sapiens
cuuuaggguuaguccuca

SEQ ID NO: 12964 - RNA, 20 nt, Homo sapiens
cuuucucccccucugccuuu

SEQ ID NO: 12965 - RNA, 20 nt, Homo sapiens
gaagaaucuaaaagauaaca

SEQ ID NO: 12966 - RNA, 24 nt, Homo sapiens
gaguccugacucagaacaccaacu

SEQ ID NO: 12967 - RNA, 22 nt, Homo sapiens
ggcucuccccacccauuccccu

SEQ ID NO: 12968 - RNA, 24 nt, Homo sapiens
uaaguggggaaugcaacgugaggc

SEQ ID NO: 12969 - RNA, 21 nt, Homo sapiens
ucucuuuguggucaugugauu

SEQ ID NO: 12970 - RNA, 19 nt, Homo sapiens
uuuucuuuccagccaguua

SEQ ID NO: 12971 - RNA, 18 nt, Homo sapiens
accgccaccgccuggucc

SEQ ID NO: 12972 - RNA, 21 nt, Homo sapiens
acauuuagauaauuuauagua

SEQ ID NO: 12973 - RNA, 19 nt, Homo sapiens
auccaagcuaugcauuuca

SEQ ID NO: 12974 - RNA, 22 nt, Homo sapiens
augcauuucauauagcuuuuuc

SEQ ID NO: 12975 - RNA, 19 nt, Homo sapiens
aggagacaggaagccucaa

SEQ ID NO: 12976 - RNA, 22 nt, Homo sapiens
cuaaaagcauggcccugcugcc

SEQ ID NO: 12977 - RNA, 16 nt, Homo sapiens
gagcuuccagagcucu

SEQ ID NO: 12978 - RNA, 26 nt, Homo sapiens
cauggugcuauccucugaaccccuca

SEQ ID NO: 12979 - RNA, 23 nt, Homo sapiens
cuuuggacuuggaaggugugcgg

SEQ ID NO: 12980 - RNA, 17 nt, Homo sapiens
ucccccagcaucucuca

SEQ ID NO: 12981 - RNA, 19 nt, Homo sapiens
cccacggccccuacaggcu

SEQ ID NO: 12982 - RNA, 17 nt, Homo sapiens
cgugacagguuuccaca

SEQ ID NO: 12983 - RNA, 21 nt, Homo sapiens
aaaaucaguuaacuauacucc

SEQ ID NO: 12984 - RNA, 19 nt, Homo sapiens
ccagccugguggcccagcu

SEQ ID NO: 12985 - RNA, 21 nt, Homo sapiens
ccggacugaccaaaucaccca

SEQ ID NO: 12986 - RNA, 20 nt, Homo sapiens
cacucuuagaauucccauuu

SEQ ID NO: 12987 - RNA, 22 nt, Homo sapiens
cucuggugcacuccaucuguaa

SEQ ID NO: 12988 - RNA, 19 nt, Homo sapiens
guacuauuauuccauacua

SEQ ID NO: 12989 - RNA, 18 nt, Homo sapiens
uccaucuguuucuugcca

SEQ ID NO: 12990 - RNA, 21 nt, Homo sapiens
uccccacuguacacuguggua

SEQ ID NO: 12991 - RNA, 20 nt, Homo sapiens
uuagaaauuuaaaauagcau

SEQ ID NO: 12992 - RNA, 21 nt, Homo sapiens
uucgagucuguuuauccguug

SEQ ID NO: 12993 - RNA, 21 nt, Homo sapiens
uuuccaaaauuaaccuuuaaa

SEQ ID NO: 12994 - RNA, 22 nt, Homo sapiens
aggcacaauuccaccuuccuuu

SEQ ID NO: 12995 - RNA, 24 nt, Homo sapiens
aaugguuaaacacaaaaggcugau

SEQ ID NO: 12996 - RNA, 18 nt, Homo sapiens
acugugaaacuuucugaa

SEQ ID NO: 12997 - RNA, 16 nt, Homo sapiens
cugcucacacuccaga

SEQ ID NO: 12998 - RNA, 19 nt, Homo sapiens
cugcuucgcugcagggaua

SEQ ID NO: 12999 - RNA, 24 nt, Homo sapiens
ggaaacaucuuucauagccacauu

SEQ ID NO: 13000 - RNA, 19 nt, Homo sapiens
ggcuucucccgguucauuu

SEQ ID NO: 13001 - RNA, 26 nt, Homo sapiens
ucagugcauaauuccaaguggcuuuu

SEQ ID NO: 13002 - RNA, 23 nt, Homo sapiens
gguggcgaagcagcagccgcggc

SEQ ID NO: 13003 - RNA, 22 nt, Homo sapiens
gcaccuccacgccacugccucc

SEQ ID NO: 13004 - RNA, 22 nt, Homo sapiens
gggcggccagggacccaaagca

SEQ ID NO: 13005 - RNA, 19 nt, Homo sapiens
uagcauuuaaaaguuuaaa

SEQ ID NO: 13006 - RNA, 18 nt, Homo sapiens
uguauuguaaauuggcau

SEQ ID NO: 13007 - RNA, 19 nt, Homo sapiens
uuuuucauauacuggccuu

SEQ ID NO: 13008 - RNA, 17 nt, Homo sapiens
gauauuuucuacccuca

SEQ ID NO: 13009 - RNA, 22 nt, Homo sapiens
gcuccucuguccugccuacccu

SEQ ID NO: 13010 - RNA, 17 nt, Homo sapiens
ggaccgggcagugucac

SEQ ID NO: 13011 - RNA, 22 nt, Homo sapiens
acagaaagaucauuugaaacca

SEQ ID NO: 13012 - RNA, 20 nt, Homo sapiens
uaacugccauauauguaaua

SEQ ID NO: 13013 - RNA, 21 nt, Homo sapiens
gucggagucgaaugcauuugu

SEQ ID NO: 13014 - RNA, 24 nt, Homo sapiens
ugcaggaacugcaugcugcaggug

SEQ ID NO: 13015 - RNA, 20 nt, Homo sapiens
ggaacacaaaacucuuugua

SEQ ID NO: 13016 - RNA, 20 nt, Homo sapiens
uaacaaggaauguuucuuau

SEQ ID NO: 13017 - RNA, 21 nt, Homo sapiens
guauuucaaauaucuaagcaa

SEQ ID NO: 13018 - RNA, 28 nt, Homo sapiens
ugaauguuagaugcuuagugugaaguug

SEQ ID NO: 13019 - RNA, 20 nt, Homo sapiens
ugagugggcuucggagugaa

SEQ ID NO: 13020 - RNA, 24 nt, Homo sapiens
ccacuuccccaucuccccaaguag

SEQ ID NO: 13021 - RNA, 26 nt, Homo sapiens
agagaaggcuauguaaacaaaccaca

SEQ ID NO: 13022 - RNA, 22 nt, Homo sapiens
auuccuccuccaauugguuuaa

SEQ ID NO: 13023 - RNA, 24 nt, Homo sapiens
ccugggaguagcuaguuugcuuuu

SEQ ID NO: 13024 - RNA, 21 nt, Homo sapiens
gacacagacguuaggcauuuc

SEQ ID NO: 13025 - RNA, 17 nt, Homo sapiens
guucaaagacugugaac

SEQ ID NO: 13026 - RNA, 18 nt, Homo sapiens
ugacucucaccuguacua

SEQ ID NO: 13027 - RNA, 22 nt, Homo sapiens
acuaacuucuaagaugauuuca

SEQ ID NO: 13028 - RNA, 22 nt, Homo sapiens
gcagguagcuucuuuuuucuca

SEQ ID NO: 13029 - RNA, 19 nt, Homo sapiens
guaguuaccauacagauua

SEQ ID NO: 13030 - RNA, 21 nt, Homo sapiens
uguuuguuccccgggacuuca

SEQ ID NO: 13031 - RNA, 23 nt, Homo sapiens
cugaggauuuuaacauugugaua

SEQ ID NO: 13032 - RNA, 22 nt, Homo sapiens
uacuuuaucauguuuucaugau

SEQ ID NO: 13033 - RNA, 21 nt, Homo sapiens
ugaauuuuggcaugaugacug

SEQ ID NO: 13034 - RNA, 20 nt, Homo sapiens
cgccggccggccagcaccca

SEQ ID NO: 13035 - RNA, 17 nt, Homo sapiens
ucugugggaaauggaga

SEQ ID NO: 13036 - RNA, 18 nt, Homo sapiens
caggguugcugacccuua

SEQ ID NO: 13037 - RNA, 21 nt, Homo sapiens
cucuuucucuguacagucuca

SEQ ID NO: 13038 - RNA, 21 nt, Homo sapiens
gccuguucucagcaguagaga

SEQ ID NO: 13039 - RNA, 18 nt, Homo sapiens
gggccagaugcccugcca

SEQ ID NO: 13040 - RNA, 21 nt, Homo sapiens
acgugggaaucacacccucca

SEQ ID NO: 13041 - RNA, 19 nt, Homo sapiens
cagaccucccacagcucca

SEQ ID NO: 13042 - RNA, 25 nt, Homo sapiens
acaucuagcuuugacaaucauagua

SEQ ID NO: 13043 - RNA, 20 nt, Homo sapiens
ccuuuuucuuuuucuccccu

SEQ ID NO: 13044 - RNA, 26 nt, Homo sapiens
gggacauguaccacggcggccaaagc

SEQ ID NO: 13045 - RNA, 25 nt, Homo sapiens
uacuauugguguguuggugaauuuu

SEQ ID NO: 13046 - RNA, 20 nt, Homo sapiens
ugagcucuuuuuuccccccc

SEQ ID NO: 13047 - RNA, 25 nt, Homo sapiens
ugggggggugucaaagaacuugaca

SEQ ID NO: 13048 - RNA, 21 nt, Homo sapiens
guccugaacugauuuuuguga

SEQ ID NO: 13049 - RNA, 24 nt, Homo sapiens
aaacaaaacaaaacagaaaaauca

SEQ ID NO: 13050 - RNA, 19 nt, Homo sapiens
cuaaaaauaccacagaugg

SEQ ID NO: 13051 - RNA, 24 nt, Homo sapiens
gcugaaauggcuguuggcaguucu

SEQ ID NO: 13052 - RNA, 20 nt, Homo sapiens
aguuugaacgucagugucac

SEQ ID NO: 13053 - RNA, 23 nt, Homo sapiens
cagcaucuggaagacuuuccucu

SEQ ID NO: 13054 - RNA, 21 nt, Homo sapiens
uuccugguugcacucuguaga

SEQ ID NO: 13055 - RNA, 19 nt, Homo sapiens
uuccuugggaaccuaggga

SEQ ID NO: 13056 - RNA, 18 nt, Homo sapiens
acugcuucucugcucuga

SEQ ID NO: 13057 - RNA, 17 nt, Homo sapiens
ccgcucccucaggaguc

SEQ ID NO: 13058 - RNA, 23 nt, Homo sapiens
aaagagacuuccucuuggcguuc

SEQ ID NO: 13059 - RNA, 22 nt, Homo sapiens
aagagacuuccucuuggcguuc

SEQ ID NO: 13060 - RNA, 17 nt, Homo sapiens
aggaaacacagauucuu

SEQ ID NO: 13061 - RNA, 18 nt, Homo sapiens
ccuucucuuuacucucca

SEQ ID NO: 13062 - RNA, 18 nt, Homo sapiens
ggcuuuugccccacuuug

SEQ ID NO: 13063 - RNA, 18 nt, Homo sapiens
uccgccucuuggguucaa

SEQ ID NO: 13064 - RNA, 23 nt, Homo sapiens
uugucuuccccauguucauagcu

SEQ ID NO: 13065 - RNA, 23 nt, Homo sapiens
agggcgggaaucagaccuacucc

SEQ ID NO: 13066 - RNA, 18 nt, Homo sapiens
auugucuaaaugaggccu

SEQ ID NO: 13067 - RNA, 23 nt, Homo sapiens
ccucugggcuugaccaguuccca

SEQ ID NO: 13068 - RNA, 20 nt, Homo sapiens
ugggcccugccaaggcgaca

SEQ ID NO: 13069 - RNA, 19 nt, Homo sapiens
ugggagucucccugccuca

SEQ ID NO: 13070 - RNA, 21 nt, Homo sapiens
uguagcagccuccuggacuuc

SEQ ID NO: 13071 - RNA, 26 nt, Homo sapiens
aaacagauauuguaccauguaccuaa

SEQ ID NO: 13072 - RNA, 25 nt, Homo sapiens
ccccgcccgguccgcccccgcggcu

SEQ ID NO: 13073 - RNA, 17 nt, Homo sapiens
gcgcgccgcggcgcugu

SEQ ID NO: 13074 - RNA, 23 nt, Homo sapiens
gcgucuggccagccgcgagcucu

SEQ ID NO: 13075 - RNA, 21 nt, Homo sapiens
ugcuguuaauguauacuacug

SEQ ID NO: 13076 - RNA, 19 nt, Homo sapiens
uuuucaugcuuccagguaa

SEQ ID NO: 13077 - RNA, 22 nt, Homo sapiens
aaggacuaacauuuuuaaguua

SEQ ID NO: 13078 - RNA, 22 nt, Homo sapiens
auaaguggauacaaccacucua

SEQ ID NO: 13079 - RNA, 17 nt, Homo sapiens
augcaagaugcucugau

SEQ ID NO: 13080 - RNA, 22 nt, Homo sapiens
caaugcaagaugcucugauagc

SEQ ID NO: 13081 - RNA, 22 nt, Homo sapiens
cuaagaugguaacugugugauu

SEQ ID NO: 13082 - RNA, 16 nt, Homo sapiens
gcaagaugcucugaua

SEQ ID NO: 13083 - RNA, 19 nt, Homo sapiens
gugauaaaacaacauggua

SEQ ID NO: 13084 - RNA, 17 nt, Homo sapiens
ugaugagguaauaauca

SEQ ID NO: 13085 - RNA, 18 nt, Homo sapiens
uucuccugccucagccuu

SEQ ID NO: 13086 - RNA, 19 nt, Homo sapiens
gccccugacucuaagcuga

SEQ ID NO: 13087 - RNA, 21 nt, Homo sapiens
auccugcccugcagucacaug

SEQ ID NO: 13088 - RNA, 20 nt, Homo sapiens
ccacagccccgcuguggucc

SEQ ID NO: 13089 - RNA, 17 nt, Homo sapiens
uccagaaaugcucccca

SEQ ID NO: 13090 - RNA, 17 nt, Homo sapiens
gcgucugcgacgggaga

SEQ ID NO: 13091 - RNA, 19 nt, Homo sapiens
gccagcgccuuccacucca

SEQ ID NO: 13092 - RNA, 21 nt, Homo sapiens
uuucauuguuuugccuucaaa

SEQ ID NO: 13093 - RNA, 18 nt, Homo sapiens
uuugacuugacuugcgaa

SEQ ID NO: 13094 - RNA, 23 nt, Homo sapiens
ggaagaggaggcugagaggguca

SEQ ID NO: 13095 - RNA, 21 nt, Homo sapiens
aauacagauauauacaaauau

SEQ ID NO: 13096 - RNA, 18 nt, Homo sapiens
accaaaacggguuaauca

SEQ ID NO: 13097 - RNA, 18 nt, Homo sapiens
aucucgugcaugaagcug

SEQ ID NO: 13098 - RNA, 23 nt, Homo sapiens
augucauugauauaauuucccua

SEQ ID NO: 13099 - RNA, 18 nt, Homo sapiens
cacuuuggaaucacccca

SEQ ID NO: 13100 - RNA, 20 nt, Homo sapiens
gccaauaauacaaacccguu

SEQ ID NO: 13101 - RNA, 21 nt, Homo sapiens
gcccauggaggaggcucuuga

SEQ ID NO: 13102 - RNA, 17 nt, Homo sapiens
uuucuguucacucacac

SEQ ID NO: 13103 - RNA, 21 nt, Homo sapiens
auggcuuggcaggaacucugg

SEQ ID NO: 13104 - RNA, 20 nt, Homo sapiens
cagccuacuauaucuacaua

SEQ ID NO: 13105 - RNA, 17 nt, Homo sapiens
ccagauggcugccccag

SEQ ID NO: 13106 - RNA, 21 nt, Homo sapiens
cgacaggcaaaagagauuuug

SEQ ID NO: 13107 - RNA, 19 nt, Homo sapiens
uacaaucaugugcaacuuu

SEQ ID NO: 13108 - RNA, 19 nt, Homo sapiens
ucugggucagcuuggcacc

SEQ ID NO: 13109 - RNA, 21 nt, Homo sapiens
ucugucaaucucuuugcaccu

SEQ ID NO: 13110 - RNA, 21 nt, Homo sapiens
acacaugauggccaagugcca

SEQ ID NO: 13111 - RNA, 17 nt, Homo sapiens
cucccuggggcuguuca

SEQ ID NO: 13112 - RNA, 16 nt, Homo sapiens
uugcaaguguucaccu

SEQ ID NO: 13113 - RNA, 20 nt, Homo sapiens
acccugaagaaauccuggga

SEQ ID NO: 13114 - RNA, 21 nt, Homo sapiens
ggaaacgugaaaggcuguggc

SEQ ID NO: 13115 - RNA, 22 nt, Homo sapiens
ccaaccucccacucccaccucc

SEQ ID NO: 13116 - RNA, 21 nt, Homo sapiens
ccccacccagcccccugcagc

SEQ ID NO: 13117 - RNA, 18 nt, Homo sapiens
gagacagagacacagcca

SEQ ID NO: 13118 - RNA, 21 nt, Homo sapiens
gaugaggcuugcggcuguggc

SEQ ID NO: 13119 - RNA, 26 nt, Homo sapiens
uccugcuggccuggaagacucugugg

SEQ ID NO: 13120 - RNA, 17 nt, Homo sapiens
uucugucacuggucuca

SEQ ID NO: 13121 - RNA, 21 nt, Homo sapiens
aguaaguuucuccgaaucccu

SEQ ID NO: 13122 - RNA, 17 nt, Homo sapiens
ucuaaaacaauggagua

SEQ ID NO: 13123 - RNA, 18 nt, Homo sapiens
ugcaaauacaugcauuua

SEQ ID NO: 13124 - RNA, 16 nt, Homo sapiens
ugccauucuccugccu

SEQ ID NO: 13125 - RNA, 20 nt, Homo sapiens
caguauuuuguccuagcagc

SEQ ID NO: 13126 - RNA, 17 nt, Homo sapiens
ccccuccuuauucucca

SEQ ID NO: 13127 - RNA, 18 nt, Homo sapiens
cugagugaacugcuaaua

SEQ ID NO: 13128 - RNA, 19 nt, Homo sapiens
acuguccgaauugacauca

SEQ ID NO: 13129 - RNA, 21 nt, Homo sapiens
caauuccaccccccaccaacc

SEQ ID NO: 13130 - RNA, 22 nt, Homo sapiens
caccccccaccaacccccuucu

SEQ ID NO: 13131 - RNA, 25 nt, Homo sapiens
ccacuuacuuagauaucugcagaua

SEQ ID NO: 13132 - RNA, 17 nt, Homo sapiens
ccaucugcuucuaacgc

SEQ ID NO: 13133 - RNA, 18 nt, Homo sapiens
ucuaacgccuucauggua

SEQ ID NO: 13134 - RNA, 18 nt, Homo sapiens
cucagggaaagcauuuaa

SEQ ID NO: 13135 - RNA, 19 nt, Homo sapiens
gacauucaauaaaguugag

SEQ ID NO: 13136 - RNA, 25 nt, Homo sapiens
auaucccuacugacaguaacuaccu

SEQ ID NO: 13137 - RNA, 18 nt, Homo sapiens
cagauguaaaguuuucua

SEQ ID NO: 13138 - RNA, 21 nt, Homo sapiens
guuagauuuacuggaaaugua

SEQ ID NO: 13139 - RNA, 20 nt, Homo sapiens
ugguaaaagauauuuagcaa

SEQ ID NO: 13140 - RNA, 17 nt, Homo sapiens
uugauguagauuuuacu

SEQ ID NO: 13141 - RNA, 23 nt, Homo sapiens
ccuccuuagcauuuucuuuugua

SEQ ID NO: 13142 - RNA, 18 nt, Homo sapiens
gcagagcccuccugcuca

SEQ ID NO: 13143 - RNA, 19 nt, Homo sapiens
uggccagcucugcauuuga

SEQ ID NO: 13144 - RNA, 18 nt, Homo sapiens
ccagauguuuuaccaguc

SEQ ID NO: 13145 - RNA, 20 nt, Homo sapiens
cccuauauagucacacuuug

SEQ ID NO: 13146 - RNA, 18 nt, Homo sapiens
gcccuggcccaaagccag

SEQ ID NO: 13147 - RNA, 23 nt, Homo sapiens
aaacccaguccaaacaacgccuc

SEQ ID NO: 13148 - RNA, 19 nt, Homo sapiens
caagccggcuacgguauca

SEQ ID NO: 13149 - RNA, 16 nt, Homo sapiens
cacucaccuacacuga

SEQ ID NO: 13150 - RNA, 22 nt, Homo sapiens
ccccccccuuuuccuucuuucc

SEQ ID NO: 13151 - RNA, 19 nt, Homo sapiens
ccuucuuucccccuauccu

SEQ ID NO: 13152 - RNA, 30 nt, Homo sapiens
uagagagcaacccaaccaaaacaaaucaca

SEQ ID NO: 13153 - RNA, 18 nt, Homo sapiens
ugagccuuggaucccuca

SEQ ID NO: 13154 - RNA, 19 nt, Homo sapiens
accgcgacgggcgggcggc

SEQ ID NO: 13155 - RNA, 19 nt, Homo sapiens
aaauuuugacugucagcua

SEQ ID NO: 13156 - RNA, 19 nt, Homo sapiens
cccgcgccgccggccccgc

SEQ ID NO: 13157 - RNA, 20 nt, Homo sapiens
cuguuaugcccuguuugcaa

SEQ ID NO: 13158 - RNA, 18 nt, Homo sapiens
gcccuccgccccgcccca

SEQ ID NO: 13159 - RNA, 23 nt, Homo sapiens
gcccuguuugcaaaaacaauuua

SEQ ID NO: 13160 - RNA, 21 nt, Homo sapiens
uucuccaguguuaaaacuuuu

SEQ ID NO: 13161 - RNA, 19 nt, Homo sapiens
aagcaguucucccaccuca

SEQ ID NO: 13162 - RNA, 15 nt, Homo sapiens
aauguauuagugaau

SEQ ID NO: 13163 - RNA, 19 nt, Homo sapiens
cuugaguucugccucgcuu

SEQ ID NO: 13164 - RNA, 19 nt, Homo sapiens
ucucuguagaaaaccgcac

SEQ ID NO: 13165 - RNA, 23 nt, Homo sapiens
ucucuuucagagcauuuagccuu

SEQ ID NO: 13166 - RNA, 19 nt, Homo sapiens
uguugguguuaauuucuga

SEQ ID NO: 13167 - RNA, 21 nt, Homo sapiens
uucucaauccacccuuuucca

SEQ ID NO: 13168 - RNA, 19 nt, Homo sapiens
cagaggacccugacccucg

SEQ ID NO: 13169 - RNA, 17 nt, Homo sapiens
cccaacccuggauccca

SEQ ID NO: 13170 - RNA, 18 nt, Homo sapiens
cugggcagaguccccugc

SEQ ID NO: 13171 - RNA, 20 nt, Homo sapiens
gcaaaaaaguaaaaugcugc

SEQ ID NO: 13172 - RNA, 19 nt, Homo sapiens
uggucagcauagccgccca

SEQ ID NO: 13173 - RNA, 19 nt, Homo sapiens
aaaaaaacaagacgggccg

SEQ ID NO: 13174 - RNA, 19 nt, Homo sapiens
ccgcccuccucacugcuga

SEQ ID NO: 13175 - RNA, 19 nt, Homo sapiens
uggguggaucacuugaggc

SEQ ID NO: 13176 - RNA, 23 nt, Homo sapiens
augucaccaacaggaugauguca

SEQ ID NO: 13177 - RNA, 21 nt, Homo sapiens
ccagaugcuaaagugauucaa

SEQ ID NO: 13178 - RNA, 22 nt, Homo sapiens
gagccaagaucguaccacugca

SEQ ID NO: 13179 - RNA, 21 nt, Homo sapiens
gcuacaauauacaguucaggc

SEQ ID NO: 13180 - RNA, 21 nt, Homo sapiens
auuugaccagauuguuuggcu

SEQ ID NO: 13181 - RNA, 22 nt, Homo sapiens
acaagucuugaaucaguccuca

SEQ ID NO: 13182 - RNA, 21 nt, Homo sapiens
augaacccaggccacuagucu

SEQ ID NO: 13183 - RNA, 21 nt, Homo sapiens
cagaauuuaccucaucucaca

SEQ ID NO: 13184 - RNA, 17 nt, Homo sapiens
ccagaggaugcagggaa

SEQ ID NO: 13185 - RNA, 19 nt, Homo sapiens
ccgcccccgccaaaccuca

SEQ ID NO: 13186 - RNA, 20 nt, Homo sapiens
cucagcccgguaagcugcag

SEQ ID NO: 13187 - RNA, 18 nt, Homo sapiens
cugggugggggucugugg

SEQ ID NO: 13188 - RNA, 18 nt, Homo sapiens
gcagcucugcucaacugc

SEQ ID NO: 13189 - RNA, 21 nt, Homo sapiens
guuggacguguccgucugucc

SEQ ID NO: 13190 - RNA, 19 nt, Homo sapiens
guuuucugccacaccccca

SEQ ID NO: 13191 - RNA, 19 nt, Homo sapiens
ucaacugcgucuucucuca

SEQ ID NO: 13192 - RNA, 21 nt, Homo sapiens
ucugcugaugggaaggcagag

SEQ ID NO: 13193 - RNA, 22 nt, Homo sapiens
uugaugcacagaauuuaccuca

SEQ ID NO: 13194 - RNA, 19 nt, Homo sapiens
aagcaauucuccugccuca

SEQ ID NO: 13195 - RNA, 25 nt, Homo sapiens
acuugggcugcacagauccugggcc

SEQ ID NO: 13196 - RNA, 17 nt, Homo sapiens
aaaggaagcuagcugcu

SEQ ID NO: 13197 - RNA, 16 nt, Homo sapiens
cgcuuaaaucauguga

SEQ ID NO: 13198 - RNA, 18 nt, Homo sapiens
gucaccagauucauuaca

SEQ ID NO: 13199 - RNA, 22 nt, Homo sapiens
cacccccucacccccuucuuuu

SEQ ID NO: 13200 - RNA, 22 nt, Homo sapiens
caggguuggugggggucaguca

SEQ ID NO: 13201 - RNA, 21 nt, Homo sapiens
ccaccucagugcccacagcca

SEQ ID NO: 13202 - RNA, 18 nt, Homo sapiens
ucauuuucuuuuugaucu

SEQ ID NO: 13203 - RNA, 19 nt, Homo sapiens
uucuaccugaggaggcugc

SEQ ID NO: 13204 - RNA, 22 nt, Homo sapiens
uucugaugagaaaggccugagg

SEQ ID NO: 13205 - RNA, 22 nt, Homo sapiens
uuuuguuugggggcuuugugga

SEQ ID NO: 13206 - RNA, 19 nt, Homo sapiens
agauuaggauaaguaagcu

SEQ ID NO: 13207 - RNA, 19 nt, Homo sapiens
cugaaaugcauuuuccucu

SEQ ID NO: 13208 - RNA, 19 nt, Homo sapiens
cuuuucagcacuuaauuuu

SEQ ID NO: 13209 - RNA, 19 nt, Homo sapiens
gcgcgaggggcggccggga

SEQ ID NO: 13210 - RNA, 24 nt, Homo sapiens
ucugcuuuucuccucucuguuccu

SEQ ID NO: 13211 - RNA, 24 nt, Homo sapiens
gagggcagggauugugucugguua

SEQ ID NO: 13212 - RNA, 21 nt, Homo sapiens
ugcugucccccugcagacugc

SEQ ID NO: 13213 - RNA, 19 nt, Homo sapiens
uuggcucagaagucaccuc

SEQ ID NO: 13214 - RNA, 16 nt, Homo sapiens
cugaacugcucuggcu

SEQ ID NO: 13215 - RNA, 18 nt, Homo sapiens
gagguccgaucuggaaca

SEQ ID NO: 13216 - RNA, 20 nt, Homo sapiens
gccuuuguucccaagaccca

SEQ ID NO: 13217 - RNA, 19 nt, Homo sapiens
guugcacauuuguuuuuaa

SEQ ID NO: 13218 - RNA, 16 nt, Homo sapiens
ucauuucugucaaacu

SEQ ID NO: 13219 - RNA, 26 nt, Homo sapiens
ugaauguagauuuuacugugaagcua

SEQ ID NO: 13220 - RNA, 19 nt, Homo sapiens
acugaguccccucaccuga

SEQ ID NO: 13221 - RNA, 19 nt, Homo sapiens
ccaccucuuuuuccauucc

SEQ ID NO: 13222 - RNA, 22 nt, Homo sapiens
cggaggaagcaccucugccucc

SEQ ID NO: 13223 - RNA, 19 nt, Homo sapiens
gacacugcccugcuuccuc

SEQ ID NO: 13224 - RNA, 16 nt, Homo sapiens
accuuccuggacugca

SEQ ID NO: 13225 - RNA, 18 nt, Homo sapiens
auuacauuucagcucuca

SEQ ID NO: 13226 - RNA, 19 nt, Homo sapiens
cuucaaaucagacauuaca

SEQ ID NO: 13227 - RNA, 25 nt, Homo sapiens
cuuuuucacuuaagugcuuuaguuu

SEQ ID NO: 13228 - RNA, 19 nt, Homo sapiens
gccagaccaaagcaccuuc

SEQ ID NO: 13229 - RNA, 22 nt, Homo sapiens
gcuguaaagauguaaguugugu

SEQ ID NO: 13230 - RNA, 23 nt, Homo sapiens
ucuuaggauuuaggauugcugua

SEQ ID NO: 13231 - RNA, 19 nt, Homo sapiens
uugccuaauguaguuuaug

SEQ ID NO: 13232 - RNA, 17 nt, Homo sapiens
uugggcaggucuuugaa

SEQ ID NO: 13233 - RNA, 18 nt, Homo sapiens
uuuaaguauuugaugauc

SEQ ID NO: 13234 - RNA, 22 nt, Homo sapiens
auuugaauugaggcuuuggccu

SEQ ID NO: 13235 - RNA, 20 nt, Homo sapiens
cuggaagcccccucugccuc

SEQ ID NO: 13236 - RNA, 21 nt, Homo sapiens
cuggaagcccccucugccucc

SEQ ID NO: 13237 - RNA, 21 nt, Homo sapiens
aaacaaucuuaacuaugcaca

SEQ ID NO: 13238 - RNA, 19 nt, Homo sapiens
augcauuuugagcauuuca

SEQ ID NO: 13239 - RNA, 22 nt, Homo sapiens
caaacaaucuuaacuaugcaca

SEQ ID NO: 13240 - RNA, 16 nt, Homo sapiens
cccagggcagcugcca

SEQ ID NO: 13241 - RNA, 22 nt, Homo sapiens
ggaaaugagaccugguggaaua

SEQ ID NO: 13242 - RNA, 23 nt, Homo sapiens
uccuggaaaugagaccuggugga

SEQ ID NO: 13243 - RNA, 21 nt, Homo sapiens
cacugucauaaccagugcucu

SEQ ID NO: 13244 - RNA, 20 nt, Homo sapiens
cagagucuacacagacgccu

SEQ ID NO: 13245 - RNA, 19 nt, Homo sapiens
gccuaaaaucuuaggucau

SEQ ID NO: 13246 - RNA, 21 nt, Homo sapiens
gggguccucugggauuaguua

SEQ ID NO: 13247 - RNA, 24 nt, Homo sapiens
agccuggccaacauggcaaaacca

SEQ ID NO: 13248 - RNA, 19 nt, Homo sapiens
auuuucggcaaccgcugcu

SEQ ID NO: 13249 - RNA, 21 nt, Homo sapiens
cauggcaaaaccaucucuacu

SEQ ID NO: 13250 - RNA, 18 nt, Homo sapiens
ccuuccauuuuccuucca

SEQ ID NO: 13251 - RNA, 23 nt, Homo sapiens
gcaguuuugccagguguuuguua

SEQ ID NO: 13252 - RNA, 23 nt, Homo sapiens
acccagaguggcccaagacuccc

SEQ ID NO: 13253 - RNA, 22 nt, Homo sapiens
caucauuagcaugaaccaccca

SEQ ID NO: 13254 - RNA, 18 nt, Homo sapiens
ccaagucauccucccacc

SEQ ID NO: 13255 - RNA, 23 nt, Homo sapiens
aagguauacuaaauaauauauca

SEQ ID NO: 13256 - RNA, 20 nt, Homo sapiens
aggcucccacugcuacuacu

SEQ ID NO: 13257 - RNA, 16 nt, Homo sapiens
gcccagaaggcaccag

SEQ ID NO: 13258 - RNA, 18 nt, Homo sapiens
cggggcccaugcccgugc

SEQ ID NO: 13259 - RNA, 18 nt, Homo sapiens
gcccggugccucucagga

SEQ ID NO: 13260 - RNA, 24 nt, Homo sapiens
gcuucucuguggguacgugccccu

SEQ ID NO: 13261 - RNA, 18 nt, Homo sapiens
gcuuugcccgccuggccc

SEQ ID NO: 13262 - RNA, 26 nt, Homo sapiens
gugccauaguuuuauuaacuccauua

SEQ ID NO: 13263 - RNA, 23 nt, Homo sapiens
uguugccuugccacguccuguca

SEQ ID NO: 13264 - RNA, 19 nt, Homo sapiens
agaucaccagcccggccug

SEQ ID NO: 13265 - RNA, 16 nt, Homo sapiens
gccccuucccaucucu

SEQ ID NO: 13266 - RNA, 22 nt, Homo sapiens
acuggaagaguagaauaucaua

SEQ ID NO: 13267 - RNA, 19 nt, Homo sapiens
cacucucaccaagucacca

SEQ ID NO: 13268 - RNA, 20 nt, Homo sapiens
caugcugggcauccuaggcc

SEQ ID NO: 13269 - RNA, 21 nt, Homo sapiens
cucucuccucacucugccucu

SEQ ID NO: 13270 - RNA, 22 nt, Homo sapiens
gcuugggaaccaccccuggccu

SEQ ID NO: 13271 - RNA, 18 nt, Homo sapiens
uaacagucugcuccccuc

SEQ ID NO: 13272 - RNA, 22 nt, Homo sapiens
uaucauauagggaagaaaccuu

SEQ ID NO: 13273 - RNA, 18 nt, Homo sapiens
ucaugauuuuccguuaca

SEQ ID NO: 13274 - RNA, 18 nt, Homo sapiens
aacauguagggcaagagg

SEQ ID NO: 13275 - RNA, 19 nt, Homo sapiens
aagaggagaugugaucagg

SEQ ID NO: 13276 - RNA, 19 nt, Homo sapiens
ggccccgccuuuuccccca

SEQ ID NO: 13277 - RNA, 20 nt, Homo sapiens
ugucccucagcaacauccca

SEQ ID NO: 13278 - RNA, 19 nt, Homo sapiens
uagcaauacaaacuaguug

SEQ ID NO: 13279 - RNA, 19 nt, Homo sapiens
agacagcugcucagagcca

SEQ ID NO: 13280 - RNA, 23 nt, Homo sapiens
aucugagccagcaccgccggcuu

SEQ ID NO: 13281 - RNA, 20 nt, Homo sapiens
uugagucuauuuuuguacaa

SEQ ID NO: 13282 - RNA, 23 nt, Homo sapiens
aucuggguuaauucauuugguuc

SEQ ID NO: 13283 - RNA, 19 nt, Homo sapiens
auguuaccuuuucaucccc

SEQ ID NO: 13284 - RNA, 18 nt, Homo sapiens
cgcucuuuucaaucucuu

SEQ ID NO: 13285 - RNA, 16 nt, Homo sapiens
cucagagaccaauaaa

SEQ ID NO: 13286 - RNA, 17 nt, Homo sapiens
uccgaaaacuuccauug

SEQ ID NO: 13287 - RNA, 21 nt, Homo sapiens
ucugaaaacccaaggccaggu

SEQ ID NO: 13288 - RNA, 20 nt, Homo sapiens
ucuuuucaaucucuuaaucu

SEQ ID NO: 13289 - RNA, 23 nt, Homo sapiens
aaaacuguauuaaaaugcauuga

SEQ ID NO: 13290 - RNA, 17 nt, Homo sapiens
uguauuaaaaugcauug

SEQ ID NO: 13291 - RNA, 23 nt, Homo sapiens
agaaaggaaaucccagcuuuccc

SEQ ID NO: 13292 - RNA, 20 nt, Homo sapiens
ugaggaaugaaaggaaccca

SEQ ID NO: 13293 - RNA, 19 nt, Homo sapiens
agcugaccgggcucacuug

SEQ ID NO: 13294 - RNA, 21 nt, Homo sapiens
ccaugcucuuguucuguuccu

SEQ ID NO: 13295 - RNA, 19 nt, Homo sapiens
cucuaaagaccauguugga

SEQ ID NO: 13296 - RNA, 21 nt, Homo sapiens
gucccuuuuaguuugaucaga

SEQ ID NO: 13297 - RNA, 23 nt, Homo sapiens
ucaaaacacuuccagucuggaga

SEQ ID NO: 13298 - RNA, 18 nt, Homo sapiens
ccuccugggaucuguggg

SEQ ID NO: 13299 - RNA, 22 nt, Homo sapiens
ccaagaguaacccucccauccc

SEQ ID NO: 13300 - RNA, 18 nt, Homo sapiens
gaguaacccucccauccc

SEQ ID NO: 13301 - RNA, 20 nt, Homo sapiens
aaaacaggaacccaccaaac

SEQ ID NO: 13302 - RNA, 21 nt, Homo sapiens
acacacaaaccagccucaacu

SEQ ID NO: 13303 - RNA, 20 nt, Homo sapiens
ccagggcguuaaauucacag

SEQ ID NO: 13304 - RNA, 23 nt, Homo sapiens
cccuccccuccccuucuucucca

SEQ ID NO: 13305 - RNA, 19 nt, Homo sapiens
gcuagucacaccuauuuga

SEQ ID NO: 13306 - RNA, 17 nt, Homo sapiens
ggaaaacaggaacccac

SEQ ID NO: 13307 - RNA, 19 nt, Homo sapiens
aaacaaacaaaacaaagaa

SEQ ID NO: 13308 - RNA, 17 nt, Homo sapiens
acaaaaauuagccaagu

SEQ ID NO: 13309 - RNA, 21 nt, Homo sapiens
agccuuucguguuuuuccaca

SEQ ID NO: 13310 - RNA, 23 nt, Homo sapiens
cacaaacccuccauccacuuccc

SEQ ID NO: 13311 - RNA, 20 nt, Homo sapiens
cuucccauuuccucugcccu

SEQ ID NO: 13312 - RNA, 21 nt, Homo sapiens
gccuggaucgcucgaccuggc

SEQ ID NO: 13313 - RNA, 25 nt, Homo sapiens
gcgacacaucugaucagcuguggug

SEQ ID NO: 13314 - RNA, 18 nt, Homo sapiens
guuuaagcuucucuguac

SEQ ID NO: 13315 - RNA, 19 nt, Homo sapiens
ucuuuuugacuuccaacug

SEQ ID NO: 13316 - RNA, 17 nt, Homo sapiens
uuuucagaaccacguca

SEQ ID NO: 13317 - RNA, 19 nt, Homo sapiens
aaggguuuggucuaagcug

SEQ ID NO: 13318 - RNA, 24 nt, Homo sapiens
aucaaacacaggugcacucagcug

SEQ ID NO: 13319 - RNA, 20 nt, Homo sapiens
cagcugggaguguccaucau

SEQ ID NO: 13320 - RNA, 19 nt, Homo sapiens
ucaaacacaggugcacuca

SEQ ID NO: 13321 - RNA, 22 nt, Homo sapiens
ucguaccagcaaguagacuagg

SEQ ID NO: 13322 - RNA, 18 nt, Homo sapiens
ugguccuugggagcucug

SEQ ID NO: 13323 - RNA, 19 nt, Homo sapiens
cuucccucuaccuccccca

SEQ ID NO: 13324 - RNA, 24 nt, Homo sapiens
uuuuuugcccaccugccuugauuu

SEQ ID NO: 13325 - RNA, 18 nt, Homo sapiens
gccccgugccgccgccgc

SEQ ID NO: 13326 - RNA, 24 nt, Homo sapiens
gccuuccggccgaccgcccggcuu

SEQ ID NO: 13327 - RNA, 21 nt, Homo sapiens
auccacuuuguacauaaguua

SEQ ID NO: 13328 - RNA, 21 nt, Homo sapiens
ggcuucuguauguaguauuuu

SEQ ID NO: 13329 - RNA, 23 nt, Homo sapiens
ugaagaaucuuucagucauagua

SEQ ID NO: 13330 - RNA, 19 nt, Homo sapiens
uucugaaguaaaggcuugu

SEQ ID NO: 13331 - RNA, 20 nt, Homo sapiens
ggcucccugcucucauuuua

SEQ ID NO: 13332 - RNA, 18 nt, Homo sapiens
guguaguugaaacaguca

SEQ ID NO: 13333 - RNA, 20 nt, Homo sapiens
uacccacacacauacacaca

SEQ ID NO: 13334 - RNA, 20 nt, Homo sapiens
uugauugggacuggggcuga

SEQ ID NO: 13335 - RNA, 17 nt, Homo sapiens
ugauuucaaacacuuuu

SEQ ID NO: 13336 - RNA, 18 nt, Homo sapiens
auuuuuuuccacuaccca

SEQ ID NO: 13337 - RNA, 21 nt, Homo sapiens
cugaauugaguuacuuugaua

SEQ ID NO: 13338 - RNA, 17 nt, Homo sapiens
gcagugauuaaccaaga

SEQ ID NO: 13339 - RNA, 20 nt, Homo sapiens
gccaaacugaauaaaacugu

SEQ ID NO: 13340 - RNA, 21 nt, Homo sapiens
gccuuaggagcaaauguagua

SEQ ID NO: 13341 - RNA, 20 nt, Homo sapiens
ucuuauguacucaugcaugg

SEQ ID NO: 13342 - RNA, 25 nt, Homo sapiens
gggaacguggugcggcggcggcggc

SEQ ID NO: 13343 - RNA, 20 nt, Homo sapiens
ucagcagcggcaacaagugc

SEQ ID NO: 13344 - RNA, 22 nt, Homo sapiens
uugguuuccuggugguaucaua

SEQ ID NO: 13345 - RNA, 18 nt, Homo sapiens
aggguccgggcccggccg

SEQ ID NO: 13346 - RNA, 22 nt, Homo sapiens
cuucuucucgggucuugguccu

SEQ ID NO: 13347 - RNA, 20 nt, Homo sapiens
acauuuuguaauuuuccuca

SEQ ID NO: 13348 - RNA, 18 nt, Homo sapiens
aucaauauuaacacuuga

SEQ ID NO: 13349 - RNA, 19 nt, Homo sapiens
ggccacuuuacgcaacuca

SEQ ID NO: 13350 - RNA, 19 nt, Homo sapiens
ucaacuuuuagccugcuca

SEQ ID NO: 13351 - RNA, 19 nt, Homo sapiens
agagugcugccucuaucca

SEQ ID NO: 13352 - RNA, 16 nt, Homo sapiens
auccugguaucauugc

SEQ ID NO: 13353 - RNA, 19 nt, Homo sapiens
ccugagucgggaggccugc

SEQ ID NO: 13354 - RNA, 23 nt, Homo sapiens
gguggguggagggguuugcagug

SEQ ID NO: 13355 - RNA, 20 nt, Homo sapiens
ccacgccgaccccuccccuc

SEQ ID NO: 13356 - RNA, 21 nt, Homo sapiens
cccgcuuuuacccuccccacc

SEQ ID NO: 13357 - RNA, 18 nt, Homo sapiens
acacuccuccuugcgcac

SEQ ID NO: 13358 - RNA, 23 nt, Homo sapiens
ucucuucucucucuuuuaauuuu

SEQ ID NO: 13359 - RNA, 19 nt, Homo sapiens
gggcggggcgaacccugcc

SEQ ID NO: 13360 - RNA, 26 nt, Homo sapiens
aaaacaacagaugggggguuugugga

SEQ ID NO: 13361 - RNA, 24 nt, Homo sapiens
caaucuugacuuguuuuugcagua

SEQ ID NO: 13362 - RNA, 17 nt, Homo sapiens
cuuccccuucccuuucc

SEQ ID NO: 13363 - RNA, 19 nt, Homo sapiens
guuugcuuuugccacuuuc

SEQ ID NO: 13364 - RNA, 20 nt, Homo sapiens
ugauaaagaucaucaguuuu

SEQ ID NO: 13365 - RNA, 24 nt, Homo sapiens
gaaagaacagagauuacccuuuca

SEQ ID NO: 13366 - RNA, 16 nt, Homo sapiens
gaauguauuuggaaua

SEQ ID NO: 13367 - RNA, 24 nt, Homo sapiens
uccuguucuguaagaucagauguu

SEQ ID NO: 13368 - RNA, 21 nt, Homo sapiens
uugguaugguuggaguguagg

SEQ ID NO: 13369 - RNA, 20 nt, Homo sapiens
cagaaaagacaaacauuuca

SEQ ID NO: 13370 - RNA, 18 nt, Homo sapiens
gccagggaagccaacccc

SEQ ID NO: 13371 - RNA, 18 nt, Homo sapiens
uagucucgaguuuuuuuu

SEQ ID NO: 13372 - RNA, 19 nt, Homo sapiens
aauaaaauccuaugaaauc

SEQ ID NO: 13373 - RNA, 19 nt, Homo sapiens
ccccgcccugggcugcagc

SEQ ID NO: 13374 - RNA, 24 nt, Homo sapiens
uaccccauccagaacauucuugga

SEQ ID NO: 13375 - RNA, 19 nt, Homo sapiens
ugcccagagcgugucccag

SEQ ID NO: 13376 - RNA, 21 nt, Homo sapiens
uggaggcggcgguggcacuga

SEQ ID NO: 13377 - RNA, 21 nt, Homo sapiens
ugggagccucugggcucggca

SEQ ID NO: 13378 - RNA, 18 nt, Homo sapiens
ucuuuuucacuuuacuuu

SEQ ID NO: 13379 - RNA, 19 nt, Homo sapiens
acagcugacugaucagacu

SEQ ID NO: 13380 - RNA, 20 nt, Homo sapiens
ccuaagucuccuuuucuuca

SEQ ID NO: 13381 - RNA, 20 nt, Homo sapiens
auuuuccagauacuugcuuu

SEQ ID NO: 13382 - RNA, 21 nt, Homo sapiens
cuuuguacuuucuuuaaucuu

SEQ ID NO: 13383 - RNA, 18 nt, Homo sapiens
ucauuacuucauguguca

SEQ ID NO: 13384 - RNA, 20 nt, Homo sapiens
agaagauaugaaucucugag

SEQ ID NO: 13385 - RNA, 22 nt, Homo sapiens
ggcauuuggcaauucuuagaga

SEQ ID NO: 13386 - RNA, 23 nt, Homo sapiens
ucacagaauacuaaagcaccuca

SEQ ID NO: 13387 - RNA, 16 nt, Homo sapiens
ucccaaaaugucagaa

SEQ ID NO: 13388 - RNA, 23 nt, Homo sapiens
uccgguugucacaauuggaggga

SEQ ID NO: 13389 - RNA, 21 nt, Homo sapiens
aaagugcuaauaauaaucuca

SEQ ID NO: 13390 - RNA, 19 nt, Homo sapiens
aaauaaaaguucuacuuca

SEQ ID NO: 13391 - RNA, 26 nt, Homo sapiens
caagguugugacguucgagcuuaguu

SEQ ID NO: 13392 - RNA, 19 nt, Homo sapiens
cccacucgugauaagucaa

SEQ ID NO: 13393 - RNA, 17 nt, Homo sapiens
ccugauuuuaauuguga

SEQ ID NO: 13394 - RNA, 16 nt, Homo sapiens
uaaauccaaagucccc

SEQ ID NO: 13395 - RNA, 28 nt, Homo sapiens
uaugacccugauuuuaauugugaaauua

SEQ ID NO: 13396 - RNA, 21 nt, Homo sapiens
ucaggauucuaauagcuacau

SEQ ID NO: 13397 - RNA, 18 nt, Homo sapiens
uuccuagagaacugucca

SEQ ID NO: 13398 - RNA, 22 nt, Homo sapiens
uuccuauuuuauacucauggaa

SEQ ID NO: 13399 - RNA, 21 nt, Homo sapiens
uugcccacucgugauaaguca

SEQ ID NO: 13400 - RNA, 21 nt, Homo sapiens
aacaaaaacagcaguuuguga

SEQ ID NO: 13401 - RNA, 16 nt, Homo sapiens
agccuguaaacggugc

SEQ ID NO: 13402 - RNA, 18 nt, Homo sapiens
caauuuggaaggcauuga

SEQ ID NO: 13403 - RNA, 20 nt, Homo sapiens
ucucauaggguugugugauu

SEQ ID NO: 13404 - RNA, 17 nt, Homo sapiens
uaagaucaggaggccca

SEQ ID NO: 13405 - RNA, 16 nt, Homo sapiens
agaaguaaacagguca

SEQ ID NO: 13406 - RNA, 21 nt, Homo sapiens
cuguucaaaggcauuaucugu

SEQ ID NO: 13407 - RNA, 18 nt, Homo sapiens
ugugaaacaacuacauua

SEQ ID NO: 13408 - RNA, 25 nt, Homo sapiens
uuucagcaaauuuuaaaacauuuuu

SEQ ID NO: 13409 - RNA, 18 nt, Homo sapiens
gaauaauugaagucccuu

SEQ ID NO: 13410 - RNA, 21 nt, Homo sapiens
uccagcuaagagggcccaucu

SEQ ID NO: 13411 - RNA, 16 nt, Homo sapiens
ucucaccucuuuccua

SEQ ID NO: 13412 - RNA, 25 nt, Homo sapiens
uguaauugagaaaauguucaccaaa

SEQ ID NO: 13413 - RNA, 26 nt, Homo sapiens
aaaauuauaccauuggcaugaagcug

SEQ ID NO: 13414 - RNA, 23 nt, Homo sapiens
acuaugacuguaugauuauuuua

SEQ ID NO: 13415 - RNA, 17 nt, Homo sapiens
uagaacagauggcacua

SEQ ID NO: 13416 - RNA, 22 nt, Homo sapiens
ucuugguguauaguucugugaa

SEQ ID NO: 13417 - RNA, 17 nt, Homo sapiens
aauaugucuuaacuauu

SEQ ID NO: 13418 - RNA, 22 nt, Homo sapiens
aucuuggcucacugcaaccucu

SEQ ID NO: 13419 - RNA, 20 nt, Homo sapiens
ccucugccuccuggguucaa

SEQ ID NO: 13420 - RNA, 20 nt, Homo sapiens
cucagauaguacugaacccu

SEQ ID NO: 13421 - RNA, 21 nt, Homo sapiens
uaccuaacuucuaguguagua

SEQ ID NO: 13422 - RNA, 20 nt, Homo sapiens
uagaauuucuauaucuaguc

SEQ ID NO: 13423 - RNA, 23 nt, Homo sapiens
uagaguuggcaguuaaugcugaa

SEQ ID NO: 13424 - RNA, 18 nt, Homo sapiens
ucucacucugucauuguu

SEQ ID NO: 13425 - RNA, 20 nt, Homo sapiens
uggccaggcuggucuugaac

SEQ ID NO: 13426 - RNA, 19 nt, Homo sapiens
uguguagaguuuuugauua

SEQ ID NO: 13427 - RNA, 18 nt, Homo sapiens
aaaguuggggggugggaa

SEQ ID NO: 13428 - RNA, 28 nt, Homo sapiens
auuugauacuauaauagaaugagacaua

SEQ ID NO: 13429 - RNA, 18 nt, Homo sapiens
gcgcgcggcggccguggc

SEQ ID NO: 13430 - RNA, 19 nt, Homo sapiens
acagcacuccaggccagcu

SEQ ID NO: 13431 - RNA, 26 nt, Homo sapiens
cuuggguaaguacgcaacuuacuuuu

SEQ ID NO: 13432 - RNA, 19 nt, Homo sapiens
aggucuuauagauuccuga

SEQ ID NO: 13433 - RNA, 19 nt, Homo sapiens
ugaggaauacagugagcag

SEQ ID NO: 13434 - RNA, 19 nt, Homo sapiens
agggaccuggacucccccu

SEQ ID NO: 13435 - RNA, 23 nt, Homo sapiens
gugccucuuuggcuggggguucu

SEQ ID NO: 13436 - RNA, 20 nt, Homo sapiens
guguuuuccagucccauccc

SEQ ID NO: 13437 - RNA, 22 nt, Homo sapiens
uggguguucucagcaugaagcu

SEQ ID NO: 13438 - RNA, 25 nt, Homo sapiens
cccgaggugcggagcgaccugcgga

SEQ ID NO: 13439 - RNA, 17 nt, Homo sapiens
accaaaacaaauggaga

SEQ ID NO: 13440 - RNA, 20 nt, Homo sapiens
aguauuaccaaugcuguugu

SEQ ID NO: 13441 - RNA, 19 nt, Homo sapiens
cuccccuuugguaaugcuu

SEQ ID NO: 13442 - RNA, 27 nt, Homo sapiens
gcaggauggugauggggguuuuuguua

SEQ ID NO: 13443 - RNA, 16 nt, Homo sapiens
uagcaaauugugcugc

SEQ ID NO: 13444 - RNA, 16 nt, Homo sapiens
uagcaaauugugcugc

SEQ ID NO: 13445 - RNA, 19 nt, Homo sapiens
ugcuguuaacuacuacuga

SEQ ID NO: 13446 - RNA, 20 nt, Homo sapiens
caucaagucuccacguguuu

SEQ ID NO: 13447 - RNA, 20 nt, Homo sapiens
ccccgccccucccccuacag

SEQ ID NO: 13448 - RNA, 21 nt, Homo sapiens
ccuucagccgccgccgcagcu

SEQ ID NO: 13449 - RNA, 19 nt, Homo sapiens
cgccccugcccagcaccuc

SEQ ID NO: 13450 - RNA, 20 nt, Homo sapiens
cgccccugcccagcaccucc

SEQ ID NO: 13451 - RNA, 23 nt, Homo sapiens
cuccgggcagagaccaccgcgcc

SEQ ID NO: 13452 - RNA, 19 nt, Homo sapiens
gccccuuucucuugcuguu

SEQ ID NO: 13453 - RNA, 23 nt, Homo sapiens
auggaaaccaggggacuuaccuu

SEQ ID NO: 13454 - RNA, 24 nt, Homo sapiens
cagacagguuaacagaagcuacug

SEQ ID NO: 13455 - RNA, 19 nt, Homo sapiens
gcaaaaugaaaauuuugcc

SEQ ID NO: 13456 - RNA, 21 nt, Homo sapiens
gcaaaaugaaaauuuugccuu

SEQ ID NO: 13457 - RNA, 23 nt, Homo sapiens
uacugcaguggaaagagcacuga

SEQ ID NO: 13458 - RNA, 26 nt, Homo sapiens
ucuggguuucucucaaguuuguuuuu

SEQ ID NO: 13459 - RNA, 18 nt, Homo sapiens
uggacagaauuucccaca

SEQ ID NO: 13460 - RNA, 15 nt, Homo sapiens
agagagagaaguacc

SEQ ID NO: 13461 - RNA, 20 nt, Homo sapiens
cagccuuuucuaauaggcua

SEQ ID NO: 13462 - RNA, 21 nt, Homo sapiens
gguuuauuuauguuguagcaa

SEQ ID NO: 13463 - RNA, 20 nt, Homo sapiens
uaaaagcucggcauuguaau

SEQ ID NO: 13464 - RNA, 18 nt, Homo sapiens
uauuuucacuuuguguca

SEQ ID NO: 13465 - RNA, 21 nt, Homo sapiens
ucaugaauuuaguuagacuaa

SEQ ID NO: 13466 - RNA, 20 nt, Homo sapiens
acaaccuucggccgccccac

SEQ ID NO: 13467 - RNA, 19 nt, Homo sapiens
agccacucugacucagcca

SEQ ID NO: 13468 - RNA, 20 nt, Homo sapiens
caccaucaucacauccccca

SEQ ID NO: 13469 - RNA, 24 nt, Homo sapiens
ccuuagccuugggaggucugggaa

SEQ ID NO: 13470 - RNA, 18 nt, Homo sapiens
cugccccaccucucccca

SEQ ID NO: 13471 - RNA, 22 nt, Homo sapiens
gggacaggaaaccacuuccuuu

SEQ ID NO: 13472 - RNA, 18 nt, Homo sapiens
uccgccuccuggguucaa

SEQ ID NO: 13473 - RNA, 20 nt, Homo sapiens
ugacccugaggucaacacag

SEQ ID NO: 13474 - RNA, 22 nt, Homo sapiens
uuuaguaaucugccuuagccuu

SEQ ID NO: 13475 - RNA, 22 nt, Homo sapiens
agggguacacacuuuuugcuua

SEQ ID NO: 13476 - RNA, 23 nt, Homo sapiens
cccaguuccguccaaguugcugc

SEQ ID NO: 13477 - RNA, 18 nt, Homo sapiens
cggagagagauuccaucu

SEQ ID NO: 13478 - RNA, 20 nt, Homo sapiens
cuauaauugucucugaguaa

SEQ ID NO: 13479 - RNA, 19 nt, Homo sapiens
gcuguauauuuaucuuuca

SEQ ID NO: 13480 - RNA, 18 nt, Homo sapiens
ucaaauguaugccuguua

SEQ ID NO: 13481 - RNA, 19 nt, Homo sapiens
ucuuuuucagagcuucuca

SEQ ID NO: 13482 - RNA, 18 nt, Homo sapiens
ugguacauauauaccaca

SEQ ID NO: 13483 - RNA, 20 nt, Homo sapiens
cgccugcuucacaccccuca

SEQ ID NO: 13484 - RNA, 17 nt, Homo sapiens
gcccacccagggcccgg

SEQ ID NO: 13485 - RNA, 21 nt, Homo sapiens
aguagcugagaaaacuaaguc

SEQ ID NO: 13486 - RNA, 19 nt, Homo sapiens
uuuuugauugcaguuuaua

SEQ ID NO: 13487 - RNA, 21 nt, Homo sapiens
aaacacuuguccaaggucuca

SEQ ID NO: 13488 - RNA, 19 nt, Homo sapiens
caagccccgccucuccucu

SEQ ID NO: 13489 - RNA, 21 nt, Homo sapiens
cugugcguccaaguggaguca

SEQ ID NO: 13490 - RNA, 18 nt, Homo sapiens
guggagucagguuuucua

SEQ ID NO: 13491 - RNA, 19 nt, Homo sapiens
ugcaaauucaguguuaacu

SEQ ID NO: 13492 - RNA, 20 nt, Homo sapiens
uguuugcaaauucaguguua

SEQ ID NO: 13493 - RNA, 20 nt, Homo sapiens
acugcaguggccacuucuga

SEQ ID NO: 13494 - RNA, 17 nt, Homo sapiens
agguucuccagaucucu

SEQ ID NO: 13495 - RNA, 24 nt, Homo sapiens
caaagcuggcauccuccuauguca

SEQ ID NO: 13496 - RNA, 17 nt, Homo sapiens
cacuggcacuuucagca

SEQ ID NO: 13497 - RNA, 19 nt, Homo sapiens
cagaucucuuaagacugua

SEQ ID NO: 13498 - RNA, 19 nt, Homo sapiens
ccacauccacuuccacccc

SEQ ID NO: 13499 - RNA, 21 nt, Homo sapiens
ggauggugacugcgccauggc

SEQ ID NO: 13500 - RNA, 18 nt, Homo sapiens
ggauguuaacaugggauu

SEQ ID NO: 13501 - RNA, 18 nt, Homo sapiens
agaagcccuggccaguga

SEQ ID NO: 13502 - RNA, 26 nt, Homo sapiens
ccugcagacugaagacucuggacuca

SEQ ID NO: 13503 - RNA, 21 nt, Homo sapiens
ggccugggccagagucaggga

SEQ ID NO: 13504 - RNA, 17 nt, Homo sapiens
ugauuggaacaccagga

SEQ ID NO: 13505 - RNA, 19 nt, Homo sapiens
ccugcuccacuugucaggg

SEQ ID NO: 13506 - RNA, 22 nt, Homo sapiens
aaguccacccuugguuccuaac

SEQ ID NO: 13507 - RNA, 19 nt, Homo sapiens
gugccauuaacaaauguau

SEQ ID NO: 13508 - RNA, 28 nt, Homo sapiens
accacauacccucacuucccccuucccu

SEQ ID NO: 13509 - RNA, 23 nt, Homo sapiens
ccucuuucuccuuacugacuuca

SEQ ID NO: 13510 - RNA, 20 nt, Homo sapiens
cuucccccuucccuaccucu

SEQ ID NO: 13511 - RNA, 22 nt, Homo sapiens
acaccaguucuuggugacgcca

SEQ ID NO: 13512 - RNA, 20 nt, Homo sapiens
aucaggcgucuacacuguca

SEQ ID NO: 13513 - RNA, 17 nt, Homo sapiens
auguuuggcugggcauc

SEQ ID NO: 13514 - RNA, 23 nt, Homo sapiens
gcccuuccuccagcgcccugcgg

SEQ ID NO: 13515 - RNA, 18 nt, Homo sapiens
agcuaucccaucuucagg

SEQ ID NO: 13516 - RNA, 19 nt, Homo sapiens
auuggggagcuugcccuuu

SEQ ID NO: 13517 - RNA, 24 nt, Homo sapiens
guuucugcugcagauagugguguu

SEQ ID NO: 13518 - RNA, 20 nt, Homo sapiens
accuggggcagauaaaaugc

SEQ ID NO: 13519 - RNA, 24 nt, Homo sapiens
agugagugggagaguaccugugug

SEQ ID NO: 13520 - RNA, 16 nt, Homo sapiens
aguggccaucauccuc

SEQ ID NO: 13521 - RNA, 19 nt, Homo sapiens
ccauuaggucgguuccugc

SEQ ID NO: 13522 - RNA, 20 nt, Homo sapiens
cgggaggggaggcauugaca

SEQ ID NO: 13523 - RNA, 24 nt, Homo sapiens
uuacaaugugaauaauggcacuga

SEQ ID NO: 13524 - RNA, 19 nt, Homo sapiens
acaaaagucacagucugag

SEQ ID NO: 13525 - RNA, 17 nt, Homo sapiens
caauucaauccaugaca

SEQ ID NO: 13526 - RNA, 18 nt, Homo sapiens
ucaccuguguccucccug

SEQ ID NO: 13527 - RNA, 24 nt, Homo sapiens
uggagcaccucugagauggaauug

SEQ ID NO: 13528 - RNA, 21 nt, Homo sapiens
cucuaguggaagaccuuugga

SEQ ID NO: 13529 - RNA, 24 nt, Homo sapiens
cuuuuugggugaaauggauuuaug

SEQ ID NO: 13530 - RNA, 17 nt, Homo sapiens
gcuguuccuuuucaccu

SEQ ID NO: 13531 - RNA, 20 nt, Homo sapiens
uauuucagcuguuccuuuuc

SEQ ID NO: 13532 - RNA, 23 nt, Homo sapiens
ugccaaccgugcuuguacugcua

SEQ ID NO: 13533 - RNA, 18 nt, Homo sapiens
aaagaagcuaugaagaua

SEQ ID NO: 13534 - RNA, 24 nt, Homo sapiens
gagaaauacugagcaagucuuuca

SEQ ID NO: 13535 - RNA, 22 nt, Homo sapiens
gcuuauauuuaucgcuuggcuc

SEQ ID NO: 13536 - RNA, 25 nt, Homo sapiens
uuuccauacuaaaccaguuuguuaa

SEQ ID NO: 13537 - RNA, 18 nt, Homo sapiens
agugaguggagagccagc

SEQ ID NO: 13538 - RNA, 20 nt, Homo sapiens
guccgugcaccgaugcacac

SEQ ID NO: 13539 - RNA, 22 nt, Homo sapiens
ucucuuuugaguuuuauaccuu

SEQ ID NO: 13540 - RNA, 20 nt, Homo sapiens
uaugcuuauuuggaaaguca

SEQ ID NO: 13541 - RNA, 17 nt, Homo sapiens
ucuaguuguuuuaaucu

SEQ ID NO: 13542 - RNA, 21 nt, Homo sapiens
aaacaauguauagguacacag

SEQ ID NO: 13543 - RNA, 16 nt, Homo sapiens
aacccuccuguguccu

SEQ ID NO: 13544 - RNA, 18 nt, Homo sapiens
acagaacccuuuuccuga

SEQ ID NO: 13545 - RNA, 24 nt, Homo sapiens
agaagaaagagaaaccuucacuuu

SEQ ID NO: 13546 - RNA, 19 nt, Homo sapiens
aucaaauguauaugcuuuu

SEQ ID NO: 13547 - RNA, 18 nt, Homo sapiens
ccacuuuugacuagguaa

SEQ ID NO: 13548 - RNA, 19 nt, Homo sapiens
ccagccaacaguaacacuu

SEQ ID NO: 13549 - RNA, 19 nt, Homo sapiens
gcugucucucugacaccag

SEQ ID NO: 13550 - RNA, 22 nt, Homo sapiens
gucauauacucugcaucacugu

SEQ ID NO: 13551 - RNA, 17 nt, Homo sapiens
gugaauaaaguugugug

SEQ ID NO: 13552 - RNA, 23 nt, Homo sapiens
uaugccccaaagcuugcucuuuu

SEQ ID NO: 13553 - RNA, 20 nt, Homo sapiens
ucacugcacuccuuugucau

SEQ ID NO: 13554 - RNA, 16 nt, Homo sapiens
uccuguguccucugaa

SEQ ID NO: 13555 - RNA, 17 nt, Homo sapiens
ugguuaaaacaccauga

SEQ ID NO: 13556 - RNA, 21 nt, Homo sapiens
cgccaaggacuuuccacauca

SEQ ID NO: 13557 - RNA, 19 nt, Homo sapiens
gaggaggagggcgacgcca

SEQ ID NO: 13558 - RNA, 20 nt, Homo sapiens
aaccucuucagcacuagcca

SEQ ID NO: 13559 - RNA, 19 nt, Homo sapiens
aucuuaaauguguaaguca

SEQ ID NO: 13560 - RNA, 23 nt, Homo sapiens
cuauuuuugagaaaacccucaca

SEQ ID NO: 13561 - RNA, 18 nt, Homo sapiens
cuuuccacucucuuucca

SEQ ID NO: 13562 - RNA, 26 nt, Homo sapiens
uucugccccuuuuaugacaccuuuga

SEQ ID NO: 13563 - RNA, 19 nt, Homo sapiens
uuguuuuaucucccuuucc

SEQ ID NO: 13564 - RNA, 20 nt, Homo sapiens
agccacacucgcaccuccug

SEQ ID NO: 13565 - RNA, 19 nt, Homo sapiens
ccaggaaaccauuaagccc

SEQ ID NO: 13566 - RNA, 24 nt, Homo sapiens
ccugcacucaugccaccugccagg

SEQ ID NO: 13567 - RNA, 19 nt, Homo sapiens
gcccuggggcuggggggcu

SEQ ID NO: 13568 - RNA, 19 nt, Homo sapiens
ucaaacaccccuaacucag

SEQ ID NO: 13569 - RNA, 18 nt, Homo sapiens
ucaguccucccuugacuu

SEQ ID NO: 13570 - RNA, 18 nt, Homo sapiens
agaaaaaaaaaauuguau

SEQ ID NO: 13571 - RNA, 21 nt, Homo sapiens
agauuuuguagggacccauua

SEQ ID NO: 13572 - RNA, 23 nt, Homo sapiens
aggauuuuacagccuucugauga

SEQ ID NO: 13573 - RNA, 19 nt, Homo sapiens
ccaauuuuaaugacacuaa

SEQ ID NO: 13574 - RNA, 18 nt, Homo sapiens
gggaaccaucagcaccaa

SEQ ID NO: 13575 - RNA, 22 nt, Homo sapiens
uaagauuguggagucugaguua

SEQ ID NO: 13576 - RNA, 15 nt, Homo sapiens
uaauucaauggcaau

SEQ ID NO: 13577 - RNA, 17 nt, Homo sapiens
ucagacugaaauccuaa

SEQ ID NO: 13578 - RNA, 19 nt, Homo sapiens
ugauguaauucucucacuu

SEQ ID NO: 13579 - RNA, 17 nt, Homo sapiens
aaggggcuggaaucuca

SEQ ID NO: 13580 - RNA, 19 nt, Homo sapiens
acacacaaaacaaacaaac

SEQ ID NO: 13581 - RNA, 26 nt, Homo sapiens
acuuggaaacuugauuguugugguuc

SEQ ID NO: 13582 - RNA, 19 nt, Homo sapiens
cccgccguucccugcgcuu

SEQ ID NO: 13583 - RNA, 20 nt, Homo sapiens
ucugacugucccugccaaug

SEQ ID NO: 13584 - RNA, 20 nt, Homo sapiens
uuugguacccccaaaccccc

SEQ ID NO: 13585 - RNA, 20 nt, Homo sapiens
gcuauugugaguuuuuucaa

SEQ ID NO: 13586 - RNA, 17 nt, Homo sapiens
uaugggaaaacauucca

SEQ ID NO: 13587 - RNA, 17 nt, Homo sapiens
gaacugcuuuccaacuc

SEQ ID NO: 13588 - RNA, 21 nt, Homo sapiens
gugugugugguggggcuuggc

SEQ ID NO: 13589 - RNA, 18 nt, Homo sapiens
aaggcuugauguguauaa

SEQ ID NO: 13590 - RNA, 19 nt, Homo sapiens
accaagcauaagagaagaa

SEQ ID NO: 13591 - RNA, 19 nt, Homo sapiens
gccugcccuccaagcccca

SEQ ID NO: 13592 - RNA, 17 nt, Homo sapiens
agaaauauuguaccgca

SEQ ID NO: 13593 - RNA, 20 nt, Homo sapiens
uuuagaguaaaaaauaagca

SEQ ID NO: 13594 - RNA, 22 nt, Homo sapiens
uuuuguuauaaauuuauaacuu

SEQ ID NO: 13595 - RNA, 20 nt, Homo sapiens
acagaaguguucacagugua

SEQ ID NO: 13596 - RNA, 20 nt, Homo sapiens
auucgcaucuucucuaucca

SEQ ID NO: 13597 - RNA, 19 nt, Homo sapiens
ggugcccugaauggaacua

SEQ ID NO: 13598 - RNA, 18 nt, Homo sapiens
uggcuuaggauggaauua

SEQ ID NO: 13599 - RNA, 17 nt, Homo sapiens
aagaaaaguacccggca

SEQ ID NO: 13600 - RNA, 19 nt, Homo sapiens
caaaugaacuguccugaca

SEQ ID NO: 13601 - RNA, 18 nt, Homo sapiens
cuuuuucugugcuuugac

SEQ ID NO: 13602 - RNA, 19 nt, Homo sapiens
gaacucuuggccuuacgaa

SEQ ID NO: 13603 - RNA, 17 nt, Homo sapiens
gcucggaguuucgggga

SEQ ID NO: 13604 - RNA, 17 nt, Homo sapiens
agaguccauguccaucu

SEQ ID NO: 13605 - RNA, 19 nt, Homo sapiens
agccuuuuuugggcaguca

SEQ ID NO: 13606 - RNA, 20 nt, Homo sapiens
cagucccucagcuucaccca

SEQ ID NO: 13607 - RNA, 21 nt, Homo sapiens
uucuccuggacaaaccuuucc

SEQ ID NO: 13608 - RNA, 19 nt, Homo sapiens
agaaaagaagucuuaagau

SEQ ID NO: 13609 - RNA, 20 nt, Homo sapiens
agaagucuuaagauauuuca

SEQ ID NO: 13610 - RNA, 21 nt, Homo sapiens
cugagagacagacacaacagu

SEQ ID NO: 13611 - RNA, 21 nt, Homo sapiens
gaccucggccucuccauguga

SEQ ID NO: 13612 - RNA, 24 nt, Homo sapiens
aacaauccguggcugcucauucuu

SEQ ID NO: 13613 - RNA, 19 nt, Homo sapiens
ccucccccuaccuccuucc

SEQ ID NO: 13614 - RNA, 23 nt, Homo sapiens
gugguuuggggagggacuucguu

SEQ ID NO: 13615 - RNA, 16 nt, Homo sapiens
aauccaaugcucaccu

SEQ ID NO: 13616 - RNA, 25 nt, Homo sapiens
gccacggaggcagggucucugggga

SEQ ID NO: 13617 - RNA, 20 nt, Homo sapiens
ggccugcuccuccugcaggg

SEQ ID NO: 13618 - RNA, 17 nt, Homo sapiens
ugcuugugucucccucg

SEQ ID NO: 13619 - RNA, 18 nt, Homo sapiens
uguaauugcuuugugugc

SEQ ID NO: 13620 - RNA, 18 nt, Homo sapiens
aaguggaaagcuacacug

SEQ ID NO: 13621 - RNA, 17 nt, Homo sapiens
agaaaagacaaagguua

SEQ ID NO: 13622 - RNA, 21 nt, Homo sapiens
aucccuuugagagguggcuca

SEQ ID NO: 13623 - RNA, 25 nt, Homo sapiens
cccugggucccaggagggucuggag

SEQ ID NO: 13624 - RNA, 24 nt, Homo sapiens
cccuggugcucagagcaccugugg

SEQ ID NO: 13625 - RNA, 22 nt, Homo sapiens
ccuacuguccuaagcugcuuuu

SEQ ID NO: 13626 - RNA, 19 nt, Homo sapiens
cuucccagaccugcuucca

SEQ ID NO: 13627 - RNA, 21 nt, Homo sapiens
cuucuuuaugauguucacuuu

SEQ ID NO: 13628 - RNA, 21 nt, Homo sapiens
gcgccgccgugcucaugcugc

SEQ ID NO: 13629 - RNA, 23 nt, Homo sapiens
ggaaucuucaccccacuuccucu

SEQ ID NO: 13630 - RNA, 15 nt, Homo sapiens
ggucccugccuuuuu

SEQ ID NO: 13631 - RNA, 21 nt, Homo sapiens
ugcuuggaaguggccucccca

SEQ ID NO: 13632 - RNA, 18 nt, Homo sapiens
ugacgagacccaugugug

SEQ ID NO: 13633 - RNA, 22 nt, Homo sapiens
aaauaaccaacaaccucuucca

SEQ ID NO: 13634 - RNA, 22 nt, Homo sapiens
aagaauaaaaacgaccucuuug

SEQ ID NO: 13635 - RNA, 18 nt, Homo sapiens
acaacccaccuggaacuu

SEQ ID NO: 13636 - RNA, 21 nt, Homo sapiens
ccauggcuuagcagaacccca

SEQ ID NO: 13637 - RNA, 19 nt, Homo sapiens
ccugggcugcuccuguccc

SEQ ID NO: 13638 - RNA, 17 nt, Homo sapiens
cgggaagaagccagcaa

SEQ ID NO: 13639 - RNA, 18 nt, Homo sapiens
guggcuccugccacaccc

SEQ ID NO: 13640 - RNA, 18 nt, Homo sapiens
uccaggcuggccuuccag

SEQ ID NO: 13641 - RNA, 23 nt, Homo sapiens
uggcuccugccacacccacaggg

SEQ ID NO: 13642 - RNA, 21 nt, Homo sapiens
uggcuucagccccuugagcag

SEQ ID NO: 13643 - RNA, 27 nt, Homo sapiens
gggaauauacaaagugaagccacauug

SEQ ID NO: 13644 - RNA, 23 nt, Homo sapiens
caaaggaccaggcuugccuuuuc

SEQ ID NO: 13645 - RNA, 20 nt, Homo sapiens
caaugacuucauuuuuuucu

SEQ ID NO: 13646 - RNA, 23 nt, Homo sapiens
gaaaagagucucagguuauuuuu

SEQ ID NO: 13647 - RNA, 21 nt, Homo sapiens
agagcuaguguaagcuguuga

SEQ ID NO: 13648 - RNA, 16 nt, Homo sapiens
uuuaauaaccagcuca

SEQ ID NO: 13649 - RNA, 19 nt, Homo sapiens
aauacuccuucuuccuuca

SEQ ID NO: 13650 - RNA, 18 nt, Homo sapiens
ccguagccucacagccag

SEQ ID NO: 13651 - RNA, 24 nt, Homo sapiens
gccagaagcccguuggcgagcucu

SEQ ID NO: 13652 - RNA, 17 nt, Homo sapiens
ggcaccugcaaaccacc

SEQ ID NO: 13653 - RNA, 21 nt, Homo sapiens
acaacagaggagauaaucucc

SEQ ID NO: 13654 - RNA, 26 nt, Homo sapiens
ccugauggaauuccaacaugagauua

SEQ ID NO: 13655 - RNA, 21 nt, Homo sapiens
acucuccucucuccuucugca

SEQ ID NO: 13656 - RNA, 21 nt, Homo sapiens
aguauggucgggugucagaua

SEQ ID NO: 13657 - RNA, 24 nt, Homo sapiens
auagcugugauucaccccacccca

SEQ ID NO: 13658 - RNA, 21 nt, Homo sapiens
caguguuuuguuuccagcuca

SEQ ID NO: 13659 - RNA, 23 nt, Homo sapiens
cucugaugcucugaggcuucugg

SEQ ID NO: 13660 - RNA, 18 nt, Homo sapiens
cugagcagcuccuggcuc

SEQ ID NO: 13661 - RNA, 18 nt, Homo sapiens
gaaaggacccgugcaucu

SEQ ID NO: 13662 - RNA, 23 nt, Homo sapiens
gccugguggguguucccuggccc

SEQ ID NO: 13663 - RNA, 19 nt, Homo sapiens
gcucacuuuguaccccuca

SEQ ID NO: 13664 - RNA, 17 nt, Homo sapiens
ggcaugccucccuucca

SEQ ID NO: 13665 - RNA, 20 nt, Homo sapiens
gugaaccuacugguggacuc

SEQ ID NO: 13666 - RNA, 22 nt, Homo sapiens
uggccuggugcauccacagagg

SEQ ID NO: 13667 - RNA, 18 nt, Homo sapiens
uggcuccggugggaacug

SEQ ID NO: 13668 - RNA, 19 nt, Homo sapiens
aacccagcuggcacccucu

SEQ ID NO: 13669 - RNA, 19 nt, Homo sapiens
cgauggcgaugaugccucu

SEQ ID NO: 13670 - RNA, 25 nt, Homo sapiens
gcuuucuuuaaaaaagggucuguga

SEQ ID NO: 13671 - RNA, 23 nt, Homo sapiens
ggcaagaaaagcuguagcucgcc

SEQ ID NO: 13672 - RNA, 18 nt, Homo sapiens
ugucggucuaaaagagga

SEQ ID NO: 13673 - RNA, 21 nt, Homo sapiens
uuuuuuugaugaagccgagca

SEQ ID NO: 13674 - RNA, 22 nt, Homo sapiens
auuuguuuagcuugcuuggcuu

SEQ ID NO: 13675 - RNA, 17 nt, Homo sapiens
gaaaaaggaagacccgu

SEQ ID NO: 13676 - RNA, 17 nt, Homo sapiens
gaguguagcgggcaucg

SEQ ID NO: 13677 - RNA, 22 nt, Homo sapiens
ucuccaucgagcuguuugguuc

SEQ ID NO: 13678 - RNA, 19 nt, Homo sapiens
uguguugguuucuuucuga

SEQ ID NO: 13679 - RNA, 16 nt, Homo sapiens
uuuuuuccuuagccuu

SEQ ID NO: 13680 - RNA, 21 nt, Homo sapiens
cuggaacaauguugcuuggcu

SEQ ID NO: 13681 - RNA, 18 nt, Homo sapiens
gagcuaagcgugaagcug

SEQ ID NO: 13682 - RNA, 17 nt, Homo sapiens
accugcccuuagugaug

SEQ ID NO: 13683 - RNA, 17 nt, Homo sapiens
aggauauucccugcugc

SEQ ID NO: 13684 - RNA, 19 nt, Homo sapiens
cauaucccuggacucuuga

SEQ ID NO: 13685 - RNA, 17 nt, Homo sapiens
uuugccuuguugcaaca

SEQ ID NO: 13686 - RNA, 22 nt, Homo sapiens
aaagaaugaugguucaaggcca

SEQ ID NO: 13687 - RNA, 19 nt, Homo sapiens
agcaguagucacaaagcca

SEQ ID NO: 13688 - RNA, 16 nt, Homo sapiens
gcuuuggagaaagacc

SEQ ID NO: 13689 - RNA, 18 nt, Homo sapiens
uccauucuccuggagcug

SEQ ID NO: 13690 - RNA, 22 nt, Homo sapiens
uguagguaagcaagcuacugua

SEQ ID NO: 13691 - RNA, 23 nt, Homo sapiens
uuugguguucuccggauccuuuu

SEQ ID NO: 13692 - RNA, 23 nt, Homo sapiens
aagccaauucucuggguguccca

SEQ ID NO: 13693 - RNA, 18 nt, Homo sapiens
aggauaaaccauacuucc

SEQ ID NO: 13694 - RNA, 17 nt, Homo sapiens
cagcugguggaugcauc

SEQ ID NO: 13695 - RNA, 18 nt, Homo sapiens
aagaagugacuuuucuga

SEQ ID NO: 13696 - RNA, 25 nt, Homo sapiens
aauccagcgaugcugcagcuguaaa

SEQ ID NO: 13697 - RNA, 23 nt, Homo sapiens
aaugauuaucauuagaagcuaac

SEQ ID NO: 13698 - RNA, 17 nt, Homo sapiens
agaaaauggcugugcug

SEQ ID NO: 13699 - RNA, 17 nt, Homo sapiens
aucugaaggucaucucc

SEQ ID NO: 13700 - RNA, 18 nt, Homo sapiens
caaagaagugacuuuucu

SEQ ID NO: 13701 - RNA, 20 nt, Homo sapiens
gggagcggccccgcuccccc

SEQ ID NO: 13702 - RNA, 19 nt, Homo sapiens
ugagggcagaggcuguggc

SEQ ID NO: 13703 - RNA, 18 nt, Homo sapiens
ucacuugucuuccacuuu

SEQ ID NO: 13704 - RNA, 22 nt, Homo sapiens
ucucuccggaggucaccaagga

SEQ ID NO: 13705 - RNA, 23 nt, Homo sapiens
ucuuuaauggcugucuugcccuu

SEQ ID NO: 13706 - RNA, 18 nt, Homo sapiens
uuuucaugcccaguuaac

SEQ ID NO: 13707 - RNA, 26 nt, Homo sapiens
ccuugauuuguguuugucuuggccuu

SEQ ID NO: 13708 - RNA, 20 nt, Homo sapiens
aaaauaaaaaugaacaggua

SEQ ID NO: 13709 - RNA, 19 nt, Homo sapiens
agcuccucccaccucagca

SEQ ID NO: 13710 - RNA, 17 nt, Homo sapiens
cacacguaguggcuuaa

SEQ ID NO: 13711 - RNA, 22 nt, Homo sapiens
gcuagcuccucccaccucagca

SEQ ID NO: 13712 - RNA, 23 nt, Homo sapiens
ugaggaaggcucaacuggggcug

SEQ ID NO: 13713 - RNA, 22 nt, Homo sapiens
ccgccuccgcgcgccuaugaga

SEQ ID NO: 13714 - RNA, 17 nt, Homo sapiens
uggaagguuuuuguuca

SEQ ID NO: 13715 - RNA, 16 nt, Homo sapiens
aaugaagccuucuucc

SEQ ID NO: 13716 - RNA, 18 nt, Homo sapiens
acacagacacacacacac

SEQ ID NO: 13717 - RNA, 19 nt, Homo sapiens
uuguuggugguuuuuucaa

SEQ ID NO: 13718 - RNA, 17 nt, Homo sapiens
aacugaacuucagagca

SEQ ID NO: 13719 - RNA, 22 nt, Homo sapiens
cagauccucaauaaacauuuca

SEQ ID NO: 13720 - RNA, 19 nt, Homo sapiens
gugaugacauucccugcua

SEQ ID NO: 13721 - RNA, 20 nt, Homo sapiens
ucugcugauaucugcaggga

SEQ ID NO: 13722 - RNA, 18 nt, Homo sapiens
uugcaauugcuucccuca

SEQ ID NO: 13723 - RNA, 19 nt, Homo sapiens
aaccugaucaucccaccca

SEQ ID NO: 13724 - RNA, 21 nt, Homo sapiens
uaaaaccagaaaaguguuuag

SEQ ID NO: 13725 - RNA, 19 nt, Homo sapiens
gagguuccuuuguucuacc

SEQ ID NO: 13726 - RNA, 23 nt, Homo sapiens
ucuuuggucauuuuucugcuccu

SEQ ID NO: 13727 - RNA, 19 nt, Homo sapiens
ucuuuuucaucuauuugca

SEQ ID NO: 13728 - RNA, 20 nt, Homo sapiens
agaagggccgggcucgguca

SEQ ID NO: 13729 - RNA, 17 nt, Homo sapiens
cuugagaucagcccucc

SEQ ID NO: 13730 - RNA, 18 nt, Homo sapiens
gcccacccacucgcgucu

SEQ ID NO: 13731 - RNA, 21 nt, Homo sapiens
ccacuugcccaaacugccaaa

SEQ ID NO: 13732 - RNA, 21 nt, Homo sapiens
cccuccccgcgccccucccca

SEQ ID NO: 13733 - RNA, 18 nt, Homo sapiens
ccuggcgaggacgcugcc

SEQ ID NO: 13734 - RNA, 18 nt, Homo sapiens
uggaccugaugugaaauu

SEQ ID NO: 13735 - RNA, 18 nt, Homo sapiens
uucucaccgacucuccac

SEQ ID NO: 13736 - RNA, 18 nt, Homo sapiens
cacugccacacgcagcuc

SEQ ID NO: 13737 - RNA, 31 nt, Homo sapiens
cgcuccuccgccccgcuccuccuccuccucu

SEQ ID NO: 13738 - RNA, 22 nt, Homo sapiens
gcuccuccuccuccucuuccuc

SEQ ID NO: 13739 - RNA, 19 nt, Homo sapiens
ccgcccuccccccaccucc

SEQ ID NO: 13740 - RNA, 20 nt, Homo sapiens
gccugggccgcggugaggcc

SEQ ID NO: 13741 - RNA, 18 nt, Homo sapiens
ccacgcucaucuugcaaa

SEQ ID NO: 13742 - RNA, 20 nt, Homo sapiens
agcagcucacuacgauauca

SEQ ID NO: 13743 - RNA, 19 nt, Homo sapiens
auagaauauacauguaaca

SEQ ID NO: 13744 - RNA, 18 nt, Homo sapiens
gccuuggcauuugugcag

SEQ ID NO: 13745 - RNA, 20 nt, Homo sapiens
gccuucaaggguucuggagg

SEQ ID NO: 13746 - RNA, 24 nt, Homo sapiens
agcgcuggugauccacccgcgcgc

SEQ ID NO: 13747 - RNA, 22 nt, Homo sapiens
aggagagagaaaaauaauggca

SEQ ID NO: 13748 - RNA, 20 nt, Homo sapiens
gccaccuccgaguccugggg

SEQ ID NO: 13749 - RNA, 18 nt, Homo sapiens
gccccgcccgccccccuu

SEQ ID NO: 13750 - RNA, 22 nt, Homo sapiens
ugcuccugaccagagccaccuc

SEQ ID NO: 13751 - RNA, 19 nt, Homo sapiens
agcccggccacgccgcccc

SEQ ID NO: 13752 - RNA, 20 nt, Homo sapiens
augccuugauaguuagcccu

SEQ ID NO: 13753 - RNA, 21 nt, Homo sapiens
cacaacagggcaguugugaua

SEQ ID NO: 13754 - RNA, 24 nt, Homo sapiens
cuugucuuuuuuuuuuuauuuuua

SEQ ID NO: 13755 - RNA, 20 nt, Homo sapiens
ccuaaagaucaagcuacaca

SEQ ID NO: 13756 - RNA, 23 nt, Homo sapiens
ugcuguucaaagaaauuacaguu

SEQ ID NO: 13757 - RNA, 19 nt, Homo sapiens
gcuccuucaaucccauuuu

SEQ ID NO: 13758 - RNA, 18 nt, Homo sapiens
acagacauacauuucuca

SEQ ID NO: 13759 - RNA, 22 nt, Homo sapiens
caaauauggggaaaaaacugug

SEQ ID NO: 13760 - RNA, 23 nt, Homo sapiens
caaguauggcuccuccauaucuc

SEQ ID NO: 13761 - RNA, 18 nt, Homo sapiens
cagacaagcugcauuuca

SEQ ID NO: 13762 - RNA, 18 nt, Homo sapiens
cagugccgacagcucucc

SEQ ID NO: 13763 - RNA, 19 nt, Homo sapiens
ccacagugccgacagcucu

SEQ ID NO: 13764 - RNA, 20 nt, Homo sapiens
ucccgccagccagccccgac

SEQ ID NO: 13765 - RNA, 20 nt, Homo sapiens
ugcagggguagccugaggug

SEQ ID NO: 13766 - RNA, 23 nt, Homo sapiens
uuuaagggcccaggaucguuuuu

SEQ ID NO: 13767 - RNA, 16 nt, Homo sapiens
aaccuugcuuccugcu

SEQ ID NO: 13768 - RNA, 22 nt, Homo sapiens
aauauuguauaaauuguuuuca

SEQ ID NO: 13769 - RNA, 21 nt, Homo sapiens
gaauccaccuuccacuauugu

SEQ ID NO: 13770 - RNA, 21 nt, Homo sapiens
guauaaauuguuuucauacuu

SEQ ID NO: 13771 - RNA, 20 nt, Homo sapiens
ucccagcuuggaaauucugc

SEQ ID NO: 13772 - RNA, 19 nt, Homo sapiens
uuccagaaagugaucacag

SEQ ID NO: 13773 - RNA, 21 nt, Homo sapiens
gcccagcucucucaggauuca

SEQ ID NO: 13774 - RNA, 18 nt, Homo sapiens
ggcugguguuuguaguug

SEQ ID NO: 13775 - RNA, 19 nt, Homo sapiens
uccaaucugguaauggugu

SEQ ID NO: 13776 - RNA, 20 nt, Homo sapiens
agaagaaauauuuuucaccu

SEQ ID NO: 13777 - RNA, 19 nt, Homo sapiens
agggggucccccacccucu

SEQ ID NO: 13778 - RNA, 20 nt, Homo sapiens
caagacaucacccucuccuc

SEQ ID NO: 13779 - RNA, 18 nt, Homo sapiens
ccuguccucuucccaguu

SEQ ID NO: 13780 - RNA, 20 nt, Homo sapiens
cggaaggcggcuggugcaca

SEQ ID NO: 13781 - RNA, 21 nt, Homo sapiens
cucccccgcccugcuggccuc

SEQ ID NO: 13782 - RNA, 16 nt, Homo sapiens
ggcuaauucuaagcac

SEQ ID NO: 13783 - RNA, 21 nt, Homo sapiens
uccucucucccccuuguuauu

SEQ ID NO: 13784 - RNA, 16 nt, Homo sapiens
gaaccaauaugaacug

SEQ ID NO: 13785 - RNA, 19 nt, Homo sapiens
accaccaacuccuccuccu

SEQ ID NO: 13786 - RNA, 17 nt, Homo sapiens
ccgcuacaguuugaaga

SEQ ID NO: 13787 - RNA, 22 nt, Homo sapiens
uccuuuuuucccccuuguuccu

SEQ ID NO: 13788 - RNA, 20 nt, Homo sapiens
uguaaacauuuucucucuca

SEQ ID NO: 13789 - RNA, 18 nt, Homo sapiens
acaacauccgccuccugg

SEQ ID NO: 13790 - RNA, 18 nt, Homo sapiens
auauagaauuugauaaua

SEQ ID NO: 13791 - RNA, 20 nt, Homo sapiens
auuaguaauauugagcgcuc

SEQ ID NO: 13792 - RNA, 19 nt, Homo sapiens
gaaucugccauccacauca

SEQ ID NO: 13793 - RNA, 22 nt, Homo sapiens
gacggcauuaguuuuucccuua

SEQ ID NO: 13794 - RNA, 19 nt, Homo sapiens
gggggugcugggccuggcg

SEQ ID NO: 13795 - RNA, 22 nt, Homo sapiens
aaacugaagccaagccacauca

SEQ ID NO: 13796 - RNA, 19 nt, Homo sapiens
agcuauuacaaauauaaca

SEQ ID NO: 13797 - RNA, 20 nt, Homo sapiens
auagauguuuuuuuuuauuc

SEQ ID NO: 13798 - RNA, 20 nt, Homo sapiens
auauauuuucuaccauucca

SEQ ID NO: 13799 - RNA, 21 nt, Homo sapiens
uuucuagauggcuuuaauuuu

SEQ ID NO: 13800 - RNA, 19 nt, Homo sapiens
aucuguuaaacugaugaca

SEQ ID NO: 13801 - RNA, 21 nt, Homo sapiens
gacuuagguggguagcaaugc

SEQ ID NO: 13802 - RNA, 18 nt, Homo sapiens
ucugcccugguuugugug

SEQ ID NO: 13803 - RNA, 19 nt, Homo sapiens
ugaugacagacauaacuca

SEQ ID NO: 13804 - RNA, 19 nt, Homo sapiens
uguaauacgcuguacagua

SEQ ID NO: 13805 - RNA, 18 nt, Homo sapiens
ggaggucgacgacuccgu

SEQ ID NO: 13806 - RNA, 28 nt, Homo sapiens
ugggagcaacuguaaauaacuugcccug

SEQ ID NO: 13807 - RNA, 26 nt, Homo sapiens
aaagacuggauccaaacccaucuucc

SEQ ID NO: 13808 - RNA, 20 nt, Homo sapiens
ucacaccaccccccaugcca

SEQ ID NO: 13809 - RNA, 22 nt, Homo sapiens
uccccuugcaaaccaucccagc

SEQ ID NO: 13810 - RNA, 26 nt, Homo sapiens
ugaggucucuguggcaggccugguca

SEQ ID NO: 13811 - RNA, 18 nt, Homo sapiens
uggccuuuggcaugagau

SEQ ID NO: 13812 - RNA, 17 nt, Homo sapiens
auuauuucaagccgcca

SEQ ID NO: 13813 - RNA, 17 nt, Homo sapiens
cuggcagccaggcaauc

SEQ ID NO: 13814 - RNA, 18 nt, Homo sapiens
aagagagguuauagagua

SEQ ID NO: 13815 - RNA, 22 nt, Homo sapiens
acauagguauauauaugccaug

SEQ ID NO: 13816 - RNA, 18 nt, Homo sapiens
acuguucccucugcuccu

SEQ ID NO: 13817 - RNA, 20 nt, Homo sapiens
ggcacaugacaacuuugcca

SEQ ID NO: 13818 - RNA, 17 nt, Homo sapiens
aaacacugaaccauucu

SEQ ID NO: 13819 - RNA, 18 nt, Homo sapiens
agggcaaucugucuuuaa

SEQ ID NO: 13820 - RNA, 23 nt, Homo sapiens
uccaaaaguuucucuagguccca

SEQ ID NO: 13821 - RNA, 22 nt, Homo sapiens
ggcugaaacuuagugauugcca

SEQ ID NO: 13822 - RNA, 19 nt, Homo sapiens
guugaagauuuauggacag

SEQ ID NO: 13823 - RNA, 22 nt, Homo sapiens
gcccuaacccuuggcuccagga

SEQ ID NO: 13824 - RNA, 20 nt, Homo sapiens
gggccccccgccccucccuc

SEQ ID NO: 13825 - RNA, 16 nt, Homo sapiens
ucauuacugucuccug

SEQ ID NO: 13826 - RNA, 19 nt, Homo sapiens
uguagcuauaucugccccu

SEQ ID NO: 13827 - RNA, 20 nt, Homo sapiens
ggucuggcccgccugccaca

SEQ ID NO: 13828 - RNA, 16 nt, Homo sapiens
aauguguguugugagc

SEQ ID NO: 13829 - RNA, 18 nt, Homo sapiens
cacacucucauucacaca

SEQ ID NO: 13830 - RNA, 17 nt, Homo sapiens
cuccuuugucccucuga

SEQ ID NO: 13831 - RNA, 22 nt, Homo sapiens
uccuggugaagcauggcuucgg

SEQ ID NO: 13832 - RNA, 16 nt, Homo sapiens
uggucauuucaaucca

SEQ ID NO: 13833 - RNA, 15 nt, Homo sapiens
caaauucaguauccu

SEQ ID NO: 13834 - RNA, 20 nt, Homo sapiens
guaacugccauauuauauaa

SEQ ID NO: 13835 - RNA, 18 nt, Homo sapiens
guccuguacaucauucuc

SEQ ID NO: 13836 - RNA, 19 nt, Homo sapiens
ugaacuauacuugaaggac

SEQ ID NO: 13837 - RNA, 22 nt, Homo sapiens
uuccauguucuacuucagcuaa

SEQ ID NO: 13838 - RNA, 17 nt, Homo sapiens
uagguacuguaaucuac

SEQ ID NO: 13839 - RNA, 22 nt, Homo sapiens
uuugcgccggagugccugugaa

SEQ ID NO: 13840 - RNA, 19 nt, Homo sapiens
gccucugucccucugguca

SEQ ID NO: 13841 - RNA, 19 nt, Homo sapiens
ggagucggggauaaacauc

SEQ ID NO: 13842 - RNA, 15 nt, Homo sapiens
uuucuuccuuuuaua

SEQ ID NO: 13843 - RNA, 17 nt, Homo sapiens
accgccacagcacucaa

SEQ ID NO: 13844 - RNA, 23 nt, Homo sapiens
ccgcucccucacucgaacacaca

SEQ ID NO: 13845 - RNA, 20 nt, Homo sapiens
gcuccugcuccuccuccgcu

SEQ ID NO: 13846 - RNA, 19 nt, Homo sapiens
aagcgauucucucaccuca

SEQ ID NO: 13847 - RNA, 18 nt, Homo sapiens
aauuuuuguauuuuuaga

SEQ ID NO: 13848 - RNA, 18 nt, Homo sapiens
ccugcaaccuccaccucc

SEQ ID NO: 13849 - RNA, 20 nt, Homo sapiens
uggccaggcuggucuugaac

SEQ ID NO: 13850 - RNA, 18 nt, Homo sapiens
aaaacuucagauuguuca

SEQ ID NO: 13851 - RNA, 20 nt, Homo sapiens
ggacauugagaucacuuguc

SEQ ID NO: 13852 - RNA, 23 nt, Homo sapiens
guuuuacuuuaccuucacuaaca

SEQ ID NO: 13853 - RNA, 21 nt, Homo sapiens
ucugcgcgcccuuccaacgaa

SEQ ID NO: 13854 - RNA, 18 nt, Homo sapiens
accuuugauuccuggcuu

SEQ ID NO: 13855 - RNA, 18 nt, Homo sapiens
acuguuggacaaaugaua

SEQ ID NO: 13856 - RNA, 22 nt, Homo sapiens
cuaaaagaauuacagggauguu

SEQ ID NO: 13857 - RNA, 19 nt, Homo sapiens
agucccaccauaagagcua

SEQ ID NO: 13858 - RNA, 20 nt, Homo sapiens
ccagucaaaaagaaagugag

SEQ ID NO: 13859 - RNA, 18 nt, Homo sapiens
cuuucagacuuaaacuga

SEQ ID NO: 13860 - RNA, 22 nt, Homo sapiens
ugaggcuuucagacuuaaacug

SEQ ID NO: 13861 - RNA, 20 nt, Homo sapiens
ugagguuugagguccugguc

SEQ ID NO: 13862 - RNA, 19 nt, Homo sapiens
ugugaguguguuuccagaa

SEQ ID NO: 13863 - RNA, 16 nt, Homo sapiens
acagguaccauguucc

SEQ ID NO: 13864 - RNA, 17 nt, Homo sapiens
ccgagaccagcaccccg

SEQ ID NO: 13865 - RNA, 21 nt, Homo sapiens
gucauuguuuuacugcccuca

SEQ ID NO: 13866 - RNA, 20 nt, Homo sapiens
gugguacccaguuuuaggaa

SEQ ID NO: 13867 - RNA, 23 nt, Homo sapiens
aacaauuagaacacaacaggcca

SEQ ID NO: 13868 - RNA, 18 nt, Homo sapiens
uauguugcuguguuguua

SEQ ID NO: 13869 - RNA, 25 nt, Homo sapiens
aggaagaggaucaccuuccaagaca

SEQ ID NO: 13870 - RNA, 18 nt, Homo sapiens
ugcuaucaaaccacuucu

SEQ ID NO: 13871 - RNA, 19 nt, Homo sapiens
caaauaccaacauccaucc

SEQ ID NO: 13872 - RNA, 21 nt, Homo sapiens
cacccucagagauucugauua

SEQ ID NO: 13873 - RNA, 18 nt, Homo sapiens
cacagugaaaauucucgg

SEQ ID NO: 13874 - RNA, 18 nt, Homo sapiens
acuucccuucguuugcau

SEQ ID NO: 13875 - RNA, 19 nt, Homo sapiens
aggaaagagaggaaacauc

SEQ ID NO: 13876 - RNA, 19 nt, Homo sapiens
aaagcccauguucugugag

SEQ ID NO: 13877 - RNA, 19 nt, Homo sapiens
ggccaagauagaaucugua

SEQ ID NO: 13878 - RNA, 18 nt, Homo sapiens
accucagggcugcauuca

SEQ ID NO: 13879 - RNA, 21 nt, Homo sapiens
agcaacaguuugucuccaguc

SEQ ID NO: 13880 - RNA, 19 nt, Homo sapiens
cacuugugccaucuucuuu

SEQ ID NO: 13881 - RNA, 21 nt, Homo sapiens
gcaaaaacacauccugagaca

SEQ ID NO: 13882 - RNA, 15 nt, Homo sapiens
gccugggguuucggg

SEQ ID NO: 13883 - RNA, 24 nt, Homo sapiens
caagccccccuugacauccucuca

SEQ ID NO: 13884 - RNA, 24 nt, Homo sapiens
ucuacuggauuagcccuacucuuu

SEQ ID NO: 13885 - RNA, 19 nt, Homo sapiens
caaaauacaacuccucagc

SEQ ID NO: 13886 - RNA, 18 nt, Homo sapiens
cagaauuguugguccuca

SEQ ID NO: 13887 - RNA, 18 nt, Homo sapiens
cuucagacaauuccaaau

SEQ ID NO: 13888 - RNA, 22 nt, Homo sapiens
ugaagaauucugcuucagagua

SEQ ID NO: 13889 - RNA, 18 nt, Homo sapiens
augacuccagaggaccuc

SEQ ID NO: 13890 - RNA, 22 nt, Homo sapiens
caacucucccaaaauggcucag

SEQ ID NO: 13891 - RNA, 17 nt, Homo sapiens
ccugauccggucugugg

SEQ ID NO: 13892 - RNA, 19 nt, Homo sapiens
gccacagccacacguguga

SEQ ID NO: 13893 - RNA, 19 nt, Homo sapiens
gcccaaucacagacaagca

SEQ ID NO: 13894 - RNA, 20 nt, Homo sapiens
uuggccccuggaggugagcu

SEQ ID NO: 13895 - RNA, 18 nt, Homo sapiens
uuuuccagagccuguuag

SEQ ID NO: 13896 - RNA, 22 nt, Homo sapiens
cccggcuaagccagaagagcca

SEQ ID NO: 13897 - RNA, 19 nt, Homo sapiens
cacuuccugccccauuugg

SEQ ID NO: 13898 - RNA, 23 nt, Homo sapiens
cccuggcccagaggucuggcgga

SEQ ID NO: 13899 - RNA, 23 nt, Homo sapiens
ccugaaccucuuaacuuaauaaa

SEQ ID NO: 13900 - RNA, 18 nt, Homo sapiens
cuggucccccucugucuc

SEQ ID NO: 13901 - RNA, 17 nt, Homo sapiens
gcgcggcggcgggcggc

SEQ ID NO: 13902 - RNA, 20 nt, Homo sapiens
caagaacaguuuugagccau

SEQ ID NO: 13903 - RNA, 19 nt, Homo sapiens
ccgccagccgccuucccca

SEQ ID NO: 13904 - RNA, 22 nt, Homo sapiens
cuggggacgcuguuuucuuuua

SEQ ID NO: 13905 - RNA, 17 nt, Homo sapiens
aaauacuucaucacuaa

SEQ ID NO: 13906 - RNA, 20 nt, Homo sapiens
aagaauuuccuuugcugggc

SEQ ID NO: 13907 - RNA, 18 nt, Homo sapiens
aauccauuaccauguaca

SEQ ID NO: 13908 - RNA, 23 nt, Homo sapiens
cuuccauagcuuauuaacacuaa

SEQ ID NO: 13909 - RNA, 21 nt, Homo sapiens
uacuaaugaauugaacuguga

SEQ ID NO: 13910 - RNA, 21 nt, Homo sapiens
uccauagcuuauuaacacuaa

SEQ ID NO: 13911 - RNA, 18 nt, Homo sapiens
aaaagaagaaucaauuuu

SEQ ID NO: 13912 - RNA, 17 nt, Homo sapiens
acaauccauaacaucca

SEQ ID NO: 13913 - RNA, 23 nt, Homo sapiens
gugcugugacuucggugaauuuu

SEQ ID NO: 13914 - RNA, 22 nt, Homo sapiens
uguagauuuguuaaaugugugu

SEQ ID NO: 13915 - RNA, 19 nt, Homo sapiens
uguugggauauggaaugaa

SEQ ID NO: 13916 - RNA, 21 nt, Homo sapiens
uucaaacaucugaggcaugau

SEQ ID NO: 13917 - RNA, 23 nt, Homo sapiens
aaaguaggucugcagcuauuuca

SEQ ID NO: 13918 - RNA, 18 nt, Homo sapiens
cugucuuucaccuuucca

SEQ ID NO: 13919 - RNA, 25 nt, Homo sapiens
uuucuaucauguccaacacauucaa

SEQ ID NO: 13920 - RNA, 24 nt, Homo sapiens
aucauggggaacagauguguucca

SEQ ID NO: 13921 - RNA, 18 nt, Homo sapiens
uccaccuccuggguucaa

SEQ ID NO: 13922 - RNA, 18 nt, Homo sapiens
ucuugaccucaugaucca

SEQ ID NO: 13923 - RNA, 19 nt, Homo sapiens
ucaguuguguauuuguuca

SEQ ID NO: 13924 - RNA, 19 nt, Homo sapiens
ccaagcccagcccaccucc

SEQ ID NO: 13925 - RNA, 18 nt, Homo sapiens
gcugagccauucuccuca

SEQ ID NO: 13926 - RNA, 20 nt, Homo sapiens
ucacugagcagggacuguca

SEQ ID NO: 13927 - RNA, 22 nt, Homo sapiens
uccugggcaaggaacuuaaacu

SEQ ID NO: 13928 - RNA, 24 nt, Homo sapiens
uaaguuguaacugagauugcaaua

SEQ ID NO: 13929 - RNA, 19 nt, Homo sapiens
ugcauuaagagaaagcaau

SEQ ID NO: 13930 - RNA, 26 nt, Homo sapiens
uuaaaggccugguucuaaguccuuuu

SEQ ID NO: 13931 - RNA, 19 nt, Homo sapiens
gcaggucucucagcacuga

SEQ ID NO: 13932 - RNA, 18 nt, Homo sapiens
acugacauuacauagcua

SEQ ID NO: 13933 - RNA, 22 nt, Homo sapiens
gagccaagauggcaccacugca

SEQ ID NO: 13934 - RNA, 22 nt, Homo sapiens
uuuguguguguguguguuugug

SEQ ID NO: 13935 - RNA, 20 nt, Homo sapiens
augagagaagacugugacaa

SEQ ID NO: 13936 - RNA, 19 nt, Homo sapiens
ccacaauuccaggcaaugg

SEQ ID NO: 13937 - RNA, 22 nt, Homo sapiens
gaguuguaaccauuuucuggua

SEQ ID NO: 13938 - RNA, 21 nt, Homo sapiens
ugauguggaauauacuaaagc

SEQ ID NO: 13939 - RNA, 22 nt, Homo sapiens
uuguaaccauuuucugguauca

SEQ ID NO: 13940 - RNA, 22 nt, Homo sapiens
uuguaauucuccccacccuuga

SEQ ID NO: 13941 - RNA, 18 nt, Homo sapiens
augauugugcuacugcac

SEQ ID NO: 13942 - RNA, 24 nt, Homo sapiens
cagaaaaccuccacggccuuuuca

SEQ ID NO: 13943 - RNA, 22 nt, Homo sapiens
ucuacuuuguauucuugugagg

SEQ ID NO: 13944 - RNA, 19 nt, Homo sapiens
accucugacucccugguuc

SEQ ID NO: 13945 - RNA, 27 nt, Homo sapiens
ccauccccucuucuaccuccugcaacc

SEQ ID NO: 13946 - RNA, 19 nt, Homo sapiens
ccuuccccacccccucccc

SEQ ID NO: 13947 - RNA, 16 nt, Homo sapiens
acuuucaagauccaaa

SEQ ID NO: 13948 - RNA, 17 nt, Homo sapiens
caaaaacaagaugacca

SEQ ID NO: 13949 - RNA, 22 nt, Homo sapiens
caggauuaaacuagguuugguu

SEQ ID NO: 13950 - RNA, 25 nt, Homo sapiens
ccaagagcaaauccacauuccucuu

SEQ ID NO: 13951 - RNA, 19 nt, Homo sapiens
ggauggcgacaagggcagc

SEQ ID NO: 13952 - RNA, 18 nt, Homo sapiens
ggcuucuauauugcauuu

SEQ ID NO: 13953 - RNA, 18 nt, Homo sapiens
ggugcuauuucucuguaa

SEQ ID NO: 13954 - RNA, 18 nt, Homo sapiens
ucuguguguguaguuuug

SEQ ID NO: 13955 - RNA, 21 nt, Homo sapiens
guugaagcaacuguuugucuu

SEQ ID NO: 13956 - RNA, 17 nt, Homo sapiens
uggcccuaaacauguaa

SEQ ID NO: 13957 - RNA, 17 nt, Homo sapiens
aggcaguuccccgguga

SEQ ID NO: 13958 - RNA, 16 nt, Homo sapiens
ccccacccccgcagcu

SEQ ID NO: 13959 - RNA, 18 nt, Homo sapiens
ccuuccuccuccagguac

SEQ ID NO: 13960 - RNA, 19 nt, Homo sapiens
ucaacaucuaagccuguug

SEQ ID NO: 13961 - RNA, 21 nt, Homo sapiens
caggacccccacaccacccca

SEQ ID NO: 13962 - RNA, 20 nt, Homo sapiens
caugaaacccccacccccac

SEQ ID NO: 13963 - RNA, 18 nt, Homo sapiens
agauuauauauuucccuc

SEQ ID NO: 13964 - RNA, 18 nt, Homo sapiens
auccagugucaugcuuac

SEQ ID NO: 13965 - RNA, 20 nt, Homo sapiens
augugccuguuuaaagcacu

SEQ ID NO: 13966 - RNA, 20 nt, Homo sapiens
gacauuacauucuguacuua

SEQ ID NO: 13967 - RNA, 25 nt, Homo sapiens
gagcuacuuucaucuaaaccuguaa

SEQ ID NO: 13968 - RNA, 23 nt, Homo sapiens
aaaaugucuugcaaugugcugua

SEQ ID NO: 13969 - RNA, 17 nt, Homo sapiens
auacauguuauuaguug

SEQ ID NO: 13970 - RNA, 22 nt, Homo sapiens
cccgucucuacuaaaaauacca

SEQ ID NO: 13971 - RNA, 18 nt, Homo sapiens
gaacagaagcuuaauguu

SEQ ID NO: 13972 - RNA, 18 nt, Homo sapiens
gugauagcaguugucauu

SEQ ID NO: 13973 - RNA, 16 nt, Homo sapiens
uaauguggagugacua

SEQ ID NO: 13974 - RNA, 20 nt, Homo sapiens
uucuuuacuuuucuuuggug

SEQ ID NO: 13975 - RNA, 24 nt, Homo sapiens
aaaaugaagugucaaaaaaucuca

SEQ ID NO: 13976 - RNA, 21 nt, Homo sapiens
gcagaauucaacuuuuuaaac

SEQ ID NO: 13977 - RNA, 23 nt, Homo sapiens
ugccccugaaaaguuuuugcuga

SEQ ID NO: 13978 - RNA, 22 nt, Homo sapiens
ugcuuaugguaaaauuugccug

SEQ ID NO: 13979 - RNA, 24 nt, Homo sapiens
caugaccucuguauucucuaguua

SEQ ID NO: 13980 - RNA, 21 nt, Homo sapiens
gucccaccgcugccccuacug

SEQ ID NO: 13981 - RNA, 22 nt, Homo sapiens
ucaaaaucauugcagaguauua

SEQ ID NO: 13982 - RNA, 20 nt, Homo sapiens
auauuaaucauauguuuugu

SEQ ID NO: 13983 - RNA, 20 nt, Homo sapiens
uugccugaaaauauuuguga

SEQ ID NO: 13984 - RNA, 20 nt, Homo sapiens
acgucagagaacuuaaacug

SEQ ID NO: 13985 - RNA, 22 nt, Homo sapiens
acucaccacaaggguccgcggc

SEQ ID NO: 13986 - RNA, 19 nt, Homo sapiens
cagugagaccaagaaccca

SEQ ID NO: 13987 - RNA, 20 nt, Homo sapiens
gaaacuccgaacacauccga

SEQ ID NO: 13988 - RNA, 21 nt, Homo sapiens
uuucucagcuucuuuggccuu

SEQ ID NO: 13989 - RNA, 17 nt, Homo sapiens
agcucugcaccauccuc

SEQ ID NO: 13990 - RNA, 22 nt, Homo sapiens
caaagcuuuaggcaugauucca

SEQ ID NO: 13991 - RNA, 24 nt, Homo sapiens
gcuguuuuugggggugccuggaga

SEQ ID NO: 13992 - RNA, 24 nt, Homo sapiens
aaaagacuucaaguaaauauaaga

SEQ ID NO: 13993 - RNA, 19 nt, Homo sapiens
cauuuccucucaaaccuua

SEQ ID NO: 13994 - RNA, 23 nt, Homo sapiens
gauguggaaauaucuucagccaa

SEQ ID NO: 13995 - RNA, 17 nt, Homo sapiens
gcuagaugacaaucuca

SEQ ID NO: 13996 - RNA, 20 nt, Homo sapiens
gugaagguagcaauacuuca

SEQ ID NO: 13997 - RNA, 23 nt, Homo sapiens
guaguuggcaagaugaaaugcca

SEQ ID NO: 13998 - RNA, 16 nt, Homo sapiens
ccuguuuauuguggga

SEQ ID NO: 13999 - RNA, 20 nt, Homo sapiens
uugcccccccuuuccaucuc

SEQ ID NO: 14000 - RNA, 18 nt, Homo sapiens
ggcucauuuccccgauga

SEQ ID NO: 14001 - RNA, 23 nt, Homo sapiens
cccacaaaagcaagcauugauuu

SEQ ID NO: 14002 - RNA, 23 nt, Homo sapiens
gaauuccaucuuggcuucccuaa

SEQ ID NO: 14003 - RNA, 19 nt, Homo sapiens
gauccaaaacagccucucu

SEQ ID NO: 14004 - RNA, 18 nt, Homo sapiens
uccucugcucagguucag

SEQ ID NO: 14005 - RNA, 23 nt, Homo sapiens
gcgguuuuaucuucccccuuguc

SEQ ID NO: 14006 - RNA, 19 nt, Homo sapiens
aggccuccccagcaaugug

SEQ ID NO: 14007 - RNA, 21 nt, Homo sapiens
aucuuggcucacugcaaccuc

SEQ ID NO: 14008 - RNA, 18 nt, Homo sapiens
ccugcaaccuccaccucc

SEQ ID NO: 14009 - RNA, 19 nt, Homo sapiens
cugcaaccuccaccuccca

SEQ ID NO: 14010 - RNA, 23 nt, Homo sapiens
cuguaaguuuccugaggccuccc

SEQ ID NO: 14011 - RNA, 24 nt, Homo sapiens
ggcgugggccgccgcacccggcca

SEQ ID NO: 14012 - RNA, 18 nt, Homo sapiens
uccaccucccagguucaa

SEQ ID NO: 14013 - RNA, 22 nt, Homo sapiens
auccacagguaacaccaugaug

SEQ ID NO: 14014 - RNA, 19 nt, Homo sapiens
cugaccacagagcgcugcu

SEQ ID NO: 14015 - RNA, 18 nt, Homo sapiens
agccgagaacccagggcc

SEQ ID NO: 14016 - RNA, 18 nt, Homo sapiens
caccugaaccacgagcca

SEQ ID NO: 14017 - RNA, 22 nt, Homo sapiens
cgagguugaagggucuugguca

SEQ ID NO: 14018 - RNA, 18 nt, Homo sapiens
ggccaccugaaccacgag

SEQ ID NO: 14019 - RNA, 18 nt, Homo sapiens
ucaucgacaacgaaaagc

SEQ ID NO: 14020 - RNA, 19 nt, Homo sapiens
cauggugucaggcaccugu

SEQ ID NO: 14021 - RNA, 18 nt, Homo sapiens
ccccacccccccccccgc

SEQ ID NO: 14022 - RNA, 20 nt, Homo sapiens
cuguuaugagcugaccccca

SEQ ID NO: 14023 - RNA, 21 nt, Homo sapiens
gucuuucuauuauuguagaga

SEQ ID NO: 14024 - RNA, 16 nt, Homo sapiens
ugaucaccacaacuca

SEQ ID NO: 14025 - RNA, 16 nt, Homo sapiens
ugaucaccacaacuca

SEQ ID NO: 14026 - RNA, 21 nt, Homo sapiens
uuuugggagcauugagccugc

SEQ ID NO: 14027 - RNA, 22 nt, Homo sapiens
acaaucccucacugcugccuca

SEQ ID NO: 14028 - RNA, 19 nt, Homo sapiens
cccagagggccucccccag

SEQ ID NO: 14029 - RNA, 19 nt, Homo sapiens
gacgggguuucacucuguc

SEQ ID NO: 14030 - RNA, 23 nt, Homo sapiens
uccaagggacaggcaguucuucu

SEQ ID NO: 14031 - RNA, 21 nt, Homo sapiens
aacugccacagauagcugcca

SEQ ID NO: 14032 - RNA, 27 nt, Homo sapiens
cccuaucauuauuucaccaagccaaua

SEQ ID NO: 14033 - RNA, 18 nt, Homo sapiens
gcuccaagaggcuccuga

SEQ ID NO: 14034 - RNA, 18 nt, Homo sapiens
ggaacccagcaacacgcu

SEQ ID NO: 14035 - RNA, 17 nt, Homo sapiens
ucaccaagccaauacca

SEQ ID NO: 14036 - RNA, 19 nt, Homo sapiens
ucguggaaguggccgugca

SEQ ID NO: 14037 - RNA, 21 nt, Homo sapiens
ucugggacuucccgguggagu

SEQ ID NO: 14038 - RNA, 19 nt, Homo sapiens
cccugggccagggucugug

SEQ ID NO: 14039 - RNA, 19 nt, Homo sapiens
ucaauaaagauuucaagau

SEQ ID NO: 14040 - RNA, 17 nt, Homo sapiens
ccggccccucccacccc

SEQ ID NO: 14041 - RNA, 23 nt, Homo sapiens
gccccucccaccccccugccucu

SEQ ID NO: 14042 - RNA, 18 nt, Homo sapiens
acagguggcuguuggucu

SEQ ID NO: 14043 - RNA, 24 nt, Homo sapiens
cucuggcuaccuagggaccugugg

SEQ ID NO: 14044 - RNA, 20 nt, Homo sapiens
cugcugggcgugaacacccu

SEQ ID NO: 14045 - RNA, 18 nt, Homo sapiens
aaggggggaggggucccg

SEQ ID NO: 14046 - RNA, 15 nt, Homo sapiens
acaguuucuguugaa

SEQ ID NO: 14047 - RNA, 17 nt, Homo sapiens
ucuucuuuuuuuucuca

SEQ ID NO: 14048 - RNA, 17 nt, Homo sapiens
aaacagaucaggaagca

SEQ ID NO: 14049 - RNA, 18 nt, Homo sapiens
aaaccucacauuugugaa

SEQ ID NO: 14050 - RNA, 18 nt, Homo sapiens
auaaaauauguucuuuag

SEQ ID NO: 14051 - RNA, 22 nt, Homo sapiens
cagaaaccuccaucaaaccuca

SEQ ID NO: 14052 - RNA, 22 nt, Homo sapiens
cauuugugaacucaaacgaugu

SEQ ID NO: 14053 - RNA, 18 nt, Homo sapiens
ugauauuuuucaugcucc

SEQ ID NO: 14054 - RNA, 18 nt, Homo sapiens
aaggcuugauguguauaa

SEQ ID NO: 14055 - RNA, 21 nt, Homo sapiens
accagaagggaggcccuggaa

SEQ ID NO: 14056 - RNA, 25 nt, Homo sapiens
uaaagauacaaaaugguauuguuua

SEQ ID NO: 14057 - RNA, 18 nt, Homo sapiens
acauauauauacacacac

SEQ ID NO: 14058 - RNA, 19 nt, Homo sapiens
aucgugucugcuuauaaua

SEQ ID NO: 14059 - RNA, 17 nt, Homo sapiens
caagaaaccuugggcca

SEQ ID NO: 14060 - RNA, 19 nt, Homo sapiens
cugacucauggaucuggua

SEQ ID NO: 14061 - RNA, 16 nt, Homo sapiens
ggaucgugucugcuua

SEQ ID NO: 14062 - RNA, 18 nt, Homo sapiens
ggugcagccuacauggca

SEQ ID NO: 14063 - RNA, 19 nt, Homo sapiens
guauacaguuauuuucuca

SEQ ID NO: 14064 - RNA, 18 nt, Homo sapiens
uucaagaaaccuugggcc

SEQ ID NO: 14065 - RNA, 19 nt, Homo sapiens
uuuaggaucgugucugcuu

SEQ ID NO: 14066 - RNA, 19 nt, Homo sapiens
aacauuuaaaaagaugaca

SEQ ID NO: 14067 - RNA, 21 nt, Homo sapiens
cggggcggugcccccaccgca

SEQ ID NO: 14068 - RNA, 21 nt, Homo sapiens
uuuuucagauuguuuugauuu

SEQ ID NO: 14069 - RNA, 23 nt, Homo sapiens
gcgcgaaacauggcggggcagga

SEQ ID NO: 14070 - RNA, 21 nt, Homo sapiens
aaaacaaaaacccaaccaaac

SEQ ID NO: 14071 - RNA, 22 nt, Homo sapiens
aacugacaaauuaaggagguua

SEQ ID NO: 14072 - RNA, 21 nt, Homo sapiens
gccugggcaacagguaagacu

SEQ ID NO: 14073 - RNA, 19 nt, Homo sapiens
guucaagaaaaguacuuca

SEQ ID NO: 14074 - RNA, 16 nt, Homo sapiens
acugcaauuauucagu

SEQ ID NO: 14075 - RNA, 25 nt, Homo sapiens
cuuuuuuauagccuauuucuuuaau

SEQ ID NO: 14076 - RNA, 25 nt, Homo sapiens
gaacccaaggcucaaauuuacuguc

SEQ ID NO: 14077 - RNA, 19 nt, Homo sapiens
uaggguguagaccuccagu

SEQ ID NO: 14078 - RNA, 22 nt, Homo sapiens
cauccacccuucuccaugcuca

SEQ ID NO: 14079 - RNA, 21 nt, Homo sapiens
cuggagcaaggcacucucaaa

SEQ ID NO: 14080 - RNA, 23 nt, Homo sapiens
uuucuuuguucagcuuuaguuuu

SEQ ID NO: 14081 - RNA, 23 nt, Homo sapiens
gugucucggaaaugguuggcuuu

SEQ ID NO: 14082 - RNA, 20 nt, Homo sapiens
ugaggcacuugggcuugguu

SEQ ID NO: 14083 - RNA, 21 nt, Homo sapiens
acacgacgucuguguggagcc

SEQ ID NO: 14084 - RNA, 22 nt, Homo sapiens
agcaaaccuucccagcagcccu

SEQ ID NO: 14085 - RNA, 22 nt, Homo sapiens
agcugccacuucuuuugccuca

SEQ ID NO: 14086 - RNA, 21 nt, Homo sapiens
gacuggagggugagucccuca

SEQ ID NO: 14087 - RNA, 17 nt, Homo sapiens
gcaggggugaggcggug

SEQ ID NO: 14088 - RNA, 21 nt, Homo sapiens
guccagagccccagcagggag

SEQ ID NO: 14089 - RNA, 21 nt, Homo sapiens
uaccuaggacaccagcugcca

SEQ ID NO: 14090 - RNA, 21 nt, Homo sapiens
aagacuggugcuguucauuca

SEQ ID NO: 14091 - RNA, 18 nt, Homo sapiens
aggagaaucaauucuuca

SEQ ID NO: 14092 - RNA, 18 nt, Homo sapiens
ugauggagacauucugaa

SEQ ID NO: 14093 - RNA, 24 nt, Homo sapiens
uuuuuucauacuacuguuaacuuu

SEQ ID NO: 14094 - RNA, 21 nt, Homo sapiens
ccuucccggccauuucugucc

SEQ ID NO: 14095 - RNA, 18 nt, Homo sapiens
agccucagguggcagaug

SEQ ID NO: 14096 - RNA, 19 nt, Homo sapiens
ccuggaaggcagaugagcu

SEQ ID NO: 14097 - RNA, 17 nt, Homo sapiens
gcuuacaucccauuuug

SEQ ID NO: 14098 - RNA, 19 nt, Homo sapiens
gucuacuguuuuaaugaga

SEQ ID NO: 14099 - RNA, 21 nt, Homo sapiens
uagaaccuuagguagaacucc

SEQ ID NO: 14100 - RNA, 20 nt, Homo sapiens
aggugcccgccaccacacca

SEQ ID NO: 14101 - RNA, 25 nt, Homo sapiens
gauuguauaaugugauuuuuuuuag

SEQ ID NO: 14102 - RNA, 22 nt, Homo sapiens
ggugcuauuuaaggugugcaau

SEQ ID NO: 14103 - RNA, 19 nt, Homo sapiens
uaguuaaaaguuuuuguca

SEQ ID NO: 14104 - RNA, 17 nt, Homo sapiens
ucaagugauucuccugc

SEQ ID NO: 14105 - RNA, 20 nt, Homo sapiens
uggccaggcuggucuugaac

SEQ ID NO: 14106 - RNA, 21 nt, Homo sapiens
acccgugccacgcgcucugca

SEQ ID NO: 14107 - RNA, 20 nt, Homo sapiens
caccugcacaccgucccucu

SEQ ID NO: 14108 - RNA, 19 nt, Homo sapiens
cgcccuccucccuccgcua

SEQ ID NO: 14109 - RNA, 17 nt, Homo sapiens
cugcacaccccugcaca

SEQ ID NO: 14110 - RNA, 19 nt, Homo sapiens
aaacacugauuuuaaaauc

SEQ ID NO: 14111 - RNA, 20 nt, Homo sapiens
aagugacugagaaucuagca

SEQ ID NO: 14112 - RNA, 18 nt, Homo sapiens
ccauguguguugaucaga

SEQ ID NO: 14113 - RNA, 21 nt, Homo sapiens
uuaaaaaugaccaaaacaugu

SEQ ID NO: 14114 - RNA, 26 nt, Homo sapiens
aaagacacgauuccucagaccaguga

SEQ ID NO: 14115 - RNA, 20 nt, Homo sapiens
cagagacuauaaagauuuca

SEQ ID NO: 14116 - RNA, 18 nt, Homo sapiens
ccuuagaucucccuucca

SEQ ID NO: 14117 - RNA, 21 nt, Homo sapiens
ccuucccuucacuucugucca

SEQ ID NO: 14118 - RNA, 16 nt, Homo sapiens
uucagagaccguucca

SEQ ID NO: 14119 - RNA, 21 nt, Homo sapiens
uuccagagaccaccuucccag

SEQ ID NO: 14120 - RNA, 19 nt, Homo sapiens
uucuccugcucugcagcuu

SEQ ID NO: 14121 - RNA, 21 nt, Homo sapiens
caaggcugugaacaaacauac

SEQ ID NO: 14122 - RNA, 23 nt, Homo sapiens
caugggccauuuaaaguguuuca

SEQ ID NO: 14123 - RNA, 16 nt, Homo sapiens
ccagcgaacccacuuu

SEQ ID NO: 14124 - RNA, 24 nt, Homo sapiens
gagaaauaggggagugggggccca

SEQ ID NO: 14125 - RNA, 21 nt, Homo sapiens
gacccuggguagacucccaca

SEQ ID NO: 14126 - RNA, 21 nt, Homo sapiens
gccugggcuggugucaggccc

SEQ ID NO: 14127 - RNA, 19 nt, Homo sapiens
uguguuggccauuucugga

SEQ ID NO: 14128 - RNA, 17 nt, Homo sapiens
uucuuugagccuuagcc

SEQ ID NO: 14129 - RNA, 20 nt, Homo sapiens
uugagacuuucccacaugau

SEQ ID NO: 14130 - RNA, 16 nt, Homo sapiens
gagccccuguccccac

SEQ ID NO: 14131 - RNA, 17 nt, Homo sapiens
agcccccuggauggcag

SEQ ID NO: 14132 - RNA, 18 nt, Homo sapiens
gccacgcugaaccagccg

SEQ ID NO: 14133 - RNA, 20 nt, Homo sapiens
aaaagauauauaugugugac

SEQ ID NO: 14134 - RNA, 18 nt, Homo sapiens
uuauguggaaaacccuca

SEQ ID NO: 14135 - RNA, 21 nt, Homo sapiens
aagaaaggagggaaaaaccau

SEQ ID NO: 14136 - RNA, 20 nt, Homo sapiens
aaggcuggugccaguaguua

SEQ ID NO: 14137 - RNA, 23 nt, Homo sapiens
cuuccauugaggagcccaggcug

SEQ ID NO: 14138 - RNA, 21 nt, Homo sapiens
uggcuuugcaccaaauccucc

SEQ ID NO: 14139 - RNA, 17 nt, Homo sapiens
aguguguuuuaacuagc

SEQ ID NO: 14140 - RNA, 20 nt, Homo sapiens
cuguauauuguuuacuuuau

SEQ ID NO: 14141 - RNA, 23 nt, Homo sapiens
gcaguuuaggaccugcugucaua

SEQ ID NO: 14142 - RNA, 26 nt, Homo sapiens
gcguuggaagaguuguuggggguuuu

SEQ ID NO: 14143 - RNA, 18 nt, Homo sapiens
ccagcugaccaccccucc

SEQ ID NO: 14144 - RNA, 16 nt, Homo sapiens
cucucucucucucuca

SEQ ID NO: 14145 - RNA, 21 nt, Homo sapiens
cucuuucucucucucucucuc

SEQ ID NO: 14146 - RNA, 19 nt, Homo sapiens
ugaccaccccucccagcuc

SEQ ID NO: 14147 - RNA, 21 nt, Homo sapiens
uggaacccccaagugaggcug

SEQ ID NO: 14148 - RNA, 20 nt, Homo sapiens
aaaaaguuacagaaauacua

SEQ ID NO: 14149 - RNA, 22 nt, Homo sapiens
aaacaguugugaaccaagaucu

SEQ ID NO: 14150 - RNA, 18 nt, Homo sapiens
uaauaucauucacuagcu

SEQ ID NO: 14151 - RNA, 18 nt, Homo sapiens
ucuugcucuaucucucaa

SEQ ID NO: 14152 - RNA, 20 nt, Homo sapiens
aaaaaguuacagaaauacua

SEQ ID NO: 14153 - RNA, 22 nt, Homo sapiens
aaacaguugugaaccaagaucu

SEQ ID NO: 14154 - RNA, 18 nt, Homo sapiens
uaauaucauucacuagcu

SEQ ID NO: 14155 - RNA, 18 nt, Homo sapiens
ucuugcucuaucucucaa

SEQ ID NO: 14156 - RNA, 20 nt, Homo sapiens
aaaaaguuacagaaauacua

SEQ ID NO: 14157 - RNA, 22 nt, Homo sapiens
aaacaguugugaaccaagaucu

SEQ ID NO: 14158 - RNA, 20 nt, Homo sapiens
gccucugccuuggggaguua

SEQ ID NO: 14159 - RNA, 18 nt, Homo sapiens
uaauaucauucacuagcu

SEQ ID NO: 14160 - RNA, 18 nt, Homo sapiens
ucuugcucuaucucucaa

SEQ ID NO: 14161 - RNA, 17 nt, Homo sapiens
augaauauuucauaucu

SEQ ID NO: 14162 - RNA, 21 nt, Homo sapiens
cccuagcccccccagugugca

SEQ ID NO: 14163 - RNA, 20 nt, Homo sapiens
ccuguugcugaaaccauaca

SEQ ID NO: 14164 - RNA, 22 nt, Homo sapiens
cggcacuccagccugggugaca

SEQ ID NO: 14165 - RNA, 16 nt, Homo sapiens
ucaagaaccgguuucc

SEQ ID NO: 14166 - RNA, 22 nt, Homo sapiens
uuguacaaaauacguuuuguaa

SEQ ID NO: 14167 - RNA, 17 nt, Homo sapiens
augaauauuucauaucu

SEQ ID NO: 14168 - RNA, 21 nt, Homo sapiens
cccuagcccccccagugugca

SEQ ID NO: 14169 - RNA, 20 nt, Homo sapiens
ccuguugcugaaaccauaca

SEQ ID NO: 14170 - RNA, 22 nt, Homo sapiens
cggcacuccagccugggugaca

SEQ ID NO: 14171 - RNA, 16 nt, Homo sapiens
ucaagaaccgguuucc

SEQ ID NO: 14172 - RNA, 22 nt, Homo sapiens
uuguacaaaauacguuuuguaa

SEQ ID NO: 14173 - RNA, 17 nt, Homo sapiens
augaauauuucauaucu

SEQ ID NO: 14174 - RNA, 21 nt, Homo sapiens
cccuagcccccccagugugca

SEQ ID NO: 14175 - RNA, 20 nt, Homo sapiens
ccuguugcugaaaccauaca

SEQ ID NO: 14176 - RNA, 22 nt, Homo sapiens
cggcacuccagccugggugaca

SEQ ID NO: 14177 - RNA, 16 nt, Homo sapiens
ucaagaaccgguuucc

SEQ ID NO: 14178 - RNA, 22 nt, Homo sapiens
uuguacaaaauacguuuuguaa

SEQ ID NO: 14179 - RNA, 17 nt, Homo sapiens
augaauauuucauaucu

SEQ ID NO: 14180 - RNA, 21 nt, Homo sapiens
cccuagcccccccagugugca

SEQ ID NO: 14181 - RNA, 20 nt, Homo sapiens
ccuguugcugaaaccauaca

SEQ ID NO: 14182 - RNA, 22 nt, Homo sapiens
cggcacuccagccugggugaca

SEQ ID NO: 14183 - RNA, 21 nt, Homo sapiens
guaaagcugcuugugaauuuu

SEQ ID NO: 14184 - RNA, 16 nt, Homo sapiens
ucaagaaccgguuucc

SEQ ID NO: 14185 - RNA, 22 nt, Homo sapiens
uuguacaaaauacguuuuguaa

SEQ ID NO: 14186 - RNA, 17 nt, Homo sapiens
augaauauuucauaucu

SEQ ID NO: 14187 - RNA, 21 nt, Homo sapiens
cccuagcccccccagugugca

SEQ ID NO: 14188 - RNA, 20 nt, Homo sapiens
ccuguugcugaaaccauaca

SEQ ID NO: 14189 - RNA, 22 nt, Homo sapiens
cggcacuccagccugggugaca

SEQ ID NO: 14190 - RNA, 16 nt, Homo sapiens
ucaagaaccgguuucc

SEQ ID NO: 14191 - RNA, 22 nt, Homo sapiens
uuguacaaaauacguuuuguaa

SEQ ID NO: 14192 - RNA, 17 nt, Homo sapiens
augaauauuucauaucu

SEQ ID NO: 14193 - RNA, 21 nt, Homo sapiens
cccuagcccccccagugugca

SEQ ID NO: 14194 - RNA, 20 nt, Homo sapiens
ccuguugcugaaaccauaca

SEQ ID NO: 14195 - RNA, 22 nt, Homo sapiens
cggcacuccagccugggugaca

SEQ ID NO: 14196 - RNA, 16 nt, Homo sapiens
ucaagaaccgguuucc

SEQ ID NO: 14197 - RNA, 22 nt, Homo sapiens
uuguacaaaauacguuuuguaa

SEQ ID NO: 14198 - RNA, 17 nt, Homo sapiens
augaauauuucauaucu

SEQ ID NO: 14199 - RNA, 21 nt, Homo sapiens
cccuagcccccccagugugca

SEQ ID NO: 14200 - RNA, 20 nt, Homo sapiens
ccuguugcugaaaccauaca

SEQ ID NO: 14201 - RNA, 22 nt, Homo sapiens
cggcacuccagccugggugaca

SEQ ID NO: 14202 - RNA, 21 nt, Homo sapiens
gaucccccacagccacuacug

SEQ ID NO: 14203 - RNA, 20 nt, Homo sapiens
gggugaaggagcuuucauca

SEQ ID NO: 14204 - RNA, 16 nt, Homo sapiens
ucaagaaccgguuucc

SEQ ID NO: 14205 - RNA, 22 nt, Homo sapiens
uuguacaaaauacguuuuguaa

SEQ ID NO: 14206 - RNA, 17 nt, Homo sapiens
augaauauuucauaucu

SEQ ID NO: 14207 - RNA, 21 nt, Homo sapiens
cccuagcccccccagugugca

SEQ ID NO: 14208 - RNA, 20 nt, Homo sapiens
ccuguugcugaaaccauaca

SEQ ID NO: 14209 - RNA, 22 nt, Homo sapiens
cggcacuccagccugggugaca

SEQ ID NO: 14210 - RNA, 16 nt, Homo sapiens
ucaagaaccgguuucc

SEQ ID NO: 14211 - RNA, 22 nt, Homo sapiens
uuguacaaaauacguuuuguaa

SEQ ID NO: 14212 - RNA, 17 nt, Homo sapiens
augaauauuucauaucu

SEQ ID NO: 14213 - RNA, 21 nt, Homo sapiens
cccuagcccccccagugugca

SEQ ID NO: 14214 - RNA, 20 nt, Homo sapiens
ccuguugcugaaaccauaca

SEQ ID NO: 14215 - RNA, 22 nt, Homo sapiens
cggcacuccagccugggugaca

SEQ ID NO: 14216 - RNA, 16 nt, Homo sapiens
ucaagaaccgguuucc

SEQ ID NO: 14217 - RNA, 22 nt, Homo sapiens
uuguacaaaauacguuuuguaa

SEQ ID NO: 14218 - RNA, 17 nt, Homo sapiens
augaauauuucauaucu

SEQ ID NO: 14219 - RNA, 21 nt, Homo sapiens
cccuagcccccccagugugca

SEQ ID NO: 14220 - RNA, 20 nt, Homo sapiens
ccuguugcugaaaccauaca

SEQ ID NO: 14221 - RNA, 22 nt, Homo sapiens
cggcacuccagccugggugaca

SEQ ID NO: 14222 - RNA, 16 nt, Homo sapiens
ucaagaaccgguuucc

SEQ ID NO: 14223 - RNA, 22 nt, Homo sapiens
uuguacaaaauacguuuuguaa

SEQ ID NO: 14224 - RNA, 19 nt, Homo sapiens
acagcuggugccaaauagc

SEQ ID NO: 14225 - RNA, 17 nt, Homo sapiens
augcacacggcugguca

SEQ ID NO: 14226 - RNA, 18 nt, Homo sapiens
ccacaaacggagccccug

SEQ ID NO: 14227 - RNA, 19 nt, Homo sapiens
ccccacuccucuaagacaa

SEQ ID NO: 14228 - RNA, 21 nt, Homo sapiens
uguccacauccccagagccca

SEQ ID NO: 14229 - RNA, 21 nt, Homo sapiens
cgggugcggagccgccggugg

SEQ ID NO: 14230 - RNA, 18 nt, Homo sapiens
agaaacaucaguuacucu

SEQ ID NO: 14231 - RNA, 22 nt, Homo sapiens
gaauuuuuuucaucuucucugg

SEQ ID NO: 14232 - RNA, 23 nt, Homo sapiens
acucauuaccgucugugauugcc

SEQ ID NO: 14233 - RNA, 19 nt, Homo sapiens
auuucucaucaauucucua

SEQ ID NO: 14234 - RNA, 19 nt, Homo sapiens
ccacagcaaaugagaugua

SEQ ID NO: 14235 - RNA, 18 nt, Homo sapiens
uggauguuucuucuuuga

SEQ ID NO: 14236 - RNA, 17 nt, Homo sapiens
uugggcugggucugcuu

SEQ ID NO: 14237 - RNA, 22 nt, Homo sapiens
cucugaagaggaagccugugag

SEQ ID NO: 14238 - RNA, 22 nt, Homo sapiens
uccagcggcgcgcugcuaguga

SEQ ID NO: 14239 - RNA, 19 nt, Homo sapiens
accacacaccccacugggc

SEQ ID NO: 14240 - RNA, 17 nt, Homo sapiens
ccgcccacccgccccca

SEQ ID NO: 14241 - RNA, 20 nt, Homo sapiens
cugguggugcagcagacauc

SEQ ID NO: 14242 - RNA, 19 nt, Homo sapiens
acucaucuuuuauauucug

SEQ ID NO: 14243 - RNA, 20 nt, Homo sapiens
cugguggugcagcagacauc

SEQ ID NO: 14244 - RNA, 24 nt, Homo sapiens
uagaugggaaguccauggagacua

SEQ ID NO: 14245 - RNA, 20 nt, Homo sapiens
caguugggccauauggugcu

SEQ ID NO: 14246 - RNA, 19 nt, Homo sapiens
caucccuguccucaugacc

SEQ ID NO: 14247 - RNA, 23 nt, Homo sapiens
cuggcacuuacugguccuuacca

SEQ ID NO: 14248 - RNA, 22 nt, Homo sapiens
auuugagcacuuuuuauacaca

SEQ ID NO: 14249 - RNA, 19 nt, Homo sapiens
ccuguugacugcugggccc

SEQ ID NO: 14250 - RNA, 20 nt, Homo sapiens
gaaggcuuugauuuagagua

SEQ ID NO: 14251 - RNA, 21 nt, Homo sapiens
ggccugcccaugagucagggg

SEQ ID NO: 14252 - RNA, 26 nt, Homo sapiens
ugcacuuagaaugauguaauauucca

SEQ ID NO: 14253 - RNA, 21 nt, Homo sapiens
ugggcccgauucugauaugag

SEQ ID NO: 14254 - RNA, 18 nt, Homo sapiens
acuguaccaugccuguca

SEQ ID NO: 14255 - RNA, 23 nt, Homo sapiens
agagugaggaagaagcagaauga

SEQ ID NO: 14256 - RNA, 22 nt, Homo sapiens
agcuucauguugaaagaaccua

SEQ ID NO: 14257 - RNA, 18 nt, Homo sapiens
auugcacaauauagaucu

SEQ ID NO: 14258 - RNA, 18 nt, Homo sapiens
ccugugauuauuguauga

SEQ ID NO: 14259 - RNA, 16 nt, Homo sapiens
cuuguguagcauugca

SEQ ID NO: 14260 - RNA, 17 nt, Homo sapiens
uuccugcacucauucuc

SEQ ID NO: 14261 - RNA, 19 nt, Homo sapiens
aaccagaccacucaggugg

SEQ ID NO: 14262 - RNA, 22 nt, Homo sapiens
acagugugcuccagauggugcu

SEQ ID NO: 14263 - RNA, 23 nt, Homo sapiens
acuaaguaaauucaugcacuuuu

SEQ ID NO: 14264 - RNA, 19 nt, Homo sapiens
cccuaccagcagcugugca

SEQ ID NO: 14265 - RNA, 22 nt, Homo sapiens
cgccaaugcacccccaaccucc

SEQ ID NO: 14266 - RNA, 17 nt, Homo sapiens
gagugagcuggugacca

SEQ ID NO: 14267 - RNA, 19 nt, Homo sapiens
aaccagaccacucaggugg

SEQ ID NO: 14268 - RNA, 22 nt, Homo sapiens
acagugugcuccagauggugcu

SEQ ID NO: 14269 - RNA, 23 nt, Homo sapiens
acuaaguaaauucaugcacuuuu

SEQ ID NO: 14270 - RNA, 17 nt, Homo sapiens
cccaccuguguuccuca

SEQ ID NO: 14271 - RNA, 19 nt, Homo sapiens
cccuaccagcagcugugca

SEQ ID NO: 14272 - RNA, 22 nt, Homo sapiens
cgccaaugcacccccaaccucc

SEQ ID NO: 14273 - RNA, 17 nt, Homo sapiens
gagugagcuggugacca

SEQ ID NO: 14274 - RNA, 19 nt, Homo sapiens
gggcgcaccagugccugga

SEQ ID NO: 14275 - RNA, 18 nt, Homo sapiens
ugugaccgcgccuucuca

SEQ ID NO: 14276 - RNA, 22 nt, Homo sapiens
uucugcuuuuaaugcacuuuuu

SEQ ID NO: 14277 - RNA, 25 nt, Homo sapiens
uaaauggaagggagacaugaaauug

SEQ ID NO: 14278 - RNA, 18 nt, Homo sapiens
aacuuucuaaggcagcua

SEQ ID NO: 14279 - RNA, 19 nt, Homo sapiens
aagcaauucuccugccuca

SEQ ID NO: 14280 - RNA, 24 nt, Homo sapiens
agugcuuccugucccggccugaga

SEQ ID NO: 14281 - RNA, 21 nt, Homo sapiens
ccucaaaacaagcccuuccca

SEQ ID NO: 14282 - RNA, 21 nt, Homo sapiens
ccuuggcgcguggcucgugga

SEQ ID NO: 14283 - RNA, 18 nt, Homo sapiens
cucuacucuuagcacuga

SEQ ID NO: 14284 - RNA, 15 nt, Homo sapiens
cuucugucccauuuu

SEQ ID NO: 14285 - RNA, 18 nt, Homo sapiens
gccccuugcucucaggag

SEQ ID NO: 14286 - RNA, 27 nt, Homo sapiens
gucugaggguuccgguugucuuggccu

SEQ ID NO: 14287 - RNA, 23 nt, Homo sapiens
cuuaacauguaccugucaauguu

SEQ ID NO: 14288 - RNA, 19 nt, Homo sapiens
guguaaaaaaauauauuga

SEQ ID NO: 14289 - RNA, 20 nt, Homo sapiens
uuucaauaccuuuuagauuu

SEQ ID NO: 14290 - RNA, 21 nt, Homo sapiens
aagaaucaagaucuucccucu

SEQ ID NO: 14291 - RNA, 19 nt, Homo sapiens
cagugagagugcaacccca

SEQ ID NO: 14292 - RNA, 17 nt, Homo sapiens
cuauuccaacaguuguu

SEQ ID NO: 14293 - RNA, 20 nt, Homo sapiens
uuuuggaagcacauaacuug

SEQ ID NO: 14294 - RNA, 18 nt, Homo sapiens
ugagagcucugucaguga

SEQ ID NO: 14295 - RNA, 20 nt, Homo sapiens
ggagucucaucugucuuucc

SEQ ID NO: 14296 - RNA, 20 nt, Homo sapiens
agauggaugucgcacacgcc

SEQ ID NO: 14297 - RNA, 21 nt, Homo sapiens
cugcagguuuccauacacuga

SEQ ID NO: 14298 - RNA, 18 nt, Homo sapiens
ucugugguucauauuacu

SEQ ID NO: 14299 - RNA, 18 nt, Homo sapiens
agcaagauggacaaggug

SEQ ID NO: 14300 - RNA, 18 nt, Homo sapiens
caggaaagaagcuuuuaa

SEQ ID NO: 14301 - RNA, 18 nt, Homo sapiens
uccugguaacuguuccag

SEQ ID NO: 14302 - RNA, 25 nt, Homo sapiens
uuucuugggaagcuguuuugguccu

SEQ ID NO: 14303 - RNA, 21 nt, Homo sapiens
auuuggacuguuguucugcuu

SEQ ID NO: 14304 - RNA, 20 nt, Homo sapiens
cuaaugaaucauugauugac

SEQ ID NO: 14305 - RNA, 18 nt, Homo sapiens
gcuuaaaacauuugccaa

SEQ ID NO: 14306 - RNA, 23 nt, Homo sapiens
uaccugaagugagucuuugggua

SEQ ID NO: 14307 - RNA, 21 nt, Homo sapiens
ucacuggauuuuaccaaguaa

SEQ ID NO: 14308 - RNA, 19 nt, Homo sapiens
agagaacauuccucugcag

SEQ ID NO: 14309 - RNA, 18 nt, Homo sapiens
gauuguucuguccaguuu

SEQ ID NO: 14310 - RNA, 21 nt, Homo sapiens
uuagcuacuuuucagaauuga

SEQ ID NO: 14311 - RNA, 19 nt, Homo sapiens
cuaugguggaaauuugugg

SEQ ID NO: 14312 - RNA, 20 nt, Homo sapiens
gcugaaaccccaucuccacu

SEQ ID NO: 14313 - RNA, 20 nt, Homo sapiens
uggguaacagagugagacug

SEQ ID NO: 14314 - RNA, 16 nt, Homo sapiens
ugugcugagaacaccc

SEQ ID NO: 14315 - RNA, 17 nt, Homo sapiens
cccuggcggcggggacc

SEQ ID NO: 14316 - RNA, 20 nt, Homo sapiens
agccugggcaacauagugag

SEQ ID NO: 14317 - RNA, 21 nt, Homo sapiens
gcuucugggagaccucgggga

SEQ ID NO: 14318 - RNA, 25 nt, Homo sapiens
uucugagcuucuuugcagccuuuga

SEQ ID NO: 14319 - RNA, 21 nt, Homo sapiens
agucucuucucacuacagugu

SEQ ID NO: 14320 - RNA, 20 nt, Homo sapiens
augucuaugcccgucacaua

SEQ ID NO: 14321 - RNA, 19 nt, Homo sapiens
ggccgggugcaguggcuua

SEQ ID NO: 14322 - RNA, 20 nt, Homo sapiens
ccuagacaaccaagaccgcu

SEQ ID NO: 14323 - RNA, 18 nt, Homo sapiens
ccugcaaccuccaccucc

SEQ ID NO: 14324 - RNA, 23 nt, Homo sapiens
gagaagcagauuuggagagauca

SEQ ID NO: 14325 - RNA, 22 nt, Homo sapiens
gcaccugaauucuuuuucuuca

SEQ ID NO: 14326 - RNA, 23 nt, Homo sapiens
ucugguagcaccugaauucuuuu

SEQ ID NO: 14327 - RNA, 18 nt, Homo sapiens
ugccuggcaagguccuuc

SEQ ID NO: 14328 - RNA, 18 nt, Homo sapiens
uuccuugcucucuggugu

SEQ ID NO: 14329 - RNA, 22 nt, Homo sapiens
uucuauuggucagacauugaug

SEQ ID NO: 14330 - RNA, 18 nt, Homo sapiens
auccugaagugugggugg

SEQ ID NO: 14331 - RNA, 23 nt, Homo sapiens
auguucggacuggaaacauuucu

SEQ ID NO: 14332 - RNA, 20 nt, Homo sapiens
ccuguucucaacaacaggga

SEQ ID NO: 14333 - RNA, 21 nt, Homo sapiens
cucuuucucucucucucucuc

SEQ ID NO: 14334 - RNA, 20 nt, Homo sapiens
gaauucuccauauauucacu

SEQ ID NO: 14335 - RNA, 19 nt, Homo sapiens
gagcccuccuauuuucaca

SEQ ID NO: 14336 - RNA, 26 nt, Homo sapiens
guguguauuucaaauuuguuugacua

SEQ ID NO: 14337 - RNA, 16 nt, Homo sapiens
uccauauauucacuaa

SEQ ID NO: 14338 - RNA, 21 nt, Homo sapiens
ucuggaauuacaagauuucua

SEQ ID NO: 14339 - RNA, 20 nt, Homo sapiens
ucuuguuugggggaucuugg

SEQ ID NO: 14340 - RNA, 18 nt, Homo sapiens
ugcccaggugaccuguuc

SEQ ID NO: 14341 - RNA, 19 nt, Homo sapiens
acauggcauuugggaaagc

SEQ ID NO: 14342 - RNA, 20 nt, Homo sapiens
accagagagggaggccacug

SEQ ID NO: 14343 - RNA, 23 nt, Homo sapiens
aucaggcgccuuccuggccugau

SEQ ID NO: 14344 - RNA, 18 nt, Homo sapiens
cacacgugucacagccag

SEQ ID NO: 14345 - RNA, 21 nt, Homo sapiens
ccuagccuucaaguugcuuuu

SEQ ID NO: 14346 - RNA, 23 nt, Homo sapiens
ccucagccuaguugcuuuaaucu

SEQ ID NO: 14347 - RNA, 20 nt, Homo sapiens
gcugugguuaguaucuuguu

SEQ ID NO: 14348 - RNA, 20 nt, Homo sapiens
gugccaggaccaccccaccu

SEQ ID NO: 14349 - RNA, 17 nt, Homo sapiens
uccuucugagacucuca

SEQ ID NO: 14350 - RNA, 21 nt, Homo sapiens
ucuggggaugugcccuuccca

SEQ ID NO: 14351 - RNA, 18 nt, Homo sapiens
ugcuggugugugcaggga

SEQ ID NO: 14352 - RNA, 21 nt, Homo sapiens
ugcuuuucagccaugaaacua

SEQ ID NO: 14353 - RNA, 23 nt, Homo sapiens
ugggugggcuuuggcagguggcu

SEQ ID NO: 14354 - RNA, 18 nt, Homo sapiens
uguccucuggggaugugc

SEQ ID NO: 14355 - RNA, 17 nt, Homo sapiens
ccacacugaugauucuc

SEQ ID NO: 14356 - RNA, 20 nt, Homo sapiens
cccuggugguuccgcugugg

SEQ ID NO: 14357 - RNA, 18 nt, Homo sapiens
cuccguccuccucuggcc

SEQ ID NO: 14358 - RNA, 18 nt, Homo sapiens
cugcagagccccgcuguc

SEQ ID NO: 14359 - RNA, 22 nt, Homo sapiens
gcaccccuggcccucccagcca

SEQ ID NO: 14360 - RNA, 21 nt, Homo sapiens
gcaggugggcgcucgcgucuc

SEQ ID NO: 14361 - RNA, 18 nt, Homo sapiens
gccacaaacaggcucaua

SEQ ID NO: 14362 - RNA, 19 nt, Homo sapiens
gcccccggccccggcccca

SEQ ID NO: 14363 - RNA, 17 nt, Homo sapiens
ggcagcaccugcucuga

SEQ ID NO: 14364 - RNA, 18 nt, Homo sapiens
ggccccuuggauuccugg

SEQ ID NO: 14365 - RNA, 21 nt, Homo sapiens
ggugguuccgcuguggggcug

SEQ ID NO: 14366 - RNA, 20 nt, Homo sapiens
cauauguauauacaggcuga

SEQ ID NO: 14367 - RNA, 21 nt, Homo sapiens
cugguccuccccaccacccca

SEQ ID NO: 14368 - RNA, 25 nt, Homo sapiens
guauuaguaaacuugaguuacuuuu

SEQ ID NO: 14369 - RNA, 20 nt, Homo sapiens
ucuuuuccauuuuacuuugc

SEQ ID NO: 14370 - RNA, 21 nt, Homo sapiens
uguuuugaaauguuugccaaa

SEQ ID NO: 14371 - RNA, 18 nt, Homo sapiens
aagaguagcaauacugca

SEQ ID NO: 14372 - RNA, 21 nt, Homo sapiens
ggaggagcuuaguaaguggug

SEQ ID NO: 14373 - RNA, 17 nt, Homo sapiens
augagacuuuaaugcaa

SEQ ID NO: 14374 - RNA, 21 nt, Homo sapiens
auuuauagucucaaaauuccu

SEQ ID NO: 14375 - RNA, 16 nt, Homo sapiens
gaagaaaccacuauuu

SEQ ID NO: 14376 - RNA, 18 nt, Homo sapiens
cccccaagccacuaucca

SEQ ID NO: 14377 - RNA, 20 nt, Homo sapiens
cuucuuuauaaacuugacuu

SEQ ID NO: 14378 - RNA, 17 nt, Homo sapiens
cuuuuuccauuguuuaa

SEQ ID NO: 14379 - RNA, 21 nt, Homo sapiens
gaacauuugggguuuuaaacu

SEQ ID NO: 14380 - RNA, 22 nt, Homo sapiens
gauuuguuuuauccacuuuuuu

SEQ ID NO: 14381 - RNA, 20 nt, Homo sapiens
accuagagaaagccagcaaa

SEQ ID NO: 14382 - RNA, 20 nt, Homo sapiens
acccgauaugucauuaugca

SEQ ID NO: 14383 - RNA, 20 nt, Homo sapiens
acguuggccaguuuuccuca

SEQ ID NO: 14384 - RNA, 17 nt, Homo sapiens
acuagguauucuugcuc

SEQ ID NO: 14385 - RNA, 22 nt, Homo sapiens
acuuggacaaccugacuggcuu

SEQ ID NO: 14386 - RNA, 18 nt, Homo sapiens
cccuggcccuucaagaua

SEQ ID NO: 14387 - RNA, 24 nt, Homo sapiens
cuaugcauacauauauacacacau

SEQ ID NO: 14388 - RNA, 18 nt, Homo sapiens
cucuccuucaauugcuga

SEQ ID NO: 14389 - RNA, 19 nt, Homo sapiens
cuuaucaaagagauuuuaa

SEQ ID NO: 14390 - RNA, 22 nt, Homo sapiens
gaggcugaagucacccugggaa

SEQ ID NO: 14391 - RNA, 19 nt, Homo sapiens
gauucucuuauuuccggga

SEQ ID NO: 14392 - RNA, 20 nt, Homo sapiens
ugagauguugaugugaacug

SEQ ID NO: 14393 - RNA, 18 nt, Homo sapiens
ccaccaaccaccaccucc

SEQ ID NO: 14394 - RNA, 19 nt, Homo sapiens
ccuugcauuaaaccaguga

SEQ ID NO: 14395 - RNA, 17 nt, Homo sapiens
uccacugguggcucaga

SEQ ID NO: 14396 - RNA, 22 nt, Homo sapiens
agcaguuuucuuaccuuugccu

SEQ ID NO: 14397 - RNA, 19 nt, Homo sapiens
uucuuaaggagcuuuaagc

SEQ ID NO: 14398 - RNA, 17 nt, Homo sapiens
uucuuucaaucuucuca

SEQ ID NO: 14399 - RNA, 22 nt, Homo sapiens
agaagguaacaacuauguugaa

SEQ ID NO: 14400 - RNA, 19 nt, Homo sapiens
cugcaaacuccgccuccca

SEQ ID NO: 14401 - RNA, 23 nt, Homo sapiens
ugcccggcccuaaaaugaaauua

SEQ ID NO: 14402 - RNA, 18 nt, Homo sapiens
ucuguauuguacuaacca

SEQ ID NO: 14403 - RNA, 21 nt, Homo sapiens
aucuuggcucacugcaaccuc

SEQ ID NO: 14404 - RNA, 17 nt, Homo sapiens
caggcccccaccuucuc

SEQ ID NO: 14405 - RNA, 19 nt, Homo sapiens
ccuucucggcuucugguuu

SEQ ID NO: 14406 - RNA, 17 nt, Homo sapiens
cucuuccauuuugcaca

SEQ ID NO: 14407 - RNA, 22 nt, Homo sapiens
gcuugaaaaccguccgaaggca

SEQ ID NO: 14408 - RNA, 20 nt, Homo sapiens
gcuuggaccgaggccugguc

SEQ ID NO: 14409 - RNA, 19 nt, Homo sapiens
guguacacacacuugauug

SEQ ID NO: 14410 - RNA, 17 nt, Homo sapiens
uccaggguuugcaggga

SEQ ID NO: 14411 - RNA, 20 nt, Homo sapiens
uuucacuugugucugcuccu

SEQ ID NO: 14412 - RNA, 23 nt, Homo sapiens
uuucuccccauaucccaaggcga

SEQ ID NO: 14413 - RNA, 21 nt, Homo sapiens
acuaaccuggagacaguaaca

SEQ ID NO: 14414 - RNA, 17 nt, Homo sapiens
agacaucuccucacccc

SEQ ID NO: 14415 - RNA, 19 nt, Homo sapiens
agacuugggggcaggcgcc

SEQ ID NO: 14416 - RNA, 25 nt, Homo sapiens
agagauuccccuggaccacaccucc

SEQ ID NO: 14417 - RNA, 18 nt, Homo sapiens
agugaaugggaaagggug

SEQ ID NO: 14418 - RNA, 20 nt, Homo sapiens
ccugaaaaaugacuguccca

SEQ ID NO: 14419 - RNA, 23 nt, Homo sapiens
cggaucuccccugaccgcucucc

SEQ ID NO: 14420 - RNA, 21 nt, Homo sapiens
uccugaaaaaugacuguccca

SEQ ID NO: 14421 - RNA, 24 nt, Homo sapiens
ugggaccugcuaaguguggaauua

SEQ ID NO: 14422 - RNA, 18 nt, Homo sapiens
uuccucuggagcuuugca

SEQ ID NO: 14423 - RNA, 20 nt, Homo sapiens
ccagaugccuucuagauuca

SEQ ID NO: 14424 - RNA, 21 nt, Homo sapiens
gaugugaucuuggaacuucca

SEQ ID NO: 14425 - RNA, 21 nt, Homo sapiens
uaggcucagcucaugaugaca

SEQ ID NO: 14426 - RNA, 22 nt, Homo sapiens
uuguaccaugaguaaaacuuca

SEQ ID NO: 14427 - RNA, 17 nt, Homo sapiens
acccucuccccacuuuu

SEQ ID NO: 14428 - RNA, 22 nt, Homo sapiens
ugggaccugcucuuaaccucaa

SEQ ID NO: 14429 - RNA, 20 nt, Homo sapiens
aaauauguauaauuaugaug

SEQ ID NO: 14430 - RNA, 19 nt, Homo sapiens
agaagcuucaaauuccuca

SEQ ID NO: 14431 - RNA, 20 nt, Homo sapiens
aagugcaaugacuugauuua

SEQ ID NO: 14432 - RNA, 17 nt, Homo sapiens
acuaagcuucugucuua

SEQ ID NO: 14433 - RNA, 17 nt, Homo sapiens
cacauauaaaauaugua

SEQ ID NO: 14434 - RNA, 21 nt, Homo sapiens
ggccuuguuuugcuguagcaa

SEQ ID NO: 14435 - RNA, 24 nt, Homo sapiens
uuuuuuguuugugaccacuaagcu

SEQ ID NO: 14436 - RNA, 18 nt, Homo sapiens
aagcaagaugaaauguca

SEQ ID NO: 14437 - RNA, 18 nt, Homo sapiens
cuguaaucuuuuguuuug

SEQ ID NO: 14438 - RNA, 19 nt, Homo sapiens
acucuucauggaaagcaac

SEQ ID NO: 14439 - RNA, 25 nt, Homo sapiens
gccccgaacuguggucgccaggccc

SEQ ID NO: 14440 - RNA, 19 nt, Homo sapiens
ggccgggugcgguggcuca

SEQ ID NO: 14441 - RNA, 18 nt, Homo sapiens
ucucuacuaaaaaugcaa

SEQ ID NO: 14442 - RNA, 21 nt, Homo sapiens
guuacagcagcagcagcucca

SEQ ID NO: 14443 - RNA, 20 nt, Homo sapiens
accugagucaaaauugucau

SEQ ID NO: 14444 - RNA, 21 nt, Homo sapiens
agcccauuuugccaagauguc

SEQ ID NO: 14445 - RNA, 21 nt, Homo sapiens
cacugucagcccucacuguca

SEQ ID NO: 14446 - RNA, 21 nt, Homo sapiens
gccaccccuuggcacugugga

SEQ ID NO: 14447 - RNA, 23 nt, Homo sapiens
gcucuccaaauuuugcuuuagua

SEQ ID NO: 14448 - RNA, 23 nt, Homo sapiens
gcgcgaagcggaguggaccggga

SEQ ID NO: 14449 - RNA, 25 nt, Homo sapiens
ggaaacgagcccuugacgcuguggc

SEQ ID NO: 14450 - RNA, 21 nt, Homo sapiens
gaguucucuguaguuccucca

SEQ ID NO: 14451 - RNA, 19 nt, Homo sapiens
gaaacaaagaacuccugga

SEQ ID NO: 14452 - RNA, 20 nt, Homo sapiens
guucuuuuuugcuccaagug

SEQ ID NO: 14453 - RNA, 17 nt, Homo sapiens
aaagugacuguacugca

SEQ ID NO: 14454 - RNA, 20 nt, Homo sapiens
ucgaugugauuuuuuuucaa

SEQ ID NO: 14455 - RNA, 18 nt, Homo sapiens
gaauuuuuuuuaaugugg

SEQ ID NO: 14456 - RNA, 22 nt, Homo sapiens
uaaguucauaaucauauuuuuc

SEQ ID NO: 14457 - RNA, 19 nt, Homo sapiens
ugacaguacauaaucaguu

SEQ ID NO: 14458 - RNA, 20 nt, Homo sapiens
uuacacauacaccuguuaua

SEQ ID NO: 14459 - RNA, 22 nt, Homo sapiens
gcuccucgcggccuccgcgucu

SEQ ID NO: 14460 - RNA, 23 nt, Homo sapiens
agaauguugguaaugccauguca

SEQ ID NO: 14461 - RNA, 18 nt, Homo sapiens
gauacaggcauaugucau

SEQ ID NO: 14462 - RNA, 19 nt, Homo sapiens
cacagacgcggacagcgcc

SEQ ID NO: 14463 - RNA, 23 nt, Homo sapiens
cagaguucagcaaggagcugcug

SEQ ID NO: 14464 - RNA, 20 nt, Homo sapiens
uaacagauacgggcagcuag

SEQ ID NO: 14465 - RNA, 19 nt, Homo sapiens
ugaccauugugcacaugcg

SEQ ID NO: 14466 - RNA, 21 nt, Homo sapiens
gucaccuuucuaaagcuuuuu

SEQ ID NO: 14467 - RNA, 23 nt, Homo sapiens
uauuugauucugaucugaaacua

SEQ ID NO: 14468 - RNA, 18 nt, Homo sapiens
accuggcugccuucuuca

SEQ ID NO: 14469 - RNA, 21 nt, Homo sapiens
cgcgcgggcaggcaccugugc

SEQ ID NO: 14470 - RNA, 19 nt, Homo sapiens
cuucaucaaccuucucuca

SEQ ID NO: 14471 - RNA, 19 nt, Homo sapiens
cuucaucaaccuucucuca

SEQ ID NO: 14472 - RNA, 19 nt, Homo sapiens
gccgcccucgagcgcccca

SEQ ID NO: 14473 - RNA, 17 nt, Homo sapiens
guggccuccuggacuca

SEQ ID NO: 14474 - RNA, 19 nt, Homo sapiens
accugggaaguguuguuug

SEQ ID NO: 14475 - RNA, 20 nt, Homo sapiens
ucagcccugguggcccugca

SEQ ID NO: 14476 - RNA, 20 nt, Homo sapiens
aaggucacccaucaccgcca

SEQ ID NO: 14477 - RNA, 19 nt, Homo sapiens
cccuuuauugucuaacuga

SEQ ID NO: 14478 - RNA, 15 nt, Homo sapiens
gcaacauuucaggga

SEQ ID NO: 14479 - RNA, 20 nt, Homo sapiens
ugcccgggacgcccgcacca

SEQ ID NO: 14480 - RNA, 17 nt, Homo sapiens
uggccuuaaccagagcu

SEQ ID NO: 14481 - RNA, 20 nt, Homo sapiens
acagcugcaguuaggaaggg

SEQ ID NO: 14482 - RNA, 22 nt, Homo sapiens
aucuuggcucacugcaaccucu

SEQ ID NO: 14483 - RNA, 22 nt, Homo sapiens
ccucucccaggucacugucuca

SEQ ID NO: 14484 - RNA, 20 nt, Homo sapiens
ccucugccuccuggguucaa

SEQ ID NO: 14485 - RNA, 22 nt, Homo sapiens
gaagaaccauuuuaacuccauc

SEQ ID NO: 14486 - RNA, 20 nt, Homo sapiens
gcaacugcuuugcaaugaca

SEQ ID NO: 14487 - RNA, 19 nt, Homo sapiens
ucuccagaaugccagccag

SEQ ID NO: 14488 - RNA, 19 nt, Homo sapiens
ucugcuuuggcuuugccgg

SEQ ID NO: 14489 - RNA, 17 nt, Homo sapiens
ugaggacagcuaaucca

SEQ ID NO: 14490 - RNA, 21 nt, Homo sapiens
uggugaggugaccacagcugc

SEQ ID NO: 14491 - RNA, 21 nt, Homo sapiens
uucaagugauucuccugccac

SEQ ID NO: 14492 - RNA, 21 nt, Homo sapiens
gacaccuuuuguugccuucuu

SEQ ID NO: 14493 - RNA, 21 nt, Homo sapiens
gauguacugauggauccucca

SEQ ID NO: 14494 - RNA, 21 nt, Homo sapiens
gcuguggacagagcucccuca

SEQ ID NO: 14495 - RNA, 18 nt, Homo sapiens
ucugaagccaccugguuc

SEQ ID NO: 14496 - RNA, 23 nt, Homo sapiens
ugggugacuugacugugagacug

SEQ ID NO: 14497 - RNA, 17 nt, Homo sapiens
uuuuuuaauuugaggua

SEQ ID NO: 14498 - RNA, 18 nt, Homo sapiens
acaaaagcugguuagguu

SEQ ID NO: 14499 - RNA, 18 nt, Homo sapiens
accuuacccuuauuccuc

SEQ ID NO: 14500 - RNA, 18 nt, Homo sapiens
augccugaugaguuuaua

SEQ ID NO: 14501 - RNA, 18 nt, Homo sapiens
cagcagcagcagcagcac

SEQ ID NO: 14502 - RNA, 18 nt, Homo sapiens
cuuauuccucucugucca

SEQ ID NO: 14503 - RNA, 19 nt, Homo sapiens
cuugguguaguagcaauaa

SEQ ID NO: 14504 - RNA, 25 nt, Homo sapiens
ucaaccucaugucccccaccccuca

SEQ ID NO: 14505 - RNA, 24 nt, Homo sapiens
ucucuuuaccuggggccuggcuuu

SEQ ID NO: 14506 - RNA, 22 nt, Homo sapiens
ucugcacuguccugcacucuuu

SEQ ID NO: 14507 - RNA, 19 nt, Homo sapiens
ugcuaugcaaaacaaucua

SEQ ID NO: 14508 - RNA, 23 nt, Homo sapiens
cccuccccaggggccuccuuucc

SEQ ID NO: 14509 - RNA, 22 nt, Homo sapiens
cuacggaaccagauucugguga

SEQ ID NO: 14510 - RNA, 19 nt, Homo sapiens
uuuguagaaaagguuuccu

SEQ ID NO: 14511 - RNA, 20 nt, Homo sapiens
aaggcaucagucccccugug

SEQ ID NO: 14512 - RNA, 21 nt, Homo sapiens
auguggagacugauggccagg

SEQ ID NO: 14513 - RNA, 18 nt, Homo sapiens
gcugcagccccuugcucu

SEQ ID NO: 14514 - RNA, 19 nt, Homo sapiens
uccaggccucuaguuccag

SEQ ID NO: 14515 - RNA, 19 nt, Homo sapiens
uucccccaccagcugcagc

SEQ ID NO: 14516 - RNA, 17 nt, Homo sapiens
aacaaagaagacuaugu

SEQ ID NO: 14517 - RNA, 23 nt, Homo sapiens
uaaggguucugagcaugaagcug

SEQ ID NO: 14518 - RNA, 24 nt, Homo sapiens
uaaucauguuggcuggucugguca

SEQ ID NO: 14519 - RNA, 19 nt, Homo sapiens
ucuccgcuuaugcuucugg

SEQ ID NO: 14520 - RNA, 17 nt, Homo sapiens
uguaaaagaccaugcaa

SEQ ID NO: 14521 - RNA, 23 nt, Homo sapiens
uuuugcaucagcuguuuaacuuu

SEQ ID NO: 14522 - RNA, 24 nt, Homo sapiens
acuucuuaggagacaugcacuuuu

SEQ ID NO: 14523 - RNA, 23 nt, Homo sapiens
gagaaaguaaugauuccuaaagc

SEQ ID NO: 14524 - RNA, 19 nt, Homo sapiens
aauuccagauuucuuuguc

SEQ ID NO: 14525 - RNA, 17 nt, Homo sapiens
agagugggaagagguga

SEQ ID NO: 14526 - RNA, 17 nt, Homo sapiens
caagaacaaaacuccau

SEQ ID NO: 14527 - RNA, 19 nt, Homo sapiens
cuccuucuuaucugugaua

SEQ ID NO: 14528 - RNA, 16 nt, Homo sapiens
cgcguucaccacuuuu

SEQ ID NO: 14529 - RNA, 17 nt, Homo sapiens
gcgcgacaucggcgaac

SEQ ID NO: 14530 - RNA, 18 nt, Homo sapiens
aguuuuccuguuucccac

SEQ ID NO: 14531 - RNA, 17 nt, Homo sapiens
cauuggccgacaucaca

SEQ ID NO: 14532 - RNA, 19 nt, Homo sapiens
ccugaggcacccacuuggg

SEQ ID NO: 14533 - RNA, 18 nt, Homo sapiens
ccuggcaagucaccugca

SEQ ID NO: 14534 - RNA, 18 nt, Homo sapiens
cugcaccgucuacccuuc

SEQ ID NO: 14535 - RNA, 18 nt, Homo sapiens
cuuaggcguuuugaccuu

SEQ ID NO: 14536 - RNA, 17 nt, Homo sapiens
uaauggagcccuaccuc

SEQ ID NO: 14537 - RNA, 17 nt, Homo sapiens
ucaggaaaacuguucca

SEQ ID NO: 14538 - RNA, 18 nt, Homo sapiens
agcucguaccuucucacc

SEQ ID NO: 14539 - RNA, 22 nt, Homo sapiens
cuggcucauacugcccccacca

SEQ ID NO: 14540 - RNA, 23 nt, Homo sapiens
ugcuguggcaccccaucgcccca

SEQ ID NO: 14541 - RNA, 18 nt, Homo sapiens
cuagagaucaacuuucuc

SEQ ID NO: 14542 - RNA, 18 nt, Homo sapiens
uagagaucaacuuucuca

SEQ ID NO: 14543 - RNA, 22 nt, Homo sapiens
ucuguuacgcuaaacuuuugau

SEQ ID NO: 14544 - RNA, 24 nt, Homo sapiens
ucuuuuuauauuguacauagucuu

SEQ ID NO: 14545 - RNA, 19 nt, Homo sapiens
caucuguugguuacaagau

SEQ ID NO: 14546 - RNA, 21 nt, Homo sapiens
ucugcugaagcuccuaaugga

SEQ ID NO: 14547 - RNA, 18 nt, Homo sapiens
aauggaaauguuuucuaa

SEQ ID NO: 14548 - RNA, 20 nt, Homo sapiens
aggaauauuagaggaaacuu

SEQ ID NO: 14549 - RNA, 21 nt, Homo sapiens
gagcacacaacaaaugucaga

SEQ ID NO: 14550 - RNA, 24 nt, Homo sapiens
agaaagugugaaugcggaguagga

SEQ ID NO: 14551 - RNA, 19 nt, Homo sapiens
ccaagacccuaucuguuca

SEQ ID NO: 14552 - RNA, 24 nt, Homo sapiens
uacgaaggauccccaagcccuuca

SEQ ID NO: 14553 - RNA, 20 nt, Homo sapiens
ugaccuuucccugggcuuca

SEQ ID NO: 14554 - RNA, 20 nt, Homo sapiens
auacuucuguuuucucuugc

SEQ ID NO: 14555 - RNA, 22 nt, Homo sapiens
uacuggcucuuuccugcucugg

SEQ ID NO: 14556 - RNA, 21 nt, Homo sapiens
uucuuuauucaauuuuacuga

SEQ ID NO: 14557 - RNA, 22 nt, Homo sapiens
gagagcaggggacacggugcua

SEQ ID NO: 14558 - RNA, 18 nt, Homo sapiens
ggccaggucuucauccug

SEQ ID NO: 14559 - RNA, 19 nt, Homo sapiens
guccugaaaacccugugga

SEQ ID NO: 14560 - RNA, 17 nt, Homo sapiens
cugcugcaguuaccaug

SEQ ID NO: 14561 - RNA, 17 nt, Homo sapiens
gccccuaaauuuugcac

SEQ ID NO: 14562 - RNA, 16 nt, Homo sapiens
gcugcuuuugcucuga

SEQ ID NO: 14563 - RNA, 23 nt, Homo sapiens
uauuauuucaaauaaauggaaaa

SEQ ID NO: 14564 - RNA, 22 nt, Homo sapiens
ucgugugaccauaagauacuga

SEQ ID NO: 14565 - RNA, 24 nt, Homo sapiens
gacauuuuaauaccaugccagaga

SEQ ID NO: 14566 - RNA, 17 nt, Homo sapiens
uucuugcaauaguaacu

SEQ ID NO: 14567 - RNA, 18 nt, Homo sapiens
acacagaauacaaccuca

SEQ ID NO: 14568 - RNA, 26 nt, Homo sapiens
agaacaacaaaagcacuuuuccaucu

SEQ ID NO: 14569 - RNA, 21 nt, Homo sapiens
aucaaacaggccuggguaucu

SEQ ID NO: 14570 - RNA, 18 nt, Homo sapiens
cucgacaccgaguccuag

SEQ ID NO: 14571 - RNA, 28 nt, Homo sapiens
gccuggguaucugaggcuugcuuggcuu

SEQ ID NO: 14572 - RNA, 17 nt, Homo sapiens
aaugagauggcauguga

SEQ ID NO: 14573 - RNA, 19 nt, Homo sapiens
cagcuuuguggccuuugca

SEQ ID NO: 14574 - RNA, 17 nt, Homo sapiens
ccucccccacuccauuc

SEQ ID NO: 14575 - RNA, 23 nt, Homo sapiens
gcgcuguuugcugcgcgggcuuu

SEQ ID NO: 14576 - RNA, 19 nt, Homo sapiens
ggugcuucugaauuccuga

SEQ ID NO: 14577 - RNA, 19 nt, Homo sapiens
guagccuugacacugaugg

SEQ ID NO: 14578 - RNA, 20 nt, Homo sapiens
uauaugauauuggguugaua

SEQ ID NO: 14579 - RNA, 15 nt, Homo sapiens
ugaggagaaaagcaa

SEQ ID NO: 14580 - RNA, 23 nt, Homo sapiens
ugcaaauucuguuuccaacuuga

SEQ ID NO: 14581 - RNA, 20 nt, Homo sapiens
uuuuaucauauuuuagggug

SEQ ID NO: 14582 - RNA, 19 nt, Homo sapiens
aaagugcugcugauuccca

SEQ ID NO: 14583 - RNA, 18 nt, Homo sapiens
caggaccaccaagccccu

SEQ ID NO: 14584 - RNA, 18 nt, Homo sapiens
ggcuucucccucccguuu

SEQ ID NO: 14585 - RNA, 17 nt, Homo sapiens
ucaccaagcugucucuc

SEQ ID NO: 14586 - RNA, 19 nt, Homo sapiens
caugcacaagaagcacuca

SEQ ID NO: 14587 - RNA, 17 nt, Homo sapiens
cccacccccauaguugu

SEQ ID NO: 14588 - RNA, 20 nt, Homo sapiens
ccccaaacuuccaaauccca

SEQ ID NO: 14589 - RNA, 19 nt, Homo sapiens
uugagcacgagacacuuuu

SEQ ID NO: 14590 - RNA, 23 nt, Homo sapiens
ccacaggccccgccccuccuccc

SEQ ID NO: 14591 - RNA, 20 nt, Homo sapiens
ugaaugagauugaggcgugg

SEQ ID NO: 14592 - RNA, 23 nt, Homo sapiens
uucuggcgguugugggcuucgga

SEQ ID NO: 14593 - RNA, 23 nt, Homo sapiens
cuggguucaggugauucuccuga

SEQ ID NO: 14594 - RNA, 20 nt, Homo sapiens
accaaggauuguggcaacca

SEQ ID NO: 14595 - RNA, 21 nt, Homo sapiens
agaauaaauuucggcuguuuu

SEQ ID NO: 14596 - RNA, 18 nt, Homo sapiens
augaaguccugucacuca

SEQ ID NO: 14597 - RNA, 23 nt, Homo sapiens
ccuagaagcagagacucugugag

SEQ ID NO: 14598 - RNA, 23 nt, Homo sapiens
ccuuuaauccugccacugucaua

SEQ ID NO: 14599 - RNA, 23 nt, Homo sapiens
cgucugacuuagugggcaccuga

SEQ ID NO: 14600 - RNA, 18 nt, Homo sapiens
cucagguccuggcaaguu

SEQ ID NO: 14601 - RNA, 20 nt, Homo sapiens
gaucucagcaaagccacuga

SEQ ID NO: 14602 - RNA, 20 nt, Homo sapiens
gaucucagcaaagccacuga

SEQ ID NO: 14603 - RNA, 21 nt, Homo sapiens
ggaaacagaucucagcaaagc

SEQ ID NO: 14604 - RNA, 21 nt, Homo sapiens
ggugaguggaggagacccaug

SEQ ID NO: 14605 - RNA, 24 nt, Homo sapiens
aaauaaauaacauaaaucguugaa

SEQ ID NO: 14606 - RNA, 18 nt, Homo sapiens
acuggauauaucacuaug

SEQ ID NO: 14607 - RNA, 21 nt, Homo sapiens
caccguaaccacugcacauca

SEQ ID NO: 14608 - RNA, 22 nt, Homo sapiens
cugugcaaauaaacuccuuuua

SEQ ID NO: 14609 - RNA, 17 nt, Homo sapiens
guggggcagcggcugug

SEQ ID NO: 14610 - RNA, 19 nt, Homo sapiens
uagugaaacuuaucugaug

SEQ ID NO: 14611 - RNA, 20 nt, Homo sapiens
uauuuagcaauauuugauga

SEQ ID NO: 14612 - RNA, 20 nt, Homo sapiens
ugcacaucaccuccaucucu

SEQ ID NO: 14613 - RNA, 21 nt, Homo sapiens
ccaccuuccacccccaacucc

SEQ ID NO: 14614 - RNA, 24 nt, Homo sapiens
ccuuccacccccaacucccuucca

SEQ ID NO: 14615 - RNA, 20 nt, Homo sapiens
gcuccaggggcugccaggga

SEQ ID NO: 14616 - RNA, 23 nt, Homo sapiens
uccuguaucuguaaacacuuuuu

SEQ ID NO: 14617 - RNA, 19 nt, Homo sapiens
cagagacgccacaacuuca

SEQ ID NO: 14618 - RNA, 21 nt, Homo sapiens
ccuuggugguccucaugugga

SEQ ID NO: 14619 - RNA, 18 nt, Homo sapiens
gaccugauaugggauccc

SEQ ID NO: 14620 - RNA, 15 nt, Homo sapiens
gcccgucaggggcca

SEQ ID NO: 14621 - RNA, 19 nt, Homo sapiens
ggccggacgcaguagcuua

SEQ ID NO: 14622 - RNA, 22 nt, Homo sapiens
guaguuguaggguacuuuguca

SEQ ID NO: 14623 - RNA, 17 nt, Homo sapiens
gugcuggcuuuucugga

SEQ ID NO: 14624 - RNA, 26 nt, Homo sapiens
gugucuuuuugcuuuuggugaacuuu

SEQ ID NO: 14625 - RNA, 18 nt, Homo sapiens
uccagaaagguaauggug

SEQ ID NO: 14626 - RNA, 20 nt, Homo sapiens
uccucuuauucuuccacaaa

SEQ ID NO: 14627 - RNA, 17 nt, Homo sapiens
ugucccaaggcauaacu

SEQ ID NO: 14628 - RNA, 18 nt, Homo sapiens
ugucugauuuuuacaaug

SEQ ID NO: 14629 - RNA, 18 nt, Homo sapiens
uguugaguguucuuugga

SEQ ID NO: 14630 - RNA, 21 nt, Homo sapiens
acacugccgucgcuuuugcug

SEQ ID NO: 14631 - RNA, 20 nt, Homo sapiens
ucuggggcgcucuccggugu

SEQ ID NO: 14632 - RNA, 22 nt, Homo sapiens
agccaaagcagggagccuuucu

SEQ ID NO: 14633 - RNA, 19 nt, Homo sapiens
aguccaguuuucaauauga

SEQ ID NO: 14634 - RNA, 18 nt, Homo sapiens
auugcaugcugcucagac

SEQ ID NO: 14635 - RNA, 20 nt, Homo sapiens
cacacagaccuguuuccuuu

SEQ ID NO: 14636 - RNA, 21 nt, Homo sapiens
caccacaaucaacuauugaca

SEQ ID NO: 14637 - RNA, 22 nt, Homo sapiens
ccuguucaucucuuucaugccc

SEQ ID NO: 14638 - RNA, 19 nt, Homo sapiens
gcaaugaccaaauauuuca

SEQ ID NO: 14639 - RNA, 18 nt, Homo sapiens
guaaucauauaaggccau

SEQ ID NO: 14640 - RNA, 18 nt, Homo sapiens
uaguuucuguacaacuga

SEQ ID NO: 14641 - RNA, 23 nt, Homo sapiens
ucaucuguauaauugccaaauga

SEQ ID NO: 14642 - RNA, 25 nt, Homo sapiens
uccaaugcuuuuugacaucuuuaua

SEQ ID NO: 14643 - RNA, 21 nt, Homo sapiens
uccuugcccacacuauggaau

SEQ ID NO: 14644 - RNA, 20 nt, Homo sapiens
ugauacaaccugugacauca

SEQ ID NO: 14645 - RNA, 18 nt, Homo sapiens
uuuaaaacugcuuuucca

SEQ ID NO: 14646 - RNA, 19 nt, Homo sapiens
acuaaggacacaagaauca

SEQ ID NO: 14647 - RNA, 20 nt, Homo sapiens
ccacuaccuccuccaacaaa

SEQ ID NO: 14648 - RNA, 19 nt, Homo sapiens
cccuccacccacuaccucc

SEQ ID NO: 14649 - RNA, 20 nt, Homo sapiens
ccuuugguaucaucaugaaa

SEQ ID NO: 14650 - RNA, 18 nt, Homo sapiens
cuccagagcuggcccuuc

SEQ ID NO: 14651 - RNA, 21 nt, Homo sapiens
cuuagggagguuggugucaga

SEQ ID NO: 14652 - RNA, 19 nt, Homo sapiens
gcucugagccagauuccac

SEQ ID NO: 14653 - RNA, 18 nt, Homo sapiens
ggaggagggcagggcuug

SEQ ID NO: 14654 - RNA, 22 nt, Homo sapiens
gggacagcuaccacuguccucu

SEQ ID NO: 14655 - RNA, 24 nt, Homo sapiens
uggaugggggugaugcagggacug

SEQ ID NO: 14656 - RNA, 18 nt, Homo sapiens
aaguagagcaaagagcca

SEQ ID NO: 14657 - RNA, 24 nt, Homo sapiens
cuguuauuugcugauuuuguuuua

SEQ ID NO: 14658 - RNA, 19 nt, Homo sapiens
gguggacauuauuucccca

SEQ ID NO: 14659 - RNA, 21 nt, Homo sapiens
ucuuuaaacaauucugugagc

SEQ ID NO: 14660 - RNA, 20 nt, Homo sapiens
acguggcuaccaaaugccua

SEQ ID NO: 14661 - RNA, 19 nt, Homo sapiens
caaagaucaaggaauguca

SEQ ID NO: 14662 - RNA, 17 nt, Homo sapiens
ccguggaagcacacucu

SEQ ID NO: 14663 - RNA, 20 nt, Homo sapiens
ggaccaauaaacagccuccu

SEQ ID NO: 14664 - RNA, 17 nt, Homo sapiens
gucaucucuggugucag

SEQ ID NO: 14665 - RNA, 24 nt, Homo sapiens
gucauugcgugugugugguuugug

SEQ ID NO: 14666 - RNA, 17 nt, Homo sapiens
uggguauuaugcagugc

SEQ ID NO: 14667 - RNA, 18 nt, Homo sapiens
uguaccaauuucuuuuaa

SEQ ID NO: 14668 - RNA, 18 nt, Homo sapiens
uucaaauguaaauuguuc

SEQ ID NO: 14669 - RNA, 20 nt, Homo sapiens
uugcgugugugugguuugug

SEQ ID NO: 14670 - RNA, 18 nt, Homo sapiens
ucuugguugcacauguua

SEQ ID NO: 14671 - RNA, 19 nt, Homo sapiens
cuuaagcaggcugaucgcu

SEQ ID NO: 14672 - RNA, 19 nt, Homo sapiens
gggacccggcggcggcggc

SEQ ID NO: 14673 - RNA, 17 nt, Homo sapiens
ucaugggcaacagaggc

SEQ ID NO: 14674 - RNA, 18 nt, Homo sapiens
agaaacuuuggaacaaaa

SEQ ID NO: 14675 - RNA, 17 nt, Homo sapiens
augccuuucauaguuua

SEQ ID NO: 14676 - RNA, 19 nt, Homo sapiens
gaacaggaguuugcugcca

SEQ ID NO: 14677 - RNA, 16 nt, Homo sapiens
gacagccgcugcuucc

SEQ ID NO: 14678 - RNA, 26 nt, Homo sapiens
aucgcauguccuacaaucugcucuua

SEQ ID NO: 14679 - RNA, 19 nt, Homo sapiens
caaauuugcacucugcucc

SEQ ID NO: 14680 - RNA, 26 nt, Homo sapiens
cacuuccauuggucuccaggccccaa

SEQ ID NO: 14681 - RNA, 22 nt, Homo sapiens
gauucaacaggaaaccgaucuu

SEQ ID NO: 14682 - RNA, 16 nt, Homo sapiens
gcagaggacugggcca

SEQ ID NO: 14683 - RNA, 23 nt, Homo sapiens
cuuuuuaauugaagaugucuuga

SEQ ID NO: 14684 - RNA, 16 nt, Homo sapiens
ggagccagccagcgug

SEQ ID NO: 14685 - RNA, 17 nt, Homo sapiens
aucccacccauguugua

SEQ ID NO: 14686 - RNA, 22 nt, Homo sapiens
ccauuaaaaaaccauucucuua

SEQ ID NO: 14687 - RNA, 19 nt, Homo sapiens
cugccccacccccaccucc

SEQ ID NO: 14688 - RNA, 17 nt, Homo sapiens
gccucagggccugguga

SEQ ID NO: 14689 - RNA, 23 nt, Homo sapiens
ucuccuauuaucuauuaucacug

SEQ ID NO: 14690 - RNA, 21 nt, Homo sapiens
ucuggacagacagaaccaucu

SEQ ID NO: 14691 - RNA, 19 nt, Homo sapiens
aucccaccuacagacuacc

SEQ ID NO: 14692 - RNA, 21 nt, Homo sapiens
cuccgaguguccuccccugcc

SEQ ID NO: 14693 - RNA, 20 nt, Homo sapiens
uuccaggaauagcgcuccag

SEQ ID NO: 14694 - RNA, 22 nt, Homo sapiens
uuucaaaauugcagcaguccca

SEQ ID NO: 14695 - RNA, 19 nt, Homo sapiens
aggccccugggcuccuuca

SEQ ID NO: 14696 - RNA, 21 nt, Homo sapiens
agggaagagaaugaggaccac

SEQ ID NO: 14697 - RNA, 19 nt, Homo sapiens
cuuccagagguuucagcuu

SEQ ID NO: 14698 - RNA, 23 nt, Homo sapiens
gauugcuuuguggugauucucag

SEQ ID NO: 14699 - RNA, 16 nt, Homo sapiens
cccuggccagcaccca

SEQ ID NO: 14700 - RNA, 22 nt, Homo sapiens
caggauucaaagcuagguuugg

SEQ ID NO: 14701 - RNA, 18 nt, Homo sapiens
ccugggggugccuggccu

SEQ ID NO: 14702 - RNA, 19 nt, Homo sapiens
gugggugggaagacuagug

SEQ ID NO: 14703 - RNA, 19 nt, Homo sapiens
aagugaugcccuccugcca

SEQ ID NO: 14704 - RNA, 24 nt, Homo sapiens
ccuuacgcuugugggggucugcgg

SEQ ID NO: 14705 - RNA, 16 nt, Homo sapiens
cuagacgcugcuagga

SEQ ID NO: 14706 - RNA, 19 nt, Homo sapiens
caaaauauaaaauguaaca

SEQ ID NO: 14707 - RNA, 20 nt, Homo sapiens
cuggucuuucuugacagggu

SEQ ID NO: 14708 - RNA, 20 nt, Homo sapiens
cuuugcagacguuucacucc

SEQ ID NO: 14709 - RNA, 20 nt, Homo sapiens
gcaaaaaguaccucuucuua

SEQ ID NO: 14710 - RNA, 18 nt, Homo sapiens
agccgcagccucugccgc

SEQ ID NO: 14711 - RNA, 18 nt, Homo sapiens
ccucgggcaccagccugc

SEQ ID NO: 14712 - RNA, 18 nt, Homo sapiens
ccugcccuccccaccccc

SEQ ID NO: 14713 - RNA, 24 nt, Homo sapiens
ccuggcaccaggcucacccaccca

SEQ ID NO: 14714 - RNA, 22 nt, Homo sapiens
gccucugccgcagcgcccccgc

SEQ ID NO: 14715 - RNA, 22 nt, Homo sapiens
gccuggaccccauugucugucu

SEQ ID NO: 14716 - RNA, 19 nt, Homo sapiens
ggguggugcuggcccaguu

SEQ ID NO: 14717 - RNA, 18 nt, Homo sapiens
guaaaaguacaugccaug

SEQ ID NO: 14718 - RNA, 22 nt, Homo sapiens
cgucagggucgccagcgccuca

SEQ ID NO: 14719 - RNA, 20 nt, Homo sapiens
uuuguguguguguaguuuau

SEQ ID NO: 14720 - RNA, 18 nt, Homo sapiens
agauguucuuucacccga

SEQ ID NO: 14721 - RNA, 20 nt, Homo sapiens
gcggccgcgucgacgugaca

SEQ ID NO: 14722 - RNA, 19 nt, Homo sapiens
acagccaucuaacucauua

SEQ ID NO: 14723 - RNA, 19 nt, Homo sapiens
caucuaacucauuaccuua

SEQ ID NO: 14724 - RNA, 23 nt, Homo sapiens
gaauguccgugaugccuaccuca

SEQ ID NO: 14725 - RNA, 18 nt, Homo sapiens
gacuuaauuaugagacug

SEQ ID NO: 14726 - RNA, 19 nt, Homo sapiens
uauuucauauauucucucc

SEQ ID NO: 14727 - RNA, 18 nt, Homo sapiens
ucugcucuuguuugugug

SEQ ID NO: 14728 - RNA, 20 nt, Homo sapiens
acaaacacagagcugcccag

SEQ ID NO: 14729 - RNA, 25 nt, Homo sapiens
accugaacgcaccacccucuggccu

SEQ ID NO: 14730 - RNA, 16 nt, Homo sapiens
agaaaaauaaucuggu

SEQ ID NO: 14731 - RNA, 21 nt, Homo sapiens
cagaagaaaaauaaucugguc

SEQ ID NO: 14732 - RNA, 19 nt, Homo sapiens
uaacagucugcacaguuuc

SEQ ID NO: 14733 - RNA, 22 nt, Homo sapiens
ccagagaccauccagcucauca

SEQ ID NO: 14734 - RNA, 20 nt, Homo sapiens
uuuguuuuauuucacugauu

SEQ ID NO: 14735 - RNA, 19 nt, Homo sapiens
ccacggccucugccucccc

SEQ ID NO: 14736 - RNA, 18 nt, Homo sapiens
aguguuacaacugaguug

SEQ ID NO: 14737 - RNA, 23 nt, Homo sapiens
auugaagauagguuuagcaguaa

SEQ ID NO: 14738 - RNA, 23 nt, Homo sapiens
agcgcgacccugcaggugcugga

SEQ ID NO: 14739 - RNA, 22 nt, Homo sapiens
aguggguggggaagguuguugu

SEQ ID NO: 14740 - RNA, 25 nt, Homo sapiens
cugcacccagccaggucccugggga

SEQ ID NO: 14741 - RNA, 17 nt, Homo sapiens
cugccuugcuuccucca

SEQ ID NO: 14742 - RNA, 19 nt, Homo sapiens
ugguuucggcgugauguug

SEQ ID NO: 14743 - RNA, 17 nt, Homo sapiens
agacgacgauaucagcg

SEQ ID NO: 14744 - RNA, 23 nt, Homo sapiens
cuucugacgagccacacguuugc

SEQ ID NO: 14745 - RNA, 22 nt, Homo sapiens
acagacacagccgccagcccaa

SEQ ID NO: 14746 - RNA, 19 nt, Homo sapiens
ccacagacccaguccucca

SEQ ID NO: 14747 - RNA, 23 nt, Homo sapiens
gccaccccuugaggguggccagg

SEQ ID NO: 14748 - RNA, 16 nt, Homo sapiens
ucuguggagaguggag

SEQ ID NO: 14749 - RNA, 22 nt, Homo sapiens
aaaaacauuccaagccaauugg

SEQ ID NO: 14750 - RNA, 19 nt, Homo sapiens
aguuugcuuaguuacaaca

SEQ ID NO: 14751 - RNA, 21 nt, Homo sapiens
caaccucuagagauugaggua

SEQ ID NO: 14752 - RNA, 23 nt, Homo sapiens
cucuuucuccccccaaaccccuc

SEQ ID NO: 14753 - RNA, 18 nt, Homo sapiens
ucucucucucucugucuc

SEQ ID NO: 14754 - RNA, 19 nt, Homo sapiens
ugcgucuauaugauacuca

SEQ ID NO: 14755 - RNA, 20 nt, Homo sapiens
uuccucuuucauacauucca

SEQ ID NO: 14756 - RNA, 21 nt, Homo sapiens
uuguuugauuucccucugcag

SEQ ID NO: 14757 - RNA, 18 nt, Homo sapiens
uuuucuuguaacaugaua

SEQ ID NO: 14758 - RNA, 19 nt, Homo sapiens
accgggcgcaccaucuuuc

SEQ ID NO: 14759 - RNA, 19 nt, Homo sapiens
cugcugcuuagguccuuuu

SEQ ID NO: 14760 - RNA, 20 nt, Homo sapiens
ucaugcuacccaccaccuca

SEQ ID NO: 14761 - RNA, 22 nt, Homo sapiens
auuuggguugucugucuugucu

SEQ ID NO: 14762 - RNA, 23 nt, Homo sapiens
ccuaggcaccacugaguuguuuu

SEQ ID NO: 14763 - RNA, 17 nt, Homo sapiens
guuuucccaacgugaca

SEQ ID NO: 14764 - RNA, 21 nt, Homo sapiens
auuauauuguugaagccuuca

SEQ ID NO: 14765 - RNA, 18 nt, Homo sapiens
uucaauauauauaccugg

SEQ ID NO: 14766 - RNA, 20 nt, Homo sapiens
accucacccagauaucaucc

SEQ ID NO: 14767 - RNA, 17 nt, Homo sapiens
aggccaccugucacuca

SEQ ID NO: 14768 - RNA, 19 nt, Homo sapiens
cccucuacccuguuccuca

SEQ ID NO: 14769 - RNA, 18 nt, Homo sapiens
ccugaaccagccuggcuu

SEQ ID NO: 14770 - RNA, 22 nt, Homo sapiens
cugcacagucuggccaugugac

SEQ ID NO: 14771 - RNA, 24 nt, Homo sapiens
gcagguggaggccaugccugucuu

SEQ ID NO: 14772 - RNA, 22 nt, Homo sapiens
gcuuggucugaccccuuggccu

SEQ ID NO: 14773 - RNA, 20 nt, Homo sapiens
ucucccaccaagaggccacc

SEQ ID NO: 14774 - RNA, 19 nt, Homo sapiens
uguuccucagcauggagcu

SEQ ID NO: 14775 - RNA, 19 nt, Homo sapiens
uuuccccuguuuucccaca

SEQ ID NO: 14776 - RNA, 21 nt, Homo sapiens
cuccccaagggugccggcacu

SEQ ID NO: 14777 - RNA, 23 nt, Homo sapiens
gcaccagcagccgccuccaugcc

SEQ ID NO: 14778 - RNA, 24 nt, Homo sapiens
gccccacgucaaaggucaagugag

SEQ ID NO: 14779 - RNA, 18 nt, Homo sapiens
ccuagauaacucuacacg

SEQ ID NO: 14780 - RNA, 19 nt, Homo sapiens
gcaccacucugcugcccca

SEQ ID NO: 14781 - RNA, 20 nt, Homo sapiens
gcagcgcaccugccaccccu

SEQ ID NO: 14782 - RNA, 21 nt, Homo sapiens
ucuuuuuaguuccaugaucuu

SEQ ID NO: 14783 - RNA, 16 nt, Homo sapiens
accucaucagagaagc

SEQ ID NO: 14784 - RNA, 18 nt, Homo sapiens
agggucccagcuuaguua

SEQ ID NO: 14785 - RNA, 19 nt, Homo sapiens
ccugaugaguacaugugga

SEQ ID NO: 14786 - RNA, 19 nt, Homo sapiens
ggaagggaauaaucuuuua

SEQ ID NO: 14787 - RNA, 23 nt, Homo sapiens
aucugagccuaucgcccuggccu

SEQ ID NO: 14788 - RNA, 17 nt, Homo sapiens
ggcaguuagccagccca

SEQ ID NO: 14789 - RNA, 24 nt, Homo sapiens
cuguaaaaauguauuaucuuguaa

SEQ ID NO: 14790 - RNA, 18 nt, Homo sapiens
gccaccugggaguucugg

SEQ ID NO: 14791 - RNA, 19 nt, Homo sapiens
auacuguguuuaguacacu

SEQ ID NO: 14792 - RNA, 19 nt, Homo sapiens
aggaugcuguggcuguucu

SEQ ID NO: 14793 - RNA, 21 nt, Homo sapiens
agugagucucaaauuguuuuu

SEQ ID NO: 14794 - RNA, 20 nt, Homo sapiens
aucuuuacucaagaauuuca

SEQ ID NO: 14795 - RNA, 25 nt, Homo sapiens
cuccaggaagaguuaagcacugcuu

SEQ ID NO: 14796 - RNA, 27 nt, Homo sapiens
cuuuuuaguuacagauguuuugacuuu

SEQ ID NO: 14797 - RNA, 21 nt, Homo sapiens
uacuuuauaugcauuaugaug

SEQ ID NO: 14798 - RNA, 16 nt, Homo sapiens
ugauggacaugugaaa

SEQ ID NO: 14799 - RNA, 20 nt, Homo sapiens
ccaggggcuguuauauacau

SEQ ID NO: 14800 - RNA, 19 nt, Homo sapiens
gguuuauaugauuaaauua

SEQ ID NO: 14801 - RNA, 22 nt, Homo sapiens
gucccagauuauuucuguaaga

SEQ ID NO: 14802 - RNA, 17 nt, Homo sapiens
caccacaaugacugucu

SEQ ID NO: 14803 - RNA, 17 nt, Homo sapiens
uaagcuggaacagucca

SEQ ID NO: 14804 - RNA, 19 nt, Homo sapiens
accccgagacaaaaaugcu

SEQ ID NO: 14805 - RNA, 19 nt, Homo sapiens
cucccgcccccaaacccca

SEQ ID NO: 14806 - RNA, 16 nt, Homo sapiens
uccuuuaagaggcggg

SEQ ID NO: 14807 - RNA, 19 nt, Homo sapiens
uguuaggaaaauuaaccaa

SEQ ID NO: 14808 - RNA, 25 nt, Homo sapiens
aguguuaaguagcagguguguugug

SEQ ID NO: 14809 - RNA, 18 nt, Homo sapiens
ucucgcacgcugccccug

SEQ ID NO: 14810 - RNA, 21 nt, Homo sapiens
uggauggaucuucucugaacu

SEQ ID NO: 14811 - RNA, 18 nt, Homo sapiens
uucgugauuccacgucua

SEQ ID NO: 14812 - RNA, 24 nt, Homo sapiens
cccaggcagcugccaagcacuccc

SEQ ID NO: 14813 - RNA, 23 nt, Homo sapiens
cuggacugaggggagugugccca

SEQ ID NO: 14814 - RNA, 22 nt, Homo sapiens
gaaccaagaucacgccacugca

SEQ ID NO: 14815 - RNA, 20 nt, Homo sapiens
auuucuggugugugcagaca

SEQ ID NO: 14816 - RNA, 21 nt, Homo sapiens
cugacagcccaaacugucaga

SEQ ID NO: 14817 - RNA, 20 nt, Homo sapiens
auuuacuccucuuuaucaca

SEQ ID NO: 14818 - RNA, 22 nt, Homo sapiens
caaaguuauauugugauacuca

SEQ ID NO: 14819 - RNA, 21 nt, Homo sapiens
cgaggcuguggagcggcguga

SEQ ID NO: 14820 - RNA, 20 nt, Homo sapiens
uggcaccuagaaugaaguua

SEQ ID NO: 14821 - RNA, 18 nt, Homo sapiens
gagaaugugauuuuuggc

SEQ ID NO: 14822 - RNA, 22 nt, Homo sapiens
auggaagaugguacauucugga

SEQ ID NO: 14823 - RNA, 17 nt, Homo sapiens
gcaccacgcccacgucc

SEQ ID NO: 14824 - RNA, 24 nt, Homo sapiens
uccagauauggguuaaauuccuca

SEQ ID NO: 14825 - RNA, 23 nt, Homo sapiens
uuaaagcauauuuaaguuauuuu

SEQ ID NO: 14826 - RNA, 19 nt, Homo sapiens
gcccacugaggggacagcc

SEQ ID NO: 14827 - RNA, 25 nt, Homo sapiens
gcccgccaagagggggccucugcua

SEQ ID NO: 14828 - RNA, 17 nt, Homo sapiens
ggagaggauagagaggu

SEQ ID NO: 14829 - RNA, 19 nt, Homo sapiens
gggcgggguggggccucca

SEQ ID NO: 14830 - RNA, 18 nt, Homo sapiens
ucugggcagggaccucgg

SEQ ID NO: 14831 - RNA, 23 nt, Homo sapiens
gucacuugacauuacugcuccca

SEQ ID NO: 14832 - RNA, 21 nt, Homo sapiens
uccagacccugacccucccuc

SEQ ID NO: 14833 - RNA, 20 nt, Homo sapiens
ugcuuaaguaagaaucaggc

SEQ ID NO: 14834 - RNA, 21 nt, Homo sapiens
aguuugacaccuugauaccca

SEQ ID NO: 14835 - RNA, 17 nt, Homo sapiens
ucucuggaaaacuauca

SEQ ID NO: 14836 - RNA, 20 nt, Homo sapiens
aagacuugucaaauauauca

SEQ ID NO: 14837 - RNA, 21 nt, Homo sapiens
gaagaaaauccauuuccauga

SEQ ID NO: 14838 - RNA, 25 nt, Homo sapiens
uuuuuucaaacaaguuuuugaccuu

SEQ ID NO: 14839 - RNA, 21 nt, Homo sapiens
aacagauuuacaucccagaca

SEQ ID NO: 14840 - RNA, 19 nt, Homo sapiens
accaggcagccacugugca

SEQ ID NO: 14841 - RNA, 18 nt, Homo sapiens
agcuauugcuccaugaca

SEQ ID NO: 14842 - RNA, 21 nt, Homo sapiens
auuugaacccaggucucgucu

SEQ ID NO: 14843 - RNA, 21 nt, Homo sapiens
gacacagaguauuuuaaaaga

SEQ ID NO: 14844 - RNA, 20 nt, Homo sapiens
ggcugcuggcugucuggcuu

SEQ ID NO: 14845 - RNA, 17 nt, Homo sapiens
ucaagugauucuucugc

SEQ ID NO: 14846 - RNA, 20 nt, Homo sapiens
ucuuuuuggacuuuaaucuu

SEQ ID NO: 14847 - RNA, 20 nt, Homo sapiens
uggccaggcuggucuugaac

SEQ ID NO: 14848 - RNA, 19 nt, Homo sapiens
uuccagaagcugcccucag

SEQ ID NO: 14849 - RNA, 18 nt, Homo sapiens
gcuaagacugucauaaaa

SEQ ID NO: 14850 - RNA, 16 nt, Homo sapiens
ugaagagauuucaaag

SEQ ID NO: 14851 - RNA, 20 nt, Homo sapiens
uuacuuucauuauuauuugc

SEQ ID NO: 14852 - RNA, 19 nt, Homo sapiens
uugaaauauuuuuaucaga

SEQ ID NO: 14853 - RNA, 20 nt, Homo sapiens
cauuugggugggugccaaau

SEQ ID NO: 14854 - RNA, 23 nt, Homo sapiens
ccuuugcuaguuguuugggcuuu

SEQ ID NO: 14855 - RNA, 18 nt, Homo sapiens
cuuauucagccuuaucca

SEQ ID NO: 14856 - RNA, 21 nt, Homo sapiens
gaaaugcacuugccuaugaua

SEQ ID NO: 14857 - RNA, 17 nt, Homo sapiens
gcuuuuuagaauaaugc

SEQ ID NO: 14858 - RNA, 19 nt, Homo sapiens
uccucagggaucacacugc

SEQ ID NO: 14859 - RNA, 23 nt, Homo sapiens
uuuaagcagcuugaaugguuuuu

SEQ ID NO: 14860 - RNA, 20 nt, Homo sapiens
aacaccuuggcuuguuauug

SEQ ID NO: 14861 - RNA, 21 nt, Homo sapiens
aaccuguugaagauuauuuca

SEQ ID NO: 14862 - RNA, 20 nt, Homo sapiens
aacaccuuggcuuguuauug

SEQ ID NO: 14863 - RNA, 21 nt, Homo sapiens
aaccuguugaagauuauuuca

SEQ ID NO: 14864 - RNA, 22 nt, Homo sapiens
gccugcugagaagaagaaacca

SEQ ID NO: 14865 - RNA, 18 nt, Homo sapiens
gucaggagagugauguga

SEQ ID NO: 14866 - RNA, 19 nt, Homo sapiens
aagcaauucuccugccuca

SEQ ID NO: 14867 - RNA, 18 nt, Homo sapiens
gcauuuucccuugcugua

SEQ ID NO: 14868 - RNA, 20 nt, Homo sapiens
gucucccagucuugucccgg

SEQ ID NO: 14869 - RNA, 18 nt, Homo sapiens
ucagacuccuggguucaa

SEQ ID NO: 14870 - RNA, 20 nt, Homo sapiens
ucgcugccuccuggguucaa

SEQ ID NO: 14871 - RNA, 19 nt, Homo sapiens
ucuuguuucuuacauauca

SEQ ID NO: 14872 - RNA, 24 nt, Homo sapiens
uuuuggaauuaaaagccacugacu

SEQ ID NO: 14873 - RNA, 24 nt, Homo sapiens
aaauggaaaaaagauacucacaca

SEQ ID NO: 14874 - RNA, 19 nt, Homo sapiens
aagacauuuagaaauaugu

SEQ ID NO: 14875 - RNA, 20 nt, Homo sapiens
aagaucccauaccuacuaca

SEQ ID NO: 14876 - RNA, 24 nt, Homo sapiens
aagggcuauagaucacauacguua

SEQ ID NO: 14877 - RNA, 23 nt, Homo sapiens
accuauaacaaggagacauuaca

SEQ ID NO: 14878 - RNA, 16 nt, Homo sapiens
cagucuuggcugcaca

SEQ ID NO: 14879 - RNA, 18 nt, Homo sapiens
caugacuuaccauuccag

SEQ ID NO: 14880 - RNA, 17 nt, Homo sapiens
caugauauuuagaccaa

SEQ ID NO: 14881 - RNA, 17 nt, Homo sapiens
cuugaugcugccuggcc

SEQ ID NO: 14882 - RNA, 21 nt, Homo sapiens
ggcaaggugaaggcauugcca

SEQ ID NO: 14883 - RNA, 18 nt, Homo sapiens
gggaaaagagucugugaa

SEQ ID NO: 14884 - RNA, 22 nt, Homo sapiens
guucaaaucauauaucagguug

SEQ ID NO: 14885 - RNA, 20 nt, Homo sapiens
ucucuugcugucauuaugau

SEQ ID NO: 14886 - RNA, 21 nt, Homo sapiens
ucuuguucuuggucuugucaa

SEQ ID NO: 14887 - RNA, 20 nt, Homo sapiens
ugaagagauugaaccuagua

SEQ ID NO: 14888 - RNA, 21 nt, Homo sapiens
uuucucuaaccuauaacaagg

SEQ ID NO: 14889 - RNA, 22 nt, Homo sapiens
uuucuuuauaguaagagcuuua

SEQ ID NO: 14890 - RNA, 19 nt, Homo sapiens
uuuguuacagccucaccug

SEQ ID NO: 14891 - RNA, 23 nt, Homo sapiens
augucacccugaucugucaugcc

SEQ ID NO: 14892 - RNA, 19 nt, Homo sapiens
caagaacaagcaaaugcca

SEQ ID NO: 14893 - RNA, 21 nt, Homo sapiens
cugucaugccccaccgccacc

SEQ ID NO: 14894 - RNA, 24 nt, Homo sapiens
ggggacggcggcggcggcggcggc

SEQ ID NO: 14895 - RNA, 18 nt, Homo sapiens
uuuccucccacccccuca

SEQ ID NO: 14896 - RNA, 22 nt, Homo sapiens
ccuccucgccauccuacuccuc

SEQ ID NO: 14897 - RNA, 21 nt, Homo sapiens
ccuccucgucauccucccccu

SEQ ID NO: 14898 - RNA, 19 nt, Homo sapiens
aucaguucgcagggcuuaa

SEQ ID NO: 14899 - RNA, 21 nt, Homo sapiens
ccaaguauauaaagcucccug

SEQ ID NO: 14900 - RNA, 20 nt, Homo sapiens
cugaaaguaaaguuguaugu

SEQ ID NO: 14901 - RNA, 19 nt, Homo sapiens
cuuccucacuuccucucca

SEQ ID NO: 14902 - RNA, 19 nt, Homo sapiens
gugguuaaaacauagcuuu

SEQ ID NO: 14903 - RNA, 24 nt, Homo sapiens
ucauuuccaccagcaguucccuua

SEQ ID NO: 14904 - RNA, 18 nt, Homo sapiens
uguuucagaaaacauaau

SEQ ID NO: 14905 - RNA, 19 nt, Homo sapiens
uuugcuggauuuacuaaca

SEQ ID NO: 14906 - RNA, 21 nt, Homo sapiens
gacagggcuccagggcuuguc

SEQ ID NO: 14907 - RNA, 19 nt, Homo sapiens
accagaagagaaaauacug

SEQ ID NO: 14908 - RNA, 18 nt, Homo sapiens
ccgcaggggcucuuggga

SEQ ID NO: 14909 - RNA, 22 nt, Homo sapiens
cucuucccgugccccuaccaga

SEQ ID NO: 14910 - RNA, 19 nt, Homo sapiens
acacccguguagaugggua

SEQ ID NO: 14911 - RNA, 26 nt, Homo sapiens
gacauuugccuuaggaacuuaacucu

SEQ ID NO: 14912 - RNA, 19 nt, Homo sapiens
gucucucccuguccuagcu

SEQ ID NO: 14913 - RNA, 16 nt, Homo sapiens
guuaucaacugcaaug

SEQ ID NO: 14914 - RNA, 21 nt, Homo sapiens
guugaaggaauuuccugguuu

SEQ ID NO: 14915 - RNA, 20 nt, Homo sapiens
acaacagaaaggaaauccua

SEQ ID NO: 14916 - RNA, 20 nt, Homo sapiens
agaucagcagagccacccua

SEQ ID NO: 14917 - RNA, 25 nt, Homo sapiens
agccaagggagccaaacacacuaga

SEQ ID NO: 14918 - RNA, 21 nt, Homo sapiens
cuagaucagcugaaacucuaa

SEQ ID NO: 14919 - RNA, 19 nt, Homo sapiens
cugaacuaaggcuuggccu

SEQ ID NO: 14920 - RNA, 21 nt, Homo sapiens
gaaaauuuagcaagccacuga

SEQ ID NO: 14921 - RNA, 18 nt, Homo sapiens
guaguaauaccuaucuca

SEQ ID NO: 14922 - RNA, 18 nt, Homo sapiens
guugagaucuucauccaa

SEQ ID NO: 14923 - RNA, 24 nt, Homo sapiens
ucauauuuuuuauuacaacacuaa

SEQ ID NO: 14924 - RNA, 21 nt, Homo sapiens
ugcgaacacugaacucuacgc

SEQ ID NO: 14925 - RNA, 19 nt, Homo sapiens
cuuguaaucuguuccuuac

SEQ ID NO: 14926 - RNA, 18 nt, Homo sapiens
gguauuucaaagcucuuu

SEQ ID NO: 14927 - RNA, 17 nt, Homo sapiens
guuuuauuacaauguaa

SEQ ID NO: 14928 - RNA, 18 nt, Homo sapiens
ugaacugaaauugugcca

SEQ ID NO: 14929 - RNA, 20 nt, Homo sapiens
ugucuugagaaagaaaucac

SEQ ID NO: 14930 - RNA, 17 nt, Homo sapiens
gccuguuucuucucuga

SEQ ID NO: 14931 - RNA, 20 nt, Homo sapiens
aaagacuauuaagagcaaua

SEQ ID NO: 14932 - RNA, 24 nt, Homo sapiens
ucuuggugauggagugugcgugug

SEQ ID NO: 14933 - RNA, 21 nt, Homo sapiens
ucuuuuuaaaaugcuguuuug

SEQ ID NO: 14934 - RNA, 21 nt, Homo sapiens
uuuguuacagcuaugcacugu

SEQ ID NO: 14935 - RNA, 17 nt, Homo sapiens
ccgggcccacauucucc

SEQ ID NO: 14936 - RNA, 19 nt, Homo sapiens
ugucucgcucgcuccgccc

SEQ ID NO: 14937 - RNA, 24 nt, Homo sapiens
ccaggcucaggcaggccuggccca

SEQ ID NO: 14938 - RNA, 18 nt, Homo sapiens
ggaucccagagcguugua

SEQ ID NO: 14939 - RNA, 20 nt, Homo sapiens
ucugugggucauccuuuccc

SEQ ID NO: 14940 - RNA, 20 nt, Homo sapiens
uucaagaccagccugaccaa

SEQ ID NO: 14941 - RNA, 21 nt, Homo sapiens
uuucaagcagugcuuguugug

SEQ ID NO: 14942 - RNA, 19 nt, Homo sapiens
ccuuguccaguggagccca

SEQ ID NO: 14943 - RNA, 20 nt, Homo sapiens
agcccccagaugguauugca

SEQ ID NO: 14944 - RNA, 19 nt, Homo sapiens
ccuacuucccaguuaacuc

SEQ ID NO: 14945 - RNA, 17 nt, Homo sapiens
ccugcuggaagcugcca

SEQ ID NO: 14946 - RNA, 20 nt, Homo sapiens
gguauuugucaugugccaac

SEQ ID NO: 14947 - RNA, 19 nt, Homo sapiens
uggagcccgcugcaggcca

SEQ ID NO: 14948 - RNA, 20 nt, Homo sapiens
cugucaauggaauuacagcu

SEQ ID NO: 14949 - RNA, 18 nt, Homo sapiens
gcagcugccgugggcuuu

SEQ ID NO: 14950 - RNA, 18 nt, Homo sapiens
caguacuuuguccagauu

SEQ ID NO: 14951 - RNA, 21 nt, Homo sapiens
cccguggcauggcguggcuca

SEQ ID NO: 14952 - RNA, 21 nt, Homo sapiens
gcuugggaaccguuugagccu

SEQ ID NO: 14953 - RNA, 19 nt, Homo sapiens
gucaucuaaaguccaguga

SEQ ID NO: 14954 - RNA, 19 nt, Homo sapiens
uggcccccaaggucagagc

SEQ ID NO: 14955 - RNA, 20 nt, Homo sapiens
ucuuuuguugcuuuaauuuu

SEQ ID NO: 14956 - RNA, 23 nt, Homo sapiens
cuucauugguaaccuggaccaca

SEQ ID NO: 14957 - RNA, 21 nt, Homo sapiens
uucauugguaaccuggaccac

SEQ ID NO: 14958 - RNA, 25 nt, Homo sapiens
guucuuuuugcugccaucuuccuca

SEQ ID NO: 14959 - RNA, 19 nt, Homo sapiens
uccuugcgccacgugcuuc

SEQ ID NO: 14960 - RNA, 22 nt, Homo sapiens
ccccucgagugggggacuguac

SEQ ID NO: 14961 - RNA, 23 nt, Homo sapiens
gcuugggcugcccagcccugucc

SEQ ID NO: 14962 - RNA, 19 nt, Homo sapiens
ggcagcgagugaaggacgc

SEQ ID NO: 14963 - RNA, 16 nt, Homo sapiens
cuugagaccagaggcu

SEQ ID NO: 14964 - RNA, 23 nt, Homo sapiens
acccacagcucccuucucaucuc

SEQ ID NO: 14965 - RNA, 19 nt, Homo sapiens
uuguugauccagcauuuga

SEQ ID NO: 14966 - RNA, 25 nt, Homo sapiens
agccgugggcucuaacgcggggcug

SEQ ID NO: 14967 - RNA, 18 nt, Homo sapiens
gcaauauguauuugaguu

SEQ ID NO: 14968 - RNA, 19 nt, Homo sapiens
uguagaccagacugccucu

SEQ ID NO: 14969 - RNA, 22 nt, Homo sapiens
uuaagaguauuuaaccuuucca

SEQ ID NO: 14970 - RNA, 22 nt, Homo sapiens
ucugaguuucugcaggucauuu

SEQ ID NO: 14971 - RNA, 20 nt, Homo sapiens
cccagcacgcgcuccgcgcc

SEQ ID NO: 14972 - RNA, 24 nt, Homo sapiens
gcugguuugagggccaccacugca

SEQ ID NO: 14973 - RNA, 23 nt, Homo sapiens
ugagaggagagaaauacacgucu

SEQ ID NO: 14974 - RNA, 20 nt, Homo sapiens
gaggcugcgcugcccgggag

SEQ ID NO: 14975 - RNA, 22 nt, Homo sapiens
gcagacaccacaggguggcauc

SEQ ID NO: 14976 - RNA, 18 nt, Homo sapiens
gccugccgagggcugcgc

SEQ ID NO: 14977 - RNA, 21 nt, Homo sapiens
accagagaacuauuacuaggc

SEQ ID NO: 14978 - RNA, 24 nt, Homo sapiens
gcgcuuuugucuccggugaguuuu

SEQ ID NO: 14979 - RNA, 18 nt, Homo sapiens
uggguggaucaccugagg

SEQ ID NO: 14980 - RNA, 22 nt, Homo sapiens
ccuggcacacagcagggaccca

SEQ ID NO: 14981 - RNA, 24 nt, Homo sapiens
gccaggcgggcugcaggcaccuca

SEQ ID NO: 14982 - RNA, 20 nt, Homo sapiens
accugaugcccuccuaccca

SEQ ID NO: 14983 - RNA, 21 nt, Homo sapiens
ccccauagucccgccugcagc

SEQ ID NO: 14984 - RNA, 22 nt, Homo sapiens
ccgggcuagcacugacgugucu

SEQ ID NO: 14985 - RNA, 21 nt, Homo sapiens
gcgccucggaaggggagcucu

SEQ ID NO: 14986 - RNA, 21 nt, Homo sapiens
ucuugagaccugaugcccucc

SEQ ID NO: 14987 - RNA, 21 nt, Homo sapiens
gaaucgauaacauuucaagaa

SEQ ID NO: 14988 - RNA, 22 nt, Homo sapiens
cacggaaggacacacgcugaag

SEQ ID NO: 14989 - RNA, 18 nt, Homo sapiens
gaguggagcacgugagac

SEQ ID NO: 14990 - RNA, 23 nt, Homo sapiens
acuuuuagaauguagcaaccacu

SEQ ID NO: 14991 - RNA, 19 nt, Homo sapiens
gugugggacuuuuagaaug

SEQ ID NO: 14992 - RNA, 21 nt, Homo sapiens
uguugggaaaggcuucuugaa

SEQ ID NO: 14993 - RNA, 19 nt, Homo sapiens
auggaaugccccaaguauu

SEQ ID NO: 14994 - RNA, 20 nt, Homo sapiens
gccaacugaguagcaaauca

SEQ ID NO: 14995 - RNA, 24 nt, Homo sapiens
agugggugggaggggucaggugug

SEQ ID NO: 14996 - RNA, 19 nt, Homo sapiens
gaacagaaacaguguuauu

SEQ ID NO: 14997 - RNA, 19 nt, Homo sapiens
gaaggcccccgcucccucu

SEQ ID NO: 14998 - RNA, 20 nt, Homo sapiens
aacagaggguauuauuuguu

SEQ ID NO: 14999 - RNA, 19 nt, Homo sapiens
aguaauauuagcaaaucuc

SEQ ID NO: 15000 - RNA, 18 nt, Homo sapiens
auauagcacguugugcaa

SEQ ID NO: 15001 - RNA, 18 nt, Homo sapiens
cuugugcccucacuaugc

SEQ ID NO: 15002 - RNA, 19 nt, Homo sapiens
gaaacuacugaggagcuua

SEQ ID NO: 15003 - RNA, 18 nt, Homo sapiens
ucacauugguuugucucc

SEQ ID NO: 15004 - RNA, 21 nt, Homo sapiens
ugagaucguggaccaucaguu

SEQ ID NO: 15005 - RNA, 21 nt, Homo sapiens
aacuccaucaggcaaaauuua

SEQ ID NO: 15006 - RNA, 22 nt, Homo sapiens
gaaacagaaauugaccuccggu

SEQ ID NO: 15007 - RNA, 19 nt, Homo sapiens
uccagacuauugaaguaug

SEQ ID NO: 15008 - RNA, 21 nt, Homo sapiens
aguuacccuuuauucugugau

SEQ ID NO: 15009 - RNA, 24 nt, Homo sapiens
ggugggugcggaggggcgugugug

SEQ ID NO: 15010 - RNA, 25 nt, Homo sapiens
guggcugugaagggaagucuuuguu

SEQ ID NO: 15011 - RNA, 20 nt, Homo sapiens
ggccuccuuuguucccauuu

SEQ ID NO: 15012 - RNA, 17 nt, Homo sapiens
uccucggcaggacccca

SEQ ID NO: 15013 - RNA, 19 nt, Homo sapiens
ucugccucuugcaccuuga

SEQ ID NO: 15014 - RNA, 19 nt, Homo sapiens
ugugaccacuggggccuca

SEQ ID NO: 15015 - RNA, 24 nt, Homo sapiens
acugagguccccaaaccccacccc

SEQ ID NO: 15016 - RNA, 25 nt, Homo sapiens
caccccaagugaccccccgcagcuc

SEQ ID NO: 15017 - RNA, 23 nt, Homo sapiens
ccauccucugaaccccaaucccc

SEQ ID NO: 15018 - RNA, 22 nt, Homo sapiens
ccccaagugaccccccgcagcu

SEQ ID NO: 15019 - RNA, 22 nt, Homo sapiens
ccucuggccacccgcuguccca

SEQ ID NO: 15020 - RNA, 15 nt, Homo sapiens
aacacugaauuucuc

SEQ ID NO: 15021 - RNA, 20 nt, Homo sapiens
acccaccucaccccggcuca

SEQ ID NO: 15022 - RNA, 17 nt, Homo sapiens
agagucuuuuaucuggu

SEQ ID NO: 15023 - RNA, 17 nt, Homo sapiens
agucaguagggacauug

SEQ ID NO: 15024 - RNA, 24 nt, Homo sapiens
ccuggaagucuguaaguuguuuuu

SEQ ID NO: 15025 - RNA, 20 nt, Homo sapiens
gaggagaaaugagauugcca

SEQ ID NO: 15026 - RNA, 21 nt, Homo sapiens
ucauggaagaggcuccucuga

SEQ ID NO: 15027 - RNA, 22 nt, Homo sapiens
uguggaugggugccugugggug

SEQ ID NO: 15028 - RNA, 19 nt, Homo sapiens
agggccuuuauuuccaacu

SEQ ID NO: 15029 - RNA, 19 nt, Homo sapiens
caucugucaaugugaugau

SEQ ID NO: 15030 - RNA, 18 nt, Homo sapiens
gaaucaguguaagccacu

SEQ ID NO: 15031 - RNA, 21 nt, Homo sapiens
ugaauggaaugcaugcgacug

SEQ ID NO: 15032 - RNA, 18 nt, Homo sapiens
aaugcaacuacucuacau

SEQ ID NO: 15033 - RNA, 17 nt, Homo sapiens
gaaaauggccagauuuu

SEQ ID NO: 15034 - RNA, 18 nt, Homo sapiens
accccgagcugcccucuu

SEQ ID NO: 15035 - RNA, 16 nt, Homo sapiens
agucaugcccauucuc

SEQ ID NO: 15036 - RNA, 18 nt, Homo sapiens
caacccuuccccuguccu

SEQ ID NO: 15037 - RNA, 22 nt, Homo sapiens
cccacccccacauuugcacacc

SEQ ID NO: 15038 - RNA, 22 nt, Homo sapiens
uagguagucuacccuuaccuug

SEQ ID NO: 15039 - RNA, 18 nt, Homo sapiens
ugacacacgcccuccuca

SEQ ID NO: 15040 - RNA, 19 nt, Homo sapiens
aguuuuaaguggcaacuca

SEQ ID NO: 15041 - RNA, 19 nt, Homo sapiens
cuuuaaagccuugcaggaa

SEQ ID NO: 15042 - RNA, 26 nt, Homo sapiens
gcagugccuggggcccuguuucuggg

SEQ ID NO: 15043 - RNA, 17 nt, Homo sapiens
uguugggaccauuuuug

SEQ ID NO: 15044 - RNA, 21 nt, Homo sapiens
cucucucucucuuucucucuc

SEQ ID NO: 15045 - RNA, 18 nt, Homo sapiens
uugacgggacuucaucuu

SEQ ID NO: 15046 - RNA, 22 nt, Homo sapiens
aaugacuauacagacuuuaguc

SEQ ID NO: 15047 - RNA, 20 nt, Homo sapiens
gaaaauguuuaagucuuuga

SEQ ID NO: 15048 - RNA, 19 nt, Homo sapiens
gcauggcgcucagacauuu

SEQ ID NO: 15049 - RNA, 18 nt, Homo sapiens
ucuuuuuaguucuuaacc

SEQ ID NO: 15050 - RNA, 22 nt, Homo sapiens
uugauacagcgucgccaaaacu

SEQ ID NO: 15051 - RNA, 18 nt, Homo sapiens
agcagcugaaggagccuc

SEQ ID NO: 15052 - RNA, 20 nt, Homo sapiens
ccccagcugacaggcuguug

SEQ ID NO: 15053 - RNA, 27 nt, Homo sapiens
gagcccugccuguucccuguccaucca

SEQ ID NO: 15054 - RNA, 19 nt, Homo sapiens
gcuggagcccuccuacccg

SEQ ID NO: 15055 - RNA, 17 nt, Homo sapiens
ggcccucagaacucuca

SEQ ID NO: 15056 - RNA, 15 nt, Homo sapiens
ucagugcugaugcca

SEQ ID NO: 15057 - RNA, 19 nt, Homo sapiens
ucugggcgaccucuggccc

SEQ ID NO: 15058 - RNA, 21 nt, Homo sapiens
agacuuggagagacccgucug

SEQ ID NO: 15059 - RNA, 17 nt, Homo sapiens
cauccucuuccuuccca

SEQ ID NO: 15060 - RNA, 19 nt, Homo sapiens
accugggcccucccaccca

SEQ ID NO: 15061 - RNA, 18 nt, Homo sapiens
caagaccccccucucuuc

SEQ ID NO: 15062 - RNA, 22 nt, Homo sapiens
ccucccccgcuuccucccuucc

SEQ ID NO: 15063 - RNA, 20 nt, Homo sapiens
gaccccucccccgcuuccuc

SEQ ID NO: 15064 - RNA, 16 nt, Homo sapiens
gcucccaaaaccgcug

SEQ ID NO: 15065 - RNA, 19 nt, Homo sapiens
uggaauguaacgcgaucuc

SEQ ID NO: 15066 - RNA, 20 nt, Homo sapiens
accaaaacagaugguagaga

SEQ ID NO: 15067 - RNA, 23 nt, Homo sapiens
auggcagcaugaauuccaacuca

SEQ ID NO: 15068 - RNA, 19 nt, Homo sapiens
ucacacccgcuucccccuc

SEQ ID NO: 15069 - RNA, 19 nt, Homo sapiens
ugagauccagcacaacuca

SEQ ID NO: 15070 - RNA, 18 nt, Homo sapiens
acucuuucccucuauuua

SEQ ID NO: 15071 - RNA, 23 nt, Homo sapiens
cccuccccaacggcugccuuccc

SEQ ID NO: 15072 - RNA, 20 nt, Homo sapiens
aaguucccggggcuuccucc

SEQ ID NO: 15073 - RNA, 18 nt, Homo sapiens
augaagagaaucuuauua

SEQ ID NO: 15074 - RNA, 22 nt, Homo sapiens
uuugucccaggcuuucuggugu

SEQ ID NO: 15075 - RNA, 21 nt, Homo sapiens
gaacaacagcaguguuauugu

SEQ ID NO: 15076 - RNA, 18 nt, Homo sapiens
gcuacccagcacaugcca

SEQ ID NO: 15077 - RNA, 19 nt, Homo sapiens
accucugacucccugguuc

SEQ ID NO: 15078 - RNA, 27 nt, Homo sapiens
ccauccccucuucuaccuccugcaacc

SEQ ID NO: 15079 - RNA, 22 nt, Homo sapiens
ccuuccccacccccucccccca

SEQ ID NO: 15080 - RNA, 22 nt, Homo sapiens
ucaaagacgagggucacgcacg

SEQ ID NO: 15081 - RNA, 22 nt, Homo sapiens
cagacagagcccucuagcugcu

SEQ ID NO: 15082 - RNA, 18 nt, Homo sapiens
aaaacaaacagaacccaa

SEQ ID NO: 15083 - RNA, 20 nt, Homo sapiens
aaaacaaacagaacccaaac

SEQ ID NO: 15084 - RNA, 20 nt, Homo sapiens
caagaaaaaggcagugccuc

SEQ ID NO: 15085 - RNA, 24 nt, Homo sapiens
gggauaacccuuccuucgauacca

SEQ ID NO: 15086 - RNA, 18 nt, Homo sapiens
cagcuucgggagcgcgcu

SEQ ID NO: 15087 - RNA, 20 nt, Homo sapiens
ccacagccaccuccaccccc

SEQ ID NO: 15088 - RNA, 19 nt, Homo sapiens
ccacugggccccauucucc

SEQ ID NO: 15089 - RNA, 20 nt, Homo sapiens
ccccguagccacucucugcc

SEQ ID NO: 15090 - RNA, 20 nt, Homo sapiens
cccuggggaagaggccuugg

SEQ ID NO: 15091 - RNA, 18 nt, Homo sapiens
cgaggcugccucugggug

SEQ ID NO: 15092 - RNA, 19 nt, Homo sapiens
ggaacauucccacauaaua

SEQ ID NO: 15093 - RNA, 16 nt, Homo sapiens
gcgugcgcagcccggg

SEQ ID NO: 15094 - RNA, 20 nt, Homo sapiens
aaacauuugccaaacuaaau

SEQ ID NO: 15095 - RNA, 19 nt, Homo sapiens
aacauuugccaaacuaaau

SEQ ID NO: 15096 - RNA, 19 nt, Homo sapiens
cuuuuuauauauguuuuaa

SEQ ID NO: 15097 - RNA, 19 nt, Homo sapiens
ugguuguacuacaguauac

SEQ ID NO: 15098 - RNA, 18 nt, Homo sapiens
aucauucagaucaucccc

SEQ ID NO: 15099 - RNA, 20 nt, Homo sapiens
ugguuuguuuuuacaaaaua

SEQ ID NO: 15100 - RNA, 23 nt, Homo sapiens
uacugcaugcaucacuucugcau

SEQ ID NO: 15101 - RNA, 22 nt, Homo sapiens
gccuggacggcucugcuggucu

SEQ ID NO: 15102 - RNA, 21 nt, Homo sapiens
guuggggaaggcuccuggccc

SEQ ID NO: 15103 - RNA, 18 nt, Homo sapiens
ucuccugccuggacggcu

SEQ ID NO: 15104 - RNA, 22 nt, Homo sapiens
gccuggacagcucugcuggucu

SEQ ID NO: 15105 - RNA, 23 nt, Homo sapiens
accuggguucuguccccuggcuc

SEQ ID NO: 15106 - RNA, 20 nt, Homo sapiens
agcugggaacuugguguugc

SEQ ID NO: 15107 - RNA, 16 nt, Homo sapiens
ccuuugucuggaguca

SEQ ID NO: 15108 - RNA, 19 nt, Homo sapiens
ggauguauccuccagccaa

SEQ ID NO: 15109 - RNA, 18 nt, Homo sapiens
ugggggcgguggggaggu

SEQ ID NO: 15110 - RNA, 21 nt, Homo sapiens
uucuggccaaucaaggcuugc

SEQ ID NO: 15111 - RNA, 19 nt, Homo sapiens
acuucucuuuauucugcau

SEQ ID NO: 15112 - RNA, 18 nt, Homo sapiens
agccuuguguggcagaua

SEQ ID NO: 15113 - RNA, 18 nt, Homo sapiens
gaucuagccuuuccagua

SEQ ID NO: 15114 - RNA, 19 nt, Homo sapiens
gucauacuuuuccaccgaa

SEQ ID NO: 15115 - RNA, 22 nt, Homo sapiens
ucagcuuuacagaacuguauua

SEQ ID NO: 15116 - RNA, 20 nt, Homo sapiens
aggaagaaaccacaccauca

SEQ ID NO: 15117 - RNA, 18 nt, Homo sapiens
caacccacccccugcccu

SEQ ID NO: 15118 - RNA, 20 nt, Homo sapiens
ccuuccccaccuccuuccca

SEQ ID NO: 15119 - RNA, 20 nt, Homo sapiens
gagcugaggcauccaagaaa

SEQ ID NO: 15120 - RNA, 24 nt, Homo sapiens
gguggaugggggagugaaauugug

SEQ ID NO: 15121 - RNA, 26 nt, Homo sapiens
gugugugugacccuguauuguuugau

SEQ ID NO: 15122 - RNA, 23 nt, Homo sapiens
uggguggucccagccuggagcug

SEQ ID NO: 15123 - RNA, 18 nt, Homo sapiens
aauggaaguaauacauca

SEQ ID NO: 15124 - RNA, 21 nt, Homo sapiens
gauagcuauacagucuguaca

SEQ ID NO: 15125 - RNA, 24 nt, Homo sapiens
uaaaugggucaauaaauggaagua

SEQ ID NO: 15126 - RNA, 18 nt, Homo sapiens
uuuccaaacuugaccuca

SEQ ID NO: 15127 - RNA, 19 nt, Homo sapiens
caggucaccaauuuucuca

SEQ ID NO: 15128 - RNA, 19 nt, Homo sapiens
caucugacaccauguagaa

SEQ ID NO: 15129 - RNA, 22 nt, Homo sapiens
cuccucaagccguaauguugaa

SEQ ID NO: 15130 - RNA, 21 nt, Homo sapiens
gauguagaugcagauauucua

SEQ ID NO: 15131 - RNA, 16 nt, Homo sapiens
guacaucuguugagca

SEQ ID NO: 15132 - RNA, 20 nt, Homo sapiens
guugaguacccgcuugguuu

SEQ ID NO: 15133 - RNA, 20 nt, Homo sapiens
cccccaaccuccaccccacc

SEQ ID NO: 15134 - RNA, 22 nt, Homo sapiens
gccacucugaggcuggcggccu

SEQ ID NO: 15135 - RNA, 20 nt, Homo sapiens
gagcccucggcgggcugcga

SEQ ID NO: 15136 - RNA, 20 nt, Homo sapiens
gagcccucggcgggcugcga

SEQ ID NO: 15137 - RNA, 21 nt, Homo sapiens
ccgcgcagcgcgagcgccuca

SEQ ID NO: 15138 - RNA, 21 nt, Homo sapiens
ccgcgcagcgcgagcgccuca

SEQ ID NO: 15139 - RNA, 21 nt, Homo sapiens
aacuagaaaaguggcccagaa

SEQ ID NO: 15140 - RNA, 22 nt, Homo sapiens
gaaaaguggcccagaaacagca

SEQ ID NO: 15141 - RNA, 21 nt, Homo sapiens
ccgcgcagcgcgagcgccuca

SEQ ID NO: 15142 - RNA, 18 nt, Homo sapiens
cgcuuagacaaugccccg

SEQ ID NO: 15143 - RNA, 21 nt, Homo sapiens
accuccccgggcugccggugg

SEQ ID NO: 15144 - RNA, 21 nt, Homo sapiens
accuccccgggcugccggugg

SEQ ID NO: 15145 - RNA, 21 nt, Homo sapiens
accuccccgggcugccggugg

SEQ ID NO: 15146 - RNA, 21 nt, Homo sapiens
accuccccgggcugccggugg

SEQ ID NO: 15147 - RNA, 21 nt, Homo sapiens
accuccccgggcugccggugg

SEQ ID NO: 15148 - RNA, 19 nt, Homo sapiens
acagccaaauugcagaaga

SEQ ID NO: 15149 - RNA, 20 nt, Homo sapiens
acauuuggcuccacuguaaa

SEQ ID NO: 15150 - RNA, 19 nt, Homo sapiens
accacuaucuuuuguucua

SEQ ID NO: 15151 - RNA, 21 nt, Homo sapiens
ccagggcggccgggcgcccca

SEQ ID NO: 15152 - RNA, 20 nt, Homo sapiens
gauucaagugcaauccaugu

SEQ ID NO: 15153 - RNA, 21 nt, Homo sapiens
guagcuggagagagaguucuc

SEQ ID NO: 15154 - RNA, 21 nt, Homo sapiens
ucaaaagauuaacaacacugc

SEQ ID NO: 15155 - RNA, 19 nt, Homo sapiens
acagccaaauugcagaaga

SEQ ID NO: 15156 - RNA, 20 nt, Homo sapiens
acauuuggcuccacuguaaa

SEQ ID NO: 15157 - RNA, 19 nt, Homo sapiens
accacuaucuuuuguucua

SEQ ID NO: 15158 - RNA, 21 nt, Homo sapiens
ccagggcggccgggcgcccca

SEQ ID NO: 15159 - RNA, 20 nt, Homo sapiens
gauucaagugcaauccaugu

SEQ ID NO: 15160 - RNA, 21 nt, Homo sapiens
guagcuggagagagaguucuc

SEQ ID NO: 15161 - RNA, 21 nt, Homo sapiens
ucaaaagauuaacaacacugc

SEQ ID NO: 15162 - RNA, 21 nt, Homo sapiens
acuuggaucuucccuuggucc

SEQ ID NO: 15163 - RNA, 22 nt, Homo sapiens
agaauuguaguucuuaguccca

SEQ ID NO: 15164 - RNA, 17 nt, Homo sapiens
agagggagacagagaug

SEQ ID NO: 15165 - RNA, 24 nt, Homo sapiens
aguucucuuucuuagucccuaauc

SEQ ID NO: 15166 - RNA, 20 nt, Homo sapiens
cagcacagccuugauuuccu

SEQ ID NO: 15167 - RNA, 21 nt, Homo sapiens
ccuucccccuuaccuccccca

SEQ ID NO: 15168 - RNA, 19 nt, Homo sapiens
gaaagaaacccacagaagg

SEQ ID NO: 15169 - RNA, 20 nt, Homo sapiens
gaaucuggacauuuguucca

SEQ ID NO: 15170 - RNA, 18 nt, Homo sapiens
gagcaaaacauugggcca

SEQ ID NO: 15171 - RNA, 18 nt, Homo sapiens
ggcuuaaguaccaaucuc

SEQ ID NO: 15172 - RNA, 20 nt, Homo sapiens
ucaagacuucuccaggccca

SEQ ID NO: 15173 - RNA, 23 nt, Homo sapiens
ucuccuugauuuuugguaguauc

SEQ ID NO: 15174 - RNA, 19 nt, Homo sapiens
ugcauugagaaggaacuga

SEQ ID NO: 15175 - RNA, 19 nt, Homo sapiens
uuaucaccaccccccuuuu

SEQ ID NO: 15176 - RNA, 17 nt, Homo sapiens
uucucccguuaaccagg

SEQ ID NO: 15177 - RNA, 20 nt, Homo sapiens
gagcccucggcgggcugcga

SEQ ID NO: 15178 - RNA, 19 nt, Homo sapiens
accugggccccacuggaca

SEQ ID NO: 15179 - RNA, 21 nt, Homo sapiens
ucagcuaugacucaguccccu

SEQ ID NO: 15180 - RNA, 19 nt, Homo sapiens
accugggccccacuggaca

SEQ ID NO: 15181 - RNA, 21 nt, Homo sapiens
ucagcuaugacucaguccccu

SEQ ID NO: 15182 - RNA, 21 nt, Homo sapiens
aggagaaagcaaaauacauca

SEQ ID NO: 15183 - RNA, 25 nt, Homo sapiens
gaaacuccaucuucaaaacaaaaca

SEQ ID NO: 15184 - RNA, 17 nt, Homo sapiens
gaacaggggcugguauu

SEQ ID NO: 15185 - RNA, 17 nt, Homo sapiens
gagauaauugcuugcca

SEQ ID NO: 15186 - RNA, 23 nt, Homo sapiens
ugggauuaugugccucccauuca

SEQ ID NO: 15187 - RNA, 19 nt, Homo sapiens
uggguggaucacuugaggc

SEQ ID NO: 15188 - RNA, 18 nt, Homo sapiens
cuggacaccaccuggccu

SEQ ID NO: 15189 - RNA, 20 nt, Homo sapiens
gacucuuggauaugaaacug

SEQ ID NO: 15190 - RNA, 20 nt, Homo sapiens
augaaaccuuauuuuuucca

SEQ ID NO: 15191 - RNA, 22 nt, Homo sapiens
ccaacuacaaccaagcucucug

SEQ ID NO: 15192 - RNA, 21 nt, Homo sapiens
cuaccucccugcaaccaacua

SEQ ID NO: 15193 - RNA, 23 nt, Homo sapiens
ggaugugcuuuucuccaauauca

SEQ ID NO: 15194 - RNA, 20 nt, Homo sapiens
ucuaaaagauccuuuuuaaa

SEQ ID NO: 15195 - RNA, 17 nt, Homo sapiens
ugaaggacacuuccugc

SEQ ID NO: 15196 - RNA, 19 nt, Homo sapiens
ugagccuggcuggcacaga

SEQ ID NO: 15197 - RNA, 19 nt, Homo sapiens
acaaauguuacacuagaca

SEQ ID NO: 15198 - RNA, 21 nt, Homo sapiens
auggcuguacuggauauccca

SEQ ID NO: 15199 - RNA, 18 nt, Homo sapiens
ccaguauuuccccuucuc

SEQ ID NO: 15200 - RNA, 24 nt, Homo sapiens
cugguuccucccugccccuugcca

SEQ ID NO: 15201 - RNA, 19 nt, Homo sapiens
agggcaagaucccauccca

SEQ ID NO: 15202 - RNA, 24 nt, Homo sapiens
ggcagaaggugaccagccagcuca

SEQ ID NO: 15203 - RNA, 20 nt, Homo sapiens
ggcuaccaggaggcuaagaa

SEQ ID NO: 15204 - RNA, 20 nt, Homo sapiens
gugagcccugaaagcucugg

SEQ ID NO: 15205 - RNA, 20 nt, Homo sapiens
guuucauguugaacacagcu

SEQ ID NO: 15206 - RNA, 19 nt, Homo sapiens
aagcaauucuccugccuca

SEQ ID NO: 15207 - RNA, 21 nt, Homo sapiens
acacucuaccuuuagugcaag

SEQ ID NO: 15208 - RNA, 21 nt, Homo sapiens
acuacauguuauguuuccuga

SEQ ID NO: 15209 - RNA, 22 nt, Homo sapiens
augucauuugucucccgcccua

SEQ ID NO: 15210 - RNA, 18 nt, Homo sapiens
cucuuacacuagaauccu

SEQ ID NO: 15211 - RNA, 19 nt, Homo sapiens
gaauucacuuguucuguca

SEQ ID NO: 15212 - RNA, 18 nt, Homo sapiens
ucaaggcuccaccucaga

SEQ ID NO: 15213 - RNA, 18 nt, Homo sapiens
uggauggagacugugaac

SEQ ID NO: 15214 - RNA, 19 nt, Homo sapiens
ugucuaucagcacaacuca

SEQ ID NO: 15215 - RNA, 21 nt, Homo sapiens
uucuguuucaacaaucauuac

SEQ ID NO: 15216 - RNA, 17 nt, Homo sapiens
uuugauacuugacagug

SEQ ID NO: 15217 - RNA, 20 nt, Homo sapiens
uuuuuguuaugugguuuaua

SEQ ID NO: 15218 - RNA, 16 nt, Homo sapiens
acacuuagugagaagg

SEQ ID NO: 15219 - RNA, 16 nt, Homo sapiens
caugucaucuuuucca

SEQ ID NO: 15220 - RNA, 19 nt, Homo sapiens
gaauuuuuguaaacucugg

SEQ ID NO: 15221 - RNA, 20 nt, Homo sapiens
ggaauagucucuucucuuca

SEQ ID NO: 15222 - RNA, 19 nt, Homo sapiens
uaugauugugccacugcac

SEQ ID NO: 15223 - RNA, 18 nt, Homo sapiens
uggguggaucaccugagg

SEQ ID NO: 15224 - RNA, 21 nt, Homo sapiens
caccuaagucuauauucacug

SEQ ID NO: 15225 - RNA, 22 nt, Homo sapiens
cgaauccacucucaugucuuuu

SEQ ID NO: 15226 - RNA, 20 nt, Homo sapiens
gcucuacaucuuaucaguca

SEQ ID NO: 15227 - RNA, 22 nt, Homo sapiens
gcugcaauguagucuugugugu

SEQ ID NO: 15228 - RNA, 18 nt, Homo sapiens
gguuauaacagaaaacug

SEQ ID NO: 15229 - RNA, 25 nt, Homo sapiens
gugcucuguaccacuggugagugcu

SEQ ID NO: 15230 - RNA, 23 nt, Homo sapiens
uaccugcuguuacuuauucagau

SEQ ID NO: 15231 - RNA, 18 nt, Homo sapiens
uagagcuacagguguuca

SEQ ID NO: 15232 - RNA, 18 nt, Homo sapiens
ugaagaucauauaccaaa

SEQ ID NO: 15233 - RNA, 20 nt, Homo sapiens
acaggaacccagccagaguu

SEQ ID NO: 15234 - RNA, 21 nt, Homo sapiens
cagcugguugggggcaccauc

SEQ ID NO: 15235 - RNA, 17 nt, Homo sapiens
ugccucccugcacuuca

SEQ ID NO: 15236 - RNA, 17 nt, Homo sapiens
aguucaguaauaagcua

SEQ ID NO: 15237 - RNA, 19 nt, Homo sapiens
ugggucaagcagcgcccca

SEQ ID NO: 15238 - RNA, 24 nt, Homo sapiens
acauuaguggauauacucauagua

SEQ ID NO: 15239 - RNA, 19 nt, Homo sapiens
agugccuaacccugcuugu

SEQ ID NO: 15240 - RNA, 21 nt, Homo sapiens
aucaacacuacuaacauuaca

SEQ ID NO: 15241 - RNA, 21 nt, Homo sapiens
cauuaagagugucuuaugaga

SEQ ID NO: 15242 - RNA, 18 nt, Homo sapiens
ggauuuuuguuguuuuug

SEQ ID NO: 15243 - RNA, 17 nt, Homo sapiens
uacugccuaccuuagcu

SEQ ID NO: 15244 - RNA, 18 nt, Homo sapiens
uagccaugauagaugaug

SEQ ID NO: 15245 - RNA, 22 nt, Homo sapiens
ucugaguuguuuguuuggacuu

SEQ ID NO: 15246 - RNA, 17 nt, Homo sapiens
uuaaaguaaaucucuua

SEQ ID NO: 15247 - RNA, 18 nt, Homo sapiens
augacccugaaaugacug

SEQ ID NO: 15248 - RNA, 19 nt, Homo sapiens
cguguguguggcuaaauua

SEQ ID NO: 15249 - RNA, 21 nt, Homo sapiens
cuuugcugggaagacugugag

SEQ ID NO: 15250 - RNA, 21 nt, Homo sapiens
ucauuuugauuuuacaaauaa

SEQ ID NO: 15251 - RNA, 17 nt, Homo sapiens
aguagcuuaauuacccc

SEQ ID NO: 15252 - RNA, 24 nt, Homo sapiens
ucuaguuucccuagagucauuuuu

SEQ ID NO: 15253 - RNA, 18 nt, Homo sapiens
uuuccaggcauagcaaug

SEQ ID NO: 15254 - RNA, 19 nt, Homo sapiens
uuuggcaauuuauaauuua

SEQ ID NO: 15255 - RNA, 21 nt, Homo sapiens
accugagccuggggcuggcuc

SEQ ID NO: 15256 - RNA, 17 nt, Homo sapiens
aggccagcacccaccau

SEQ ID NO: 15257 - RNA, 18 nt, Homo sapiens
gugcccccgcgugccugc

SEQ ID NO: 15258 - RNA, 19 nt, Homo sapiens
uccaaguggggcagcucuc

SEQ ID NO: 15259 - RNA, 20 nt, Homo sapiens
uccccaccccaacagagcca

SEQ ID NO: 15260 - RNA, 23 nt, Homo sapiens
cccugaguagugaggaucugcgg

SEQ ID NO: 15261 - RNA, 16 nt, Homo sapiens
uccguggagagcugug

SEQ ID NO: 15262 - RNA, 22 nt, Homo sapiens
gcgguuuuuuugguuuguuguu

SEQ ID NO: 15263 - RNA, 22 nt, Homo sapiens
gguauccuagguaagagccccu

SEQ ID NO: 15264 - RNA, 19 nt, Homo sapiens
aaagcauauauacuaccua

SEQ ID NO: 15265 - RNA, 21 nt, Homo sapiens
agcaaguuucgaagucacagu

SEQ ID NO: 15266 - RNA, 20 nt, Homo sapiens
caaggagugaagcgcccacc

SEQ ID NO: 15267 - RNA, 21 nt, Homo sapiens
ugagauuuucucagccaguga

SEQ ID NO: 15268 - RNA, 21 nt, Homo sapiens
aagaguagcucuauuugucca

SEQ ID NO: 15269 - RNA, 23 nt, Homo sapiens
guguuauuaccugcaggauauua

SEQ ID NO: 15270 - RNA, 23 nt, Homo sapiens
ugaggcaggaagcacacuggagc

SEQ ID NO: 15271 - RNA, 17 nt, Homo sapiens
ggagacgaaggacgcau

SEQ ID NO: 15272 - RNA, 23 nt, Homo sapiens
caaggucauuacagcugcaguca

SEQ ID NO: 15273 - RNA, 22 nt, Homo sapiens
gcucuggccugggagcuggcga

SEQ ID NO: 15274 - RNA, 18 nt, Homo sapiens
cagcacuuugggaagcca

SEQ ID NO: 15275 - RNA, 18 nt, Homo sapiens
gugcacacuaccuuccca

SEQ ID NO: 15276 - RNA, 17 nt, Homo sapiens
ucacuuguaccccacua

SEQ ID NO: 15277 - RNA, 18 nt, Homo sapiens
ucugugcuccccacucca

SEQ ID NO: 15278 - RNA, 20 nt, Homo sapiens
acaggaugcaaccacaacac

SEQ ID NO: 15279 - RNA, 25 nt, Homo sapiens
cgucuccaaagccaggauucugagg

SEQ ID NO: 15280 - RNA, 16 nt, Homo sapiens
gaauggagagcaugga

SEQ ID NO: 15281 - RNA, 22 nt, Homo sapiens
gacggugaugacccagcagcaa

SEQ ID NO: 15282 - RNA, 19 nt, Homo sapiens
gacugccagaaaaccacca

SEQ ID NO: 15283 - RNA, 20 nt, Homo sapiens
gccaaggaacccaaggacug

SEQ ID NO: 15284 - RNA, 20 nt, Homo sapiens
uucugaggaaaguccugugg

SEQ ID NO: 15285 - RNA, 17 nt, Homo sapiens
acaaaaacauuugccaa

SEQ ID NO: 15286 - RNA, 24 nt, Homo sapiens
agaccccugaauauuuauaucagu

SEQ ID NO: 15287 - RNA, 19 nt, Homo sapiens
agugaucccagcaucauuu

SEQ ID NO: 15288 - RNA, 17 nt, Homo sapiens
ccuuaugaagcacugcu

SEQ ID NO: 15289 - RNA, 23 nt, Homo sapiens
ccuugaaaaauuggaagaucugu

SEQ ID NO: 15290 - RNA, 18 nt, Homo sapiens
cugaucuauguguuugag

SEQ ID NO: 15291 - RNA, 24 nt, Homo sapiens
guuuuggaugaccuuccaaacuua

SEQ ID NO: 15292 - RNA, 17 nt, Homo sapiens
ucaagugauucucuugc

SEQ ID NO: 15293 - RNA, 18 nt, Homo sapiens
uccgucucccagguucaa

SEQ ID NO: 15294 - RNA, 18 nt, Homo sapiens
ucuguguaccugcagcau

SEQ ID NO: 15295 - RNA, 17 nt, Homo sapiens
ugcaauuauucuuuaua

SEQ ID NO: 15296 - RNA, 22 nt, Homo sapiens
uuucccuauguauaaccaguga

SEQ ID NO: 15297 - RNA, 22 nt, Homo sapiens
agggcagagcaaggacaacccc

SEQ ID NO: 15298 - RNA, 19 nt, Homo sapiens
augggaccagguggccaua

SEQ ID NO: 15299 - RNA, 19 nt, Homo sapiens
cccugugugcaccaaccua

SEQ ID NO: 15300 - RNA, 17 nt, Homo sapiens
ucaagugauucuccugc

SEQ ID NO: 15301 - RNA, 19 nt, Homo sapiens
ucauacuguacucucccca

SEQ ID NO: 15302 - RNA, 18 nt, Homo sapiens
uuucucauugcugcucua

SEQ ID NO: 15303 - RNA, 22 nt, Homo sapiens
ccaugucauguaucucauuaua

SEQ ID NO: 15304 - RNA, 22 nt, Homo sapiens
gcacguguccagggacacugca

SEQ ID NO: 15305 - RNA, 20 nt, Homo sapiens
uuuuuccaccaagcgagaua

SEQ ID NO: 15306 - RNA, 18 nt, Homo sapiens
agaaacuccccuuguacc

SEQ ID NO: 15307 - RNA, 20 nt, Homo sapiens
ccuaaaaagcugagcuguaa

SEQ ID NO: 15308 - RNA, 20 nt, Homo sapiens
ggaggaggaggcugggaucc

SEQ ID NO: 15309 - RNA, 22 nt, Homo sapiens
uaacagucuuauucucauucuu

SEQ ID NO: 15310 - RNA, 24 nt, Homo sapiens
uuucuuccugccguucuuagcuuu

SEQ ID NO: 15311 - RNA, 23 nt, Homo sapiens
cuaaauauaacuuaaaaagugaa

SEQ ID NO: 15312 - RNA, 22 nt, Homo sapiens
uaaagacugcaauugaagauaa

SEQ ID NO: 15313 - RNA, 18 nt, Homo sapiens
aaggcuaucuggcuuuaa

SEQ ID NO: 15314 - RNA, 19 nt, Homo sapiens
augaaugccaucaauguaa

SEQ ID NO: 15315 - RNA, 18 nt, Homo sapiens
gucauucauacuacugcu

SEQ ID NO: 15316 - RNA, 21 nt, Homo sapiens
caggguucccugggcccaguc

SEQ ID NO: 15317 - RNA, 21 nt, Homo sapiens
ccaaacagauaucuaaacacu

SEQ ID NO: 15318 - RNA, 26 nt, Homo sapiens
ccuggucuggucucagaaucacuuuu

SEQ ID NO: 15319 - RNA, 21 nt, Homo sapiens
gcuugauauuccuccucuacc

SEQ ID NO: 15320 - RNA, 17 nt, Homo sapiens
ggccuguuuggcuccga

SEQ ID NO: 15321 - RNA, 20 nt, Homo sapiens
uucuuccaccccuuucuggu

SEQ ID NO: 15322 - RNA, 22 nt, Homo sapiens
aaacccaaaacaaaacaaaaca

SEQ ID NO: 15323 - RNA, 19 nt, Homo sapiens
aucauugaaaagcgcccug

SEQ ID NO: 15324 - RNA, 18 nt, Homo sapiens
auuuccuuccgauuaccu

SEQ ID NO: 15325 - RNA, 19 nt, Homo sapiens
agcuacuccuggucccuca

SEQ ID NO: 15326 - RNA, 22 nt, Homo sapiens
gcuauuuguguuuagugucaga

SEQ ID NO: 15327 - RNA, 28 nt, Homo sapiens
uuaagaguaauauauuuaauuuuaucca

SEQ ID NO: 15328 - RNA, 20 nt, Homo sapiens
caacgcacauccgccuguau

SEQ ID NO: 15329 - RNA, 20 nt, Homo sapiens
cccccaacccacagauacca

SEQ ID NO: 15330 - RNA, 20 nt, Homo sapiens
uuuuguuacagguacuucaa

SEQ ID NO: 15331 - RNA, 18 nt, Homo sapiens
agugaaaaggauaaaugg

SEQ ID NO: 15332 - RNA, 18 nt, Homo sapiens
cacuuacaggaagacuga

SEQ ID NO: 15333 - RNA, 20 nt, Homo sapiens
ccucugccuccuggguucaa

SEQ ID NO: 15334 - RNA, 17 nt, Homo sapiens
gcgauuccccugccuca

SEQ ID NO: 15335 - RNA, 19 nt, Homo sapiens
uucaagaccagauauucaa

SEQ ID NO: 15336 - RNA, 15 nt, Homo sapiens
uucuucuuuuucuca

SEQ ID NO: 15337 - RNA, 19 nt, Homo sapiens
caugcuuuggaaaaguuua

SEQ ID NO: 15338 - RNA, 18 nt, Homo sapiens
uuuggagguacucccagu

SEQ ID NO: 15339 - RNA, 18 nt, Homo sapiens
gggggugggguugaaaua

SEQ ID NO: 15340 - RNA, 21 nt, Homo sapiens
uaauuccagaguacuguccuc

SEQ ID NO: 15341 - RNA, 29 nt, Homo sapiens
uaggucucccacuuucuaggaucauuuuu

SEQ ID NO: 15342 - RNA, 20 nt, Homo sapiens
ucugugacuggugccauaga

SEQ ID NO: 15343 - RNA, 22 nt, Homo sapiens
aaauccauauacacacguagaa

SEQ ID NO: 15344 - RNA, 18 nt, Homo sapiens
aaugugauauuaaagacu

SEQ ID NO: 15345 - RNA, 21 nt, Homo sapiens
aucuagaguguuuuacaaaau

SEQ ID NO: 15346 - RNA, 22 nt, Homo sapiens
aaaacuauuacuaggcugauaa

SEQ ID NO: 15347 - RNA, 17 nt, Homo sapiens
caagcuacuggaugcac

SEQ ID NO: 15348 - RNA, 16 nt, Homo sapiens
ccagcccugccuguac

SEQ ID NO: 15349 - RNA, 17 nt, Homo sapiens
ccguggaaauaauguuu

SEQ ID NO: 15350 - RNA, 23 nt, Homo sapiens
cgagcugugguuaggcuugguua

SEQ ID NO: 15351 - RNA, 23 nt, Homo sapiens
cuaaagcaguacuggacuggcca

SEQ ID NO: 15352 - RNA, 21 nt, Homo sapiens
cucuuucucucucucucucuc

SEQ ID NO: 15353 - RNA, 20 nt, Homo sapiens
cuguacauacacaugcacac

SEQ ID NO: 15354 - RNA, 18 nt, Homo sapiens
gacuauuugacaaccaca

SEQ ID NO: 15355 - RNA, 17 nt, Homo sapiens
ggaaaagaguaugccca

SEQ ID NO: 15356 - RNA, 19 nt, Homo sapiens
ggcagcaaagaugucuguu

SEQ ID NO: 15357 - RNA, 19 nt, Homo sapiens
ggucuugagaccugugaac

SEQ ID NO: 15358 - RNA, 16 nt, Homo sapiens
uaguguuggugucuug

SEQ ID NO: 15359 - RNA, 19 nt, Homo sapiens
ucaauuuagucuucucuca

SEQ ID NO: 15360 - RNA, 20 nt, Homo sapiens
ucuagaauuugaaaggguuu

SEQ ID NO: 15361 - RNA, 20 nt, Homo sapiens
uuuuugggcaaaacuacuca

SEQ ID NO: 15362 - RNA, 15 nt, Homo sapiens
aaaaaugacaugugu

SEQ ID NO: 15363 - RNA, 19 nt, Homo sapiens
agagaucuauuguacuuca

SEQ ID NO: 15364 - RNA, 21 nt, Homo sapiens
cacuuucagucaggugugcca

SEQ ID NO: 15365 - RNA, 21 nt, Homo sapiens
cuucuuacauaauauuuauca

SEQ ID NO: 15366 - RNA, 22 nt, Homo sapiens
uccccaaguaagguuuuuacca

SEQ ID NO: 15367 - RNA, 23 nt, Homo sapiens
uuuaaauuguuaaugugguaagu

SEQ ID NO: 15368 - RNA, 20 nt, Homo sapiens
caacaucuaucucugcugcc

SEQ ID NO: 15369 - RNA, 18 nt, Homo sapiens
uuggugugcguucagaga

SEQ ID NO: 15370 - RNA, 18 nt, Homo sapiens
uauggacucaaaacucuc

SEQ ID NO: 15371 - RNA, 24 nt, Homo sapiens
agaaaauuucuguucuugcacguu

SEQ ID NO: 15372 - RNA, 24 nt, Homo sapiens
ccugcauccuucucccauucccca

SEQ ID NO: 15373 - RNA, 20 nt, Homo sapiens
cuucuugcucuccucuccuc

SEQ ID NO: 15374 - RNA, 17 nt, Homo sapiens
gagaaggauagagaggu

SEQ ID NO: 15375 - RNA, 19 nt, Homo sapiens
gaguccugaucuggaacug

SEQ ID NO: 15376 - RNA, 19 nt, Homo sapiens
caucauugaaaaacaugga

SEQ ID NO: 15377 - RNA, 19 nt, Homo sapiens
cugccaugcccugcucuga

SEQ ID NO: 15378 - RNA, 23 nt, Homo sapiens
uaaaugacauuaacuugaaauua

SEQ ID NO: 15379 - RNA, 21 nt, Homo sapiens
agcucuuucucuauuuacuga

SEQ ID NO: 15380 - RNA, 22 nt, Homo sapiens
uaaauggaccucuguacggcug

SEQ ID NO: 15381 - RNA, 21 nt, Homo sapiens
ucugcugggugccuugaccuu

SEQ ID NO: 15382 - RNA, 23 nt, Homo sapiens
uugcuauggucugaauauuugug

SEQ ID NO: 15383 - RNA, 21 nt, Homo sapiens
cugcuauguuuuguuaugcag

SEQ ID NO: 15384 - RNA, 16 nt, Homo sapiens
aggcugguuuacaguc

SEQ ID NO: 15385 - RNA, 22 nt, Homo sapiens
aucuuggcucacugcaaccucu

SEQ ID NO: 15386 - RNA, 20 nt, Homo sapiens
ccucugucucccagguucag

SEQ ID NO: 15387 - RNA, 18 nt, Homo sapiens
ccugcaaccuccaccucc

SEQ ID NO: 15388 - RNA, 18 nt, Homo sapiens
cugucccacccuaccugc

SEQ ID NO: 15389 - RNA, 25 nt, Homo sapiens
cuucuaaugaaaacuuggucaucuu

SEQ ID NO: 15390 - RNA, 18 nt, Homo sapiens
uccugaccucaugaucca

SEQ ID NO: 15391 - RNA, 21 nt, Homo sapiens
uuucacuuauguaccauuuuu

SEQ ID NO: 15392 - RNA, 17 nt, Homo sapiens
acauuuucaucucccca

SEQ ID NO: 15393 - RNA, 21 nt, Homo sapiens
acuuuagaaaauuguugacau

SEQ ID NO: 15394 - RNA, 22 nt, Homo sapiens
cccaucacuuugggaggccaga

SEQ ID NO: 15395 - RNA, 21 nt, Homo sapiens
uggauggaucaccugagccug

SEQ ID NO: 15396 - RNA, 17 nt, Homo sapiens
aaaaacaaacaaacaaa

SEQ ID NO: 15397 - RNA, 22 nt, Homo sapiens
gagccaagaucacgccacugca

SEQ ID NO: 15398 - RNA, 20 nt, Homo sapiens
uucaagaccagccugaccaa

SEQ ID NO: 15399 - RNA, 19 nt, Homo sapiens
uauuaagaaauuauccagu

SEQ ID NO: 15400 - RNA, 23 nt, Homo sapiens
aaggaaugaccugaaacauuuuu

SEQ ID NO: 15401 - RNA, 18 nt, Homo sapiens
augccguaaugucauuau

SEQ ID NO: 15402 - RNA, 16 nt, Homo sapiens
gugacaguaguuguca

SEQ ID NO: 15403 - RNA, 22 nt, Homo sapiens
gcacccgcccugugacgcucca

SEQ ID NO: 15404 - RNA, 25 nt, Homo sapiens
aaaugcaaugugcugcccugagauc

SEQ ID NO: 15405 - RNA, 18 nt, Homo sapiens
cccgggaucuccaucucu

SEQ ID NO: 15406 - RNA, 20 nt, Homo sapiens
cugugcuuuugcaccauuga

SEQ ID NO: 15407 - RNA, 21 nt, Homo sapiens
ggacacgugggaguccuccca

SEQ ID NO: 15408 - RNA, 23 nt, Homo sapiens
ugagaagcagcacuaggccuguu

SEQ ID NO: 15409 - RNA, 22 nt, Homo sapiens
gagccaagaucgugucacugca

SEQ ID NO: 15410 - RNA, 20 nt, Homo sapiens
gccuaccucauagcuucaca

SEQ ID NO: 15411 - RNA, 21 nt, Homo sapiens
gccucugagcuccagggguca

SEQ ID NO: 15412 - RNA, 20 nt, Homo sapiens
acccugcuucauacucuuga

SEQ ID NO: 15413 - RNA, 20 nt, Homo sapiens
agguauuacuucugcacuua

SEQ ID NO: 15414 - RNA, 21 nt, Homo sapiens
aucugggguuccugacugaua

SEQ ID NO: 15415 - RNA, 19 nt, Homo sapiens
augccuccaaacaacacug

SEQ ID NO: 15416 - RNA, 19 nt, Homo sapiens
auggacacccuuaauuuua

SEQ ID NO: 15417 - RNA, 20 nt, Homo sapiens
cacauuauacccugcucuua

SEQ ID NO: 15418 - RNA, 21 nt, Homo sapiens
ccgcccaagcucucagugccu

SEQ ID NO: 15419 - RNA, 24 nt, Homo sapiens
gcaaagagaaccuauuauuugcca

SEQ ID NO: 15420 - RNA, 18 nt, Homo sapiens
ggaaacaucuucugugua

SEQ ID NO: 15421 - RNA, 16 nt, Homo sapiens
ucucugguaguuuuuc

SEQ ID NO: 15422 - RNA, 17 nt, Homo sapiens
ucuuucuucuaaaacgg

SEQ ID NO: 15423 - RNA, 18 nt, Homo sapiens
ugugacacaauccuaaua

SEQ ID NO: 15424 - RNA, 22 nt, Homo sapiens
gguugugaaugauuucuuuuga

SEQ ID NO: 15425 - RNA, 21 nt, Homo sapiens
auaucucaaacaccagcauca

SEQ ID NO: 15426 - RNA, 23 nt, Homo sapiens
cauccccggacaccuggucuaca

SEQ ID NO: 15427 - RNA, 16 nt, Homo sapiens
uccccccaccaccuca

SEQ ID NO: 15428 - RNA, 24 nt, Homo sapiens
ugcuguuccagauaugacuacuga

SEQ ID NO: 15429 - RNA, 22 nt, Homo sapiens
agaaacuauagcugaggacuaa

SEQ ID NO: 15430 - RNA, 21 nt, Homo sapiens
auggaaaaguguugccugcca

SEQ ID NO: 15431 - RNA, 15 nt, Homo sapiens
gcucuauuuuucagc

SEQ ID NO: 15432 - RNA, 21 nt, Homo sapiens
uaacaguccuuggaccauucu

SEQ ID NO: 15433 - RNA, 24 nt, Homo sapiens
aucuccaugaauccuaguuaggga

SEQ ID NO: 15434 - RNA, 18 nt, Homo sapiens
cuagcucucugucuugau

SEQ ID NO: 15435 - RNA, 21 nt, Homo sapiens
accuggcacagugccuggccu

SEQ ID NO: 15436 - RNA, 22 nt, Homo sapiens
auuugaaagcuguguaacucca

SEQ ID NO: 15437 - RNA, 20 nt, Homo sapiens
aagucugaucuguauaccca

SEQ ID NO: 15438 - RNA, 16 nt, Homo sapiens
agcuccucuucccaca

SEQ ID NO: 15439 - RNA, 18 nt, Homo sapiens
guaaaagaugggugugaa

SEQ ID NO: 15440 - RNA, 16 nt, Homo sapiens
ucuucccacagccagg

SEQ ID NO: 15441 - RNA, 21 nt, Homo sapiens
auguuccauagauuaugucau

SEQ ID NO: 15442 - RNA, 18 nt, Homo sapiens
auguuucccagcaguuua

SEQ ID NO: 15443 - RNA, 18 nt, Homo sapiens
cagccaugucucugcgua

SEQ ID NO: 15444 - RNA, 19 nt, Homo sapiens
ggucuagaauagguuggca

SEQ ID NO: 15445 - RNA, 22 nt, Homo sapiens
ucugaauugugauucccaguuc

SEQ ID NO: 15446 - RNA, 20 nt, Homo sapiens
uggcaaacuagucugugagc

SEQ ID NO: 15447 - RNA, 19 nt, Homo sapiens
aagcaauucucccaccuca

SEQ ID NO: 15448 - RNA, 19 nt, Homo sapiens
aagcgauucuccuaccuca

SEQ ID NO: 15449 - RNA, 17 nt, Homo sapiens
auccuaccuucccccac

SEQ ID NO: 15450 - RNA, 19 nt, Homo sapiens
cauucagcaaaagcccuga

SEQ ID NO: 15451 - RNA, 21 nt, Homo sapiens
ccuggcacacagcaaacacuc

SEQ ID NO: 15452 - RNA, 21 nt, Homo sapiens
cucuuucucucuuucuuucuc

SEQ ID NO: 15453 - RNA, 19 nt, Homo sapiens
gaaaucaacaucuuugaaa

SEQ ID NO: 15454 - RNA, 18 nt, Homo sapiens
guauaaggguuguacaga

SEQ ID NO: 15455 - RNA, 18 nt, Homo sapiens
uccugaccucaugaucca

SEQ ID NO: 15456 - RNA, 22 nt, Homo sapiens
uggcagccccagugugcaacua

SEQ ID NO: 15457 - RNA, 20 nt, Homo sapiens
uguccccaaggcuggagugc

SEQ ID NO: 15458 - RNA, 21 nt, Homo sapiens
aggacacauuaggauugguca

SEQ ID NO: 15459 - RNA, 21 nt, Homo sapiens
ugcuuugauccacuaaugcua

SEQ ID NO: 15460 - RNA, 16 nt, Homo sapiens
acccguauuguggaca

SEQ ID NO: 15461 - RNA, 17 nt, Homo sapiens
gaggucuaggcuugguc

SEQ ID NO: 15462 - RNA, 15 nt, Homo sapiens
cauacugagauaggg

SEQ ID NO: 15463 - RNA, 20 nt, Homo sapiens
cguuuuugccuaacacccca

SEQ ID NO: 15464 - RNA, 23 nt, Homo sapiens
caagcagugauuaguuucaguca

SEQ ID NO: 15465 - RNA, 19 nt, Homo sapiens
acaaccuuucccagacucc

SEQ ID NO: 15466 - RNA, 19 nt, Homo sapiens
aucacucuccuccauagca

SEQ ID NO: 15467 - RNA, 17 nt, Homo sapiens
ccuucucuuauucucca

SEQ ID NO: 15468 - RNA, 18 nt, Homo sapiens
gggcuccugggcccaguc

SEQ ID NO: 15469 - RNA, 23 nt, Homo sapiens
uccuuaaccguggacucuuccuu

SEQ ID NO: 15470 - RNA, 18 nt, Homo sapiens
ugggucucuggauuccug

SEQ ID NO: 15471 - RNA, 19 nt, Homo sapiens
cccacugaggccccuacug

SEQ ID NO: 15472 - RNA, 20 nt, Homo sapiens
ggaggaggaagcccauagac

SEQ ID NO: 15473 - RNA, 23 nt, Homo sapiens
uccuuaaccguggacucuuccuu

SEQ ID NO: 15474 - RNA, 18 nt, Homo sapiens
ugggucucuggauuccug

SEQ ID NO: 15475 - RNA, 19 nt, Homo sapiens
ugcauucuuacauuaguua

SEQ ID NO: 15476 - RNA, 19 nt, Homo sapiens
ccccuccccaacccccuca

SEQ ID NO: 15477 - RNA, 20 nt, Homo sapiens
agaaaagaagugguuuauca

SEQ ID NO: 15478 - RNA, 19 nt, Homo sapiens
ccaguggcagauccccugu

SEQ ID NO: 15479 - RNA, 19 nt, Homo sapiens
ucauucugucauugcugcu

SEQ ID NO: 15480 - RNA, 19 nt, Homo sapiens
uucccccacuaugcauauc

SEQ ID NO: 15481 - RNA, 22 nt, Homo sapiens
gccugugggcgauuuccuccgg

SEQ ID NO: 15482 - RNA, 21 nt, Homo sapiens
ggaaguggcggcggcggcggc

SEQ ID NO: 15483 - RNA, 19 nt, Homo sapiens
aagaaacagaaguuuagca

SEQ ID NO: 15484 - RNA, 16 nt, Homo sapiens
auucaccugccuuucc

SEQ ID NO: 15485 - RNA, 22 nt, Homo sapiens
cagaaguuuagcaagggucaug

SEQ ID NO: 15486 - RNA, 21 nt, Homo sapiens
cccagggugggagaccuggaa

SEQ ID NO: 15487 - RNA, 20 nt, Homo sapiens
gggggcggcagggaggcggc

SEQ ID NO: 15488 - RNA, 20 nt, Homo sapiens
gggucaugaagaauacugca

SEQ ID NO: 15489 - RNA, 18 nt, Homo sapiens
ucuacccggaggagcgcu

SEQ ID NO: 15490 - RNA, 21 nt, Homo sapiens
ucucccuggaccacuuccggu

SEQ ID NO: 15491 - RNA, 20 nt, Homo sapiens
uucuuaccucccagcuaccu

SEQ ID NO: 15492 - RNA, 19 nt, Homo sapiens
acagcugcuacccccaaga

SEQ ID NO: 15493 - RNA, 21 nt, Homo sapiens
augaaauuaaaauauuaaaua

SEQ ID NO: 15494 - RNA, 16 nt, Homo sapiens
cucugggaacagcugc

SEQ ID NO: 15495 - RNA, 20 nt, Homo sapiens
gcguucagggccugacgguu

SEQ ID NO: 15496 - RNA, 19 nt, Homo sapiens
cccacccacuucugcacuu

SEQ ID NO: 15497 - RNA, 20 nt, Homo sapiens
gcccaccccacccacuucug

SEQ ID NO: 15498 - RNA, 23 nt, Homo sapiens
aaccagagucaagauuugaaaua

SEQ ID NO: 15499 - RNA, 19 nt, Homo sapiens
agaaaggcagcccauuuua

SEQ ID NO: 15500 - RNA, 17 nt, Homo sapiens
ggaauagauccgauuca

SEQ ID NO: 15501 - RNA, 18 nt, Homo sapiens
ucgccuuguuuccauggg

SEQ ID NO: 15502 - RNA, 19 nt, Homo sapiens
ugaagccagccaauguguu

SEQ ID NO: 15503 - RNA, 18 nt, Homo sapiens
aaacacacgaagcauaau

SEQ ID NO: 15504 - RNA, 24 nt, Homo sapiens
agaacuaucuuaugggauauuuua

SEQ ID NO: 15505 - RNA, 18 nt, Homo sapiens
caaagaaggcuaauguca

SEQ ID NO: 15506 - RNA, 20 nt, Homo sapiens
ugaggcuuuggcagaaauua

SEQ ID NO: 15507 - RNA, 21 nt, Homo sapiens
uggauguauaacaugaagcug

SEQ ID NO: 15508 - RNA, 20 nt, Homo sapiens
aagagauaagugcaucauga

SEQ ID NO: 15509 - RNA, 23 nt, Homo sapiens
gagaugcaugcuuuguucugugc

SEQ ID NO: 15510 - RNA, 20 nt, Homo sapiens
uguguuggucgcucucugaa

SEQ ID NO: 15511 - RNA, 18 nt, Homo sapiens
uuuuguucugcauugacu

SEQ ID NO: 15512 - RNA, 20 nt, Homo sapiens
ccgucaccccacacaggcug

SEQ ID NO: 15513 - RNA, 17 nt, Homo sapiens
ccuccugccaauucucu

SEQ ID NO: 15514 - RNA, 16 nt, Homo sapiens
cuccccaugcccaggg

SEQ ID NO: 15515 - RNA, 22 nt, Homo sapiens
gacacaaaggucuugguucucc

SEQ ID NO: 15516 - RNA, 16 nt, Homo sapiens
gggccagcaccgcuga

SEQ ID NO: 15517 - RNA, 23 nt, Homo sapiens
guauauauauugcauucgugcug

SEQ ID NO: 15518 - RNA, 23 nt, Homo sapiens
ugaggucacuguggggcacgguu

SEQ ID NO: 15519 - RNA, 19 nt, Homo sapiens
uguauauauauugcauucg

SEQ ID NO: 15520 - RNA, 20 nt, Homo sapiens
uuaccaaaaaacaacuguca

SEQ ID NO: 15521 - RNA, 16 nt, Homo sapiens
acacaguaucauucca

SEQ ID NO: 15522 - RNA, 23 nt, Homo sapiens
gaagaaauugcccuggcacuuuu

SEQ ID NO: 15523 - RNA, 25 nt, Homo sapiens
aaauuccaaaacugcucauaugaug

SEQ ID NO: 15524 - RNA, 18 nt, Homo sapiens
aaauacugugucuaaaga

SEQ ID NO: 15525 - RNA, 23 nt, Homo sapiens
agaaauuucaguggucuaucauu

SEQ ID NO: 15526 - RNA, 24 nt, Homo sapiens
cacugaccaaccaaccaaacucca

SEQ ID NO: 15527 - RNA, 16 nt, Homo sapiens
gauguagggucugcuu

SEQ ID NO: 15528 - RNA, 21 nt, Homo sapiens
uagacuuggggauggacagcu

SEQ ID NO: 15529 - RNA, 18 nt, Homo sapiens
ugaacugaaauugugcca

SEQ ID NO: 15530 - RNA, 24 nt, Homo sapiens
gcccugggagcagagguggagcga

SEQ ID NO: 15531 - RNA, 17 nt, Homo sapiens
aauaggaccgcccccuc

SEQ ID NO: 15532 - RNA, 19 nt, Homo sapiens
ccaccugguacuguuccag

SEQ ID NO: 15533 - RNA, 20 nt, Homo sapiens
ccaguauguuuuacagauua

SEQ ID NO: 15534 - RNA, 20 nt, Homo sapiens
gugcaccugcagugguuuaa

SEQ ID NO: 15535 - RNA, 19 nt, Homo sapiens
agaauacaaguagcauugc

SEQ ID NO: 15536 - RNA, 21 nt, Homo sapiens
caagaucacaggagccacugc

SEQ ID NO: 15537 - RNA, 19 nt, Homo sapiens
cagaugaauauuuaacuca

SEQ ID NO: 15538 - RNA, 17 nt, Homo sapiens
cucuacuaaacaugcaa

SEQ ID NO: 15539 - RNA, 20 nt, Homo sapiens
gucucggaaacacagagcca

SEQ ID NO: 15540 - RNA, 20 nt, Homo sapiens
gaggaacauaugccugagaa

SEQ ID NO: 15541 - RNA, 17 nt, Homo sapiens
ucucaccaguauuugcu

SEQ ID NO: 15542 - RNA, 22 nt, Homo sapiens
agauggaguuauaacugucaua

SEQ ID NO: 15543 - RNA, 19 nt, Homo sapiens
acagaaaaaucuaugacuc

SEQ ID NO: 15544 - RNA, 19 nt, Homo sapiens
aggauuucagggcccagca

SEQ ID NO: 15545 - RNA, 24 nt, Homo sapiens
caccacugccaccaccccucuuuu

SEQ ID NO: 15546 - RNA, 15 nt, Homo sapiens
cauucauccaacuuc

SEQ ID NO: 15547 - RNA, 22 nt, Homo sapiens
cccaccccggcugcucuugaca

SEQ ID NO: 15548 - RNA, 19 nt, Homo sapiens
cuccuugucauugaccuua

SEQ ID NO: 15549 - RNA, 24 nt, Homo sapiens
uucuagaauaaagaauuuucccuc

SEQ ID NO: 15550 - RNA, 18 nt, Homo sapiens
aaacccuuuuuuugcuuc

SEQ ID NO: 15551 - RNA, 18 nt, Homo sapiens
aguccagugccuggaacu

SEQ ID NO: 15552 - RNA, 17 nt, Homo sapiens
cucuccuuuucuaucug

SEQ ID NO: 15553 - RNA, 24 nt, Homo sapiens
cuuauuuuuuaagaauuauucuua

SEQ ID NO: 15554 - RNA, 18 nt, Homo sapiens
gauuuuucugaauacgca

SEQ ID NO: 15555 - RNA, 23 nt, Homo sapiens
uagggaagaucuguauggaauua

SEQ ID NO: 15556 - RNA, 19 nt, Homo sapiens
ugcaggggugggggcgggu

SEQ ID NO: 15557 - RNA, 16 nt, Homo sapiens
aaaggcaaacuuugua

SEQ ID NO: 15558 - RNA, 20 nt, Homo sapiens
cgccggccggccagcaccca

SEQ ID NO: 15559 - RNA, 21 nt, Homo sapiens
gugagcacacagagcagcauc

SEQ ID NO: 15560 - RNA, 17 nt, Homo sapiens
agccuggguggcagaug

SEQ ID NO: 15561 - RNA, 18 nt, Homo sapiens
agguguggcuucuggccu

SEQ ID NO: 15562 - RNA, 18 nt, Homo sapiens
cuccccugaaaugcuuuu

SEQ ID NO: 15563 - RNA, 18 nt, Homo sapiens
cuuuucccugcugccucu

SEQ ID NO: 15564 - RNA, 19 nt, Homo sapiens
ucugaccuggggucugggg

SEQ ID NO: 15565 - RNA, 26 nt, Homo sapiens
uuuuuucagauacugugcuugauuuu

SEQ ID NO: 15566 - RNA, 20 nt, Homo sapiens
caccaccaccaccaccacuc

SEQ ID NO: 15567 - RNA, 18 nt, Homo sapiens
ccucccaauccaaguagc

SEQ ID NO: 15568 - RNA, 22 nt, Homo sapiens
gaugagagaauucauccagaca

SEQ ID NO: 15569 - RNA, 19 nt, Homo sapiens
gcgcacgaacuaccauuca

SEQ ID NO: 15570 - RNA, 21 nt, Homo sapiens
ucaccaccaucaucaccuccg

SEQ ID NO: 15571 - RNA, 20 nt, Homo sapiens
ucacccagcagccagagccg

SEQ ID NO: 15572 - RNA, 19 nt, Homo sapiens
accggggccccgcuggcca

SEQ ID NO: 15573 - RNA, 20 nt, Homo sapiens
acucaucucuugcugacggu

SEQ ID NO: 15574 - RNA, 19 nt, Homo sapiens
ccccacccuugcccccagc

SEQ ID NO: 15575 - RNA, 19 nt, Homo sapiens
ccuggacugccucucgccu

SEQ ID NO: 15576 - RNA, 22 nt, Homo sapiens
gagggccuggacccagaucucc

SEQ ID NO: 15577 - RNA, 18 nt, Homo sapiens
ucccaugcacuugcccaa

SEQ ID NO: 15578 - RNA, 27 nt, Homo sapiens
uggagggucagccccaacagggagcug

SEQ ID NO: 15579 - RNA, 17 nt, Homo sapiens
ugguccuaagaauggga

SEQ ID NO: 15580 - RNA, 18 nt, Homo sapiens
ugucggaccuucacuuca

SEQ ID NO: 15581 - RNA, 21 nt, Homo sapiens
uugagacguucauuuaaugaa

SEQ ID NO: 15582 - RNA, 21 nt, Homo sapiens
acgcucaaccccaaguccuuu

SEQ ID NO: 15583 - RNA, 24 nt, Homo sapiens
acuuggaccgcuucagccugggcu

SEQ ID NO: 15584 - RNA, 23 nt, Homo sapiens
aggugucccuccccugcuaguca

SEQ ID NO: 15585 - RNA, 22 nt, Homo sapiens
ccugcugagaccuagguugcca

SEQ ID NO: 15586 - RNA, 23 nt, Homo sapiens
gccacccagcuggacacgggaga

SEQ ID NO: 15587 - RNA, 18 nt, Homo sapiens
guucuucccccuccaugu

SEQ ID NO: 15588 - RNA, 19 nt, Homo sapiens
ucaucauacuggcacuguu

SEQ ID NO: 15589 - RNA, 25 nt, Homo sapiens
acaaaagacaaugugcuuuauguua

SEQ ID NO: 15590 - RNA, 19 nt, Homo sapiens
auucagguggauaaauagu

SEQ ID NO: 15591 - RNA, 23 nt, Homo sapiens
cuaugaaugaaaaaaauauuuua

SEQ ID NO: 15592 - RNA, 18 nt, Homo sapiens
ucacuugugucaccagcu

SEQ ID NO: 15593 - RNA, 23 nt, Homo sapiens
ugcuuucuacuauaucuuucagc

SEQ ID NO: 15594 - RNA, 18 nt, Homo sapiens
aguggguggaaguccggu

SEQ ID NO: 15595 - RNA, 18 nt, Homo sapiens
ucuuuuucugggacuuug

SEQ ID NO: 15596 - RNA, 19 nt, Homo sapiens
uggguggguggcaucuccu

SEQ ID NO: 15597 - RNA, 21 nt, Homo sapiens
cuuuaauucuuuuguuccaaa

SEQ ID NO: 15598 - RNA, 18 nt, Homo sapiens
acccccagcacacacaca

SEQ ID NO: 15599 - RNA, 20 nt, Homo sapiens
cacaccuccuagaccacgcc

SEQ ID NO: 15600 - RNA, 23 nt, Homo sapiens
ccacuuagaccacgcccaccucc

SEQ ID NO: 15601 - RNA, 23 nt, Homo sapiens
ccacuuagaccacgcccaccucc

SEQ ID NO: 15602 - RNA, 19 nt, Homo sapiens
ccccacccacugccugagc

SEQ ID NO: 15603 - RNA, 18 nt, Homo sapiens
ccccagcugcgccugaca

SEQ ID NO: 15604 - RNA, 19 nt, Homo sapiens
ccuaaggaaccuuagugau

SEQ ID NO: 15605 - RNA, 21 nt, Homo sapiens
cgccccugcugccccaccacc

SEQ ID NO: 15606 - RNA, 24 nt, Homo sapiens
gaaggccagaugagaaaggucucc

SEQ ID NO: 15607 - RNA, 25 nt, Homo sapiens
gcccaccuccugaccgcguuccuca

SEQ ID NO: 15608 - RNA, 20 nt, Homo sapiens
acuucuaaggucacguuuac

SEQ ID NO: 15609 - RNA, 22 nt, Homo sapiens
caaccaaaaaucuauuguggua

SEQ ID NO: 15610 - RNA, 16 nt, Homo sapiens
ccagccaccuuguaaa

SEQ ID NO: 15611 - RNA, 22 nt, Homo sapiens
gugucaaauguuaaaugaaaua

SEQ ID NO: 15612 - RNA, 22 nt, Homo sapiens
ucuuguugucucuuccucuuca

SEQ ID NO: 15613 - RNA, 21 nt, Homo sapiens
uuucuuuguaguuguucugau

SEQ ID NO: 15614 - RNA, 19 nt, Homo sapiens
cuccguccggccucauuuc

SEQ ID NO: 15615 - RNA, 19 nt, Homo sapiens
gugugggcauuguugguua

SEQ ID NO: 15616 - RNA, 22 nt, Homo sapiens
ccaagaaguguuuggauaacca

SEQ ID NO: 15617 - RNA, 20 nt, Homo sapiens
cuguugcaagagugaaugua

SEQ ID NO: 15618 - RNA, 18 nt, Homo sapiens
ggcacauuguugcagcaa

SEQ ID NO: 15619 - RNA, 19 nt, Homo sapiens
uggguuugcagcaugaacu

SEQ ID NO: 15620 - RNA, 22 nt, Homo sapiens
gcaucuuacagauuuuacuuca

SEQ ID NO: 15621 - RNA, 18 nt, Homo sapiens
uggguggaucaccugagg

SEQ ID NO: 15622 - RNA, 22 nt, Homo sapiens
agcucagcuguugaggacaccc

SEQ ID NO: 15623 - RNA, 22 nt, Homo sapiens
agugaccccaauccuauaccca

SEQ ID NO: 15624 - RNA, 20 nt, Homo sapiens
caggggcagaaaacacuaca

SEQ ID NO: 15625 - RNA, 22 nt, Homo sapiens
ccccacuccaacuccuucucca

SEQ ID NO: 15626 - RNA, 19 nt, Homo sapiens
ggaagccagaagcauccca

SEQ ID NO: 15627 - RNA, 17 nt, Homo sapiens
uccuucuccaccaccca

SEQ ID NO: 15628 - RNA, 20 nt, Homo sapiens
caaacuaauucugauugugu

SEQ ID NO: 15629 - RNA, 20 nt, Homo sapiens
caaccagcgauaggccacau

SEQ ID NO: 15630 - RNA, 20 nt, Homo sapiens
guagcuuuguuuuccuuugu

SEQ ID NO: 15631 - RNA, 18 nt, Homo sapiens
aaaaauuacaccagagag

SEQ ID NO: 15632 - RNA, 20 nt, Homo sapiens
aacuucugucuuuuaagcca

SEQ ID NO: 15633 - RNA, 17 nt, Homo sapiens
caucaucacggggugaa

SEQ ID NO: 15634 - RNA, 17 nt, Homo sapiens
gaggucugggcccagcg

SEQ ID NO: 15635 - RNA, 21 nt, Homo sapiens
ggagacccugggagcuguggc

SEQ ID NO: 15636 - RNA, 20 nt, Homo sapiens
guccugagcacuuugcaaga

SEQ ID NO: 15637 - RNA, 23 nt, Homo sapiens
guucaagagaacccacccagaga

SEQ ID NO: 15638 - RNA, 19 nt, Homo sapiens
uaccacagaauaucacugu

SEQ ID NO: 15639 - RNA, 18 nt, Homo sapiens
aaagcuuuuucaguuccu

SEQ ID NO: 15640 - RNA, 18 nt, Homo sapiens
accuugacugccaggccc

SEQ ID NO: 15641 - RNA, 17 nt, Homo sapiens
augacccugagaucgug

SEQ ID NO: 15642 - RNA, 18 nt, Homo sapiens
ugaccucaagcucagcua

SEQ ID NO: 15643 - RNA, 19 nt, Homo sapiens
ugcagcugcugcagcaggg

SEQ ID NO: 15644 - RNA, 24 nt, Homo sapiens
aaaauaucucuucagaugaaacug

SEQ ID NO: 15645 - RNA, 18 nt, Homo sapiens
guaaucauaucuacaugc

SEQ ID NO: 15646 - RNA, 23 nt, Homo sapiens
uauagaaagugaauaugcaguua

SEQ ID NO: 15647 - RNA, 19 nt, Homo sapiens
auguaucacgugugcuuug

SEQ ID NO: 15648 - RNA, 20 nt, Homo sapiens
ccaauacaaaagcccacuga

SEQ ID NO: 15649 - RNA, 22 nt, Homo sapiens
caagcacaaggccugcccuaca

SEQ ID NO: 15650 - RNA, 18 nt, Homo sapiens
uuccaggaccuggcccag

SEQ ID NO: 15651 - RNA, 19 nt, Homo sapiens
uugccugcugccugcaucc

SEQ ID NO: 15652 - RNA, 18 nt, Homo sapiens
aaucaaucacugaaccug

SEQ ID NO: 15653 - RNA, 24 nt, Homo sapiens
accugagcuguuuucuguuggccc

SEQ ID NO: 15654 - RNA, 18 nt, Homo sapiens
caggcuggaaugaucuca

SEQ ID NO: 15655 - RNA, 18 nt, Homo sapiens
ccuggcgaucuucugggg

SEQ ID NO: 15656 - RNA, 19 nt, Homo sapiens
cggcuaccaccuguuccag

SEQ ID NO: 15657 - RNA, 19 nt, Homo sapiens
ggcgccaccaaccagccuc

SEQ ID NO: 15658 - RNA, 21 nt, Homo sapiens
ugccuggaaaaccugucccag

SEQ ID NO: 15659 - RNA, 22 nt, Homo sapiens
gggcauuugggauaccaagaua

SEQ ID NO: 15660 - RNA, 21 nt, Homo sapiens
uggugaaaccccaucuccacu

SEQ ID NO: 15661 - RNA, 21 nt, Homo sapiens
cuguuuaauggugaugccucg

SEQ ID NO: 15662 - RNA, 22 nt, Homo sapiens
ugaaugggaaaucaugcaacua

SEQ ID NO: 15663 - RNA, 15 nt, Homo sapiens
ggagcagggcuguga

SEQ ID NO: 15664 - RNA, 18 nt, Homo sapiens
accgcggccgccgggccu

SEQ ID NO: 15665 - RNA, 16 nt, Homo sapiens
caccgcggggccgacg

SEQ ID NO: 15666 - RNA, 20 nt, Homo sapiens
ccaccggccuaaagacgacg

SEQ ID NO: 15667 - RNA, 16 nt, Homo sapiens
gcaaagaacaauguac

SEQ ID NO: 15668 - RNA, 18 nt, Homo sapiens
caacacaugcucacugcc

SEQ ID NO: 15669 - RNA, 23 nt, Homo sapiens
cccuccucaauuggaggcuggac

SEQ ID NO: 15670 - RNA, 20 nt, Homo sapiens
gccaguucacccacagauca

SEQ ID NO: 15671 - RNA, 18 nt, Homo sapiens
gcccuucauggcagggac

SEQ ID NO: 15672 - RNA, 15 nt, Homo sapiens
uggccuucugugaau

SEQ ID NO: 15673 - RNA, 21 nt, Homo sapiens
caaaaggacccugccuuggug

SEQ ID NO: 15674 - RNA, 22 nt, Homo sapiens
ccuaccaagaaaaacagucuca

SEQ ID NO: 15675 - RNA, 18 nt, Homo sapiens
cuugaugauggcggugga

SEQ ID NO: 15676 - RNA, 19 nt, Homo sapiens
uugcagagauccagccccu

SEQ ID NO: 15677 - RNA, 22 nt, Homo sapiens
acagacccaaccaccagcaaua

SEQ ID NO: 15678 - RNA, 22 nt, Homo sapiens
gauuggucuugauauugagaua

SEQ ID NO: 15679 - RNA, 18 nt, Homo sapiens
aaaaagggggggaaauac

SEQ ID NO: 15680 - RNA, 20 nt, Homo sapiens
uggucaggcuggucuugaac

SEQ ID NO: 15681 - RNA, 21 nt, Homo sapiens
uuuuuugugggccaguuugua

SEQ ID NO: 15682 - RNA, 20 nt, Homo sapiens
aauuaauaaacauuuuaaua

SEQ ID NO: 15683 - RNA, 21 nt, Homo sapiens
accugagguggcugaggcuca

SEQ ID NO: 15684 - RNA, 20 nt, Homo sapiens
cguuaccggguccagacuga

SEQ ID NO: 15685 - RNA, 19 nt, Homo sapiens
gcaacugauguccugcgug

SEQ ID NO: 15686 - RNA, 16 nt, Homo sapiens
gcagcccccgcagcuc

SEQ ID NO: 15687 - RNA, 18 nt, Homo sapiens
agguggccugcccgggaa

SEQ ID NO: 15688 - RNA, 19 nt, Homo sapiens
ccugaaucuuaccaacaaa

SEQ ID NO: 15689 - RNA, 18 nt, Homo sapiens
ugaauggaucucaccaga

SEQ ID NO: 15690 - RNA, 22 nt, Homo sapiens
ugcccaagcauauaucgucucu

SEQ ID NO: 15691 - RNA, 18 nt, Homo sapiens
aguuuccacauuagcacu

SEQ ID NO: 15692 - RNA, 22 nt, Homo sapiens
cccauggcucccaaaccaugcc

SEQ ID NO: 15693 - RNA, 21 nt, Homo sapiens
ucuugaugaaaauguugcaca

SEQ ID NO: 15694 - RNA, 21 nt, Homo sapiens
uucugucucucugagccucug

SEQ ID NO: 15695 - RNA, 16 nt, Homo sapiens
uugcaaaacccgccuc

SEQ ID NO: 15696 - RNA, 23 nt, Homo sapiens
cgcgcgacacugcgugcccgcgc

SEQ ID NO: 15697 - RNA, 21 nt, Homo sapiens
cagggagagacccuaccccca

SEQ ID NO: 15698 - RNA, 20 nt, Homo sapiens
guaacauccauccugcuaca

SEQ ID NO: 15699 - RNA, 18 nt, Homo sapiens
uacaguguuugugggaug

SEQ ID NO: 15700 - RNA, 18 nt, Homo sapiens
ugagcuucccaaucaaua

SEQ ID NO: 15701 - RNA, 21 nt, Homo sapiens
uuccuuggaaccaucucugaa

SEQ ID NO: 15702 - RNA, 23 nt, Homo sapiens
agaccccagccagacccccgcca

SEQ ID NO: 15703 - RNA, 20 nt, Homo sapiens
gcucuccucaccacacagca

SEQ ID NO: 15704 - RNA, 21 nt, Homo sapiens
ggcagaacuaagccaggcaua

SEQ ID NO: 15705 - RNA, 19 nt, Homo sapiens
ggguuuugaucuuuuguca

SEQ ID NO: 15706 - RNA, 18 nt, Homo sapiens
guaguuuuaagcuuguuu

SEQ ID NO: 15707 - RNA, 19 nt, Homo sapiens
uucuacauacaaaacacag

SEQ ID NO: 15708 - RNA, 22 nt, Homo sapiens
gccgcccccugcaguccggaga

SEQ ID NO: 15709 - RNA, 17 nt, Homo sapiens
acaucuucauucuccca

SEQ ID NO: 15710 - RNA, 19 nt, Homo sapiens
auucugaugaugagucucu

SEQ ID NO: 15711 - RNA, 18 nt, Homo sapiens
cuuccggcguguccccaa

SEQ ID NO: 15712 - RNA, 17 nt, Homo sapiens
uauaauacuuagcuuua

SEQ ID NO: 15713 - RNA, 22 nt, Homo sapiens
uucugccacuugugcgcugcuu

SEQ ID NO: 15714 - RNA, 21 nt, Homo sapiens
uuugaguguccaaaauagcca

SEQ ID NO: 15715 - RNA, 19 nt, Homo sapiens
cucuccuugccuuugucuu

SEQ ID NO: 15716 - RNA, 20 nt, Homo sapiens
cugcuggucagagcaccaag

SEQ ID NO: 15717 - RNA, 19 nt, Homo sapiens
acuuugauaucauauuccu

SEQ ID NO: 15718 - RNA, 21 nt, Homo sapiens
uggcagucccaaaugaaauua

SEQ ID NO: 15719 - RNA, 18 nt, Homo sapiens
aucuucacccccaccucc

SEQ ID NO: 15720 - RNA, 24 nt, Homo sapiens
acacuuucagagccuucccaccca

SEQ ID NO: 15721 - RNA, 18 nt, Homo sapiens
gcauuuuucauauucuuc

SEQ ID NO: 15722 - RNA, 22 nt, Homo sapiens
ggcaagaagaggcugccuacca

SEQ ID NO: 15723 - RNA, 22 nt, Homo sapiens
uagaauuuguuuuuguuguuuu

SEQ ID NO: 15724 - RNA, 23 nt, Homo sapiens
ucuuuuuaugaugauuuuaccuu

SEQ ID NO: 15725 - RNA, 18 nt, Homo sapiens
caaguggucauuguuaca

SEQ ID NO: 15726 - RNA, 21 nt, Homo sapiens
gauaagaaacaugucaucaua

SEQ ID NO: 15727 - RNA, 22 nt, Homo sapiens
uaauggggcagauaugcauuaa

SEQ ID NO: 15728 - RNA, 17 nt, Homo sapiens
aaaaacaaacaaacaaa

SEQ ID NO: 15729 - RNA, 18 nt, Homo sapiens
aaacagaaguuacaaaug

SEQ ID NO: 15730 - RNA, 17 nt, Homo sapiens
auagaaagugcuuaaac

SEQ ID NO: 15731 - RNA, 27 nt, Homo sapiens
caacaucagccuggccaacaugaugaa

SEQ ID NO: 15732 - RNA, 19 nt, Homo sapiens
gaaauauguaauaaugaua

SEQ ID NO: 15733 - RNA, 19 nt, Homo sapiens
ugauagaaagugcuuaaac

SEQ ID NO: 15734 - RNA, 20 nt, Homo sapiens
aauaggcauuuaaugaaaca

SEQ ID NO: 15735 - RNA, 21 nt, Homo sapiens
accagugacccugaaaacuga

SEQ ID NO: 15736 - RNA, 25 nt, Homo sapiens
auuucagugaagucauuuugcuuca

SEQ ID NO: 15737 - RNA, 19 nt, Homo sapiens
caguuuauuacauuuacau

SEQ ID NO: 15738 - RNA, 17 nt, Homo sapiens
cugaaaacugagggugc

SEQ ID NO: 15739 - RNA, 17 nt, Homo sapiens
aacaggauuaacuguga

SEQ ID NO: 15740 - RNA, 18 nt, Homo sapiens
cgcaacuuccuagcguga

SEQ ID NO: 15741 - RNA, 18 nt, Homo sapiens
guugcugaaaaauauuug

SEQ ID NO: 15742 - RNA, 22 nt, Homo sapiens
uguuaagggaaauccaaauucc

SEQ ID NO: 15743 - RNA, 21 nt, Homo sapiens
uuguaacagcaacuugucaaa

SEQ ID NO: 15744 - RNA, 18 nt, Homo sapiens
ccugaggcugccuggccu

SEQ ID NO: 15745 - RNA, 19 nt, Homo sapiens
gcguugggggucccggggg

SEQ ID NO: 15746 - RNA, 22 nt, Homo sapiens
gguuguucugucuuuuuuuuaa

SEQ ID NO: 15747 - RNA, 24 nt, Homo sapiens
uuuugaugccucagggucucugaa

SEQ ID NO: 15748 - RNA, 17 nt, Homo sapiens
gaagaaaugaagggaca

SEQ ID NO: 15749 - RNA, 18 nt, Homo sapiens
guaacacuuauuuacaua

SEQ ID NO: 15750 - RNA, 19 nt, Homo sapiens
cuucucugcuuuuaaucuu

SEQ ID NO: 15751 - RNA, 21 nt, Homo sapiens
gacuggggcuagguuugguua

SEQ ID NO: 15752 - RNA, 20 nt, Homo sapiens
ugcucccacguccugcacug

SEQ ID NO: 15753 - RNA, 18 nt, Homo sapiens
cuacuauaguaaacucuu

SEQ ID NO: 15754 - RNA, 20 nt, Homo sapiens
uaaaugaaaguggcaucaca

SEQ ID NO: 15755 - RNA, 19 nt, Homo sapiens
ugcaaaucucucccucucu

SEQ ID NO: 15756 - RNA, 19 nt, Homo sapiens
aaggcuggcgcccguaauc

SEQ ID NO: 15757 - RNA, 21 nt, Homo sapiens
gauggguuuuuaaugauacua

SEQ ID NO: 15758 - RNA, 18 nt, Homo sapiens
uccauuuccuacuggagg

SEQ ID NO: 15759 - RNA, 19 nt, Homo sapiens
uggucauuuuguucaagga

SEQ ID NO: 15760 - RNA, 23 nt, Homo sapiens
gacauucacagcagcucugugga

SEQ ID NO: 15761 - RNA, 18 nt, Homo sapiens
uaaccaugagagaugcca

SEQ ID NO: 15762 - RNA, 19 nt, Homo sapiens
ucugugugacugucugcuu

SEQ ID NO: 15763 - RNA, 19 nt, Homo sapiens
accaggcagccacugugca

SEQ ID NO: 15764 - RNA, 18 nt, Homo sapiens
agcuauugcuccaugaca

SEQ ID NO: 15765 - RNA, 21 nt, Homo sapiens
auuugaacccaggucucgucu

SEQ ID NO: 15766 - RNA, 21 nt, Homo sapiens
cugauaaaacagauugugaua

SEQ ID NO: 15767 - RNA, 21 nt, Homo sapiens
gacacagaguauuuuaaaaga

SEQ ID NO: 15768 - RNA, 20 nt, Homo sapiens
ggcugcuggcugucuggcuu

SEQ ID NO: 15769 - RNA, 17 nt, Homo sapiens
ucaagugauucuucugc

SEQ ID NO: 15770 - RNA, 20 nt, Homo sapiens
ucuuuuuggacuuuaaucuu

SEQ ID NO: 15771 - RNA, 20 nt, Homo sapiens
uggccaggcuggucuugaac

SEQ ID NO: 15772 - RNA, 19 nt, Homo sapiens
uuccagaagcugcccucag

SEQ ID NO: 15773 - RNA, 21 nt, Homo sapiens
aguggaaauuacugaugagua

SEQ ID NO: 15774 - RNA, 18 nt, Homo sapiens
cacaguggaaauuacuga

SEQ ID NO: 15775 - RNA, 22 nt, Homo sapiens
guuagaguuuaacaaaauacuc

SEQ ID NO: 15776 - RNA, 20 nt, Homo sapiens
uuucgguuuucugccagcca

SEQ ID NO: 15777 - RNA, 20 nt, Homo sapiens
acccgcccccgccugccuca

SEQ ID NO: 15778 - RNA, 16 nt, Homo sapiens
gcccccgccugccuca

SEQ ID NO: 15779 - RNA, 17 nt, Homo sapiens
cauacagaagcagggug

SEQ ID NO: 15780 - RNA, 20 nt, Homo sapiens
ccauuacaacagcuccagga

SEQ ID NO: 15781 - RNA, 21 nt, Homo sapiens
gcccccagugacucuugguuu

SEQ ID NO: 15782 - RNA, 17 nt, Homo sapiens
gccugggcagggcccgg

SEQ ID NO: 15783 - RNA, 19 nt, Homo sapiens
guccucaggagcccccagg

SEQ ID NO: 15784 - RNA, 17 nt, Homo sapiens
aauauuauugcuugcua

SEQ ID NO: 15785 - RNA, 22 nt, Homo sapiens
ggcagaauccaaauacuggguu

SEQ ID NO: 15786 - RNA, 25 nt, Homo sapiens
caaggccgaagggugacaaaauaca

SEQ ID NO: 15787 - RNA, 20 nt, Homo sapiens
cugcggggucugccuggccu

SEQ ID NO: 15788 - RNA, 22 nt, Homo sapiens
acuaaccuaaaagaaaaugaca

SEQ ID NO: 15789 - RNA, 26 nt, Homo sapiens
auaauuuaguaggggcuuauugucuc

SEQ ID NO: 15790 - RNA, 18 nt, Homo sapiens
auaugcacauagcacugu

SEQ ID NO: 15791 - RNA, 23 nt, Homo sapiens
gccuuuuguuuccugugcaaaca

SEQ ID NO: 15792 - RNA, 23 nt, Homo sapiens
uuguggauauuuggcuguuuuua

SEQ ID NO: 15793 - RNA, 19 nt, Homo sapiens
gggaaauacugaggaccaa

SEQ ID NO: 15794 - RNA, 17 nt, Homo sapiens
guaauguggcacugagc

SEQ ID NO: 15795 - RNA, 19 nt, Homo sapiens
auuaagugcaguuuauauu

SEQ ID NO: 15796 - RNA, 15 nt, Homo sapiens
gugguggagugaagu

SEQ ID NO: 15797 - RNA, 21 nt, Homo sapiens
gugucuugguuaacuaauucu

SEQ ID NO: 15798 - RNA, 26 nt, Homo sapiens
uucaccagaacuauuuuaauauauca

SEQ ID NO: 15799 - RNA, 20 nt, Homo sapiens
cagcucuaccaggagaucca

SEQ ID NO: 15800 - RNA, 22 nt, Homo sapiens
aggaaguaguugccuuugguca

SEQ ID NO: 15801 - RNA, 19 nt, Homo sapiens
uuggauuuuauuuauaauu

SEQ ID NO: 15802 - RNA, 19 nt, Homo sapiens
ccauuuacaaauguaccuu

SEQ ID NO: 15803 - RNA, 19 nt, Homo sapiens
gaccccauugaguuacugu

SEQ ID NO: 15804 - RNA, 25 nt, Homo sapiens
uuugggguguguguguguguuugug

SEQ ID NO: 15805 - RNA, 18 nt, Homo sapiens
acagcucagcaacaacca

SEQ ID NO: 15806 - RNA, 23 nt, Homo sapiens
accacugcuggcacaagcaguga

SEQ ID NO: 15807 - RNA, 17 nt, Homo sapiens
cuggcgaucuuuugaua

SEQ ID NO: 15808 - RNA, 17 nt, Homo sapiens
gcagugacuguuuggca

SEQ ID NO: 15809 - RNA, 17 nt, Homo sapiens
uucacaguauuuugcuu

SEQ ID NO: 15810 - RNA, 19 nt, Homo sapiens
agaugaaugccgagugcuu

SEQ ID NO: 15811 - RNA, 21 nt, Homo sapiens
agauuagaucucuaaaugcag

SEQ ID NO: 15812 - RNA, 21 nt, Homo sapiens
cauuuuguccugcacacacgu

SEQ ID NO: 15813 - RNA, 19 nt, Homo sapiens
gccucagccagcaaugcaa

SEQ ID NO: 15814 - RNA, 21 nt, Homo sapiens
uccugaaaagaccuugcagua

SEQ ID NO: 15815 - RNA, 22 nt, Homo sapiens
uuucugaucacucucagacugu

SEQ ID NO: 15816 - RNA, 18 nt, Homo sapiens
gcgagugacaaugugaca

SEQ ID NO: 15817 - RNA, 18 nt, Homo sapiens
uccgccuccuggguucaa

SEQ ID NO: 15818 - RNA, 15 nt, Homo sapiens
ugcggcugugccugg

SEQ ID NO: 15819 - RNA, 21 nt, Homo sapiens
aagccccagacccccuucucu

SEQ ID NO: 15820 - RNA, 17 nt, Homo sapiens
cggggggcaugcuggcc

SEQ ID NO: 15821 - RNA, 23 nt, Homo sapiens
ugugggggugguggugcugcagg

SEQ ID NO: 15822 - RNA, 23 nt, Homo sapiens
ccagagcacuguuggaagucugg

SEQ ID NO: 15823 - RNA, 23 nt, Homo sapiens
cgaggcuacgagcugcccgaugg

SEQ ID NO: 15824 - RNA, 21 nt, Homo sapiens
uuucacuugucauucuacuuu

SEQ ID NO: 15825 - RNA, 18 nt, Homo sapiens
aagagacccguucagagu

SEQ ID NO: 15826 - RNA, 20 nt, Homo sapiens
gcucaugggcaagaaacucu

SEQ ID NO: 15827 - RNA, 18 nt, Homo sapiens
uggguggaucaccugaag

SEQ ID NO: 15828 - RNA, 17 nt, Homo sapiens
caggaauagugguuuaa

SEQ ID NO: 15829 - RNA, 21 nt, Homo sapiens
ccuuauuuuccaccuccccca

SEQ ID NO: 15830 - RNA, 19 nt, Homo sapiens
cugcaaccuccgccuccca

SEQ ID NO: 15831 - RNA, 18 nt, Homo sapiens
uccgccucccagguucaa

SEQ ID NO: 15832 - RNA, 23 nt, Homo sapiens
ggagaucuggcgaugacuguggc

SEQ ID NO: 15833 - RNA, 24 nt, Homo sapiens
uguagggaucccuccugcacauca

SEQ ID NO: 15834 - RNA, 20 nt, Homo sapiens
uucuggccuuccccacccca

SEQ ID NO: 15835 - RNA, 17 nt, Homo sapiens
gugcuggcuuuuuugaa

SEQ ID NO: 15836 - RNA, 18 nt, Homo sapiens
guucaacaccaccuuaua

SEQ ID NO: 15837 - RNA, 17 nt, Homo sapiens
cuuucucugcucagcuc

SEQ ID NO: 15838 - RNA, 17 nt, Homo sapiens
ccagggcaccguucuag

SEQ ID NO: 15839 - RNA, 20 nt, Homo sapiens
guucaagaaaauuaaauggu

SEQ ID NO: 15840 - RNA, 21 nt, Homo sapiens
uaagaucuauuaagcuugaca

SEQ ID NO: 15841 - RNA, 20 nt, Homo sapiens
uagaaccuuuucuuaucuca

SEQ ID NO: 15842 - RNA, 18 nt, Homo sapiens
gccuuacgugguaucaca

SEQ ID NO: 15843 - RNA, 21 nt, Homo sapiens
cccucugaguaggaaguguga

SEQ ID NO: 15844 - RNA, 20 nt, Homo sapiens
uguuccucaguauggggcug

SEQ ID NO: 15845 - RNA, 21 nt, Homo sapiens
ccaguggggcccccgcagcuc

SEQ ID NO: 15846 - RNA, 18 nt, Homo sapiens
cucacuuugaaaaguaug

SEQ ID NO: 15847 - RNA, 16 nt, Homo sapiens
cuucuauuccauuuua

SEQ ID NO: 15848 - RNA, 23 nt, Homo sapiens
cuuuuuacacuguaugcgguuug

SEQ ID NO: 15849 - RNA, 23 nt, Homo sapiens
cuuuuugggucucaagauuuaug

SEQ ID NO: 15850 - RNA, 22 nt, Homo sapiens
gcgccagcggagcuccggcucc

SEQ ID NO: 15851 - RNA, 22 nt, Homo sapiens
cagcuaggcuacacccaucaug

SEQ ID NO: 15852 - RNA, 21 nt, Homo sapiens
cccucuuccuuccugguguac

SEQ ID NO: 15853 - RNA, 21 nt, Homo sapiens
ucaggaacuugacacaguguu

SEQ ID NO: 15854 - RNA, 19 nt, Homo sapiens
ucccagagaccaucuauca

SEQ ID NO: 15855 - RNA, 21 nt, Homo sapiens
ugaccauccauagaauaugug

SEQ ID NO: 15856 - RNA, 19 nt, Homo sapiens
ugcggcuguaccaggaaga

SEQ ID NO: 15857 - RNA, 25 nt, Homo sapiens
auaauguacaggucauuuguguaga

SEQ ID NO: 15858 - RNA, 20 nt, Homo sapiens
ucaaaagggauguugcuggu

SEQ ID NO: 15859 - RNA, 15 nt, Homo sapiens
auuguaucuuaauca

SEQ ID NO: 15860 - RNA, 18 nt, Homo sapiens
cugugguauggccauuga

SEQ ID NO: 15861 - RNA, 23 nt, Homo sapiens
ugagguugugauuggugacauuc

SEQ ID NO: 15862 - RNA, 21 nt, Homo sapiens
ugcccaaggcaacucacccuc

SEQ ID NO: 15863 - RNA, 24 nt, Homo sapiens
uuucuuauuggguugucuugcuuu

SEQ ID NO: 15864 - RNA, 20 nt, Homo sapiens
caaguccugcgaugcuaagu

SEQ ID NO: 15865 - RNA, 23 nt, Homo sapiens
cauaacacaggagaccugcuccc

SEQ ID NO: 15866 - RNA, 22 nt, Homo sapiens
ccagggcguccuccagcucagc

SEQ ID NO: 15867 - RNA, 19 nt, Homo sapiens
gaauguucucaguguccua

SEQ ID NO: 15868 - RNA, 19 nt, Homo sapiens
ggagcacucugagaucuca

SEQ ID NO: 15869 - RNA, 18 nt, Homo sapiens
ggguuaaaaugccgacca

SEQ ID NO: 15870 - RNA, 21 nt, Homo sapiens
uaaaaugcuggaaaacuguaa

SEQ ID NO: 15871 - RNA, 20 nt, Homo sapiens
uccgucucgcucaucaucac

SEQ ID NO: 15872 - RNA, 18 nt, Homo sapiens
ucuggccucucaccccca

SEQ ID NO: 15873 - RNA, 22 nt, Homo sapiens
acaguggagacgucugcucuga

SEQ ID NO: 15874 - RNA, 23 nt, Homo sapiens
agcuacagagcaccaaccagcag

SEQ ID NO: 15875 - RNA, 18 nt, Homo sapiens
caguuuuaugcugccuuu

SEQ ID NO: 15876 - RNA, 21 nt, Homo sapiens
ccuuguugaaccgcugcuaaa

SEQ ID NO: 15877 - RNA, 17 nt, Homo sapiens
gcugguaccuuuaccuc

SEQ ID NO: 15878 - RNA, 16 nt, Homo sapiens
ggauguagacauugcc

SEQ ID NO: 15879 - RNA, 22 nt, Homo sapiens
gucccacugcugauuauugaga

SEQ ID NO: 15880 - RNA, 24 nt, Homo sapiens
uaaguuccaaaagaagauguaaua

SEQ ID NO: 15881 - RNA, 18 nt, Homo sapiens
ucccacugcugauuauug

SEQ ID NO: 15882 - RNA, 20 nt, Homo sapiens
cgccugcaccaacagccuca

SEQ ID NO: 15883 - RNA, 17 nt, Homo sapiens
cucuccuucgccuucug

SEQ ID NO: 15884 - RNA, 22 nt, Homo sapiens
gacgggguuucaccauacuggc

SEQ ID NO: 15885 - RNA, 19 nt, Homo sapiens
gcaccucugccuucuuccu

SEQ ID NO: 15886 - RNA, 22 nt, Homo sapiens
gccccacacaccacagccagga

SEQ ID NO: 15887 - RNA, 22 nt, Homo sapiens
gccccucacaccacagccagga

SEQ ID NO: 15888 - RNA, 22 nt, Homo sapiens
gccccucacaccacagccagga

SEQ ID NO: 15889 - RNA, 22 nt, Homo sapiens
gccccucacaccacagccagga

SEQ ID NO: 15890 - RNA, 22 nt, Homo sapiens
gccccucucaccacagccagga

SEQ ID NO: 15891 - RNA, 22 nt, Homo sapiens
gccccucucaccacagccagga

SEQ ID NO: 15892 - RNA, 19 nt, Homo sapiens
gcccuggucuaauccagga

SEQ ID NO: 15893 - RNA, 22 nt, Homo sapiens
gcccuucacaccacagccagga

SEQ ID NO: 15894 - RNA, 25 nt, Homo sapiens
gcgcauguaggcugccgguggcuuu

SEQ ID NO: 15895 - RNA, 18 nt, Homo sapiens
uccaucucccggguucaa

SEQ ID NO: 15896 - RNA, 18 nt, Homo sapiens
ucugaaagcaucugugga

SEQ ID NO: 15897 - RNA, 24 nt, Homo sapiens
uuuccagaccauccccucucacca

SEQ ID NO: 15898 - RNA, 20 nt, Homo sapiens
ccugaaggacugcguggugg

SEQ ID NO: 15899 - RNA, 19 nt, Homo sapiens
aagcaauucuccugccuca

SEQ ID NO: 15900 - RNA, 19 nt, Homo sapiens
aagcaauucuccuucuuca

SEQ ID NO: 15901 - RNA, 19 nt, Homo sapiens
aagcaauucuccuucuuca

SEQ ID NO: 15902 - RNA, 23 nt, Homo sapiens
acuucaagcaauucuccugccuc

SEQ ID NO: 15903 - RNA, 21 nt, Homo sapiens
agucucacucuguugccaggc

SEQ ID NO: 15904 - RNA, 19 nt, Homo sapiens
auauugccagauguccucu

SEQ ID NO: 15905 - RNA, 21 nt, Homo sapiens
aucuuggcucacugcaaccuc

SEQ ID NO: 15906 - RNA, 21 nt, Homo sapiens
aucuuggcucacugcaaccuc

SEQ ID NO: 15907 - RNA, 18 nt, Homo sapiens
ccugcaaccuccaccucc

SEQ ID NO: 15908 - RNA, 18 nt, Homo sapiens
ccugcaaccuccaccucc

SEQ ID NO: 15909 - RNA, 18 nt, Homo sapiens
cgcaguaaacuguugaua

SEQ ID NO: 15910 - RNA, 19 nt, Homo sapiens
cugcaaccuccgccuccca

SEQ ID NO: 15911 - RNA, 18 nt, Homo sapiens
uccaccucccggguucaa

SEQ ID NO: 15912 - RNA, 18 nt, Homo sapiens
uccaccuccuggguucaa

SEQ ID NO: 15913 - RNA, 18 nt, Homo sapiens
uccgccucccagguucag

SEQ ID NO: 15914 - RNA, 19 nt, Homo sapiens
uccuugugaacaguguuau

SEQ ID NO: 15915 - RNA, 20 nt, Homo sapiens
uggucaggcuggucuugaac

SEQ ID NO: 15916 - RNA, 20 nt, Homo sapiens
uggucaggcuggucuugaac

SEQ ID NO: 15917 - RNA, 20 nt, Homo sapiens
uguauccuugugugaaauug

SEQ ID NO: 15918 - RNA, 19 nt, Homo sapiens
cacaguaaaagaauuccuu

SEQ ID NO: 15919 - RNA, 16 nt, Homo sapiens
ccucacccaggaguca

SEQ ID NO: 15920 - RNA, 22 nt, Homo sapiens
cuggcuuacaauaaaugcccaa

SEQ ID NO: 15921 - RNA, 24 nt, Homo sapiens
cuucucugugaaacacucuaccuu

SEQ ID NO: 15922 - RNA, 23 nt, Homo sapiens
guuucugcugacuugccuggcuu

SEQ ID NO: 15923 - RNA, 19 nt, Homo sapiens
uuuggugaugcugugcgag

SEQ ID NO: 15924 - RNA, 21 nt, Homo sapiens
gauuguuuugcuacuuuuuca

SEQ ID NO: 15925 - RNA, 24 nt, Homo sapiens
ucuuuaaaugaacaaguaaccaca

SEQ ID NO: 15926 - RNA, 20 nt, Homo sapiens
uuucuguuucacguuccuuc

SEQ ID NO: 15927 - RNA, 25 nt, Homo sapiens
accagacgucugugcugccugguuu

SEQ ID NO: 15928 - RNA, 20 nt, Homo sapiens
cagugggaccaguguugcca

SEQ ID NO: 15929 - RNA, 20 nt, Homo sapiens
cccaucucuccuucucacug

SEQ ID NO: 15930 - RNA, 22 nt, Homo sapiens
cuccuccuccuccuccuccucu

SEQ ID NO: 15931 - RNA, 21 nt, Homo sapiens
gacaggaacaaggacaacucc

SEQ ID NO: 15932 - RNA, 21 nt, Homo sapiens
uaauuccaucagacugcuguc

SEQ ID NO: 15933 - RNA, 18 nt, Homo sapiens
ucugguuacugccuggcc

SEQ ID NO: 15934 - RNA, 18 nt, Homo sapiens
aagaguagcuuuuuuuca

SEQ ID NO: 15935 - RNA, 17 nt, Homo sapiens
cuuccccgccccucucc

SEQ ID NO: 15936 - RNA, 20 nt, Homo sapiens
ucuuuuuauauauuuagccu

SEQ ID NO: 15937 - RNA, 23 nt, Homo sapiens
acaaaaauuauugagcaacccua

SEQ ID NO: 15938 - RNA, 22 nt, Homo sapiens
gugccaaaaaccuguggauuuu

SEQ ID NO: 15939 - RNA, 24 nt, Homo sapiens
gugguuuucucgagucuuugguca

SEQ ID NO: 15940 - RNA, 18 nt, Homo sapiens
auccuaaaauacauuggu

SEQ ID NO: 15941 - RNA, 21 nt, Homo sapiens
acucuuguucaagacuagcua

SEQ ID NO: 15942 - RNA, 21 nt, Homo sapiens
cagggcguccgcuaggcucgg

SEQ ID NO: 15943 - RNA, 16 nt, Homo sapiens
ucuuucuacaguauga

SEQ ID NO: 15944 - RNA, 19 nt, Homo sapiens
aucaucuaagaccaucucu

SEQ ID NO: 15945 - RNA, 19 nt, Homo sapiens
auguggagcaaacuugagg

SEQ ID NO: 15946 - RNA, 20 nt, Homo sapiens
ccaccucuguggccaccuca

SEQ ID NO: 15947 - RNA, 26 nt, Homo sapiens
ccagauucaagugauccucccaucuc

SEQ ID NO: 15948 - RNA, 19 nt, Homo sapiens
ccuuccacuucccacuucc

SEQ ID NO: 15949 - RNA, 18 nt, Homo sapiens
cugguguccugaaagggg

SEQ ID NO: 15950 - RNA, 22 nt, Homo sapiens
gagccaagaucaugcuacugca

SEQ ID NO: 15951 - RNA, 20 nt, Homo sapiens
guaagcagcaaaccccugga

SEQ ID NO: 15952 - RNA, 19 nt, Homo sapiens
gugugugugagcaccugac

SEQ ID NO: 15953 - RNA, 21 nt, Homo sapiens
ucaccaaccccuuccacuucc

SEQ ID NO: 15954 - RNA, 22 nt, Homo sapiens
ucauacacugaagcaaauucag

SEQ ID NO: 15955 - RNA, 18 nt, Homo sapiens
acuugauaggcuaugcau

SEQ ID NO: 15956 - RNA, 24 nt, Homo sapiens
guguuuucuugagugucacuugau

SEQ ID NO: 15957 - RNA, 18 nt, Homo sapiens
cugucccugcucugccuc

SEQ ID NO: 15958 - RNA, 22 nt, Homo sapiens
cuucuucggcaaaccuugcuuu

SEQ ID NO: 15959 - RNA, 19 nt, Homo sapiens
acccuggcaggggacccca

SEQ ID NO: 15960 - RNA, 16 nt, Homo sapiens
acuggcacacgcaggc

SEQ ID NO: 15961 - RNA, 19 nt, Homo sapiens
cccucaaccggcuccauca

SEQ ID NO: 15962 - RNA, 18 nt, Homo sapiens
ccugcaaccuccaccucc

SEQ ID NO: 15963 - RNA, 18 nt, Homo sapiens
cgccccgucggcagcucu

SEQ ID NO: 15964 - RNA, 19 nt, Homo sapiens
cgcgccaccacgcccagcu

SEQ ID NO: 15965 - RNA, 22 nt, Homo sapiens
gaauaaagccaaggcuucuucc

SEQ ID NO: 15966 - RNA, 25 nt, Homo sapiens
ccucuuugccuguggguuuaacuuu

SEQ ID NO: 15967 - RNA, 20 nt, Homo sapiens
gaugcccauucuacuuuuga

SEQ ID NO: 15968 - RNA, 27 nt, Homo sapiens
gcgggccgagcggggcggccuuuguua

SEQ ID NO: 15969 - RNA, 22 nt, Homo sapiens
gcuucugcugaccgcugggccc

SEQ ID NO: 15970 - RNA, 23 nt, Homo sapiens
aaguauuuaugaacugugauaaa

SEQ ID NO: 15971 - RNA, 21 nt, Homo sapiens
acuuggaaaugccucuggcuu

SEQ ID NO: 15972 - RNA, 17 nt, Homo sapiens
cucccuuccucuccucu

SEQ ID NO: 15973 - RNA, 25 nt, Homo sapiens
ccccagaccuccagaaaugacguca

SEQ ID NO: 15974 - RNA, 24 nt, Homo sapiens
cuucuugcaacucuccuuaauuuu

SEQ ID NO: 15975 - RNA, 17 nt, Homo sapiens
uccagaaaugacgucag

SEQ ID NO: 15976 - RNA, 21 nt, Homo sapiens
acaaaaguuagccuuagaguu

SEQ ID NO: 15977 - RNA, 19 nt, Homo sapiens
acaucauuguuucuaugac

SEQ ID NO: 15978 - RNA, 20 nt, Homo sapiens
agaagcccaguggggagcuc

SEQ ID NO: 15979 - RNA, 17 nt, Homo sapiens
gaugaaaccagucuucc

SEQ ID NO: 15980 - RNA, 20 nt, Homo sapiens
gauucauucucccuugagcu

SEQ ID NO: 15981 - RNA, 17 nt, Homo sapiens
gcacucgucuuugccuu

SEQ ID NO: 15982 - RNA, 20 nt, Homo sapiens
gcaggccgggccugcuguca

SEQ ID NO: 15983 - RNA, 17 nt, Homo sapiens
aagccaucucccagggc

SEQ ID NO: 15984 - RNA, 21 nt, Homo sapiens
auccaacugccccuugagucc

SEQ ID NO: 15985 - RNA, 19 nt, Homo sapiens
cagaaaaagaagugccuuu

SEQ ID NO: 15986 - RNA, 17 nt, Homo sapiens
cagcauggcauugagaa

SEQ ID NO: 15987 - RNA, 19 nt, Homo sapiens
gauucccagcauggcauug

SEQ ID NO: 15988 - RNA, 21 nt, Homo sapiens
gccccaugaguagccaggaua

SEQ ID NO: 15989 - RNA, 21 nt, Homo sapiens
gguggaugggaagaaaauugu

SEQ ID NO: 15990 - RNA, 26 nt, Homo sapiens
gugucucauauacccuauccuggugg

SEQ ID NO: 15991 - RNA, 21 nt, Homo sapiens
uggggaugccuaacaugaagc

SEQ ID NO: 15992 - RNA, 22 nt, Homo sapiens
cgccugccccccccgccaaucc

SEQ ID NO: 15993 - RNA, 19 nt, Homo sapiens
guaucccccagccccagga

SEQ ID NO: 15994 - RNA, 19 nt, Homo sapiens
accaauggauuacaugcca

SEQ ID NO: 15995 - RNA, 21 nt, Homo sapiens
aguggaugggguuucuguugu

SEQ ID NO: 15996 - RNA, 19 nt, Homo sapiens
ccuaccccaccacacccca

SEQ ID NO: 15997 - RNA, 25 nt, Homo sapiens
gccccugucccucgccauacacuga

SEQ ID NO: 15998 - RNA, 18 nt, Homo sapiens
ugccaggagccaaccugg

SEQ ID NO: 15999 - RNA, 18 nt, Homo sapiens
uuugucgaaggccugugg

SEQ ID NO: 16000 - RNA, 20 nt, Homo sapiens
uucaccuguguccucgccgc

SEQ ID NO: 16001 - RNA, 21 nt, Homo sapiens
auugcaccaaaguacauuuga

SEQ ID NO: 16002 - RNA, 19 nt, Homo sapiens
ccagaugcuaaaucauucc

SEQ ID NO: 16003 - RNA, 19 nt, Homo sapiens
uaagccccaagagacauuu

SEQ ID NO: 16004 - RNA, 18 nt, Homo sapiens
uauaugaaagcugugaua

SEQ ID NO: 16005 - RNA, 17 nt, Homo sapiens
aaaguugaaaguggcaa

SEQ ID NO: 16006 - RNA, 19 nt, Homo sapiens
accaaguauugcuuggcuu

SEQ ID NO: 16007 - RNA, 18 nt, Homo sapiens
caguccuggucggccaca

SEQ ID NO: 16008 - RNA, 19 nt, Homo sapiens
gccaaacucuugaagcacc

SEQ ID NO: 16009 - RNA, 24 nt, Homo sapiens
ucaccacuagcccacccugcccgu

SEQ ID NO: 16010 - RNA, 23 nt, Homo sapiens
cacaacagugacuauaucacuca

SEQ ID NO: 16011 - RNA, 18 nt, Homo sapiens
cacacaguaugcucucug

SEQ ID NO: 16012 - RNA, 21 nt, Homo sapiens
uaggugggcccaccacuugag

SEQ ID NO: 16013 - RNA, 21 nt, Homo sapiens
aacaggaagccacuugcaagc

SEQ ID NO: 16014 - RNA, 18 nt, Homo sapiens
acucacucucuuuugcca

SEQ ID NO: 16015 - RNA, 21 nt, Homo sapiens
aguuauagaaagcugucuaca

SEQ ID NO: 16016 - RNA, 21 nt, Homo sapiens
caagaaacaugcauuuuggca

SEQ ID NO: 16017 - RNA, 19 nt, Homo sapiens
caggcacagagcugcaguu

SEQ ID NO: 16018 - RNA, 19 nt, Homo sapiens
ccuagaggcugcuuggccc

SEQ ID NO: 16019 - RNA, 20 nt, Homo sapiens
ucgugacaucacacacuuca

SEQ ID NO: 16020 - RNA, 18 nt, Homo sapiens
uguauuuugaccaaauaa

SEQ ID NO: 16021 - RNA, 21 nt, Homo sapiens
aaauucagaaaauucaccuga

SEQ ID NO: 16022 - RNA, 18 nt, Homo sapiens
augaucauuuagcauuca

SEQ ID NO: 16023 - RNA, 19 nt, Homo sapiens
gaaagcugcuuucacguca

SEQ ID NO: 16024 - RNA, 21 nt, Homo sapiens
uaaugaaagcacuaaguuugg

SEQ ID NO: 16025 - RNA, 18 nt, Homo sapiens
acccaucuguuccucguc

SEQ ID NO: 16026 - RNA, 23 nt, Homo sapiens
accgagugaugccccucuccccu

SEQ ID NO: 16027 - RNA, 20 nt, Homo sapiens
cagaccccccugaccaagcu

SEQ ID NO: 16028 - RNA, 19 nt, Homo sapiens
ccaucccauucccaccucc

SEQ ID NO: 16029 - RNA, 22 nt, Homo sapiens
cccgcuguggcagcggcuggag

SEQ ID NO: 16030 - RNA, 23 nt, Homo sapiens
cggggugggagcugggccuggcg

SEQ ID NO: 16031 - RNA, 15 nt, Homo sapiens
cucucucccugccuc

SEQ ID NO: 16032 - RNA, 20 nt, Homo sapiens
cucucucucuucugcuucuc

SEQ ID NO: 16033 - RNA, 20 nt, Homo sapiens
uccaugcugggggaccgugg

SEQ ID NO: 16034 - RNA, 22 nt, Homo sapiens
ugagugggcccuggggacacug

SEQ ID NO: 16035 - RNA, 19 nt, Homo sapiens
ugggacuuggguggagcug

SEQ ID NO: 16036 - RNA, 24 nt, Homo sapiens
ugugcagccuggaaaccaucgcug

SEQ ID NO: 16037 - RNA, 18 nt, Homo sapiens
uucagcagcaugaugcca

SEQ ID NO: 16038 - RNA, 22 nt, Homo sapiens
uuuucuuuuguuaaaaaucaaa

SEQ ID NO: 16039 - RNA, 19 nt, Homo sapiens
cugccuggcuggcaccuca

SEQ ID NO: 16040 - RNA, 23 nt, Homo sapiens
gagaccguguggccaugaugugg

SEQ ID NO: 16041 - RNA, 18 nt, Homo sapiens
ggagcagucacuauugua

SEQ ID NO: 16042 - RNA, 18 nt, Homo sapiens
uaaucccaguagcuguua

SEQ ID NO: 16043 - RNA, 18 nt, Homo sapiens
uagguggguuucaggagc

SEQ ID NO: 16044 - RNA, 18 nt, Homo sapiens
acaaaggaucuuaaacca

SEQ ID NO: 16045 - RNA, 21 nt, Homo sapiens
ccagcagccucccaccuguga

SEQ ID NO: 16046 - RNA, 22 nt, Homo sapiens
gccccuucccugagccacccca

SEQ ID NO: 16047 - RNA, 20 nt, Homo sapiens
ucgaguauuaauacuacugc

SEQ ID NO: 16048 - RNA, 23 nt, Homo sapiens
uugagacacuggaaaaaaagaua

SEQ ID NO: 16049 - RNA, 18 nt, Homo sapiens
agagcccaaauaagcauc

SEQ ID NO: 16050 - RNA, 21 nt, Homo sapiens
cacugaggucauggugacuca

SEQ ID NO: 16051 - RNA, 24 nt, Homo sapiens
cucugauuucauugaggaucuugg

SEQ ID NO: 16052 - RNA, 17 nt, Homo sapiens
gcuugggaagaaacucc

SEQ ID NO: 16053 - RNA, 20 nt, Homo sapiens
ugaggucauggugacucagu

SEQ ID NO: 16054 - RNA, 20 nt, Homo sapiens
cauauauaacguguuauugc

SEQ ID NO: 16055 - RNA, 21 nt, Homo sapiens
caucucaauuuacacuagcca

SEQ ID NO: 16056 - RNA, 24 nt, Homo sapiens
ccaaaaugccauuuuuaacgccga

SEQ ID NO: 16057 - RNA, 18 nt, Homo sapiens
gaguugccugggcuacaa

SEQ ID NO: 16058 - RNA, 19 nt, Homo sapiens
guuuuguauaaaacaauag

SEQ ID NO: 16059 - RNA, 23 nt, Homo sapiens
aagagaacugucaggagcccaga

SEQ ID NO: 16060 - RNA, 18 nt, Homo sapiens
auagaugccaucugugug

SEQ ID NO: 16061 - RNA, 22 nt, Homo sapiens
ccccgccccgcccccaacaacu

SEQ ID NO: 16062 - RNA, 17 nt, Homo sapiens
ggagcccagaaccaacc

SEQ ID NO: 16063 - RNA, 25 nt, Homo sapiens
uucaaaacaaaauguuacaacaaua

SEQ ID NO: 16064 - RNA, 19 nt, Homo sapiens
aacuuuaaaaaggaucagg

SEQ ID NO: 16065 - RNA, 17 nt, Homo sapiens
acaaaaguuuccugagu

SEQ ID NO: 16066 - RNA, 24 nt, Homo sapiens
accccgggcgguccacccgccuca

SEQ ID NO: 16067 - RNA, 19 nt, Homo sapiens
aggguuuguguauccauuc

SEQ ID NO: 16068 - RNA, 18 nt, Homo sapiens
gauccagaggagacaaag

SEQ ID NO: 16069 - RNA, 21 nt, Homo sapiens
gcccagaaauaaaaccuuaac

SEQ ID NO: 16070 - RNA, 19 nt, Homo sapiens
guaggaaauaaacuugaua

SEQ ID NO: 16071 - RNA, 18 nt, Homo sapiens
ucucugcuaaaaauacaa

SEQ ID NO: 16072 - RNA, 18 nt, Homo sapiens
ugauaucuauucugugac

SEQ ID NO: 16073 - RNA, 18 nt, Homo sapiens
uggguggaucacuugagg

SEQ ID NO: 16074 - RNA, 21 nt, Homo sapiens
ccaccacucccugggcaccca

SEQ ID NO: 16075 - RNA, 21 nt, Homo sapiens
agccaccaaccccagccagug

SEQ ID NO: 16076 - RNA, 19 nt, Homo sapiens
aggucagcugggucuagca

SEQ ID NO: 16077 - RNA, 23 nt, Homo sapiens
auacacccacacucuggcaccac

SEQ ID NO: 16078 - RNA, 22 nt, Homo sapiens
cagacaccauugcccacacuau

SEQ ID NO: 16079 - RNA, 23 nt, Homo sapiens
cagccucaacucugagaagccca

SEQ ID NO: 16080 - RNA, 18 nt, Homo sapiens
ccuggagggcucugggga

SEQ ID NO: 16081 - RNA, 15 nt, Homo sapiens
ccuggccccaccagc

SEQ ID NO: 16082 - RNA, 19 nt, Homo sapiens
ccuggcuccucacauccca

SEQ ID NO: 16083 - RNA, 20 nt, Homo sapiens
cugaccagcccaaaucugcc

SEQ ID NO: 16084 - RNA, 19 nt, Homo sapiens
gaacaucagcaacugacca

SEQ ID NO: 16085 - RNA, 21 nt, Homo sapiens
gacaguggaaaaaagagacca

SEQ ID NO: 16086 - RNA, 18 nt, Homo sapiens
gcgaaccccacucugcca

SEQ ID NO: 16087 - RNA, 23 nt, Homo sapiens
gcuugggcuccaggcacuggcuu

SEQ ID NO: 16088 - RNA, 16 nt, Homo sapiens
ggccuucccugccccu

SEQ ID NO: 16089 - RNA, 18 nt, Homo sapiens
gugucccucccuccugug

SEQ ID NO: 16090 - RNA, 22 nt, Homo sapiens
ucugccuggcaggccaaccuca

SEQ ID NO: 16091 - RNA, 19 nt, Homo sapiens
ugcacagacaccauugccc

SEQ ID NO: 16092 - RNA, 19 nt, Homo sapiens
uuauuucagggcccuuuuc

SEQ ID NO: 16093 - RNA, 20 nt, Homo sapiens
agauggagaagagaccauca

SEQ ID NO: 16094 - RNA, 21 nt, Homo sapiens
cacaacugccacugcucacca

SEQ ID NO: 16095 - RNA, 20 nt, Homo sapiens
cccagaaacucacuucucag

SEQ ID NO: 16096 - RNA, 21 nt, Homo sapiens
cccagaaacucacuucucagu

SEQ ID NO: 16097 - RNA, 23 nt, Homo sapiens
uaaaugaaaguaggaugaagcua

SEQ ID NO: 16098 - RNA, 22 nt, Homo sapiens
uccuucugaccacacacagaca

SEQ ID NO: 16099 - RNA, 20 nt, Homo sapiens
ugccacugcucaccaggaca

SEQ ID NO: 16100 - RNA, 18 nt, Homo sapiens
ugcucaacccaagcuucu

SEQ ID NO: 16101 - RNA, 20 nt, Homo sapiens
uuuucuuguaacucaugaca

SEQ ID NO: 16102 - RNA, 18 nt, Homo sapiens
agugccccuucugccuca

SEQ ID NO: 16103 - RNA, 17 nt, Homo sapiens
ccaaagaccaaacacug

SEQ ID NO: 16104 - RNA, 21 nt, Homo sapiens
acuuaauaaauacaauaugcu

SEQ ID NO: 16105 - RNA, 20 nt, Homo sapiens
gguuuguuacuuggacuaac

SEQ ID NO: 16106 - RNA, 22 nt, Homo sapiens
aaaacaaaacaaacccuaacua

SEQ ID NO: 16107 - RNA, 19 nt, Homo sapiens
ccccaccuccccgcaagcu

SEQ ID NO: 16108 - RNA, 19 nt, Homo sapiens
cccugguggugggggcugu

SEQ ID NO: 16109 - RNA, 19 nt, Homo sapiens
gggcacaucacccaccuca

SEQ ID NO: 16110 - RNA, 18 nt, Homo sapiens
gcaagagcacucuggguu

SEQ ID NO: 16111 - RNA, 20 nt, Homo sapiens
uacguaugaacacuauaaac

SEQ ID NO: 16112 - RNA, 22 nt, Homo sapiens
auagacaucucaccagcacuga

SEQ ID NO: 16113 - RNA, 19 nt, Homo sapiens
ccaggcacucacgccucuu

SEQ ID NO: 16114 - RNA, 18 nt, Homo sapiens
cuagagccugguccucca

SEQ ID NO: 16115 - RNA, 21 nt, Homo sapiens
gccugggcucgcggccggccc

SEQ ID NO: 16116 - RNA, 20 nt, Homo sapiens
ggccagucucggcagucgag

SEQ ID NO: 16117 - RNA, 23 nt, Homo sapiens
gucggucucugagaaagcaccug

SEQ ID NO: 16118 - RNA, 21 nt, Homo sapiens
uccagcagcucaaugcuguuu

SEQ ID NO: 16119 - RNA, 18 nt, Homo sapiens
uguccccaguccugguca

SEQ ID NO: 16120 - RNA, 19 nt, Homo sapiens
uuuugucugccuccccuca

SEQ ID NO: 16121 - RNA, 22 nt, Homo sapiens
aucaacugaagaguccauuuaa

SEQ ID NO: 16122 - RNA, 19 nt, Homo sapiens
cuccccauguuauguugaa

SEQ ID NO: 16123 - RNA, 16 nt, Homo sapiens
guggguggugagacca

SEQ ID NO: 16124 - RNA, 20 nt, Homo sapiens
ccucugccuccuggguucaa

SEQ ID NO: 16125 - RNA, 23 nt, Homo sapiens
ucuaaagaaucuuggguuauuuu

SEQ ID NO: 16126 - RNA, 22 nt, Homo sapiens
uggccaggcuggucuugugaac

SEQ ID NO: 16127 - RNA, 18 nt, Homo sapiens
aaaagacuuuuuuuuaaa

SEQ ID NO: 16128 - RNA, 21 nt, Homo sapiens
gaguuguagauaaaaugucau

SEQ ID NO: 16129 - RNA, 23 nt, Homo sapiens
ccccucccgccccagggcagggc

SEQ ID NO: 16130 - RNA, 21 nt, Homo sapiens
ccuccuuuccccugggcugcg

SEQ ID NO: 16131 - RNA, 23 nt, Homo sapiens
cgaggcagggccgccccuccagu

SEQ ID NO: 16132 - RNA, 17 nt, Homo sapiens
gcugcugcuuauguggu

SEQ ID NO: 16133 - RNA, 19 nt, Homo sapiens
aaacuccugaccucaggug

SEQ ID NO: 16134 - RNA, 20 nt, Homo sapiens
aaauguaauaaaauuugaga

SEQ ID NO: 16135 - RNA, 18 nt, Homo sapiens
auuaguuaaaauuccuca

SEQ ID NO: 16136 - RNA, 20 nt, Homo sapiens
ccucugccuccuggguucaa

SEQ ID NO: 16137 - RNA, 19 nt, Homo sapiens
cguuuagaaacaaaacccu

SEQ ID NO: 16138 - RNA, 18 nt, Homo sapiens
cucacacuaaacauuuua

SEQ ID NO: 16139 - RNA, 21 nt, Homo sapiens
gccgacccccaaucucuuuaa

SEQ ID NO: 16140 - RNA, 18 nt, Homo sapiens
guuuagaaacaaaacccu

SEQ ID NO: 16141 - RNA, 20 nt, Homo sapiens
ucagucugcuuauuuuccaa

SEQ ID NO: 16142 - RNA, 22 nt, Homo sapiens
cacugacucauugaaaauguua

SEQ ID NO: 16143 - RNA, 19 nt, Homo sapiens
cguguuuuauguuaaguca

SEQ ID NO: 16144 - RNA, 21 nt, Homo sapiens
aaaagguagaacuuggaugau

SEQ ID NO: 16145 - RNA, 20 nt, Homo sapiens
cauagacaacuagagcagcu

SEQ ID NO: 16146 - RNA, 20 nt, Homo sapiens
ccacagccauagacaacuag

SEQ ID NO: 16147 - RNA, 20 nt, Homo sapiens
ccauauguguauaauuaaca

SEQ ID NO: 16148 - RNA, 21 nt, Homo sapiens
caaggcccucuaggccuggca

SEQ ID NO: 16149 - RNA, 16 nt, Homo sapiens
caugugugugcggccc

SEQ ID NO: 16150 - RNA, 18 nt, Homo sapiens
uggcccagugugaugcug

SEQ ID NO: 16151 - RNA, 23 nt, Homo sapiens
aaagucucauuuuuaaaucuccc

SEQ ID NO: 16152 - RNA, 20 nt, Homo sapiens
aauaggaggacaucaaugua

SEQ ID NO: 16153 - RNA, 20 nt, Homo sapiens
aaucauaauuucaacuagau

SEQ ID NO: 16154 - RNA, 18 nt, Homo sapiens
gacccaggcuucauuaca

SEQ ID NO: 16155 - RNA, 19 nt, Homo sapiens
ggagaagggauauguugug

SEQ ID NO: 16156 - RNA, 21 nt, Homo sapiens
uaaaucucccuggcaugaggu

SEQ ID NO: 16157 - RNA, 20 nt, Homo sapiens
ucaguguuaagugcacuugu

SEQ ID NO: 16158 - RNA, 22 nt, Homo sapiens
aacuccugcaauucacggcauc

SEQ ID NO: 16159 - RNA, 16 nt, Homo sapiens
ccagagaucacugcag

SEQ ID NO: 16160 - RNA, 23 nt, Homo sapiens
cccuaccacugcgaggccugcgg

SEQ ID NO: 16161 - RNA, 17 nt, Homo sapiens
cuguccuguauguaucc

SEQ ID NO: 16162 - RNA, 22 nt, Homo sapiens
gagccaagaucgugccacugca

SEQ ID NO: 16163 - RNA, 19 nt, Homo sapiens
gcacgugugagcugggcca

SEQ ID NO: 16164 - RNA, 22 nt, Homo sapiens
gccugaacccccagccugggcu

SEQ ID NO: 16165 - RNA, 19 nt, Homo sapiens
ggaggaggaggauacgcca

SEQ ID NO: 16166 - RNA, 20 nt, Homo sapiens
uccuggcggcuucccugcgg

SEQ ID NO: 16167 - RNA, 21 nt, Homo sapiens
ugagguugcaugggcuugguu

SEQ ID NO: 16168 - RNA, 18 nt, Homo sapiens
ugaugagguaucaggugg

SEQ ID NO: 16169 - RNA, 21 nt, Homo sapiens
ugcagugagccaagaucgugc

SEQ ID NO: 16170 - RNA, 19 nt, Homo sapiens
aauuugcuaaauauuuuaa

SEQ ID NO: 16171 - RNA, 19 nt, Homo sapiens
acaccuguagacguucgcc

SEQ ID NO: 16172 - RNA, 22 nt, Homo sapiens
auacuguuucuccaaacacuua

SEQ ID NO: 16173 - RNA, 19 nt, Homo sapiens
auaugugcugucuauuaua

SEQ ID NO: 16174 - RNA, 18 nt, Homo sapiens
cagacgugccucugugua

SEQ ID NO: 16175 - RNA, 16 nt, Homo sapiens
ccagauggaucuguua

SEQ ID NO: 16176 - RNA, 23 nt, Homo sapiens
gacuggaaaggaauggaaaauau

SEQ ID NO: 16177 - RNA, 20 nt, Homo sapiens
ggcaaugucuauuucaggga

SEQ ID NO: 16178 - RNA, 17 nt, Homo sapiens
gguauagacaaccagcu

SEQ ID NO: 16179 - RNA, 19 nt, Homo sapiens
uaaggacugcacuauaguu

SEQ ID NO: 16180 - RNA, 18 nt, Homo sapiens
uggaaacucuccaguuca

SEQ ID NO: 16181 - RNA, 17 nt, Homo sapiens
uuguacuuagcaaauac

SEQ ID NO: 16182 - RNA, 20 nt, Homo sapiens
gggaagcgcggggccgcggc

SEQ ID NO: 16183 - RNA, 19 nt, Homo sapiens
uaaagauaauuaaaaauga

SEQ ID NO: 16184 - RNA, 19 nt, Homo sapiens
cccgcuaauguuuccauca

SEQ ID NO: 16185 - RNA, 18 nt, Homo sapiens
guuuccaucauguguaca

SEQ ID NO: 16186 - RNA, 17 nt, Homo sapiens
gaacaaaaaaugcccaa

SEQ ID NO: 16187 - RNA, 18 nt, Homo sapiens
accaaaaagaggcugggc

SEQ ID NO: 16188 - RNA, 23 nt, Homo sapiens
gaaaccacgugaaaccuacauug

SEQ ID NO: 16189 - RNA, 17 nt, Homo sapiens
uugcuauguucauaauu

SEQ ID NO: 16190 - RNA, 24 nt, Homo sapiens
uuguaauaaaccaagcuguacaau

SEQ ID NO: 16191 - RNA, 24 nt, Homo sapiens
uuuuaaggcuauauguaguguaug

SEQ ID NO: 16192 - RNA, 24 nt, Homo sapiens
accugggcugugggcuucuggguc

SEQ ID NO: 16193 - RNA, 19 nt, Homo sapiens
caccacacaccuuccuucu

SEQ ID NO: 16194 - RNA, 19 nt, Homo sapiens
cacuuucauuuucaauuga

SEQ ID NO: 16195 - RNA, 22 nt, Homo sapiens
ugcccagguagccccuccccag

SEQ ID NO: 16196 - RNA, 21 nt, Homo sapiens
caagcugggcugggucuaguc

SEQ ID NO: 16197 - RNA, 19 nt, Homo sapiens
cccaccauucacugugaca

SEQ ID NO: 16198 - RNA, 20 nt, Homo sapiens
cgugccugccccacugugac

SEQ ID NO: 16199 - RNA, 21 nt, Homo sapiens
aagagacuuucuucuguguca

SEQ ID NO: 16200 - RNA, 20 nt, Homo sapiens
accagagggagucacaggca

SEQ ID NO: 16201 - RNA, 20 nt, Homo sapiens
accuaggagcccaggacccc

SEQ ID NO: 16202 - RNA, 24 nt, Homo sapiens
agagagaacaaauggcugugggua

SEQ ID NO: 16203 - RNA, 21 nt, Homo sapiens
aggccgggcugggcucagcca

SEQ ID NO: 16204 - RNA, 22 nt, Homo sapiens
aucuguuaagauccagaucucu

SEQ ID NO: 16205 - RNA, 23 nt, Homo sapiens
cccuggugaaccuagcgcugugg

SEQ ID NO: 16206 - RNA, 20 nt, Homo sapiens
ccuuuucuccaugcauugcu

SEQ ID NO: 16207 - RNA, 19 nt, Homo sapiens
cuuuuccccauccucaagg

SEQ ID NO: 16208 - RNA, 18 nt, Homo sapiens
gcccacaucccacuuccu

SEQ ID NO: 16209 - RNA, 21 nt, Homo sapiens
gcccugggguaggggcuguga

SEQ ID NO: 16210 - RNA, 26 nt, Homo sapiens
gccuugcauaugguucugaccaguca

SEQ ID NO: 16211 - RNA, 17 nt, Homo sapiens
uccggccccacacagcu

SEQ ID NO: 16212 - RNA, 20 nt, Homo sapiens
uugauguguuuguuuggcuu

SEQ ID NO: 16213 - RNA, 19 nt, Homo sapiens
auuggucuggugcagcaua

SEQ ID NO: 16214 - RNA, 18 nt, Homo sapiens
uccuggggauucugggga

SEQ ID NO: 16215 - RNA, 23 nt, Homo sapiens
uccuuccuuccccuagugucugg

SEQ ID NO: 16216 - RNA, 23 nt, Homo sapiens
ugagugggaaugcguugggacug

SEQ ID NO: 16217 - RNA, 22 nt, Homo sapiens
caguguugcucccaucucuucu

SEQ ID NO: 16218 - RNA, 21 nt, Homo sapiens
ccagaucuggcuucuuuccca

SEQ ID NO: 16219 - RNA, 26 nt, Homo sapiens
ccagccucaucaccgugcucuucuca

SEQ ID NO: 16220 - RNA, 24 nt, Homo sapiens
cccuccacccacccccacgacccc

SEQ ID NO: 16221 - RNA, 20 nt, Homo sapiens
gaaaaagaggaagccauugg

SEQ ID NO: 16222 - RNA, 19 nt, Homo sapiens
gggaggagccaguuugcca

SEQ ID NO: 16223 - RNA, 18 nt, Homo sapiens
uccuucccugucaguguu

SEQ ID NO: 16224 - RNA, 22 nt, Homo sapiens
uuuugcuacaauuuguaacuua

SEQ ID NO: 16225 - RNA, 20 nt, Homo sapiens
agccaagaccagcagguccc

SEQ ID NO: 16226 - RNA, 19 nt, Homo sapiens
ccaucaccaagacuggcca

SEQ ID NO: 16227 - RNA, 20 nt, Homo sapiens
cgcgcgcccgcccgcgccgc

SEQ ID NO: 16228 - RNA, 20 nt, Homo sapiens
aaccugccugacuuccugcu

SEQ ID NO: 16229 - RNA, 21 nt, Homo sapiens
agaacauuuuucuuucccuca

SEQ ID NO: 16230 - RNA, 19 nt, Homo sapiens
agauucauacuuuacugua

SEQ ID NO: 16231 - RNA, 18 nt, Homo sapiens
cagccucagcaacaaaca

SEQ ID NO: 16232 - RNA, 21 nt, Homo sapiens
ccauuucuuuccucuauucag

SEQ ID NO: 16233 - RNA, 23 nt, Homo sapiens
cuucacaauuuuaagccacuuuu

SEQ ID NO: 16234 - RNA, 19 nt, Homo sapiens
gaaaaucagauuuuuuuua

SEQ ID NO: 16235 - RNA, 18 nt, Homo sapiens
ucucugcuaaaaauacaa

SEQ ID NO: 16236 - RNA, 24 nt, Homo sapiens
ugcauggccauguguuuguaggug

SEQ ID NO: 16237 - RNA, 20 nt, Homo sapiens
uuacagcuuugccgggaagu

SEQ ID NO: 16238 - RNA, 24 nt, Homo sapiens
gugugugugaguggagagugagug

SEQ ID NO: 16239 - RNA, 30 nt, Homo sapiens
auaguuacaggggguuuuuuuguuguuuuu

SEQ ID NO: 16240 - RNA, 25 nt, Homo sapiens
auuugaacaauguacucccuggccu

SEQ ID NO: 16241 - RNA, 20 nt, Homo sapiens
caaagauccugcgugcagug

SEQ ID NO: 16242 - RNA, 18 nt, Homo sapiens
ccacccaccuccgccucc

SEQ ID NO: 16243 - RNA, 22 nt, Homo sapiens
gcugucucaggccuuccuuaga

SEQ ID NO: 16244 - RNA, 23 nt, Homo sapiens
ucagccccagguagcagaacuca

SEQ ID NO: 16245 - RNA, 19 nt, Homo sapiens
agugugaaaaaagcaccuu

SEQ ID NO: 16246 - RNA, 26 nt, Homo sapiens
auacuucuuuaagguugcuuuugcug

SEQ ID NO: 16247 - RNA, 16 nt, Homo sapiens
gucagugcacauccua

SEQ ID NO: 16248 - RNA, 21 nt, Homo sapiens
aaaacuucuugcugaauggua

SEQ ID NO: 16249 - RNA, 19 nt, Homo sapiens
caggaaaugccuuacuuca

SEQ ID NO: 16250 - RNA, 23 nt, Homo sapiens
auguaucauacuauagucuugaa

SEQ ID NO: 16251 - RNA, 21 nt, Homo sapiens
gcaggacugaggguuuuugca

SEQ ID NO: 16252 - RNA, 22 nt, Homo sapiens
uguguagguugcaauugaacau

SEQ ID NO: 16253 - RNA, 21 nt, Homo sapiens
cccaccaggucccucccacaa

SEQ ID NO: 16254 - RNA, 19 nt, Homo sapiens
gaugcucaagcacucaaac

SEQ ID NO: 16255 - RNA, 18 nt, Homo sapiens
ugcuguucuuuagugaaa

SEQ ID NO: 16256 - RNA, 19 nt, Homo sapiens
uggguggauugcuugaaac

SEQ ID NO: 16257 - RNA, 20 nt, Homo sapiens
aaaagguaccuguacuuaug

SEQ ID NO: 16258 - RNA, 21 nt, Homo sapiens
agaucuuucugugacagguaa

SEQ ID NO: 16259 - RNA, 20 nt, Homo sapiens
uauagacagaaauaauaagc

SEQ ID NO: 16260 - RNA, 22 nt, Homo sapiens
ugcauagugauuuuugaauuug

SEQ ID NO: 16261 - RNA, 18 nt, Homo sapiens
uggguggaucaccugagg

SEQ ID NO: 16262 - RNA, 18 nt, Homo sapiens
augcaguuucagcagcaa

SEQ ID NO: 16263 - RNA, 21 nt, Homo sapiens
cacuucauucuccccgucuga

SEQ ID NO: 16264 - RNA, 19 nt, Homo sapiens
gcaguucacaucgauuucc

SEQ ID NO: 16265 - RNA, 23 nt, Homo sapiens
guuagagucguggaaaaaucccu

SEQ ID NO: 16266 - RNA, 23 nt, Homo sapiens
ucauccagcagcuccccccacca

SEQ ID NO: 16267 - RNA, 21 nt, Homo sapiens
ucugcuggacaguggacuguu

SEQ ID NO: 16268 - RNA, 20 nt, Homo sapiens
ugggaccuaacuugaaguua

SEQ ID NO: 16269 - RNA, 20 nt, Homo sapiens
acacggugcaccaaucuaca

SEQ ID NO: 16270 - RNA, 24 nt, Homo sapiens
aucuggacuugcccuugucuguuc

SEQ ID NO: 16271 - RNA, 16 nt, Homo sapiens
uggacaaccuggcugg

SEQ ID NO: 16272 - RNA, 22 nt, Homo sapiens
cccuccuuuccaacuuccuucc

SEQ ID NO: 16273 - RNA, 19 nt, Homo sapiens
ccuccucuucacccccagg

SEQ ID NO: 16274 - RNA, 18 nt, Homo sapiens
ucucugcccccucccucu

SEQ ID NO: 16275 - RNA, 18 nt, Homo sapiens
uuccugccccucucugcc

SEQ ID NO: 16276 - RNA, 21 nt, Homo sapiens
acagcugagaccuccuacuca

SEQ ID NO: 16277 - RNA, 18 nt, Homo sapiens
auuuuuaaaaauuagcca

SEQ ID NO: 16278 - RNA, 16 nt, Homo sapiens
cuuucagauaaaaugu

SEQ ID NO: 16279 - RNA, 22 nt, Homo sapiens
ggaauugaacaggcugcuugca

SEQ ID NO: 16280 - RNA, 20 nt, Homo sapiens
accucuuuuggcaugagcua

SEQ ID NO: 16281 - RNA, 21 nt, Homo sapiens
gcagggaagagaaacuuugcc

SEQ ID NO: 16282 - RNA, 20 nt, Homo sapiens
uagcucaugaagacaaucac

SEQ ID NO: 16283 - RNA, 21 nt, Homo sapiens
acucucuauuauuguguugcu

SEQ ID NO: 16284 - RNA, 18 nt, Homo sapiens
caguguuucaauccagcc

SEQ ID NO: 16285 - RNA, 21 nt, Homo sapiens
gugugugacucagcuuggcug

SEQ ID NO: 16286 - RNA, 20 nt, Homo sapiens
uaauaaaaacuugaauccaa

SEQ ID NO: 16287 - RNA, 21 nt, Homo sapiens
aucugccaagguugcuugccc

SEQ ID NO: 16288 - RNA, 22 nt, Homo sapiens
augcuccaacagccauugccua

SEQ ID NO: 16289 - RNA, 20 nt, Homo sapiens
caacccggccccucuguccc

SEQ ID NO: 16290 - RNA, 23 nt, Homo sapiens
caaggcaggagguacaccagcug

SEQ ID NO: 16291 - RNA, 23 nt, Homo sapiens
cccagccuuccaaggugaggcca

SEQ ID NO: 16292 - RNA, 20 nt, Homo sapiens
ccugcuccugaagccucugu

SEQ ID NO: 16293 - RNA, 19 nt, Homo sapiens
cuccuguucuggccugaga

SEQ ID NO: 16294 - RNA, 19 nt, Homo sapiens
cuuaaaccucucugccucu

SEQ ID NO: 16295 - RNA, 22 nt, Homo sapiens
gcaagagcugaugagguccuga

SEQ ID NO: 16296 - RNA, 18 nt, Homo sapiens
gccacaagcgcaggggua

SEQ ID NO: 16297 - RNA, 22 nt, Homo sapiens
gccccucuguccccuuggcucu

SEQ ID NO: 16298 - RNA, 21 nt, Homo sapiens
gcuucaggccccucugcuccu

SEQ ID NO: 16299 - RNA, 21 nt, Homo sapiens
gcuugaguugcccauaggccc

SEQ ID NO: 16300 - RNA, 18 nt, Homo sapiens
ggagcccccucugccaca

SEQ ID NO: 16301 - RNA, 20 nt, Homo sapiens
uccugcccucagccucugaa

SEQ ID NO: 16302 - RNA, 19 nt, Homo sapiens
uccugguccugcuccagga

SEQ ID NO: 16303 - RNA, 17 nt, Homo sapiens
uggggccaaggccuacc

SEQ ID NO: 16304 - RNA, 22 nt, Homo sapiens
aaugugggaaaguuuucagcca

SEQ ID NO: 16305 - RNA, 21 nt, Homo sapiens
accagaaauacauauuaugaa

SEQ ID NO: 16306 - RNA, 15 nt, Homo sapiens
aggugcuggaacagg

SEQ ID NO: 16307 - RNA, 19 nt, Homo sapiens
auugacagauaaugacuga

SEQ ID NO: 16308 - RNA, 19 nt, Homo sapiens
ccccagaaaacuugucucu

SEQ ID NO: 16309 - RNA, 23 nt, Homo sapiens
ccucuuuucccccuagaagaacc

SEQ ID NO: 16310 - RNA, 19 nt, Homo sapiens
cugcaaccuccgccuccca

SEQ ID NO: 16311 - RNA, 16 nt, Homo sapiens
gcugucucuucucacc

SEQ ID NO: 16312 - RNA, 18 nt, Homo sapiens
uccgccucccagguucaa

SEQ ID NO: 16313 - RNA, 16 nt, Homo sapiens
ugcaguaaguguagua

SEQ ID NO: 16314 - RNA, 21 nt, Homo sapiens
uggaaacuuguauagacagag

SEQ ID NO: 16315 - RNA, 21 nt, Homo sapiens
aagucucgagaugccagugaa

SEQ ID NO: 16316 - RNA, 21 nt, Homo sapiens
agcaacaggauucccucagua

SEQ ID NO: 16317 - RNA, 19 nt, Homo sapiens
cauaacagccccuuucuca

SEQ ID NO: 16318 - RNA, 21 nt, Homo sapiens
gccaggugcagcaggaucccu

SEQ ID NO: 16319 - RNA, 15 nt, Homo sapiens
ccagggacaaacccu

SEQ ID NO: 16320 - RNA, 16 nt, Homo sapiens
cccaccuacauuuccu

SEQ ID NO: 16321 - RNA, 23 nt, Homo sapiens
uccugaacucugggauccugcgg

SEQ ID NO: 16322 - RNA, 15 nt, Homo sapiens
ucucccucugccuuu

SEQ ID NO: 16323 - RNA, 21 nt, Homo sapiens
uuuggggucccagagccugcu

SEQ ID NO: 16324 - RNA, 18 nt, Homo sapiens
aagaaaagggaaagccau

SEQ ID NO: 16325 - RNA, 16 nt, Homo sapiens
aguugcuaagcacuua

SEQ ID NO: 16326 - RNA, 19 nt, Homo sapiens
cuuugacaggcgguuugug

SEQ ID NO: 16327 - RNA, 19 nt, Homo sapiens
ucaauucugaaccaccacc

SEQ ID NO: 16328 - RNA, 18 nt, Homo sapiens
ucacuugagcauguaaua

SEQ ID NO: 16329 - RNA, 20 nt, Homo sapiens
uggguguuuauaugaaacua

SEQ ID NO: 16330 - RNA, 21 nt, Homo sapiens
uuucuuugauguuuuaacuuu

SEQ ID NO: 16331 - RNA, 18 nt, Homo sapiens
auuuaggcuuugaugaga

SEQ ID NO: 16332 - RNA, 19 nt, Homo sapiens
ccaagcccacccuuccaca

SEQ ID NO: 16333 - RNA, 18 nt, Homo sapiens
ccagguuuuuagauccca

SEQ ID NO: 16334 - RNA, 19 nt, Homo sapiens
ccugggaacuguuuggucc

SEQ ID NO: 16335 - RNA, 21 nt, Homo sapiens
cuaucccaucgaaauucccca

SEQ ID NO: 16336 - RNA, 20 nt, Homo sapiens
gcuucccugucccuucccuc

SEQ ID NO: 16337 - RNA, 20 nt, Homo sapiens
ggaacuguucagaaaucuca

SEQ ID NO: 16338 - RNA, 20 nt, Homo sapiens
guaugugucaagaauuacuc

SEQ ID NO: 16339 - RNA, 26 nt, Homo sapiens
guuugagcuuugucauugcuugucuc

SEQ ID NO: 16340 - RNA, 21 nt, Homo sapiens
uccagugauggucccaccuuu

SEQ ID NO: 16341 - RNA, 21 nt, Homo sapiens
uucccauccucucucugugga

SEQ ID NO: 16342 - RNA, 18 nt, Homo sapiens
uucuccugccucuagccu

SEQ ID NO: 16343 - RNA, 20 nt, Homo sapiens
uuguuuguuaguuugccugg

SEQ ID NO: 16344 - RNA, 18 nt, Homo sapiens
ccugcccuccuagcucca

SEQ ID NO: 16345 - RNA, 22 nt, Homo sapiens
cuggcgaccacugcccauucca

SEQ ID NO: 16346 - RNA, 18 nt, Homo sapiens
cuugaagaacaaggcuga

SEQ ID NO: 16347 - RNA, 23 nt, Homo sapiens
gccccucccccaacaagaucucu

SEQ ID NO: 16348 - RNA, 19 nt, Homo sapiens
guccccugccccggccuca

SEQ ID NO: 16349 - RNA, 19 nt, Homo sapiens
ucugagccggaggcccuug

SEQ ID NO: 16350 - RNA, 19 nt, Homo sapiens
aagcaauucuccugccuca

SEQ ID NO: 16351 - RNA, 18 nt, Homo sapiens
accgugaccaugcugcca

SEQ ID NO: 16352 - RNA, 19 nt, Homo sapiens
ccgugggagcccugccucu

SEQ ID NO: 16353 - RNA, 19 nt, Homo sapiens
ccugaccccaacaccugca

SEQ ID NO: 16354 - RNA, 18 nt, Homo sapiens
ccugcaaccuccaccucc

SEQ ID NO: 16355 - RNA, 18 nt, Homo sapiens
cgugagccacugccccca

SEQ ID NO: 16356 - RNA, 19 nt, Homo sapiens
cugacagagaaggucuccu

SEQ ID NO: 16357 - RNA, 22 nt, Homo sapiens
cugggauuacaggcaccugcca

SEQ ID NO: 16358 - RNA, 18 nt, Homo sapiens
ggaaagggacggaaucaa

SEQ ID NO: 16359 - RNA, 18 nt, Homo sapiens
ggcugcgcccgcucccuc

SEQ ID NO: 16360 - RNA, 17 nt, Homo sapiens
ucaagugauucuccugc

SEQ ID NO: 16361 - RNA, 18 nt, Homo sapiens
uccaccucccggguucaa

SEQ ID NO: 16362 - RNA, 21 nt, Homo sapiens
uccagcuaggcccgugugguu

SEQ ID NO: 16363 - RNA, 20 nt, Homo sapiens
ucucuugggaacgcuggaga

SEQ ID NO: 16364 - RNA, 20 nt, Homo sapiens
uggccaggcuggucuugaac

SEQ ID NO: 16365 - RNA, 18 nt, Homo sapiens
uucuccugccucagccuu

SEQ ID NO: 16366 - RNA, 19 nt, Homo sapiens
uugggccccuuccccacca

SEQ ID NO: 16367 - RNA, 20 nt, Homo sapiens
aauaaaugaagccugaaaca

SEQ ID NO: 16368 - RNA, 18 nt, Homo sapiens
uguaguccugucauuuaa

SEQ ID NO: 16369 - RNA, 21 nt, Homo sapiens
uuaaaugaacuaauuacuuuu

SEQ ID NO: 16370 - RNA, 18 nt, Homo sapiens
aaugaaaagccuuccuuc

SEQ ID NO: 16371 - RNA, 16 nt, Homo sapiens
cagacuuguugcuguc

SEQ ID NO: 16372 - RNA, 30 nt, Homo sapiens
caugagcccucagaccacuugcuucccaca

SEQ ID NO: 16373 - RNA, 21 nt, Homo sapiens
cccgccuucccaucugucaga

SEQ ID NO: 16374 - RNA, 27 nt, Homo sapiens
ccuuggccgaggauggaagauuuggag

SEQ ID NO: 16375 - RNA, 19 nt, Homo sapiens
cuuggcauauguuuggucu

SEQ ID NO: 16376 - RNA, 16 nt, Homo sapiens
cuuuccucucugcgag

SEQ ID NO: 16377 - RNA, 24 nt, Homo sapiens
gcuccccucucgucuccuccccuc

SEQ ID NO: 16378 - RNA, 23 nt, Homo sapiens
uagggcauuccagcaagaggcug

SEQ ID NO: 16379 - RNA, 20 nt, Homo sapiens
uccauuugcaaacagaucuu

SEQ ID NO: 16380 - RNA, 25 nt, Homo sapiens
ucuuagaagauagaugcagcaguaa

SEQ ID NO: 16381 - RNA, 22 nt, Homo sapiens
uuccaaagcaauuucuuaacca

SEQ ID NO: 16382 - RNA, 17 nt, Homo sapiens
cucacuacugucuuccu

SEQ ID NO: 16383 - RNA, 19 nt, Homo sapiens
cucuuuucuucuuagccuu

SEQ ID NO: 16384 - RNA, 22 nt, Homo sapiens
guuaccacuccgaccggacuca

SEQ ID NO: 16385 - RNA, 18 nt, Homo sapiens
uaauuuagcuuuguguca

SEQ ID NO: 16386 - RNA, 19 nt, Homo sapiens
ucuuaccugcuuuaauuuu

SEQ ID NO: 16387 - RNA, 21 nt, Homo sapiens
acuugauucaacguuugguuc

SEQ ID NO: 16388 - RNA, 19 nt, Homo sapiens
agaagagaacaguacucuc

SEQ ID NO: 16389 - RNA, 21 nt, Homo sapiens
agaucaccauaagcgucccug

SEQ ID NO: 16390 - RNA, 23 nt, Homo sapiens
agcugggguagaggcacugccca

SEQ ID NO: 16391 - RNA, 17 nt, Homo sapiens
augugcugcucgugagc

SEQ ID NO: 16392 - RNA, 20 nt, Homo sapiens
caagggagcgauacuaaggc

SEQ ID NO: 16393 - RNA, 21 nt, Homo sapiens
gaaaaucagaggagccacuga

SEQ ID NO: 16394 - RNA, 24 nt, Homo sapiens
gauaggagacaggagaucaccaua

SEQ ID NO: 16395 - RNA, 22 nt, Homo sapiens
gcuuggaccugggugccuggcu

SEQ ID NO: 16396 - RNA, 19 nt, Homo sapiens
guggucuuaacguagacug

SEQ ID NO: 16397 - RNA, 24 nt, Homo sapiens
uggauggacuucaacuuggaguug

SEQ ID NO: 16398 - RNA, 20 nt, Homo sapiens
uggccaggcuggucuugaac

SEQ ID NO: 16399 - RNA, 18 nt, Homo sapiens
uggucuugcaguuuugaa

SEQ ID NO: 16400 - RNA, 16 nt, Homo sapiens
uuuagacacaaaccuc

SEQ ID NO: 16401 - RNA, 21 nt, Homo sapiens
uuucccaauuguuuuagccuu

SEQ ID NO: 16402 - RNA, 19 nt, Homo sapiens
accuuuuucccccccauuu

SEQ ID NO: 16403 - RNA, 20 nt, Homo sapiens
agugcuaggaaauaacucac

SEQ ID NO: 16404 - RNA, 20 nt, Homo sapiens
cagaagaaaaacuguaaucc

SEQ ID NO: 16405 - RNA, 19 nt, Homo sapiens
caggaagaauuuuuacagu

SEQ ID NO: 16406 - RNA, 20 nt, Homo sapiens
agugguuaggggauguugug

SEQ ID NO: 16407 - RNA, 19 nt, Homo sapiens
aucugugaagagucucagc

SEQ ID NO: 16408 - RNA, 17 nt, Homo sapiens
gacugacuccugcagca

SEQ ID NO: 16409 - RNA, 23 nt, Homo sapiens
gcuguuugucuccaggugucaga

SEQ ID NO: 16410 - RNA, 19 nt, Homo sapiens
ggugucauccuguuccucc

SEQ ID NO: 16411 - RNA, 23 nt, Homo sapiens
ucugugugcccugcccaucacca

SEQ ID NO: 16412 - RNA, 20 nt, Homo sapiens
agaccacauccacccaggga

SEQ ID NO: 16413 - RNA, 18 nt, Homo sapiens
agcauccacuugucugug

SEQ ID NO: 16414 - RNA, 15 nt, Homo sapiens
caagccaagcaucca

SEQ ID NO: 16415 - RNA, 18 nt, Homo sapiens
cacaaacauuugcucuua

SEQ ID NO: 16416 - RNA, 20 nt, Homo sapiens
cuccgggagcgggagcugga

SEQ ID NO: 16417 - RNA, 21 nt, Homo sapiens
cugauugguugccguggucuu

SEQ ID NO: 16418 - RNA, 18 nt, Homo sapiens
uuuuuuguggguugcuuu

SEQ ID NO: 16419 - RNA, 20 nt, Homo sapiens
agaaaaugaagcauugguca

SEQ ID NO: 16420 - RNA, 18 nt, Homo sapiens
caauuuagaaucacuuuu

SEQ ID NO: 16421 - RNA, 22 nt, Homo sapiens
ccaccaugccaauaaggcucuc

SEQ ID NO: 16422 - RNA, 18 nt, Homo sapiens
cccuaugacaacacuuug

SEQ ID NO: 16423 - RNA, 18 nt, Homo sapiens
cucucccucaugguuuca

SEQ ID NO: 16424 - RNA, 20 nt, Homo sapiens
gagaacauuccacaugccaa

SEQ ID NO: 16425 - RNA, 18 nt, Homo sapiens
gcuguauauaccugucaa

SEQ ID NO: 16426 - RNA, 20 nt, Homo sapiens
ggauggcgaggcagccgggc

SEQ ID NO: 16427 - RNA, 19 nt, Homo sapiens
aaacuccugaccucaggug

SEQ ID NO: 16428 - RNA, 22 nt, Homo sapiens
accugggcuguggcucucuguc

SEQ ID NO: 16429 - RNA, 21 nt, Homo sapiens
cauggcagcaggaugcaggga

SEQ ID NO: 16430 - RNA, 22 nt, Homo sapiens
cuugagcccucagccugugaua

SEQ ID NO: 16431 - RNA, 20 nt, Homo sapiens
gaauugcugccgucuggccu

SEQ ID NO: 16432 - RNA, 19 nt, Homo sapiens
gcaugccucaguuuccuca

SEQ ID NO: 16433 - RNA, 23 nt, Homo sapiens
uaggggccucuuggcagaggcug

SEQ ID NO: 16434 - RNA, 19 nt, Homo sapiens
ugccacuaacacugugaug

SEQ ID NO: 16435 - RNA, 19 nt, Homo sapiens
ugucaguacauuuugugcc

SEQ ID NO: 16436 - RNA, 18 nt, Homo sapiens
agagucuuauaacaccuc

SEQ ID NO: 16437 - RNA, 18 nt, Homo sapiens
aggaguucacaaugaugc

SEQ ID NO: 16438 - RNA, 20 nt, Homo sapiens
augcccagaugcugccucag

SEQ ID NO: 16439 - RNA, 17 nt, Homo sapiens
caacuuucccucccucc

SEQ ID NO: 16440 - RNA, 18 nt, Homo sapiens
cacuuucuucauagacuc

SEQ ID NO: 16441 - RNA, 19 nt, Homo sapiens
cagcccuccuaauaccuca

SEQ ID NO: 16442 - RNA, 21 nt, Homo sapiens
ccaugaggguaaaguugugug

SEQ ID NO: 16443 - RNA, 17 nt, Homo sapiens
cccacugcugcccucug

SEQ ID NO: 16444 - RNA, 21 nt, Homo sapiens
cccagaccagcagucacccca

SEQ ID NO: 16445 - RNA, 18 nt, Homo sapiens
cuccaggcacccaccugc

SEQ ID NO: 16446 - RNA, 21 nt, Homo sapiens
cucugggaaccccaccccacu

SEQ ID NO: 16447 - RNA, 18 nt, Homo sapiens
cugaaaugucuccacguc

SEQ ID NO: 16448 - RNA, 19 nt, Homo sapiens
gaaggagcucugccagugg

SEQ ID NO: 16449 - RNA, 18 nt, Homo sapiens
gcucaaccaacuccuuua

SEQ ID NO: 16450 - RNA, 20 nt, Homo sapiens
gcuccaagaaaggccaccca

SEQ ID NO: 16451 - RNA, 24 nt, Homo sapiens
gcuucccugccuccuccuaccuuu

SEQ ID NO: 16452 - RNA, 19 nt, Homo sapiens
ggcucuugggaugcagcaa

SEQ ID NO: 16453 - RNA, 19 nt, Homo sapiens
gugauacccagaccagcag

SEQ ID NO: 16454 - RNA, 20 nt, Homo sapiens
uccagcccuccuaauaccuc

SEQ ID NO: 16455 - RNA, 18 nt, Homo sapiens
ucugaaaagccacucugg

SEQ ID NO: 16456 - RNA, 15 nt, Homo sapiens
ugcagcaucuuuccu

SEQ ID NO: 16457 - RNA, 19 nt, Homo sapiens
ugcccagaugcugccucag

SEQ ID NO: 16458 - RNA, 16 nt, Homo sapiens
uggggcuugggaauuc

SEQ ID NO: 16459 - RNA, 23 nt, Homo sapiens
augcccaggcgauugcgucccag

SEQ ID NO: 16460 - RNA, 19 nt, Homo sapiens
cuuuagacuacaguuccca

SEQ ID NO: 16461 - RNA, 20 nt, Homo sapiens
guucuuuacuuuuuguuugg

SEQ ID NO: 16462 - RNA, 20 nt, Homo sapiens
aacaguaaauuauugugcuu

SEQ ID NO: 16463 - RNA, 20 nt, Homo sapiens
acagugaaaaaauuuaaagc

SEQ ID NO: 16464 - RNA, 20 nt, Homo sapiens
agggguacaucgucaacaua

SEQ ID NO: 16465 - RNA, 19 nt, Homo sapiens
caauguagaaagaauguga

SEQ ID NO: 16466 - RNA, 19 nt, Homo sapiens
caccuuccagacuacgcuc

SEQ ID NO: 16467 - RNA, 21 nt, Homo sapiens
cauuuuguaucuccgcacuca

SEQ ID NO: 16468 - RNA, 25 nt, Homo sapiens
ccacgggugcaggccuuuucccuca

SEQ ID NO: 16469 - RNA, 19 nt, Homo sapiens
cccuuccccacucccaucc

SEQ ID NO: 16470 - RNA, 19 nt, Homo sapiens
ccgcacucauccuguuaua

SEQ ID NO: 16471 - RNA, 19 nt, Homo sapiens
ccuuccccacucccauccc

SEQ ID NO: 16472 - RNA, 21 nt, Homo sapiens
gcuucucucauccuccccucu

SEQ ID NO: 16473 - RNA, 23 nt, Homo sapiens
ggaugugagaguaacguaccgua

SEQ ID NO: 16474 - RNA, 22 nt, Homo sapiens
guuuccaguugucuaacggguu

SEQ ID NO: 16475 - RNA, 24 nt, Homo sapiens
uuuuacagaauauaaacaacagua

SEQ ID NO: 16476 - RNA, 21 nt, Homo sapiens
aguggcuuugauuugggauua

SEQ ID NO: 16477 - RNA, 18 nt, Homo sapiens
uuaauuccuauuucaaua

SEQ ID NO: 16478 - RNA, 17 nt, Homo sapiens
aaaacaaaaaccccaaa

SEQ ID NO: 16479 - RNA, 19 nt, Homo sapiens
aaggagguauaaccuuucc

SEQ ID NO: 16480 - RNA, 20 nt, Homo sapiens
aaggcugggcuucaaaauca

SEQ ID NO: 16481 - RNA, 20 nt, Homo sapiens
aauuuuuaagaaaagcauca

SEQ ID NO: 16482 - RNA, 19 nt, Homo sapiens
acuugucaaggcuguuuua

SEQ ID NO: 16483 - RNA, 27 nt, Homo sapiens
caugguuuuugaggagggcuuuuguca

SEQ ID NO: 16484 - RNA, 18 nt, Homo sapiens
ccaaacuugguucucuga

SEQ ID NO: 16485 - RNA, 18 nt, Homo sapiens
ccaccuuugugguaaaca

SEQ ID NO: 16486 - RNA, 22 nt, Homo sapiens
ccuccccccaauucccccccca

SEQ ID NO: 16487 - RNA, 16 nt, Homo sapiens
cggcccgggaugcacu

SEQ ID NO: 16488 - RNA, 18 nt, Homo sapiens
cuuccaaagccagagcca

SEQ ID NO: 16489 - RNA, 19 nt, Homo sapiens
cuuuaugaaagacaucaca

SEQ ID NO: 16490 - RNA, 19 nt, Homo sapiens
cuuugugguaaacaaugaa

SEQ ID NO: 16491 - RNA, 22 nt, Homo sapiens
gcacccuugcuugccuuuuuca

SEQ ID NO: 16492 - RNA, 19 nt, Homo sapiens
gcccccuccgcccgccucc

SEQ ID NO: 16493 - RNA, 20 nt, Homo sapiens
guuaccuuccuguaacugcc

SEQ ID NO: 16494 - RNA, 17 nt, Homo sapiens
uacucaaagucuaacaa

SEQ ID NO: 16495 - RNA, 18 nt, Homo sapiens
agaauuauuugcaauuug

SEQ ID NO: 16496 - RNA, 17 nt, Homo sapiens
aucauggugauuuuauc

SEQ ID NO: 16497 - RNA, 18 nt, Homo sapiens
ccugggcagggucugugg

SEQ ID NO: 16498 - RNA, 19 nt, Homo sapiens
cucuccugaccccaucugg

SEQ ID NO: 16499 - RNA, 22 nt, Homo sapiens
gcaaccagccugagucgcggug

SEQ ID NO: 16500 - RNA, 22 nt, Homo sapiens
ugcccauggugggagcgugguc

SEQ ID NO: 16501 - RNA, 18 nt, Homo sapiens
ugugagcuguuuuuggaa

SEQ ID NO: 16502 - RNA, 19 nt, Homo sapiens
acuucucucccacuucugc

SEQ ID NO: 16503 - RNA, 17 nt, Homo sapiens
agcuucugguaaaucca

SEQ ID NO: 16504 - RNA, 18 nt, Homo sapiens
aggcagggaugcuguguu

SEQ ID NO: 16505 - RNA, 22 nt, Homo sapiens
auaagaguccccaccucuacuc

SEQ ID NO: 16506 - RNA, 18 nt, Homo sapiens
cucagauccuccuucuac

SEQ ID NO: 16507 - RNA, 18 nt, Homo sapiens
ugagcauagggggacagc

SEQ ID NO: 16508 - RNA, 24 nt, Homo sapiens
accacagaaugcccccucccugcu

SEQ ID NO: 16509 - RNA, 16 nt, Homo sapiens
gaacccucuuccugca

SEQ ID NO: 16510 - RNA, 23 nt, Homo sapiens
gcucuuggcugucaccugcccca

SEQ ID NO: 16511 - RNA, 18 nt, Homo sapiens
ggccaaccacagaaugcc

SEQ ID NO: 16512 - RNA, 20 nt, Homo sapiens
ggggcugggguccgccugcc

SEQ ID NO: 16513 - RNA, 17 nt, Homo sapiens
ucuuucuucucuuggca

SEQ ID NO: 16514 - RNA, 18 nt, Homo sapiens
uggggccuggcauggaac

SEQ ID NO: 16515 - RNA, 18 nt, Homo sapiens
cacucauuguccaugaug

SEQ ID NO: 16516 - RNA, 17 nt, Homo sapiens
ccaaauucuguucucug

SEQ ID NO: 16517 - RNA, 19 nt, Homo sapiens
gugcuguugcacagugaaa

SEQ ID NO: 16518 - RNA, 20 nt, Homo sapiens
uaccugcuagucuuguguca

SEQ ID NO: 16519 - RNA, 21 nt, Homo sapiens
uccugcuuggaagacuugggg

SEQ ID NO: 16520 - RNA, 23 nt, Homo sapiens
uuuagucaauuuuggaucgcuuu

SEQ ID NO: 16521 - RNA, 23 nt, Homo sapiens
aaugugggauuuggagucagaca

SEQ ID NO: 16522 - RNA, 24 nt, Homo sapiens
accugggcucauucuucuuggcuc

SEQ ID NO: 16523 - RNA, 21 nt, Homo sapiens
gccagaauccucucagaguca

SEQ ID NO: 16524 - RNA, 21 nt, Homo sapiens
gccagacgagguccucacagg

SEQ ID NO: 16525 - RNA, 21 nt, Homo sapiens
gcccaccccagccaccacuga

SEQ ID NO: 16526 - RNA, 20 nt, Homo sapiens
ggauucucaccguggggcug

SEQ ID NO: 16527 - RNA, 19 nt, Homo sapiens
ugaugaaggggauacgcug

SEQ ID NO: 16528 - RNA, 21 nt, Homo sapiens
ugccaucgccuccaucagcca

SEQ ID NO: 16529 - RNA, 17 nt, Homo sapiens
cacuuucccuccauuug

SEQ ID NO: 16530 - RNA, 19 nt, Homo sapiens
caugugcuaauguugcaca

SEQ ID NO: 16531 - RNA, 18 nt, Homo sapiens
ggugucacuuggcucuga

SEQ ID NO: 16532 - RNA, 21 nt, Homo sapiens
guaaauaugugaggugugcug

SEQ ID NO: 16533 - RNA, 24 nt, Homo sapiens
guaugagcugggugucacuuggcu

SEQ ID NO: 16534 - RNA, 20 nt, Homo sapiens
gucuaguuucugccucugau

SEQ ID NO: 16535 - RNA, 22 nt, Homo sapiens
ugggaccucuuauucucaaaua

SEQ ID NO: 16536 - RNA, 17 nt, Homo sapiens
uugaacaaaucacauuu

SEQ ID NO: 16537 - RNA, 21 nt, Homo sapiens
agaaaggacagaaucucuccc

SEQ ID NO: 16538 - RNA, 18 nt, Homo sapiens
agcugcucuaaaaucuca

SEQ ID NO: 16539 - RNA, 21 nt, Homo sapiens
caggaggcagcucuccccaca

SEQ ID NO: 16540 - RNA, 28 nt, Homo sapiens
caguaauguacaggauuccuuguguaga

SEQ ID NO: 16541 - RNA, 21 nt, Homo sapiens
caugcugguggccuucugaau

SEQ ID NO: 16542 - RNA, 22 nt, Homo sapiens
ccacagaguagugaaucucuca

SEQ ID NO: 16543 - RNA, 19 nt, Homo sapiens
gcugagcaugcuugugcag

SEQ ID NO: 16544 - RNA, 22 nt, Homo sapiens
ggaagaaagggaccccucucca

SEQ ID NO: 16545 - RNA, 20 nt, Homo sapiens
uacagccuggcaaaaguuaa

SEQ ID NO: 16546 - RNA, 24 nt, Homo sapiens
ucaauaauauaagaccugguguua

SEQ ID NO: 16547 - RNA, 22 nt, Homo sapiens
ugaaacgggcagagaugaugaa

SEQ ID NO: 16548 - RNA, 21 nt, Homo sapiens
uucccaccuuacuaaauuacc

SEQ ID NO: 16549 - RNA, 19 nt, Homo sapiens
augccucgcuccuuccugc

SEQ ID NO: 16550 - RNA, 18 nt, Homo sapiens
ccucccagcaucugugag

SEQ ID NO: 16551 - RNA, 18 nt, Homo sapiens
ccugccacccagccccuc

SEQ ID NO: 16552 - RNA, 20 nt, Homo sapiens
cuuugguggagaauuucuua

SEQ ID NO: 16553 - RNA, 22 nt, Homo sapiens
gcuccaccuggggggacuggga

SEQ ID NO: 16554 - RNA, 18 nt, Homo sapiens
gugagugcagcgugugug

SEQ ID NO: 16555 - RNA, 19 nt, Homo sapiens
accaaaacaaaauuaauga

SEQ ID NO: 16556 - RNA, 20 nt, Homo sapiens
ccaaucauuaagcccuguga

SEQ ID NO: 16557 - RNA, 19 nt, Homo sapiens
cuuuggcgacgggaaacuu

SEQ ID NO: 16558 - RNA, 17 nt, Homo sapiens
gaagaggaggccuggac

SEQ ID NO: 16559 - RNA, 22 nt, Homo sapiens
gacauuuaacuggaauccagga

SEQ ID NO: 16560 - RNA, 23 nt, Homo sapiens
ucuuucacauugcuuuugacuuu

SEQ ID NO: 16561 - RNA, 20 nt, Homo sapiens
uggccaggcuggucuugaac

SEQ ID NO: 16562 - RNA, 19 nt, Homo sapiens
uuugacaaaaaugagcucu

SEQ ID NO: 16563 - RNA, 17 nt, Homo sapiens
acggaaacccuaccccu

SEQ ID NO: 16564 - RNA, 19 nt, Homo sapiens
caacccagcccuugggcug

SEQ ID NO: 16565 - RNA, 19 nt, Homo sapiens
cacaaacucaccucccucu

SEQ ID NO: 16566 - RNA, 24 nt, Homo sapiens
ccuaccccuuccaugcucaucuca

SEQ ID NO: 16567 - RNA, 24 nt, Homo sapiens
gcuuggacaugcccgcuugugccc

SEQ ID NO: 16568 - RNA, 16 nt, Homo sapiens
gugacugcguaccugu

SEQ ID NO: 16569 - RNA, 17 nt, Homo sapiens
ugcuccaucggcuguga

SEQ ID NO: 16570 - RNA, 22 nt, Homo sapiens
acggccuuugucagccauggca

SEQ ID NO: 16571 - RNA, 18 nt, Homo sapiens
agacauacuguuugccua

SEQ ID NO: 16572 - RNA, 18 nt, Homo sapiens
caaccugcccucuggucc

SEQ ID NO: 16573 - RNA, 21 nt, Homo sapiens
ccucccuuccccuucccugcc

SEQ ID NO: 16574 - RNA, 20 nt, Homo sapiens
gacgcuccgaacucgaggca

SEQ ID NO: 16575 - RNA, 18 nt, Homo sapiens
gaucguccuguccaucca

SEQ ID NO: 16576 - RNA, 16 nt, Homo sapiens
ggaccagagugugaag

SEQ ID NO: 16577 - RNA, 17 nt, Homo sapiens
ggcuuggcgcggcggcc

SEQ ID NO: 16578 - RNA, 20 nt, Homo sapiens
gggcucgcauuguucccgca

SEQ ID NO: 16579 - RNA, 20 nt, Homo sapiens
gguugcuuugaagucucuuu

SEQ ID NO: 16580 - RNA, 20 nt, Homo sapiens
guggagggggcuguguugug

SEQ ID NO: 16581 - RNA, 19 nt, Homo sapiens
ucagcugcagggcacugug

SEQ ID NO: 16582 - RNA, 18 nt, Homo sapiens
uuuuauugaggccgggca

SEQ ID NO: 16583 - RNA, 25 nt, Homo sapiens
accugggccuccugacuccuggccc

SEQ ID NO: 16584 - RNA, 26 nt, Homo sapiens
aggaccuuugugcucacuuuggccca

SEQ ID NO: 16585 - RNA, 23 nt, Homo sapiens
gccuggaugugucugcuugacuu

SEQ ID NO: 16586 - RNA, 21 nt, Homo sapiens
aaguuauccauuggggagcuc

SEQ ID NO: 16587 - RNA, 19 nt, Homo sapiens
ccaaaaaggcugugagaug

SEQ ID NO: 16588 - RNA, 17 nt, Homo sapiens
cccuaccaaguuuggca

SEQ ID NO: 16589 - RNA, 22 nt, Homo sapiens
cuugagauuuuaccuagaggcu

SEQ ID NO: 16590 - RNA, 20 nt, Homo sapiens
gccaccuuuuaacuuguuug

SEQ ID NO: 16591 - RNA, 21 nt, Homo sapiens
gcguucccacuuucuuacucu

SEQ ID NO: 16592 - RNA, 19 nt, Homo sapiens
ucugcggccaagcaguguu

SEQ ID NO: 16593 - RNA, 21 nt, Homo sapiens
uggcagcuccuacugcugcuu

SEQ ID NO: 16594 - RNA, 20 nt, Homo sapiens
uuucuuuaugguugcuguuc

SEQ ID NO: 16595 - RNA, 19 nt, Homo sapiens
aacuguugaguugaucaca

SEQ ID NO: 16596 - RNA, 21 nt, Homo sapiens
aacuguugaguugaucacaua

SEQ ID NO: 16597 - RNA, 17 nt, Homo sapiens
aaucgcaccuuaucuga

SEQ ID NO: 16598 - RNA, 19 nt, Homo sapiens
accacuuacagcuuucuca

SEQ ID NO: 16599 - RNA, 21 nt, Homo sapiens
aguuuucuuucuuuccuuguc

SEQ ID NO: 16600 - RNA, 20 nt, Homo sapiens
auguuugaggaccugcaaua

SEQ ID NO: 16601 - RNA, 21 nt, Homo sapiens
ccaaagaucaaacacagcauu

SEQ ID NO: 16602 - RNA, 19 nt, Homo sapiens
cgguggaaugacguggcca

SEQ ID NO: 16603 - RNA, 15 nt, Homo sapiens
cuccuuuaucuugca

SEQ ID NO: 16604 - RNA, 22 nt, Homo sapiens
ggaacauggggaccaacaaagc

SEQ ID NO: 16605 - RNA, 19 nt, Homo sapiens
ucugagaucuggugucaga

SEQ ID NO: 16606 - RNA, 18 nt, Homo sapiens
uuggcaaaucgcaccuua

SEQ ID NO: 16607 - RNA, 23 nt, Homo sapiens
uuugauuuuucaagagacaagaa

SEQ ID NO: 16608 - RNA, 24 nt, Homo sapiens
aaaauugacccugggaugagauua

SEQ ID NO: 16609 - RNA, 18 nt, Homo sapiens
uccuguguuagcucugug

SEQ ID NO: 16610 - RNA, 20 nt, Homo sapiens
uccuguguuagcucugugaa

SEQ ID NO: 16611 - RNA, 26 nt, Homo sapiens
uuuaagaaauaauccuaauuguuuuu

SEQ ID NO: 16612 - RNA, 25 nt, Homo sapiens
agacugcuuucuaauagugaaacua

SEQ ID NO: 16613 - RNA, 24 nt, Homo sapiens
agaugacagaauugacuugccaua

SEQ ID NO: 16614 - RNA, 25 nt, Homo sapiens
agguggugcauucucauuuuccuca

SEQ ID NO: 16615 - RNA, 19 nt, Homo sapiens
augauuaccuaaccaguua

SEQ ID NO: 16616 - RNA, 19 nt, Homo sapiens
caaaaucuuuaaaguaaca

SEQ ID NO: 16617 - RNA, 17 nt, Homo sapiens
cauucuacaguguuuua

SEQ ID NO: 16618 - RNA, 21 nt, Homo sapiens
ccucucauuggaugacuauuc

SEQ ID NO: 16619 - RNA, 22 nt, Homo sapiens
cucuacaugaagauuucacuuu

SEQ ID NO: 16620 - RNA, 22 nt, Homo sapiens
gcacauuaaggagcaacuggga

SEQ ID NO: 16621 - RNA, 19 nt, Homo sapiens
uagauacauuuagaaaugu

SEQ ID NO: 16622 - RNA, 21 nt, Homo sapiens
uauacaaaccucauucuucau

SEQ ID NO: 16623 - RNA, 16 nt, Homo sapiens
uucuuuagggucuucc

SEQ ID NO: 16624 - RNA, 25 nt, Homo sapiens
agccaaggccugcugaccgcgccga

SEQ ID NO: 16625 - RNA, 20 nt, Homo sapiens
ccucacgccgccgccaccgc

SEQ ID NO: 16626 - RNA, 18 nt, Homo sapiens
ccucuucgcccucccacu

SEQ ID NO: 16627 - RNA, 18 nt, Homo sapiens
ugaccuauaaucuuugaa

SEQ ID NO: 16628 - RNA, 17 nt, Homo sapiens
ugagccuuccuaucaca

SEQ ID NO: 16629 - RNA, 17 nt, Homo sapiens
acuacuucauuuucuca

SEQ ID NO: 16630 - RNA, 19 nt, Homo sapiens
cuccaaaaacagcaggcca

SEQ ID NO: 16631 - RNA, 15 nt, Homo sapiens
ggaggaggcguugcc

SEQ ID NO: 16632 - RNA, 19 nt, Homo sapiens
uaaagauuugaaccuguaa

SEQ ID NO: 16633 - RNA, 18 nt, Homo sapiens
ucauauugaugaaaucgu

SEQ ID NO: 16634 - RNA, 23 nt, Homo sapiens
gcagaacuuguaagccuaaacug

SEQ ID NO: 16635 - RNA, 20 nt, Homo sapiens
ugcgcagcucgcugccgugc

SEQ ID NO: 16636 - RNA, 20 nt, Homo sapiens
aaguggagagaaucuggcaa

SEQ ID NO: 16637 - RNA, 21 nt, Homo sapiens
gccugagcagccggcuggucc

SEQ ID NO: 16638 - RNA, 21 nt, Homo sapiens
caauccugaucaagacaccaa

SEQ ID NO: 16639 - RNA, 18 nt, Homo sapiens
cuagaaaauuacuuuccc

SEQ ID NO: 16640 - RNA, 17 nt, Homo sapiens
acccaggagcugcaaua

SEQ ID NO: 16641 - RNA, 21 nt, Homo sapiens
acuguucagaaaugacugugu

SEQ ID NO: 16642 - RNA, 18 nt, Homo sapiens
auacauuggcagcugcua

SEQ ID NO: 16643 - RNA, 20 nt, Homo sapiens
auccaugucaccuuucccac

SEQ ID NO: 16644 - RNA, 22 nt, Homo sapiens
caggugguccccagaucucuuc

SEQ ID NO: 16645 - RNA, 18 nt, Homo sapiens
cauucagccuuugccaaa

SEQ ID NO: 16646 - RNA, 18 nt, Homo sapiens
gauuuugggaugaaacug

SEQ ID NO: 16647 - RNA, 20 nt, Homo sapiens
gcccccccaccccaaccccg

SEQ ID NO: 16648 - RNA, 19 nt, Homo sapiens
gcccgcaugcgugccugcu

SEQ ID NO: 16649 - RNA, 16 nt, Homo sapiens
ggccagaagcuccagg

SEQ ID NO: 16650 - RNA, 18 nt, Homo sapiens
gucagauuuuugcaccaa

SEQ ID NO: 16651 - RNA, 21 nt, Homo sapiens
ucacacuaguguuggucccuu

SEQ ID NO: 16652 - RNA, 19 nt, Homo sapiens
ugugggccuuuuuguuuua

SEQ ID NO: 16653 - RNA, 17 nt, Homo sapiens
uuucccuaauguaucca

SEQ ID NO: 16654 - RNA, 23 nt, Homo sapiens
cagacacacacguacgcacacug

SEQ ID NO: 16655 - RNA, 17 nt, Homo sapiens
gggggcagugauugcca

SEQ ID NO: 16656 - RNA, 22 nt, Homo sapiens
gugggcugaccaggaccucuga

SEQ ID NO: 16657 - RNA, 17 nt, Homo sapiens
caagaacaaaaccacca

SEQ ID NO: 16658 - RNA, 18 nt, Homo sapiens
cacacaugcacgcacaca

SEQ ID NO: 16659 - RNA, 19 nt, Homo sapiens
gagaauacaaaaagcaugc

SEQ ID NO: 16660 - RNA, 22 nt, Homo sapiens
gcucugaggaaccaggucccac

SEQ ID NO: 16661 - RNA, 20 nt, Homo sapiens
gcuugaaugccaccuucuga

SEQ ID NO: 16662 - RNA, 16 nt, Homo sapiens
ggaaaacagaggccac

SEQ ID NO: 16663 - RNA, 23 nt, Homo sapiens
uuuuuuguuuuuguuuuaacuuu

SEQ ID NO: 16664 - RNA, 17 nt, Homo sapiens
aaaacuauaguccuaua

SEQ ID NO: 16665 - RNA, 21 nt, Homo sapiens
agaaucucacuaucagagcca

SEQ ID NO: 16666 - RNA, 21 nt, Homo sapiens
aucugaccuguccccuggccc

SEQ ID NO: 16667 - RNA, 21 nt, Homo sapiens
cgcacccucaccccaccauca

SEQ ID NO: 16668 - RNA, 18 nt, Homo sapiens
cuuuuuacuucucagugc

SEQ ID NO: 16669 - RNA, 16 nt, Homo sapiens
uacugcuguaucaugc

SEQ ID NO: 16670 - RNA, 22 nt, Homo sapiens
ucuuuucaccugucucagucuu

SEQ ID NO: 16671 - RNA, 20 nt, Homo sapiens
uggcacuuuugauaugagac

SEQ ID NO: 16672 - RNA, 22 nt, Homo sapiens
accaccaccaccuguguaacca

SEQ ID NO: 16673 - RNA, 20 nt, Homo sapiens
caaauguagauuuuaccaga

SEQ ID NO: 16674 - RNA, 23 nt, Homo sapiens
caccuguguaaccaccaccgcca

SEQ ID NO: 16675 - RNA, 22 nt, Homo sapiens
ggaaaacagaugagcaacccac

SEQ ID NO: 16676 - RNA, 19 nt, Homo sapiens
uguguaaccaccaccgcca

SEQ ID NO: 16677 - RNA, 19 nt, Homo sapiens
aaggcuuggagcaaacuga

SEQ ID NO: 16678 - RNA, 22 nt, Homo sapiens
agccacugugcccggccuccug

SEQ ID NO: 16679 - RNA, 17 nt, Homo sapiens
auagggaacaugggcca

SEQ ID NO: 16680 - RNA, 22 nt, Homo sapiens
auccuucaguuuuagcacuggc

SEQ ID NO: 16681 - RNA, 16 nt, Homo sapiens
auucccucauguaaua

SEQ ID NO: 16682 - RNA, 22 nt, Homo sapiens
auuccgucugcuccaacacaca

SEQ ID NO: 16683 - RNA, 17 nt, Homo sapiens
ccauggaaacacuaguc

SEQ ID NO: 16684 - RNA, 21 nt, Homo sapiens
gauucaaaaccaggaucuuua

SEQ ID NO: 16685 - RNA, 23 nt, Homo sapiens
uggaagaagauaaauuacucuca

SEQ ID NO: 16686 - RNA, 18 nt, Homo sapiens
uucaagugauucuccugc

SEQ ID NO: 16687 - RNA, 23 nt, Homo sapiens
acagggaagaaacuccuccgguc

SEQ ID NO: 16688 - RNA, 22 nt, Homo sapiens
accaucgccaucaucaucacca

SEQ ID NO: 16689 - RNA, 22 nt, Homo sapiens
acggagucugcccaggacugca

SEQ ID NO: 16690 - RNA, 20 nt, Homo sapiens
caccaucaucaucuuccucc

SEQ ID NO: 16691 - RNA, 17 nt, Homo sapiens
caucaucaucaccacca

SEQ ID NO: 16692 - RNA, 21 nt, Homo sapiens
gcggagucagauguuucuggg

SEQ ID NO: 16693 - RNA, 18 nt, Homo sapiens
aacgcaauaaugaugaga

SEQ ID NO: 16694 - RNA, 20 nt, Homo sapiens
auagggcuguacaaauauag

SEQ ID NO: 16695 - RNA, 19 nt, Homo sapiens
cacuuguaggacuuccuuu

SEQ ID NO: 16696 - RNA, 15 nt, Homo sapiens
gcacaggacaacuuu

SEQ ID NO: 16697 - RNA, 18 nt, Homo sapiens
ugggaagacaucuggcaa

SEQ ID NO: 16698 - RNA, 19 nt, Homo sapiens
aacagaaguugauuuuguu

SEQ ID NO: 16699 - RNA, 15 nt, Homo sapiens
agcauggcaacauca

SEQ ID NO: 16700 - RNA, 21 nt, Homo sapiens
aguaagaugcacgcauuucca

SEQ ID NO: 16701 - RNA, 19 nt, Homo sapiens
caaggggagauggugcuaa

SEQ ID NO: 16702 - RNA, 20 nt, Homo sapiens
caggugauuaaaaagcuuua

SEQ ID NO: 16703 - RNA, 18 nt, Homo sapiens
cuacuccuugguccucca

SEQ ID NO: 16704 - RNA, 17 nt, Homo sapiens
uaaacagggcuugagca

SEQ ID NO: 16705 - RNA, 17 nt, Homo sapiens
uuccagaaaaucuucca

SEQ ID NO: 16706 - RNA, 18 nt, Homo sapiens
aauucacaaaacuuccaa

SEQ ID NO: 16707 - RNA, 18 nt, Homo sapiens
cauguggcuaguggcugc

SEQ ID NO: 16708 - RNA, 17 nt, Homo sapiens
ccaaaagaaaugucgug

SEQ ID NO: 16709 - RNA, 17 nt, Homo sapiens
cuuaguggcuucugaag

SEQ ID NO: 16710 - RNA, 19 nt, Homo sapiens
gacggggucucacuguauc

SEQ ID NO: 16711 - RNA, 20 nt, Homo sapiens
gcuugcccagugcuucuuga

SEQ ID NO: 16712 - RNA, 21 nt, Homo sapiens
uauauuggacagcaugggcca

SEQ ID NO: 16713 - RNA, 17 nt, Homo sapiens
ugcagacuaguuaaauc

SEQ ID NO: 16714 - RNA, 22 nt, Homo sapiens
uuaaaauuaaaauccaguuccu

SEQ ID NO: 16715 - RNA, 23 nt, Homo sapiens
uuagaguaauagagaauucuuca

SEQ ID NO: 16716 - RNA, 18 nt, Homo sapiens
uuauaaugcccuccaucc

SEQ ID NO: 16717 - RNA, 18 nt, Homo sapiens
cuauaccauccacccuca

SEQ ID NO: 16718 - RNA, 21 nt, Homo sapiens
caugacggagaaugcccucca

SEQ ID NO: 16719 - RNA, 22 nt, Homo sapiens
ccuaaauacuugcuuugauuuu

SEQ ID NO: 16720 - RNA, 19 nt, Homo sapiens
gaauacauuuccccucccu

SEQ ID NO: 16721 - RNA, 18 nt, Homo sapiens
gacacggccucgcagcaa

SEQ ID NO: 16722 - RNA, 21 nt, Homo sapiens
gcacggaugggggugaugcca

SEQ ID NO: 16723 - RNA, 20 nt, Homo sapiens
uacucaccaccauuuccuga

SEQ ID NO: 16724 - RNA, 19 nt, Homo sapiens
ucgugcuccccaaaucacc

SEQ ID NO: 16725 - RNA, 24 nt, Homo sapiens
ugcgaccucggccuccuggauuca

SEQ ID NO: 16726 - RNA, 21 nt, Homo sapiens
ugggauuguaggagugugcca

SEQ ID NO: 16727 - RNA, 19 nt, Homo sapiens
aagaaauugggacuuuuuu

SEQ ID NO: 16728 - RNA, 17 nt, Homo sapiens
acauaugucaacuguaa

SEQ ID NO: 16729 - RNA, 19 nt, Homo sapiens
aggauacuugggcugguca

SEQ ID NO: 16730 - RNA, 23 nt, Homo sapiens
caaaaccugaagauguccgugaa

SEQ ID NO: 16731 - RNA, 24 nt, Homo sapiens
gaccuaggcuuucaaaagauucca

SEQ ID NO: 16732 - RNA, 21 nt, Homo sapiens
gcagcuucaagagaagaauuu

SEQ ID NO: 16733 - RNA, 24 nt, Homo sapiens
guuuggaucaaauuuugcugguuc

SEQ ID NO: 16734 - RNA, 18 nt, Homo sapiens
uuuugcugguucuuugga

SEQ ID NO: 16735 - RNA, 21 nt, Homo sapiens
ccaucauagccugguccucca

SEQ ID NO: 16736 - RNA, 18 nt, Homo sapiens
ucugggauuuuucucuga

SEQ ID NO: 16737 - RNA, 22 nt, Homo sapiens
uggagaagggauggcaccaccc

SEQ ID NO: 16738 - RNA, 18 nt, Homo sapiens
uuuguguggcaguuugua

SEQ ID NO: 16739 - RNA, 20 nt, Homo sapiens
aaacagaaaaaucuaccggu

SEQ ID NO: 16740 - RNA, 23 nt, Homo sapiens
cagaaaaaaaguuacaugucgau

SEQ ID NO: 16741 - RNA, 18 nt, Homo sapiens
gccuuuuuuuucaucuca

SEQ ID NO: 16742 - RNA, 17 nt, Homo sapiens
ggaagaccugaaagcca

SEQ ID NO: 16743 - RNA, 17 nt, Homo sapiens
ggcuucuguuggcauuu

SEQ ID NO: 16744 - RNA, 19 nt, Homo sapiens
ucaccauagcacuuguaaa

SEQ ID NO: 16745 - RNA, 20 nt, Homo sapiens
accccagcccccagcucuga

SEQ ID NO: 16746 - RNA, 23 nt, Homo sapiens
agcccugggaccagcagccacca

SEQ ID NO: 16747 - RNA, 16 nt, Homo sapiens
auggcaguggagguga

SEQ ID NO: 16748 - RNA, 18 nt, Homo sapiens
auggcuaucauuugguug

SEQ ID NO: 16749 - RNA, 18 nt, Homo sapiens
caacccucacccuccucc

SEQ ID NO: 16750 - RNA, 18 nt, Homo sapiens
caccccugggcagcuuca

SEQ ID NO: 16751 - RNA, 19 nt, Homo sapiens
ccccucuucaccucccuca

SEQ ID NO: 16752 - RNA, 19 nt, Homo sapiens
cccuccagaccacugucuc

SEQ ID NO: 16753 - RNA, 23 nt, Homo sapiens
ucgccgccuuaucaagcgcuuuu

SEQ ID NO: 16754 - RNA, 17 nt, Homo sapiens
ucuaauuacuuguguga

SEQ ID NO: 16755 - RNA, 22 nt, Homo sapiens
uggaguuuauaaacuggacaac

SEQ ID NO: 16756 - RNA, 21 nt, Homo sapiens
ugugaugauggagccacgcaa

SEQ ID NO: 16757 - RNA, 18 nt, Homo sapiens
aaggaccccuugaaucca

SEQ ID NO: 16758 - RNA, 18 nt, Homo sapiens
auuugauccuuauaauca

SEQ ID NO: 16759 - RNA, 24 nt, Homo sapiens
caaacucucuucagggccgccuca

SEQ ID NO: 16760 - RNA, 19 nt, Homo sapiens
ccacccacaaagcaguacu

SEQ ID NO: 16761 - RNA, 19 nt, Homo sapiens
ccuaaacaauauccuguug

SEQ ID NO: 16762 - RNA, 21 nt, Homo sapiens
cuggccucucugauccuucca

SEQ ID NO: 16763 - RNA, 17 nt, Homo sapiens
ucuguggagguacggag

SEQ ID NO: 16764 - RNA, 19 nt, Homo sapiens
ugggaaaucaaacaucaca

SEQ ID NO: 16765 - RNA, 20 nt, Homo sapiens
uguguugacaagguauuucu

SEQ ID NO: 16766 - RNA, 18 nt, Homo sapiens
uucuauucccaggacuaa

SEQ ID NO: 16767 - RNA, 18 nt, Homo sapiens
uugcauguagcaagcuuu

SEQ ID NO: 16768 - RNA, 22 nt, Homo sapiens
aagacuaccaguauggaguuca

SEQ ID NO: 16769 - RNA, 24 nt, Homo sapiens
agcuucuaugguucauagucuuug

SEQ ID NO: 16770 - RNA, 18 nt, Homo sapiens
augcaucacaucacuuuu

SEQ ID NO: 16771 - RNA, 22 nt, Homo sapiens
ccgagggcggaggcgacacucu

SEQ ID NO: 16772 - RNA, 20 nt, Homo sapiens
ucagugggcaggguugcaca

SEQ ID NO: 16773 - RNA, 19 nt, Homo sapiens
cagcggcagcugcucggca

SEQ ID NO: 16774 - RNA, 18 nt, Homo sapiens
gggcggagcgcgcuggcc

SEQ ID NO: 16775 - RNA, 19 nt, Homo sapiens
uguucaauuuuguagggug

SEQ ID NO: 16776 - RNA, 17 nt, Homo sapiens
ccacuugaugcacaaau

SEQ ID NO: 16777 - RNA, 18 nt, Homo sapiens
uccuaaaauuuuccaaca

SEQ ID NO: 16778 - RNA, 20 nt, Homo sapiens
uguuaaaacagggucaaucc

SEQ ID NO: 16779 - RNA, 18 nt, Homo sapiens
aucugaccgcaccaaggu

SEQ ID NO: 16780 - RNA, 19 nt, Homo sapiens
gccaugcguuguuuggucu

SEQ ID NO: 16781 - RNA, 18 nt, Homo sapiens
aaaugugaaaaaaauaca

SEQ ID NO: 16782 - RNA, 24 nt, Homo sapiens
cauuuuuuuuuuucaaaaauguga

SEQ ID NO: 16783 - RNA, 22 nt, Homo sapiens
cuucucugucaggguugcuccu

SEQ ID NO: 16784 - RNA, 21 nt, Homo sapiens
ggacaaggccucugguucucc

SEQ ID NO: 16785 - RNA, 23 nt, Homo sapiens
gguugcuccuguggcuuuuuuaa

SEQ ID NO: 16786 - RNA, 24 nt, Homo sapiens
uuugaucauaucuuggauccuuuu

SEQ ID NO: 16787 - RNA, 23 nt, Homo sapiens
acgaauuauaauuaugguuuaca

SEQ ID NO: 16788 - RNA, 16 nt, Homo sapiens
agguaagaugaaacag

SEQ ID NO: 16789 - RNA, 21 nt, Homo sapiens
cgaggcuguaaugugccauga

SEQ ID NO: 16790 - RNA, 24 nt, Homo sapiens
cuauuagaaaugacucccuuucaa

SEQ ID NO: 16791 - RNA, 21 nt, Homo sapiens
gaauuauaauuaugguuuaca

SEQ ID NO: 16792 - RNA, 26 nt, Homo sapiens
gccacuuauuuuugaagaugcugagg

SEQ ID NO: 16793 - RNA, 18 nt, Homo sapiens
cccuuuggcacuauugug

SEQ ID NO: 16794 - RNA, 17 nt, Homo sapiens
cucguuuaaagcugcag

SEQ ID NO: 16795 - RNA, 18 nt, Homo sapiens
gugucagcauguuucugg

SEQ ID NO: 16796 - RNA, 24 nt, Homo sapiens
guguuucuuauuuuggccaguucu

SEQ ID NO: 16797 - RNA, 17 nt, Homo sapiens
guuuguuauuggcacug

SEQ ID NO: 16798 - RNA, 20 nt, Homo sapiens
ucugcugauacuccuuggag

SEQ ID NO: 16799 - RNA, 23 nt, Homo sapiens
cgccggccggggaagaggcgcgg

SEQ ID NO: 16800 - RNA, 20 nt, Homo sapiens
gaauuauccuauggaaugau

SEQ ID NO: 16801 - RNA, 18 nt, Homo sapiens
uucagaauaacuuuccag

SEQ ID NO: 16802 - RNA, 23 nt, Homo sapiens
cuaggagcaaagaggggggcagc

SEQ ID NO: 16803 - RNA, 18 nt, Homo sapiens
acuaaaaggagcccaucu

SEQ ID NO: 16804 - RNA, 22 nt, Homo sapiens
cccuccccauccuccucuuccc

SEQ ID NO: 16805 - RNA, 16 nt, Homo sapiens
cuccccuccucuccuc

SEQ ID NO: 16806 - RNA, 24 nt, Homo sapiens
cugcuuuacccucauaauucucaa

SEQ ID NO: 16807 - RNA, 20 nt, Homo sapiens
gaggccaucccaagccgaga

SEQ ID NO: 16808 - RNA, 17 nt, Homo sapiens
ggcgaacucaucucuac

SEQ ID NO: 16809 - RNA, 18 nt, Homo sapiens
gggcuucaggaguucuga

SEQ ID NO: 16810 - RNA, 22 nt, Homo sapiens
ucuccccacccuccccuccucu

SEQ ID NO: 16811 - RNA, 22 nt, Homo sapiens
caccucuaccaauccaucuuca

SEQ ID NO: 16812 - RNA, 23 nt, Homo sapiens
cuuacagauuccaggucccuuuu

SEQ ID NO: 16813 - RNA, 22 nt, Homo sapiens
ggacuuaguuucaucuauugua

SEQ ID NO: 16814 - RNA, 18 nt, Homo sapiens
uccgccucccggguucaa

SEQ ID NO: 16815 - RNA, 18 nt, Homo sapiens
ucuaacucucccaacaaa

SEQ ID NO: 16816 - RNA, 20 nt, Homo sapiens
aaacagacuagagaagccac

SEQ ID NO: 16817 - RNA, 23 nt, Homo sapiens
acugggcuacauggaaaaugaca

SEQ ID NO: 16818 - RNA, 18 nt, Homo sapiens
aucauaucaaauaugcca

SEQ ID NO: 16819 - RNA, 21 nt, Homo sapiens
cccaggagugauuucucuuua

SEQ ID NO: 16820 - RNA, 15 nt, Homo sapiens
gauccugaaacagug

SEQ ID NO: 16821 - RNA, 24 nt, Homo sapiens
agccucucuaguuuuaguuuacug

SEQ ID NO: 16822 - RNA, 22 nt, Homo sapiens
ccauuuucuugguauguacuca

SEQ ID NO: 16823 - RNA, 22 nt, Homo sapiens
gcacugccccuggugggauuca

SEQ ID NO: 16824 - RNA, 23 nt, Homo sapiens
ucugcuuuucugaucugugagua

SEQ ID NO: 16825 - RNA, 23 nt, Homo sapiens
uggucccuccccagcugaaguua

SEQ ID NO: 16826 - RNA, 18 nt, Homo sapiens
ugguccuaaauuuuauga

SEQ ID NO: 16827 - RNA, 18 nt, Homo sapiens
ugucaagcccuuaagcaa

SEQ ID NO: 16828 - RNA, 19 nt, Homo sapiens
gacaagcuguguugaaaua

SEQ ID NO: 16829 - RNA, 21 nt, Homo sapiens
ggaacaaacuguugaaaucca

SEQ ID NO: 16830 - RNA, 19 nt, Homo sapiens
guggaccucgugcucauca

SEQ ID NO: 16831 - RNA, 19 nt, Homo sapiens
aaccccauguccuccuccu

SEQ ID NO: 16832 - RNA, 17 nt, Homo sapiens
caaaaacauguguugua

SEQ ID NO: 16833 - RNA, 17 nt, Homo sapiens
cagaaggaagaggaucu

SEQ ID NO: 16834 - RNA, 22 nt, Homo sapiens
gacagcagcccgccccggccuc

SEQ ID NO: 16835 - RNA, 21 nt, Homo sapiens
gacuguuacugugucugugua

SEQ ID NO: 16836 - RNA, 18 nt, Homo sapiens
guggacgcugaccgcccg

SEQ ID NO: 16837 - RNA, 18 nt, Homo sapiens
gugucucgguuacacagc

SEQ ID NO: 16838 - RNA, 17 nt, Homo sapiens
uaagggaauccgggauc

SEQ ID NO: 16839 - RNA, 16 nt, Homo sapiens
aacucucccuucuccu

SEQ ID NO: 16840 - RNA, 21 nt, Homo sapiens
caccacacccggccccccuuc

SEQ ID NO: 16841 - RNA, 20 nt, Homo sapiens
ccucugccucccggguucaa

SEQ ID NO: 16842 - RNA, 22 nt, Homo sapiens
gcccccaucccacccuacccca

SEQ ID NO: 16843 - RNA, 19 nt, Homo sapiens
ggaacuuaacuuggggcua

SEQ ID NO: 16844 - RNA, 17 nt, Homo sapiens
uaccccacccuacccca

SEQ ID NO: 16845 - RNA, 21 nt, Homo sapiens
ugggguugcaggugugcacca

SEQ ID NO: 16846 - RNA, 16 nt, Homo sapiens
uuucucaagcuccuca

SEQ ID NO: 16847 - RNA, 18 nt, Homo sapiens
aacauccagaggugagac

SEQ ID NO: 16848 - RNA, 19 nt, Homo sapiens
aaguuuguaaaauuccuua

SEQ ID NO: 16849 - RNA, 21 nt, Homo sapiens
aggaaguaaugggaagggguu

SEQ ID NO: 16850 - RNA, 18 nt, Homo sapiens
cccgcaaccuccgccucc

SEQ ID NO: 16851 - RNA, 19 nt, Homo sapiens
ccuuucuucucacacgucg

SEQ ID NO: 16852 - RNA, 18 nt, Homo sapiens
uccgccucccggguucaa

SEQ ID NO: 16853 - RNA, 22 nt, Homo sapiens
agaaacagaaggacagcauuuc

SEQ ID NO: 16854 - RNA, 23 nt, Homo sapiens
ccagcugcagucucccagccucc

SEQ ID NO: 16855 - RNA, 18 nt, Homo sapiens
cgcucauugcucuucaga

SEQ ID NO: 16856 - RNA, 19 nt, Homo sapiens
cuguaggauuucaaauuac

SEQ ID NO: 16857 - RNA, 18 nt, Homo sapiens
gacugcuguaggauuuca

SEQ ID NO: 16858 - RNA, 19 nt, Homo sapiens
ugcccaucugcugucccag

SEQ ID NO: 16859 - RNA, 18 nt, Homo sapiens
ugccccaucuccaucccu

SEQ ID NO: 16860 - RNA, 18 nt, Homo sapiens
uggaguuaguguggaacu

SEQ ID NO: 16861 - RNA, 24 nt, Homo sapiens
uccugaaagauggaauuaugacga

SEQ ID NO: 16862 - RNA, 20 nt, Homo sapiens
aguggguggagaggaagcau

SEQ ID NO: 16863 - RNA, 18 nt, Homo sapiens
auuuccuuagauguuacc

SEQ ID NO: 16864 - RNA, 19 nt, Homo sapiens
caggccucccugcccccuc

SEQ ID NO: 16865 - RNA, 21 nt, Homo sapiens
ccaccgccgccaccucgcccg

SEQ ID NO: 16866 - RNA, 20 nt, Homo sapiens
cugguuugcccaccuccgau

SEQ ID NO: 16867 - RNA, 20 nt, Homo sapiens
ggucuggcugcguggagcug

SEQ ID NO: 16868 - RNA, 21 nt, Homo sapiens
ucccccuccugcgcugcgagc

SEQ ID NO: 16869 - RNA, 21 nt, Homo sapiens
cauaaauuaucuuuucuucug

SEQ ID NO: 16870 - RNA, 20 nt, Homo sapiens
cugugcugauggcuuggcuu

SEQ ID NO: 16871 - RNA, 21 nt, Homo sapiens
uucaagugauucugaaggcac

SEQ ID NO: 16872 - RNA, 23 nt, Homo sapiens
accacacaacacaccacacccca

SEQ ID NO: 16873 - RNA, 21 nt, Homo sapiens
accacaccacaccacaccaca

SEQ ID NO: 16874 - RNA, 21 nt, Homo sapiens
accacaccacaccacaccuca

SEQ ID NO: 16875 - RNA, 18 nt, Homo sapiens
acccacgcacaugcacac

SEQ ID NO: 16876 - RNA, 19 nt, Homo sapiens
caacacaccucaccucaca

SEQ ID NO: 16877 - RNA, 19 nt, Homo sapiens
ccagggccagauggagcca

SEQ ID NO: 16878 - RNA, 17 nt, Homo sapiens
cuggcccaggcccaguc

SEQ ID NO: 16879 - RNA, 18 nt, Homo sapiens
ggcugcccgccuccugga

SEQ ID NO: 16880 - RNA, 22 nt, Homo sapiens
auuauucuuuaaugggauaaua

SEQ ID NO: 16881 - RNA, 23 nt, Homo sapiens
gacaauguacagcauucuggcca

SEQ ID NO: 16882 - RNA, 18 nt, Homo sapiens
gagagaagacauauugac

SEQ ID NO: 16883 - RNA, 20 nt, Homo sapiens
ucaguauuggagaaaugcuu

SEQ ID NO: 16884 - RNA, 19 nt, Homo sapiens
cuccccauuuuguaacacu

SEQ ID NO: 16885 - RNA, 20 nt, Homo sapiens
gccucaguuuccccauuuua

SEQ ID NO: 16886 - RNA, 22 nt, Homo sapiens
ucccaguuuugagaugaagcug

SEQ ID NO: 16887 - RNA, 18 nt, Homo sapiens
uucaccuucgucaugcug

SEQ ID NO: 16888 - RNA, 23 nt, Homo sapiens
cccacggaaggacaugcugucca

SEQ ID NO: 16889 - RNA, 20 nt, Homo sapiens
ccuggcugggaguccugugg

SEQ ID NO: 16890 - RNA, 17 nt, Homo sapiens
cguguuagucugaggua

SEQ ID NO: 16891 - RNA, 19 nt, Homo sapiens
cugcaagcuccaucuccca

SEQ ID NO: 16892 - RNA, 25 nt, Homo sapiens
gaaacgcacugcagagauucugaga

SEQ ID NO: 16893 - RNA, 22 nt, Homo sapiens
gccgcggcguccucgacaaccu

SEQ ID NO: 16894 - RNA, 16 nt, Homo sapiens
gcugccguacuccagg

SEQ ID NO: 16895 - RNA, 17 nt, Homo sapiens
uauugccuuuucuagug

SEQ ID NO: 16896 - RNA, 18 nt, Homo sapiens
uccagaggcugcacccag

SEQ ID NO: 16897 - RNA, 20 nt, Homo sapiens
uccugugucuguccuccgga

SEQ ID NO: 16898 - RNA, 18 nt, Homo sapiens
uggggacaccuguuccag

SEQ ID NO: 16899 - RNA, 23 nt, Homo sapiens
aucugggcucaccucccugguuc

SEQ ID NO: 16900 - RNA, 16 nt, Homo sapiens
augcccagccuguucc

SEQ ID NO: 16901 - RNA, 20 nt, Homo sapiens
ccuuugguacaccuugcaaa

SEQ ID NO: 16902 - RNA, 23 nt, Homo sapiens
ccuuuuccugccgccuuggucuu

SEQ ID NO: 16903 - RNA, 22 nt, Homo sapiens
ucugaaaaccagacuccggggc

SEQ ID NO: 16904 - RNA, 23 nt, Homo sapiens
aguugguacagcucuguucuucc

SEQ ID NO: 16905 - RNA, 22 nt, Homo sapiens
ggaagaacuggugcccccucca

SEQ ID NO: 16906 - RNA, 18 nt, Homo sapiens
agauccuuuuaagaaugc

SEQ ID NO: 16907 - RNA, 20 nt, Homo sapiens
agcuucuggaaggccauguu

SEQ ID NO: 16908 - RNA, 21 nt, Homo sapiens
caaccagugucuucugccccu

SEQ ID NO: 16909 - RNA, 22 nt, Homo sapiens
cacuaauaggaaugccauucaa

SEQ ID NO: 16910 - RNA, 19 nt, Homo sapiens
caucagauaauacuuuucu

SEQ ID NO: 16911 - RNA, 18 nt, Homo sapiens
ccaacggaaaacaauaca

SEQ ID NO: 16912 - RNA, 23 nt, Homo sapiens
cugauccuuucaaaccaaccaaa

SEQ ID NO: 16913 - RNA, 20 nt, Homo sapiens
uaaagacuagaaacaaagaa

SEQ ID NO: 16914 - RNA, 19 nt, Homo sapiens
uaagggaaaaaacuuuuaa

SEQ ID NO: 16915 - RNA, 19 nt, Homo sapiens
ugaccuguucuauguugaa

SEQ ID NO: 16916 - RNA, 19 nt, Homo sapiens
uggauaccuacuuagugcu

SEQ ID NO: 16917 - RNA, 24 nt, Homo sapiens
uuguuggaaaacucaugcauccca

SEQ ID NO: 16918 - RNA, 16 nt, Homo sapiens
ccaggcauugcucugc

SEQ ID NO: 16919 - RNA, 21 nt, Homo sapiens
cuggggcacugaccuuugcca

SEQ ID NO: 16920 - RNA, 22 nt, Homo sapiens
ggacggccccaggcauugcucu

SEQ ID NO: 16921 - RNA, 18 nt, Homo sapiens
acugcauaacaggcacca

SEQ ID NO: 16922 - RNA, 20 nt, Homo sapiens
aucagacuaucuguauauau

SEQ ID NO: 16923 - RNA, 20 nt, Homo sapiens
ccucugccucccagguucaa

SEQ ID NO: 16924 - RNA, 19 nt, Homo sapiens
cugcaaccucugccuccca

SEQ ID NO: 16925 - RNA, 25 nt, Homo sapiens
cuuaacuaugacuagacauguuaua

SEQ ID NO: 16926 - RNA, 23 nt, Homo sapiens
gacgucaccaaacaagguugcau

SEQ ID NO: 16927 - RNA, 19 nt, Homo sapiens
ucucuccucauccuuuugc

SEQ ID NO: 16928 - RNA, 27 nt, Homo sapiens
auggguauauaccccaaaguggaauug

SEQ ID NO: 16929 - RNA, 19 nt, Homo sapiens
cuuaacuucauccucaagg

SEQ ID NO: 16930 - RNA, 20 nt, Homo sapiens
uguguuucugcauuucugga

SEQ ID NO: 16931 - RNA, 21 nt, Homo sapiens
aaaaaaggcacaaaaauaggu

SEQ ID NO: 16932 - RNA, 19 nt, Homo sapiens
accaaggauuuucaagaca

SEQ ID NO: 16933 - RNA, 21 nt, Homo sapiens
auagcuguguuccugauccca

SEQ ID NO: 16934 - RNA, 23 nt, Homo sapiens
cuccccacucccggcagcacuuu

SEQ ID NO: 16935 - RNA, 19 nt, Homo sapiens
cugagccuucguucuucag

SEQ ID NO: 16936 - RNA, 17 nt, Homo sapiens
gcagauuucuucuugau

SEQ ID NO: 16937 - RNA, 20 nt, Homo sapiens
uccccacugaagaggucugu

SEQ ID NO: 16938 - RNA, 17 nt, Homo sapiens
ugugaaugaggcccacc

SEQ ID NO: 16939 - RNA, 17 nt, Homo sapiens
cacucuuguugcgaucg

SEQ ID NO: 16940 - RNA, 18 nt, Homo sapiens
ccauccaucuucugugau

SEQ ID NO: 16941 - RNA, 18 nt, Homo sapiens
cucaugguauggaaaacc

SEQ ID NO: 16942 - RNA, 18 nt, Homo sapiens
gcccacccauggcucggu

SEQ ID NO: 16943 - RNA, 23 nt, Homo sapiens
ucuuguugcgaucgcuaaccuca

SEQ ID NO: 16944 - RNA, 21 nt, Homo sapiens
aaggauucagaaagaaccuua

SEQ ID NO: 16945 - RNA, 16 nt, Homo sapiens
accaccagcucuccuu

SEQ ID NO: 16946 - RNA, 20 nt, Homo sapiens
agucucacucuguugcccag

SEQ ID NO: 16947 - RNA, 21 nt, Homo sapiens
aucuuggcucacugcaaccuc

SEQ ID NO: 16948 - RNA, 20 nt, Homo sapiens
ccuuuugccaaaagcagucc

SEQ ID NO: 16949 - RNA, 22 nt, Homo sapiens
gauuggaaguggccagcagcaa

SEQ ID NO: 16950 - RNA, 23 nt, Homo sapiens
uagaugaauacugggauuggcuc

SEQ ID NO: 16951 - RNA, 18 nt, Homo sapiens
uccgucucccagguucaa

SEQ ID NO: 16952 - RNA, 20 nt, Homo sapiens
uuuccaccucugccuuuaag

SEQ ID NO: 16953 - RNA, 22 nt, Homo sapiens
aacaaaaugcacuaagaaacgu

SEQ ID NO: 16954 - RNA, 23 nt, Homo sapiens
acaccacaguucugaauagugau

SEQ ID NO: 16955 - RNA, 20 nt, Homo sapiens
cagcuguugugaucugugua

SEQ ID NO: 16956 - RNA, 21 nt, Homo sapiens
ccgugaccuugcaguugugua

SEQ ID NO: 16957 - RNA, 16 nt, Homo sapiens
ccuucacacacacaac

SEQ ID NO: 16958 - RNA, 22 nt, Homo sapiens
gaaugagcuugagccuuccucc

SEQ ID NO: 16959 - RNA, 15 nt, Homo sapiens
gggacgugucugcuu

SEQ ID NO: 16960 - RNA, 23 nt, Homo sapiens
uggagaggagagggcaaaggcga

SEQ ID NO: 16961 - RNA, 18 nt, Homo sapiens
ugugaagugaguggguga

SEQ ID NO: 16962 - RNA, 21 nt, Homo sapiens
ccccaacgccgccgccaccgc

SEQ ID NO: 16963 - RNA, 21 nt, Homo sapiens
ggcggggcucgcgcaaccucc

SEQ ID NO: 16964 - RNA, 20 nt, Homo sapiens
ggcuccaacagcuccuccgc

SEQ ID NO: 16965 - RNA, 22 nt, Homo sapiens
aagcuuaucaaaaguuugugga

SEQ ID NO: 16966 - RNA, 18 nt, Homo sapiens
acuuaguguguuccuuca

SEQ ID NO: 16967 - RNA, 23 nt, Homo sapiens
gacuguccccuuuagagauccca

SEQ ID NO: 16968 - RNA, 19 nt, Homo sapiens
gaggacugccccccggcgc

SEQ ID NO: 16969 - RNA, 22 nt, Homo sapiens
gcacuuuguuaaucuccagaga

SEQ ID NO: 16970 - RNA, 15 nt, Homo sapiens
gcuggcaaugugaca

SEQ ID NO: 16971 - RNA, 16 nt, Homo sapiens
uccagaaaagauucag

SEQ ID NO: 16972 - RNA, 21 nt, Homo sapiens
ugccccccggcgccugcccag

SEQ ID NO: 16973 - RNA, 23 nt, Homo sapiens
aagcacugagaaauucuuucuca

SEQ ID NO: 16974 - RNA, 18 nt, Homo sapiens
agagcuaaacaccagugc

SEQ ID NO: 16975 - RNA, 21 nt, Homo sapiens
cagaaggcacaaacccagugc

SEQ ID NO: 16976 - RNA, 18 nt, Homo sapiens
ccauggcacacucagcag

SEQ ID NO: 16977 - RNA, 19 nt, Homo sapiens
ccucuggugugcuuggcuu

SEQ ID NO: 16978 - RNA, 19 nt, Homo sapiens
cuguucugcuuguauccca

SEQ ID NO: 16979 - RNA, 18 nt, Homo sapiens
cuugaagcgcagaaggca

SEQ ID NO: 16980 - RNA, 21 nt, Homo sapiens
cuuuggggacuacauugcuga

SEQ ID NO: 16981 - RNA, 18 nt, Homo sapiens
gcuuuuauugcucccaca

SEQ ID NO: 16982 - RNA, 20 nt, Homo sapiens
gggaauacuggggucaguua

SEQ ID NO: 16983 - RNA, 23 nt, Homo sapiens
gguaccccaggaggcaugaugug

SEQ ID NO: 16984 - RNA, 20 nt, Homo sapiens
uaaccccuugucaguuguca

SEQ ID NO: 16985 - RNA, 20 nt, Homo sapiens
uauggguaaagagacaugaa

SEQ ID NO: 16986 - RNA, 25 nt, Homo sapiens
uccauggggucccgguguuguuuuu

SEQ ID NO: 16987 - RNA, 20 nt, Homo sapiens
uccuagaauuuggauaaacc

SEQ ID NO: 16988 - RNA, 21 nt, Homo sapiens
ucugcuuguaucccagugaua

SEQ ID NO: 16989 - RNA, 22 nt, Homo sapiens
ugagugggcuccgcacuggcug

SEQ ID NO: 16990 - RNA, 21 nt, Homo sapiens
uggaaguguuuaaugugaggc

SEQ ID NO: 16991 - RNA, 21 nt, Homo sapiens
uggcucauguuuccaugugcc

SEQ ID NO: 16992 - RNA, 19 nt, Homo sapiens
ggccaggauguccauucua

SEQ ID NO: 16993 - RNA, 24 nt, Homo sapiens
uauccaggcagagaagcuccugga

SEQ ID NO: 16994 - RNA, 20 nt, Homo sapiens
ugagccugagucuuuccaca

SEQ ID NO: 16995 - RNA, 19 nt, Homo sapiens
aaccuggaaucucucaucu

SEQ ID NO: 16996 - RNA, 20 nt, Homo sapiens
cuuguauuacagauguuaca

SEQ ID NO: 16997 - RNA, 21 nt, Homo sapiens
ggcuauguaagaguuagcagc

SEQ ID NO: 16998 - RNA, 18 nt, Homo sapiens
gucaguggugcuaugcug

SEQ ID NO: 16999 - RNA, 24 nt, Homo sapiens
uaaguggacuuugcuuuuggggcu

SEQ ID NO: 17000 - RNA, 20 nt, Homo sapiens
ugugcugcugcauuucugag

SEQ ID NO: 17001 - RNA, 21 nt, Homo sapiens
acuacuacugguaaaaugcag

SEQ ID NO: 17002 - RNA, 19 nt, Homo sapiens
caaaaauaaaugcgaacau

SEQ ID NO: 17003 - RNA, 17 nt, Homo sapiens
cagcacauaaggcuccc

SEQ ID NO: 17004 - RNA, 19 nt, Homo sapiens
cauauuuaagcaaacauca

SEQ ID NO: 17005 - RNA, 24 nt, Homo sapiens
caugcauucuuccggcuccucuga

SEQ ID NO: 17006 - RNA, 17 nt, Homo sapiens
ccccccaaucucuucca

SEQ ID NO: 17007 - RNA, 22 nt, Homo sapiens
gaacauguuuuaaaaagauaca

SEQ ID NO: 17008 - RNA, 21 nt, Homo sapiens
ggccacaggcagguccaguca

SEQ ID NO: 17009 - RNA, 18 nt, Homo sapiens
uugcaaaaugcacuuuuu

SEQ ID NO: 17010 - RNA, 20 nt, Homo sapiens
ccugcccuccuugcagccca

SEQ ID NO: 17011 - RNA, 18 nt, Homo sapiens
cucauuauuguguccuuu

SEQ ID NO: 17012 - RNA, 18 nt, Homo sapiens
uacuccuguaucauugcu

SEQ ID NO: 17013 - RNA, 20 nt, Homo sapiens
uguguagaucuguuuuggaa

SEQ ID NO: 17014 - RNA, 18 nt, Homo sapiens
uugagcaguuccuaaaga

SEQ ID NO: 17015 - RNA, 16 nt, Homo sapiens
aaccauguccaaaacc

SEQ ID NO: 17016 - RNA, 18 nt, Homo sapiens
ccugcaaccuccaccucc

SEQ ID NO: 17017 - RNA, 19 nt, Homo sapiens
uaugcaaagacgcuuaaac

SEQ ID NO: 17018 - RNA, 23 nt, Homo sapiens
ugcccuugccacuuccccaaaca

SEQ ID NO: 17019 - RNA, 19 nt, Homo sapiens
uuucuccccccugugacug

SEQ ID NO: 17020 - RNA, 17 nt, Homo sapiens
gaacaaauuccagccgg

SEQ ID NO: 17021 - RNA, 22 nt, Homo sapiens
aggccuagacgcaggaucuuua

SEQ ID NO: 17022 - RNA, 25 nt, Homo sapiens
gacacacccacaccguagaacauau

SEQ ID NO: 17023 - RNA, 19 nt, Homo sapiens
aagcaauucuccugccuca

SEQ ID NO: 17024 - RNA, 19 nt, Homo sapiens
acacucaucacaauuaaug

SEQ ID NO: 17025 - RNA, 21 nt, Homo sapiens
aucuuggcucucuccaaucuc

SEQ ID NO: 17026 - RNA, 19 nt, Homo sapiens
auguaucucauucuccuca

SEQ ID NO: 17027 - RNA, 20 nt, Homo sapiens
cugccugguuuuccuaccca

SEQ ID NO: 17028 - RNA, 24 nt, Homo sapiens
uccaguaacauuuuuauguacuca

SEQ ID NO: 17029 - RNA, 19 nt, Homo sapiens
uuuuacacacaccauuuua

SEQ ID NO: 17030 - RNA, 23 nt, Homo sapiens
ccucuccgcccacucuuugcuca

SEQ ID NO: 17031 - RNA, 27 nt, Homo sapiens
gccuggguuuuauucuuggccuggccc

SEQ ID NO: 17032 - RNA, 24 nt, Homo sapiens
aaucuguuguuucugccaaaggua

SEQ ID NO: 17033 - RNA, 18 nt, Homo sapiens
agacgguacauaauccua

SEQ ID NO: 17034 - RNA, 19 nt, Homo sapiens
auuaccaguuagcuuuuaa

SEQ ID NO: 17035 - RNA, 20 nt, Homo sapiens
cccagcuuagccacuguaag

SEQ ID NO: 17036 - RNA, 17 nt, Homo sapiens
gcgcaugcacgcacaca

SEQ ID NO: 17037 - RNA, 18 nt, Homo sapiens
ugcccccaacccagcuua

SEQ ID NO: 17038 - RNA, 23 nt, Homo sapiens
aaucagcacaucacuuaguucaa

SEQ ID NO: 17039 - RNA, 18 nt, Homo sapiens
uaccuucagauguucacu

SEQ ID NO: 17040 - RNA, 20 nt, Homo sapiens
accuuuuguaaaguugucau

SEQ ID NO: 17041 - RNA, 21 nt, Homo sapiens
gcagugaguaaaaaagaaaca

SEQ ID NO: 17042 - RNA, 20 nt, Homo sapiens
uucuuaauaugaacauggua

SEQ ID NO: 17043 - RNA, 18 nt, Homo sapiens
aagguagcggccuaagcu

SEQ ID NO: 17044 - RNA, 17 nt, Homo sapiens
agccgcagccaaauagc

SEQ ID NO: 17045 - RNA, 21 nt, Homo sapiens
aggaaauggaaccauuucaca

SEQ ID NO: 17046 - RNA, 21 nt, Homo sapiens
cacaccucuuuaagcugacuc

SEQ ID NO: 17047 - RNA, 18 nt, Homo sapiens
cagcacuuugggaagcca

SEQ ID NO: 17048 - RNA, 22 nt, Homo sapiens
ggccugugccacuggugccagc

SEQ ID NO: 17049 - RNA, 17 nt, Homo sapiens
ugacagagccagacucc

SEQ ID NO: 17050 - RNA, 22 nt, Homo sapiens
ugcccagggugaaucaauggaa

SEQ ID NO: 17051 - RNA, 19 nt, Homo sapiens
uuccagaugucugcuccag

SEQ ID NO: 17052 - RNA, 22 nt, Homo sapiens
cuucuaguguacccaucaucca

SEQ ID NO: 17053 - RNA, 17 nt, Homo sapiens
acaaagcccccauguca

SEQ ID NO: 17054 - RNA, 17 nt, Homo sapiens
aguauaacacuaagaaa

SEQ ID NO: 17055 - RNA, 20 nt, Homo sapiens
caugucauuuagacuaacca

SEQ ID NO: 17056 - RNA, 20 nt, Homo sapiens
gcaguuuccaugucuuuuuu

SEQ ID NO: 17057 - RNA, 20 nt, Homo sapiens
gcccccaugucauuuagacu

SEQ ID NO: 17058 - RNA, 19 nt, Homo sapiens
guuuucuuaaaucacuuuu

SEQ ID NO: 17059 - RNA, 18 nt, Homo sapiens
ucuuugccuguuuuaacu

SEQ ID NO: 17060 - RNA, 23 nt, Homo sapiens
ucuuuuuagcagcuuucagcuuu

SEQ ID NO: 17061 - RNA, 19 nt, Homo sapiens
uuuauaugccuaauguuac

SEQ ID NO: 17062 - RNA, 19 nt, Homo sapiens
aaaagauaagaugcuccca

SEQ ID NO: 17063 - RNA, 17 nt, Homo sapiens
caaaccuuuuugacuca

SEQ ID NO: 17064 - RNA, 20 nt, Homo sapiens
ccuugacuugagacuugugg

SEQ ID NO: 17065 - RNA, 22 nt, Homo sapiens
gccugaaucagaacgcuggcuu

SEQ ID NO: 17066 - RNA, 17 nt, Homo sapiens
ucaagugauucuccugc

SEQ ID NO: 17067 - RNA, 18 nt, Homo sapiens
uccaacucuuggguucaa

SEQ ID NO: 17068 - RNA, 19 nt, Homo sapiens
ugaugacuuuuauaaguuu

SEQ ID NO: 17069 - RNA, 23 nt, Homo sapiens
uggguucaagcaacccugccuca

SEQ ID NO: 17070 - RNA, 19 nt, Homo sapiens
uuucuuuauagucugaacu

SEQ ID NO: 17071 - RNA, 20 nt, Homo sapiens
aggcgcccgccaccacacca

SEQ ID NO: 17072 - RNA, 22 nt, Homo sapiens
caagauucugaagacuuaguua

SEQ ID NO: 17073 - RNA, 17 nt, Homo sapiens
ugguuucccaaccaaua

SEQ ID NO: 17074 - RNA, 20 nt, Homo sapiens
uguuagagauaauuucugaa

SEQ ID NO: 17075 - RNA, 19 nt, Homo sapiens
uuccaugauguucuuuuaa

SEQ ID NO: 17076 - RNA, 23 nt, Homo sapiens
uuuaagaaauaagguggaacucc

SEQ ID NO: 17077 - RNA, 20 nt, Homo sapiens
uauguauaccaacacugcca

SEQ ID NO: 17078 - RNA, 18 nt, Homo sapiens
ugcuuuucaucuggacaa

SEQ ID NO: 17079 - RNA, 18 nt, Homo sapiens
uuguguugucuuagcuuu

SEQ ID NO: 17080 - RNA, 18 nt, Homo sapiens
auguuacccugccacacc

SEQ ID NO: 17081 - RNA, 24 nt, Homo sapiens
caaugaugaaucacuuagugugaa

SEQ ID NO: 17082 - RNA, 17 nt, Homo sapiens
ucuuccggagucuagag

SEQ ID NO: 17083 - RNA, 23 nt, Homo sapiens
cagacccgugcccaaucuccucu

SEQ ID NO: 17084 - RNA, 18 nt, Homo sapiens
ccagccccuccacccccc

SEQ ID NO: 17085 - RNA, 16 nt, Homo sapiens
gcgaggagucccugca

SEQ ID NO: 17086 - RNA, 16 nt, Homo sapiens
uaagccccugcauuug

SEQ ID NO: 17087 - RNA, 22 nt, Homo sapiens
agggcucacaauuuggcuuuuu

SEQ ID NO: 17088 - RNA, 19 nt, Homo sapiens
aacaccaguuaacauagua

SEQ ID NO: 17089 - RNA, 24 nt, Homo sapiens
caacaacaccacgaaacaucugug

SEQ ID NO: 17090 - RNA, 19 nt, Homo sapiens
ccaagaggccaguccucca

SEQ ID NO: 17091 - RNA, 23 nt, Homo sapiens
cuccaaaauauuaaaauaaccca

SEQ ID NO: 17092 - RNA, 20 nt, Homo sapiens
uuuuauaccaauuauuaguc

SEQ ID NO: 17093 - RNA, 17 nt, Homo sapiens
aaacacugagaguaucu

SEQ ID NO: 17094 - RNA, 17 nt, Homo sapiens
aaaccucaaagucuggu

SEQ ID NO: 17095 - RNA, 22 nt, Homo sapiens
agcuauugaggcuuagcuuuau

SEQ ID NO: 17096 - RNA, 18 nt, Homo sapiens
auaaugcacaguacacua

SEQ ID NO: 17097 - RNA, 18 nt, Homo sapiens
cucaaagucugguguaga

SEQ ID NO: 17098 - RNA, 19 nt, Homo sapiens
gaagucuaauacaugauac

SEQ ID NO: 17099 - RNA, 18 nt, Homo sapiens
gcagcccuccgcccgggu

SEQ ID NO: 17100 - RNA, 17 nt, Homo sapiens
uauaggcauauaccuca

SEQ ID NO: 17101 - RNA, 24 nt, Homo sapiens
ucuuuuuauggggaaauugauuuu

SEQ ID NO: 17102 - RNA, 17 nt, Homo sapiens
ugaucucaaguccuuuu

SEQ ID NO: 17103 - RNA, 21 nt, Homo sapiens
uguaaucugaugcaugaauca

SEQ ID NO: 17104 - RNA, 21 nt, Homo sapiens
auuugaugcuguugucugucu

SEQ ID NO: 17105 - RNA, 19 nt, Homo sapiens
cacaugcacacaaauggac

SEQ ID NO: 17106 - RNA, 21 nt, Homo sapiens
cauuuagcuaucugccucuuu

SEQ ID NO: 17107 - RNA, 19 nt, Homo sapiens
gagcuggauuagcuguuga

SEQ ID NO: 17108 - RNA, 18 nt, Homo sapiens
uauuaccucgugcauugu

SEQ ID NO: 17109 - RNA, 19 nt, Homo sapiens
ucugcugauaugcauuuau

SEQ ID NO: 17110 - RNA, 19 nt, Homo sapiens
ugcuguugacugugcuauu

SEQ ID NO: 17111 - RNA, 22 nt, Homo sapiens
ugucucucucucacccuagcuu

SEQ ID NO: 17112 - RNA, 19 nt, Homo sapiens
uucaagacuucaaauacaa

SEQ ID NO: 17113 - RNA, 20 nt, Homo sapiens
uuuacaugccugauggcacc

SEQ ID NO: 17114 - RNA, 19 nt, Homo sapiens
aaacaaaggcagcagacua

SEQ ID NO: 17115 - RNA, 19 nt, Homo sapiens
aacagcagaccagccuggc

SEQ ID NO: 17116 - RNA, 21 nt, Homo sapiens
agugaauaauuucuuaccaaa

SEQ ID NO: 17117 - RNA, 22 nt, Homo sapiens
augguguugaaaaauaacuguu

SEQ ID NO: 17118 - RNA, 22 nt, Homo sapiens
auuuaguuauauuugauauuuu

SEQ ID NO: 17119 - RNA, 21 nt, Homo sapiens
cagugagaagugcaacaucca

SEQ ID NO: 17120 - RNA, 22 nt, Homo sapiens
cugugaguuucaaagggaguca

SEQ ID NO: 17121 - RNA, 20 nt, Homo sapiens
gaauacuacaguuuugucca

SEQ ID NO: 17122 - RNA, 19 nt, Homo sapiens
aggccucugcauauucuca

SEQ ID NO: 17123 - RNA, 21 nt, Homo sapiens
agguaccaucgccuccugcca

SEQ ID NO: 17124 - RNA, 19 nt, Homo sapiens
ccuccauggagaaaacagc

SEQ ID NO: 17125 - RNA, 22 nt, Homo sapiens
cgccagguaccaucgccuccug

SEQ ID NO: 17126 - RNA, 19 nt, Homo sapiens
gcaaaaugaagcccuuacc

SEQ ID NO: 17127 - RNA, 19 nt, Homo sapiens
gcagcaacaucugugagcc

SEQ ID NO: 17128 - RNA, 17 nt, Homo sapiens
gccaccccuaucccucu

SEQ ID NO: 17129 - RNA, 21 nt, Homo sapiens
gccuggaauguuuucuggcuc

SEQ ID NO: 17130 - RNA, 25 nt, Homo sapiens
guugcaaugauggcugggccaguca

SEQ ID NO: 17131 - RNA, 22 nt, Homo sapiens
uaggauuuuuaaaugcugguga

SEQ ID NO: 17132 - RNA, 17 nt, Homo sapiens
ugcagugcagccacuga

SEQ ID NO: 17133 - RNA, 16 nt, Homo sapiens
uggucagucccuugcc

SEQ ID NO: 17134 - RNA, 24 nt, Homo sapiens
auuaaaguuagaaacgacuacaga

SEQ ID NO: 17135 - RNA, 23 nt, Homo sapiens
ccucucucggcaccaguugaccu

SEQ ID NO: 17136 - RNA, 21 nt, Homo sapiens
ccuggauggguacuuuauuaa

SEQ ID NO: 17137 - RNA, 22 nt, Homo sapiens
cugcauacuuauaccuggaugg

SEQ ID NO: 17138 - RNA, 22 nt, Homo sapiens
uaauaaaaagauuaaaguguca

SEQ ID NO: 17139 - RNA, 23 nt, Homo sapiens
uauccccuuuaaaggagacauua

SEQ ID NO: 17140 - RNA, 17 nt, Homo sapiens
uguagcaccaaaauucu

SEQ ID NO: 17141 - RNA, 21 nt, Homo sapiens
uuucuuuguggcucaugcuuu

SEQ ID NO: 17142 - RNA, 19 nt, Homo sapiens
aaaaucuagaaaccaucgg

SEQ ID NO: 17143 - RNA, 19 nt, Homo sapiens
aggcaauucuccugccuca

SEQ ID NO: 17144 - RNA, 18 nt, Homo sapiens
uaauaaaagugaaauuac

SEQ ID NO: 17145 - RNA, 20 nt, Homo sapiens
ugaagccuagacauucagag

SEQ ID NO: 17146 - RNA, 21 nt, Homo sapiens
agaucuuuuaguauuauguaa

SEQ ID NO: 17147 - RNA, 16 nt, Homo sapiens
ccuuguccagaaaacc

SEQ ID NO: 17148 - RNA, 25 nt, Homo sapiens
gacugcauguuuacuuaaucagguu

SEQ ID NO: 17149 - RNA, 20 nt, Homo sapiens
uaaaacguucccacaaugca

SEQ ID NO: 17150 - RNA, 19 nt, Homo sapiens
uuguuuguuguuguggugu

SEQ ID NO: 17151 - RNA, 21 nt, Homo sapiens
uuuguuuguuuuuuucuaugu

SEQ ID NO: 17152 - RNA, 17 nt, Homo sapiens
cacaucuauuguuuccu

SEQ ID NO: 17153 - RNA, 23 nt, Homo sapiens
cagagacguggguacaaacccug

SEQ ID NO: 17154 - RNA, 23 nt, Homo sapiens
cgggcgcaggcggccccacggga

SEQ ID NO: 17155 - RNA, 19 nt, Homo sapiens
aggacccuuguccuggugg

SEQ ID NO: 17156 - RNA, 23 nt, Homo sapiens
ccuggaccacguugcccaaguca

SEQ ID NO: 17157 - RNA, 21 nt, Homo sapiens
cuccuggaccacguugcccaa

SEQ ID NO: 17158 - RNA, 17 nt, Homo sapiens
gcgcggcgggcucgcgc

SEQ ID NO: 17159 - RNA, 20 nt, Homo sapiens
ggcuucuguguuauguauuu

SEQ ID NO: 17160 - RNA, 21 nt, Homo sapiens
gggcuggaaggcggcugcggc

SEQ ID NO: 17161 - RNA, 21 nt, Homo sapiens
aaaaugcccaguaacuuuaca

SEQ ID NO: 17162 - RNA, 26 nt, Homo sapiens
aauuugugaucaguagucucucugga

SEQ ID NO: 17163 - RNA, 18 nt, Homo sapiens
auuaagaaaaugcccagu

SEQ ID NO: 17164 - RNA, 19 nt, Homo sapiens
cacucgacaucccauucgg

SEQ ID NO: 17165 - RNA, 19 nt, Homo sapiens
gaauucacacguagacgac

SEQ ID NO: 17166 - RNA, 17 nt, Homo sapiens
gaccccgauuaucacag

SEQ ID NO: 17167 - RNA, 19 nt, Homo sapiens
ggagcccuaauaaauuuca

SEQ ID NO: 17168 - RNA, 18 nt, Homo sapiens
uucguugugccuuugaaa

SEQ ID NO: 17169 - RNA, 22 nt, Homo sapiens
uuuauccauacuuagcaaccaa

SEQ ID NO: 17170 - RNA, 21 nt, Homo sapiens
aagugaaaugaaucugucauu

SEQ ID NO: 17171 - RNA, 22 nt, Homo sapiens
agucucacucuguuacccaggc

SEQ ID NO: 17172 - RNA, 23 nt, Homo sapiens
agugguuuucuuacauaggacuc

SEQ ID NO: 17173 - RNA, 21 nt, Homo sapiens
cuuuuuccccuccuuaauuuu

SEQ ID NO: 17174 - RNA, 22 nt, Homo sapiens
aagaugcagucucugcugauca

SEQ ID NO: 17175 - RNA, 19 nt, Homo sapiens
aagugacaacuuagggagc

SEQ ID NO: 17176 - RNA, 22 nt, Homo sapiens
aguaagauucuccuguauuuca

SEQ ID NO: 17177 - RNA, 20 nt, Homo sapiens
agugaauggggacacucgug

SEQ ID NO: 17178 - RNA, 17 nt, Homo sapiens
caacagcaucaucugca

SEQ ID NO: 17179 - RNA, 20 nt, Homo sapiens
ccacucuauuuuuuuagguu

SEQ ID NO: 17180 - RNA, 22 nt, Homo sapiens
cucuccugugagauuucacuuu

SEQ ID NO: 17181 - RNA, 18 nt, Homo sapiens
gaggagugcauggcgaga

SEQ ID NO: 17182 - RNA, 19 nt, Homo sapiens
gccaggcggccgcuuggcc

SEQ ID NO: 17183 - RNA, 20 nt, Homo sapiens
gcgucugcacugaugaccgu

SEQ ID NO: 17184 - RNA, 23 nt, Homo sapiens
gcguuccuggacaaacagccuca

SEQ ID NO: 17185 - RNA, 18 nt, Homo sapiens
gguccuacugcugugagc

SEQ ID NO: 17186 - RNA, 17 nt, Homo sapiens
ucgacuucauuuugcca

SEQ ID NO: 17187 - RNA, 19 nt, Homo sapiens
ucugcaccuaaacccauac

SEQ ID NO: 17188 - RNA, 21 nt, Homo sapiens
ugaccgucugagcccagcuca

SEQ ID NO: 17189 - RNA, 20 nt, Homo sapiens
ugccccguugccuaucacag

SEQ ID NO: 17190 - RNA, 19 nt, Homo sapiens
ugucccgcgggcgaguucu

SEQ ID NO: 17191 - RNA, 23 nt, Homo sapiens
aacucguuaucuaaagcaucaga

SEQ ID NO: 17192 - RNA, 22 nt, Homo sapiens
aggucaccaucagugaacgcaa

SEQ ID NO: 17193 - RNA, 20 nt, Homo sapiens
auuugggagacagucacguc

SEQ ID NO: 17194 - RNA, 21 nt, Homo sapiens
cacccuccuccaccucccaaa

SEQ ID NO: 17195 - RNA, 18 nt, Homo sapiens
ccacccuccuccaccucc

SEQ ID NO: 17196 - RNA, 20 nt, Homo sapiens
ccucugccucccagguucaa

SEQ ID NO: 17197 - RNA, 21 nt, Homo sapiens
gucauugguuugauuuuugga

SEQ ID NO: 17198 - RNA, 18 nt, Homo sapiens
ugugcagauauuuaugaa

SEQ ID NO: 17199 - RNA, 18 nt, Homo sapiens
gccagggagggaacccug

SEQ ID NO: 17200 - RNA, 21 nt, Homo sapiens
aaggaauaagaaguuaccuac

SEQ ID NO: 17201 - RNA, 22 nt, Homo sapiens
ccuccccuggcuuuuccuacca

SEQ ID NO: 17202 - RNA, 17 nt, Homo sapiens
cacugugucaaguuaca

SEQ ID NO: 17203 - RNA, 18 nt, Homo sapiens
caucagaauucauaauca

SEQ ID NO: 17204 - RNA, 21 nt, Homo sapiens
cuuaaaauuguauaaggcuga

SEQ ID NO: 17205 - RNA, 22 nt, Homo sapiens
ugcauuagagcacuuugcaauu

SEQ ID NO: 17206 - RNA, 21 nt, Homo sapiens
cuacacucuaguaaacauuuu

SEQ ID NO: 17207 - RNA, 20 nt, Homo sapiens
gaaaugcagcgcagauccuu

SEQ ID NO: 17208 - RNA, 23 nt, Homo sapiens
gccugagccaccgcgcccggccc

SEQ ID NO: 17209 - RNA, 18 nt, Homo sapiens
guauaucaccauugggua

SEQ ID NO: 17210 - RNA, 20 nt, Homo sapiens
uggccaggcuggucuugaac

SEQ ID NO: 17211 - RNA, 25 nt, Homo sapiens
uuucauuauuuugcacuggauccac

SEQ ID NO: 17212 - RNA, 24 nt, Homo sapiens
agaaauauaucccuugcucccuuu

SEQ ID NO: 17213 - RNA, 16 nt, Homo sapiens
cacugcuaguguacag

SEQ ID NO: 17214 - RNA, 16 nt, Homo sapiens
ucuuugugacacuuca

SEQ ID NO: 17215 - RNA, 26 nt, Homo sapiens
uuuuuuuauaguuguaguuuugauuu

SEQ ID NO: 17216 - RNA, 21 nt, Homo sapiens
acccaaaggccuuucaucuca

SEQ ID NO: 17217 - RNA, 19 nt, Homo sapiens
aucuacucuuauacugaca

SEQ ID NO: 17218 - RNA, 21 nt, Homo sapiens
auuggaaggaaauacuacuca

SEQ ID NO: 17219 - RNA, 19 nt, Homo sapiens
cacuuucacuuuacacuug

SEQ ID NO: 17220 - RNA, 19 nt, Homo sapiens
ggaugcuggcaucugugua

SEQ ID NO: 17221 - RNA, 19 nt, Homo sapiens
ucagccauuuacucuccca

SEQ ID NO: 17222 - RNA, 21 nt, Homo sapiens
uuucuguuucccauaucucac

SEQ ID NO: 17223 - RNA, 23 nt, Homo sapiens
aagaauaaagacucgaggcuucu

SEQ ID NO: 17224 - RNA, 19 nt, Homo sapiens
aagugccaggaacaaugaa

SEQ ID NO: 17225 - RNA, 17 nt, Homo sapiens
uggccugugugaagcug

SEQ ID NO: 17226 - RNA, 23 nt, Homo sapiens
ccaaacagaugcagaagaaccca

SEQ ID NO: 17227 - RNA, 22 nt, Homo sapiens
uacaguggggguaaaagucaca

SEQ ID NO: 17228 - RNA, 18 nt, Homo sapiens
guucccagaaacccagug

SEQ ID NO: 17229 - RNA, 18 nt, Homo sapiens
gguaaauacuuggaccau

SEQ ID NO: 17230 - RNA, 16 nt, Homo sapiens
uaccacucugauuaua

SEQ ID NO: 17231 - RNA, 19 nt, Homo sapiens
uauaaauacguuugccuca

SEQ ID NO: 17232 - RNA, 18 nt, Homo sapiens
cagcugggguucuaggga

SEQ ID NO: 17233 - RNA, 23 nt, Homo sapiens
agaacacaccuguggcuaucuua

SEQ ID NO: 17234 - RNA, 22 nt, Homo sapiens
aggagggggaagcagcaggaca

SEQ ID NO: 17235 - RNA, 20 nt, Homo sapiens
gccuuggggccuuaccuacc

SEQ ID NO: 17236 - RNA, 21 nt, Homo sapiens
gggaacagugcuggcuguggc

SEQ ID NO: 17237 - RNA, 21 nt, Homo sapiens
ugggguuguggugacuccagu

SEQ ID NO: 17238 - RNA, 21 nt, Homo sapiens
aaaagauauagcaaaugaaga

SEQ ID NO: 17239 - RNA, 19 nt, Homo sapiens
aggguuuuacuuccuuguu

SEQ ID NO: 17240 - RNA, 19 nt, Homo sapiens
guucucaaaauauuaacuc

SEQ ID NO: 17241 - RNA, 21 nt, Homo sapiens
ugaguggauuuuauauaggau

SEQ ID NO: 17242 - RNA, 19 nt, Homo sapiens
acaaucaccgugcugcagc

SEQ ID NO: 17243 - RNA, 21 nt, Homo sapiens
ccaaaagaaaaaaaaaucuca

SEQ ID NO: 17244 - RNA, 25 nt, Homo sapiens
ccucccccacagccucuuuucucca

SEQ ID NO: 17245 - RNA, 22 nt, Homo sapiens
ccucucccuucccucugucuca

SEQ ID NO: 17246 - RNA, 21 nt, Homo sapiens
cgcccucaaugcuggcugcug

SEQ ID NO: 17247 - RNA, 18 nt, Homo sapiens
ggaagcugaaaccucuga

SEQ ID NO: 17248 - RNA, 18 nt, Homo sapiens
ucccugcccagucaugca

SEQ ID NO: 17249 - RNA, 24 nt, Homo sapiens
cuuuccccaaaauuuccacagaaa

SEQ ID NO: 17250 - RNA, 24 nt, Homo sapiens
aaacuucaguucuauuucuauaga

SEQ ID NO: 17251 - RNA, 17 nt, Homo sapiens
acguaaucccgucugaa

SEQ ID NO: 17252 - RNA, 21 nt, Homo sapiens
ucacaugaaaaguuaucagau

SEQ ID NO: 17253 - RNA, 21 nt, Homo sapiens
cagugacuccaaguggaacua

SEQ ID NO: 17254 - RNA, 23 nt, Homo sapiens
cuuuuucaguuaguccuaacuuu

SEQ ID NO: 17255 - RNA, 23 nt, Homo sapiens
uuuagauaccugagugcacuuuu

SEQ ID NO: 17256 - RNA, 19 nt, Homo sapiens
cccgccccucccgccgcca

SEQ ID NO: 17257 - RNA, 18 nt, Homo sapiens
gcucggaacccaccccag

SEQ ID NO: 17258 - RNA, 21 nt, Homo sapiens
ucccgggcccgcgcgcuccca

SEQ ID NO: 17259 - RNA, 19 nt, Homo sapiens
agucuccccaaaucaguga

SEQ ID NO: 17260 - RNA, 23 nt, Homo sapiens
gcgagauugaagggcuuuuguua

SEQ ID NO: 17261 - RNA, 19 nt, Homo sapiens
gggaaauacuaggaacuaa

SEQ ID NO: 17262 - RNA, 19 nt, Homo sapiens
aagcaauucuccugccuca

SEQ ID NO: 17263 - RNA, 17 nt, Homo sapiens
cuaacuguugugugauu

SEQ ID NO: 17264 - RNA, 25 nt, Homo sapiens
gcugcaagcaguuuauauaaagaua

SEQ ID NO: 17265 - RNA, 15 nt, Homo sapiens
guuaccuuucugugc

SEQ ID NO: 17266 - RNA, 18 nt, Homo sapiens
uccgccucccggguucaa

SEQ ID NO: 17267 - RNA, 18 nt, Homo sapiens
uugggcauugcuuggcuc

SEQ ID NO: 17268 - RNA, 21 nt, Homo sapiens
uuuugcugcaagcaguuuaua

SEQ ID NO: 17269 - RNA, 19 nt, Homo sapiens
acuagaagaaccucaguga

SEQ ID NO: 17270 - RNA, 21 nt, Homo sapiens
ccaggcacagagcugccugcu

SEQ ID NO: 17271 - RNA, 28 nt, Homo sapiens
ccuugggagcagugggggugucugugga

SEQ ID NO: 17272 - RNA, 25 nt, Homo sapiens
ggccgggcaugguggcucaugccua

SEQ ID NO: 17273 - RNA, 18 nt, Homo sapiens
gggggcuggugauuccca

SEQ ID NO: 17274 - RNA, 18 nt, Homo sapiens
uggguggaucacuugagg

SEQ ID NO: 17275 - RNA, 19 nt, Homo sapiens
agcuaaacaacagaugcca

SEQ ID NO: 17276 - RNA, 22 nt, Homo sapiens
ccuguuuuguuuuggauuauuu

SEQ ID NO: 17277 - RNA, 17 nt, Homo sapiens
guccuuuucaguauuua

SEQ ID NO: 17278 - RNA, 23 nt, Homo sapiens
gucgacuuauuuuauacauagca

SEQ ID NO: 17279 - RNA, 20 nt, Homo sapiens
ccgcgcgccgccgccacugc

SEQ ID NO: 17280 - RNA, 19 nt, Homo sapiens
ccugacaaacuuccaucaa

SEQ ID NO: 17281 - RNA, 19 nt, Homo sapiens
cgcgcgccgccgccacugc

SEQ ID NO: 17282 - RNA, 17 nt, Homo sapiens
agaaaauucaucugugc

SEQ ID NO: 17283 - RNA, 19 nt, Homo sapiens
cgcggaggugcggcgggga

SEQ ID NO: 17284 - RNA, 23 nt, Homo sapiens
uaaccagagcuuagcaaauggga

SEQ ID NO: 17285 - RNA, 25 nt, Homo sapiens
ucuaaaguaacuggcccagucucca

SEQ ID NO: 17286 - RNA, 21 nt, Homo sapiens
ucucuucgcuggcuuaacuuu

SEQ ID NO: 17287 - RNA, 17 nt, Homo sapiens
uuaugauuguuacugca

SEQ ID NO: 17288 - RNA, 19 nt, Homo sapiens
accuaacagggacuuccca

SEQ ID NO: 17289 - RNA, 18 nt, Homo sapiens
aggcccuucuguagccuc

SEQ ID NO: 17290 - RNA, 19 nt, Homo sapiens
auccugguuucccagaucu

SEQ ID NO: 17291 - RNA, 20 nt, Homo sapiens
caccucccagagacggccac

SEQ ID NO: 17292 - RNA, 23 nt, Homo sapiens
cccuggcccugagacucugugag

SEQ ID NO: 17293 - RNA, 21 nt, Homo sapiens
cccuggguggagauuuccgaa

SEQ ID NO: 17294 - RNA, 22 nt, Homo sapiens
ccgaaaaguagucuucucugag

SEQ ID NO: 17295 - RNA, 18 nt, Homo sapiens
ccugcugagcugcagcca

SEQ ID NO: 17296 - RNA, 18 nt, Homo sapiens
cucugugagggggcugga

SEQ ID NO: 17297 - RNA, 23 nt, Homo sapiens
acaaaccuagaugguauacccua

SEQ ID NO: 17298 - RNA, 20 nt, Homo sapiens
caaaucaacaugacuguguu

SEQ ID NO: 17299 - RNA, 24 nt, Homo sapiens
cugacuacuucccuugcuaaucac

SEQ ID NO: 17300 - RNA, 19 nt, Homo sapiens
cuugaguagucuuuggucc

SEQ ID NO: 17301 - RNA, 22 nt, Homo sapiens
gagccaagaucgcgccacugca

SEQ ID NO: 17302 - RNA, 20 nt, Homo sapiens
uaagauauaaaaugguacac

SEQ ID NO: 17303 - RNA, 19 nt, Homo sapiens
uccaaagauaguauuucca

SEQ ID NO: 17304 - RNA, 21 nt, Homo sapiens
ugaaagaacacuucuaagccu

SEQ ID NO: 17305 - RNA, 17 nt, Homo sapiens
ugacugccagcagugga

SEQ ID NO: 17306 - RNA, 22 nt, Homo sapiens
gcucccacugcccccugagaug

SEQ ID NO: 17307 - RNA, 21 nt, Homo sapiens
ggagacagcaugcuggcugug

SEQ ID NO: 17308 - RNA, 20 nt, Homo sapiens
ggcccaaaccugagauucca

SEQ ID NO: 17309 - RNA, 20 nt, Homo sapiens
ucuguuucauugacucuuuu

SEQ ID NO: 17310 - RNA, 20 nt, Homo sapiens
ccuccuucccccuuugacuu

SEQ ID NO: 17311 - RNA, 19 nt, Homo sapiens
ccugagcaggggcuugggg

SEQ ID NO: 17312 - RNA, 21 nt, Homo sapiens
gcaggcacuguguuuuccuca

SEQ ID NO: 17313 - RNA, 20 nt, Homo sapiens
gccugaggagcugccugccu

SEQ ID NO: 17314 - RNA, 19 nt, Homo sapiens
gccuucggaggcucaggga

SEQ ID NO: 17315 - RNA, 20 nt, Homo sapiens
acccugcuuguuucugcagc

SEQ ID NO: 17316 - RNA, 18 nt, Homo sapiens
acugucaguggagauacu

SEQ ID NO: 17317 - RNA, 19 nt, Homo sapiens
ccaaugaaaacggccgccu

SEQ ID NO: 17318 - RNA, 20 nt, Homo sapiens
cggagagaacaaagcccauu

SEQ ID NO: 17319 - RNA, 18 nt, Homo sapiens
uccugaccucaugaucca

SEQ ID NO: 17320 - RNA, 21 nt, Homo sapiens
uguauuugcugaaagagagca

SEQ ID NO: 17321 - RNA, 22 nt, Homo sapiens
uuuaagugaugacaaguuccaa

SEQ ID NO: 17322 - RNA, 18 nt, Homo sapiens
uuuguauguuaggacuuu

SEQ ID NO: 17323 - RNA, 20 nt, Homo sapiens
auggugaaaccccaucgcua

SEQ ID NO: 17324 - RNA, 21 nt, Homo sapiens
cagggucgugggaagcuuggu

SEQ ID NO: 17325 - RNA, 19 nt, Homo sapiens
cauaucccuucuguauccu

SEQ ID NO: 17326 - RNA, 17 nt, Homo sapiens
ccccaacauuccuauag

SEQ ID NO: 17327 - RNA, 21 nt, Homo sapiens
gaguuagccuugcauaucccu

SEQ ID NO: 17328 - RNA, 19 nt, Homo sapiens
ggacugcucaaucacuauu

SEQ ID NO: 17329 - RNA, 22 nt, Homo sapiens
uucugcucacacaauugcacuc

SEQ ID NO: 17330 - RNA, 21 nt, Homo sapiens
gcaacuuuuuuugccuuggug

SEQ ID NO: 17331 - RNA, 21 nt, Homo sapiens
ggaaaggacaagaaaaaacua

SEQ ID NO: 17332 - RNA, 21 nt, Homo sapiens
guaaccuaugauaacauaaua

SEQ ID NO: 17333 - RNA, 25 nt, Homo sapiens
gugugugugagugugugugugucug

SEQ ID NO: 17334 - RNA, 19 nt, Homo sapiens
uagguaaccuaugauaaca

SEQ ID NO: 17335 - RNA, 23 nt, Homo sapiens
ugauaacauaauaauguggacgc

SEQ ID NO: 17336 - RNA, 18 nt, Homo sapiens
auguaaugagauaccuuu

SEQ ID NO: 17337 - RNA, 23 nt, Homo sapiens
ccgccgccacccagagugugguc

SEQ ID NO: 17338 - RNA, 26 nt, Homo sapiens
cuaacgcucacugucagugcccaugu

SEQ ID NO: 17339 - RNA, 22 nt, Homo sapiens
gcagcuccagcccaucuugcug

SEQ ID NO: 17340 - RNA, 22 nt, Homo sapiens
guuuuaaucacucuugccauua

SEQ ID NO: 17341 - RNA, 19 nt, Homo sapiens
ugaguauuuccaggacaac

SEQ ID NO: 17342 - RNA, 18 nt, Homo sapiens
ccccaccccgccugccgc

SEQ ID NO: 17343 - RNA, 19 nt, Homo sapiens
cccgccgccugcugcccgg

SEQ ID NO: 17344 - RNA, 15 nt, Homo sapiens
acuaauauuaccucc

SEQ ID NO: 17345 - RNA, 20 nt, Homo sapiens
auauaauuuaucauuuguac

SEQ ID NO: 17346 - RNA, 19 nt, Homo sapiens
ccugauccaccuaccugcu

SEQ ID NO: 17347 - RNA, 18 nt, Homo sapiens
cgcauguugcaccugugc

SEQ ID NO: 17348 - RNA, 20 nt, Homo sapiens
gacagcccccugccccaucu

SEQ ID NO: 17349 - RNA, 17 nt, Homo sapiens
guuuuaacucuaagaaa

SEQ ID NO: 17350 - RNA, 21 nt, Homo sapiens
uauaccaacauccugaaaguu

SEQ ID NO: 17351 - RNA, 17 nt, Homo sapiens
cucccucccucugcccu

SEQ ID NO: 17352 - RNA, 16 nt, Homo sapiens
gauaggaaaccaguga

SEQ ID NO: 17353 - RNA, 22 nt, Homo sapiens
ucaacacaauuuuauucacuaa

SEQ ID NO: 17354 - RNA, 21 nt, Homo sapiens
uuccuuuugagaagcacugaa

SEQ ID NO: 17355 - RNA, 24 nt, Homo sapiens
agggagaguggcucgggcucaguc

SEQ ID NO: 17356 - RNA, 21 nt, Homo sapiens
ccaugacuacaucacagccag

SEQ ID NO: 17357 - RNA, 18 nt, Homo sapiens
cuggaauuacacuuuuuu

SEQ ID NO: 17358 - RNA, 21 nt, Homo sapiens
gcggaaguagcacaguuucca

SEQ ID NO: 17359 - RNA, 16 nt, Homo sapiens
cagaacgauugaugaa

SEQ ID NO: 17360 - RNA, 21 nt, Homo sapiens
caacacuugaugguacaguaa

SEQ ID NO: 17361 - RNA, 18 nt, Homo sapiens
ucaauaaagaccucuuga

SEQ ID NO: 17362 - RNA, 20 nt, Homo sapiens
agcgccccagcgccucaucu

SEQ ID NO: 17363 - RNA, 18 nt, Homo sapiens
cccuccccacucccccua

SEQ ID NO: 17364 - RNA, 22 nt, Homo sapiens
gccaccuccuucccggccgccc

SEQ ID NO: 17365 - RNA, 20 nt, Homo sapiens
uccuguugucugucacacuu

SEQ ID NO: 17366 - RNA, 18 nt, Homo sapiens
ugcuuguucuaacaauau

SEQ ID NO: 17367 - RNA, 19 nt, Homo sapiens
cugcaagcuccaccuccca

SEQ ID NO: 17368 - RNA, 21 nt, Homo sapiens
gcgcuucgguacagcacgggu

SEQ ID NO: 17369 - RNA, 16 nt, Homo sapiens
gugaagacaggcugug

SEQ ID NO: 17370 - RNA, 21 nt, Homo sapiens
uucuccugcugccaccgucuu

SEQ ID NO: 17371 - RNA, 18 nt, Homo sapiens
aacagauuugccggcauu

SEQ ID NO: 17372 - RNA, 26 nt, Homo sapiens
cagggcaccccaggacacccaggaua

SEQ ID NO: 17373 - RNA, 21 nt, Homo sapiens
cugcagcaguugcacucuuuu

SEQ ID NO: 17374 - RNA, 21 nt, Homo sapiens
gccuuuccuccauuuucugug

SEQ ID NO: 17375 - RNA, 22 nt, Homo sapiens
ggaaaaguagagaaagaaaugc

SEQ ID NO: 17376 - RNA, 18 nt, Homo sapiens
ggagcuuucuaaaucuca

SEQ ID NO: 17377 - RNA, 18 nt, Homo sapiens
ugagcucuucuauagcuc

SEQ ID NO: 17378 - RNA, 20 nt, Homo sapiens
uguagggagauauguaggug

SEQ ID NO: 17379 - RNA, 19 nt, Homo sapiens
uuuuucuuuuuucauuuca

SEQ ID NO: 17380 - RNA, 19 nt, Homo sapiens
aaacuccugaccucaggug

SEQ ID NO: 17381 - RNA, 22 nt, Homo sapiens
cugggauuacaggcaccugcca

SEQ ID NO: 17382 - RNA, 18 nt, Homo sapiens
uccaccuccuggguucaa

SEQ ID NO: 17383 - RNA, 25 nt, Homo sapiens
uuagaguuaguuuuagggcacuuuu

SEQ ID NO: 17384 - RNA, 22 nt, Homo sapiens
aaaggaugggucccacccuccc

SEQ ID NO: 17385 - RNA, 21 nt, Homo sapiens
gaugcugcucaacaugggcua

SEQ ID NO: 17386 - RNA, 22 nt, Homo sapiens
ccugaaguucuuggauuacuuu

SEQ ID NO: 17387 - RNA, 23 nt, Homo sapiens
ccuugcacauacauugguuuuga

SEQ ID NO: 17388 - RNA, 19 nt, Homo sapiens
cuuaacauuucauguagua

SEQ ID NO: 17389 - RNA, 18 nt, Homo sapiens
uauuaaucuacuguauca

SEQ ID NO: 17390 - RNA, 20 nt, Homo sapiens
uguagcaaauuuguuuaauc

SEQ ID NO: 17391 - RNA, 25 nt, Homo sapiens
aaaccacagauaauaacaaaccuua

SEQ ID NO: 17392 - RNA, 18 nt, Homo sapiens
gaaauuacacugugcuca

SEQ ID NO: 17393 - RNA, 19 nt, Homo sapiens
gaaccugcuggugcaagcu

SEQ ID NO: 17394 - RNA, 27 nt, Homo sapiens
gccugggcuguagcaagcugucugccc

SEQ ID NO: 17395 - RNA, 18 nt, Homo sapiens
gucugcccuuggguucaa

SEQ ID NO: 17396 - RNA, 19 nt, Homo sapiens
aggaaccugagccuggcug

SEQ ID NO: 17397 - RNA, 17 nt, Homo sapiens
auccucuuccuucacag

SEQ ID NO: 17398 - RNA, 22 nt, Homo sapiens
cacuaccagaguucucuagcaa

SEQ ID NO: 17399 - RNA, 19 nt, Homo sapiens
cuugccagcugacgucaca

SEQ ID NO: 17400 - RNA, 21 nt, Homo sapiens
gccucugucccaauucugagu

SEQ ID NO: 17401 - RNA, 22 nt, Homo sapiens
guagagacaggauuucaccaug

SEQ ID NO: 17402 - RNA, 19 nt, Homo sapiens
gugaacucacacaugugua

SEQ ID NO: 17403 - RNA, 16 nt, Homo sapiens
guugcguagucuugaa

SEQ ID NO: 17404 - RNA, 21 nt, Homo sapiens
ucaucaucaucaucucugcua

SEQ ID NO: 17405 - RNA, 26 nt, Homo sapiens
uggguggguuucuaccuuugaaacug

SEQ ID NO: 17406 - RNA, 22 nt, Homo sapiens
uuuugggacaaugccucugucc

SEQ ID NO: 17407 - RNA, 20 nt, Homo sapiens
caagaucuccacgaauauca

SEQ ID NO: 17408 - RNA, 18 nt, Homo sapiens
agaaaauguugugcugua

SEQ ID NO: 17409 - RNA, 20 nt, Homo sapiens
agaucccaaaucuuauguaa

SEQ ID NO: 17410 - RNA, 23 nt, Homo sapiens
cacuuuuaaaaaauaccauuuga

SEQ ID NO: 17411 - RNA, 18 nt, Homo sapiens
gaguccuuccucuccccu

SEQ ID NO: 17412 - RNA, 18 nt, Homo sapiens
gaucccaaaucuuaugua

SEQ ID NO: 17413 - RNA, 20 nt, Homo sapiens
gcauauuccaauucacuuuu

SEQ ID NO: 17414 - RNA, 18 nt, Homo sapiens
uccagucaugacugucca

SEQ ID NO: 17415 - RNA, 23 nt, Homo sapiens
accauuuuuacauccaugaaaau

SEQ ID NO: 17416 - RNA, 20 nt, Homo sapiens
gaaguuuaaacucugcucac

SEQ ID NO: 17417 - RNA, 18 nt, Homo sapiens
ucccccaagaggaugcgg

SEQ ID NO: 17418 - RNA, 22 nt, Homo sapiens
acccugcuagcuuugcccuuga

SEQ ID NO: 17419 - RNA, 18 nt, Homo sapiens
acuucaucccaacuugcu

SEQ ID NO: 17420 - RNA, 16 nt, Homo sapiens
cugcuuuggauguggu

SEQ ID NO: 17421 - RNA, 21 nt, Homo sapiens
ggacggugagacggccgcggc

SEQ ID NO: 17422 - RNA, 17 nt, Homo sapiens
agaaaguuuacauacau

SEQ ID NO: 17423 - RNA, 20 nt, Homo sapiens
aguuucacuuuucaucagca

SEQ ID NO: 17424 - RNA, 24 nt, Homo sapiens
caccaccgccgccgccuccaucuu

SEQ ID NO: 17425 - RNA, 21 nt, Homo sapiens
caccuuaccaucaucaugcca

SEQ ID NO: 17426 - RNA, 17 nt, Homo sapiens
cagugggagaaaguuca

SEQ ID NO: 17427 - RNA, 20 nt, Homo sapiens
caucaucuuucacauguuca

SEQ ID NO: 17428 - RNA, 16 nt, Homo sapiens
cauugacccugcugca

SEQ ID NO: 17429 - RNA, 18 nt, Homo sapiens
ccaugcuacauuuucauc

SEQ ID NO: 17430 - RNA, 19 nt, Homo sapiens
gcacacaguauucccagug

SEQ ID NO: 17431 - RNA, 19 nt, Homo sapiens
uaccacugaaccccauugc

SEQ ID NO: 17432 - RNA, 17 nt, Homo sapiens
ugcaucugggcauuuca

SEQ ID NO: 17433 - RNA, 23 nt, Homo sapiens
uggaaagaccugggcagaaaugg

SEQ ID NO: 17434 - RNA, 17 nt, Homo sapiens
uuaccaucaucaugcca

SEQ ID NO: 17435 - RNA, 19 nt, Homo sapiens
uucaaacuccauuuccaug

SEQ ID NO: 17436 - RNA, 20 nt, Homo sapiens
accccuaaaaucuuacccac

SEQ ID NO: 17437 - RNA, 21 nt, Homo sapiens
cuccugugagccucaauuuua

SEQ ID NO: 17438 - RNA, 22 nt, Homo sapiens
gacaucacucaucuuccucaca

SEQ ID NO: 17439 - RNA, 18 nt, Homo sapiens
ugauugagccaccacacu

SEQ ID NO: 17440 - RNA, 19 nt, Homo sapiens
ugccucuccuuauccuuca

SEQ ID NO: 17441 - RNA, 26 nt, Homo sapiens
caggcuccccuccuuccuauuagcua

SEQ ID NO: 17442 - RNA, 19 nt, Homo sapiens
ccgugugucugugcagugc

SEQ ID NO: 17443 - RNA, 22 nt, Homo sapiens
ggguauuaaggucagccucuca

SEQ ID NO: 17444 - RNA, 16 nt, Homo sapiens
gguuagaucugugaac

SEQ ID NO: 17445 - RNA, 18 nt, Homo sapiens
uccgccucccggguucaa

SEQ ID NO: 17446 - RNA, 17 nt, Homo sapiens
ugacagagccagacucc

SEQ ID NO: 17447 - RNA, 18 nt, Homo sapiens
ugcucccacccuugccug

SEQ ID NO: 17448 - RNA, 27 nt, Homo sapiens
ccugggacaguggcugcucuugacuuu

SEQ ID NO: 17449 - RNA, 20 nt, Homo sapiens
ucuuuucuaggagugucuca

SEQ ID NO: 17450 - RNA, 19 nt, Homo sapiens
aauggcucucccucccccu

SEQ ID NO: 17451 - RNA, 20 nt, Homo sapiens
acccagaggguaaggauucc

SEQ ID NO: 17452 - RNA, 18 nt, Homo sapiens
acuuuaacaugcauccaa

SEQ ID NO: 17453 - RNA, 20 nt, Homo sapiens
caacuagcugacaaagcuuc

SEQ ID NO: 17454 - RNA, 20 nt, Homo sapiens
cagaucaggggcucugggga

SEQ ID NO: 17455 - RNA, 20 nt, Homo sapiens
ccagauccagaccuaggccu

SEQ ID NO: 17456 - RNA, 16 nt, Homo sapiens
ccccaguccacuggca

SEQ ID NO: 17457 - RNA, 21 nt, Homo sapiens
ccguuccuaguggggcuugcu

SEQ ID NO: 17458 - RNA, 21 nt, Homo sapiens
cucucucaggaccucuccucu

SEQ ID NO: 17459 - RNA, 21 nt, Homo sapiens
gcagccuagacagaaccugca

SEQ ID NO: 17460 - RNA, 19 nt, Homo sapiens
gccuuuccuccaaagccug

SEQ ID NO: 17461 - RNA, 18 nt, Homo sapiens
ggaaggcagccucagaca

SEQ ID NO: 17462 - RNA, 24 nt, Homo sapiens
ggcaagagccuccacgcccggcca

SEQ ID NO: 17463 - RNA, 19 nt, Homo sapiens
ucuuaccucccucccuccu

SEQ ID NO: 17464 - RNA, 18 nt, Homo sapiens
ugccagcccucgugcugc

SEQ ID NO: 17465 - RNA, 20 nt, Homo sapiens
cacuguccccacccuccuuc

SEQ ID NO: 17466 - RNA, 22 nt, Homo sapiens
cagggcacgugcucacagcccu

SEQ ID NO: 17467 - RNA, 21 nt, Homo sapiens
ccacgggcucccugcuccccc

SEQ ID NO: 17468 - RNA, 16 nt, Homo sapiens
cugcgcggccucguca

SEQ ID NO: 17469 - RNA, 18 nt, Homo sapiens
ggagcgcccggcccccuc

SEQ ID NO: 17470 - RNA, 20 nt, Homo sapiens
ggcuugcugugucucacugu

SEQ ID NO: 17471 - RNA, 21 nt, Homo sapiens
accugucucacaagaacuuca

SEQ ID NO: 17472 - RNA, 19 nt, Homo sapiens
acucaaggccaugaacuca

SEQ ID NO: 17473 - RNA, 21 nt, Homo sapiens
aucuuggcucacugcaaccuc

SEQ ID NO: 17474 - RNA, 21 nt, Homo sapiens
caagauugugcucuucuauca

SEQ ID NO: 17475 - RNA, 18 nt, Homo sapiens
cagugguguaauuuuauu

SEQ ID NO: 17476 - RNA, 18 nt, Homo sapiens
uccgacucccagguucaa

SEQ ID NO: 17477 - RNA, 20 nt, Homo sapiens
gcaagcucaccgccugaaca

SEQ ID NO: 17478 - RNA, 20 nt, Homo sapiens
gcgaggucagacauccacca

SEQ ID NO: 17479 - RNA, 19 nt, Homo sapiens
ggaacggccguccucuucc

SEQ ID NO: 17480 - RNA, 17 nt, Homo sapiens
ggaacuccauuccaccu

SEQ ID NO: 17481 - RNA, 18 nt, Homo sapiens
ucagccucaggcauccaa

SEQ ID NO: 17482 - RNA, 17 nt, Homo sapiens
uccaaaauaaaaaccca

SEQ ID NO: 17483 - RNA, 18 nt, Homo sapiens
ugagauccaccaacaucu

SEQ ID NO: 17484 - RNA, 19 nt, Homo sapiens
cagcaacagcagcaguacc

SEQ ID NO: 17485 - RNA, 18 nt, Homo sapiens
ggaaaaaaaaacaagcaa

SEQ ID NO: 17486 - RNA, 20 nt, Homo sapiens
ggagaggcggcggcggcggc

SEQ ID NO: 17487 - RNA, 19 nt, Homo sapiens
guucaagaaacuagucugu

SEQ ID NO: 17488 - RNA, 21 nt, Homo sapiens
ugagugcuuagaauggggcua

SEQ ID NO: 17489 - RNA, 22 nt, Homo sapiens
uugagcagugggugacacaaca

SEQ ID NO: 17490 - RNA, 18 nt, Homo sapiens
ccugcaaccuccaccucc

SEQ ID NO: 17491 - RNA, 19 nt, Homo sapiens
cugcaaccuccaccuccca

SEQ ID NO: 17492 - RNA, 20 nt, Homo sapiens
gacccgcccuugucggccuc

SEQ ID NO: 17493 - RNA, 18 nt, Homo sapiens
uccaccucccagguucaa

SEQ ID NO: 17494 - RNA, 23 nt, Homo sapiens
cuuucaaagcacacagucaaaca

SEQ ID NO: 17495 - RNA, 22 nt, Homo sapiens
accuucaccagcaaaccuccug

SEQ ID NO: 17496 - RNA, 16 nt, Homo sapiens
agggcuuuguuccugg

SEQ ID NO: 17497 - RNA, 19 nt, Homo sapiens
gcccccaugucccucccca

SEQ ID NO: 17498 - RNA, 20 nt, Homo sapiens
gccucuguccugccgagcca

SEQ ID NO: 17499 - RNA, 16 nt, Homo sapiens
ggcgccacacuccggg

SEQ ID NO: 17500 - RNA, 19 nt, Homo sapiens
uguccccaaaaccugugcu

SEQ ID NO: 17501 - RNA, 18 nt, Homo sapiens
agacauacauucaucccc

SEQ ID NO: 17502 - RNA, 20 nt, Homo sapiens
gcuuuuuccucuagcacuaa

SEQ ID NO: 17503 - RNA, 19 nt, Homo sapiens
guaugagguuauguugagg

SEQ ID NO: 17504 - RNA, 15 nt, Homo sapiens
ucucucauguaacca

SEQ ID NO: 17505 - RNA, 19 nt, Homo sapiens
augucacugcuucauugcc

SEQ ID NO: 17506 - RNA, 23 nt, Homo sapiens
ccugggaaguugaggucacuuuu

SEQ ID NO: 17507 - RNA, 18 nt, Homo sapiens
gggaugggcagcagcggc

SEQ ID NO: 17508 - RNA, 22 nt, Homo sapiens
gugaccaccaagacauauaugu

SEQ ID NO: 17509 - RNA, 27 nt, Homo sapiens
ugaagugcagauuguaacauggagcua

SEQ ID NO: 17510 - RNA, 24 nt, Homo sapiens
uguuuccugguggacagccgggua

SEQ ID NO: 17511 - RNA, 20 nt, Homo sapiens
uucauaaucagauuaugcua

SEQ ID NO: 17512 - RNA, 18 nt, Homo sapiens
aauucauuaguuugucau

SEQ ID NO: 17513 - RNA, 20 nt, Homo sapiens
ccaagaaauucaccaugaaa

SEQ ID NO: 17514 - RNA, 19 nt, Homo sapiens
cucuccuguagcguuagcu

SEQ ID NO: 17515 - RNA, 19 nt, Homo sapiens
cugcaaccuccgccuccca

SEQ ID NO: 17516 - RNA, 24 nt, Homo sapiens
gaagaaagacaaggaaaccccuga

SEQ ID NO: 17517 - RNA, 22 nt, Homo sapiens
gacgggguuucaccauacuggc

SEQ ID NO: 17518 - RNA, 17 nt, Homo sapiens
gccgccgccgcuggcca

SEQ ID NO: 17519 - RNA, 18 nt, Homo sapiens
uccgccucccagguucaa

SEQ ID NO: 17520 - RNA, 23 nt, Homo sapiens
ucucaguaaugggagaucuugag

SEQ ID NO: 17521 - RNA, 19 nt, Homo sapiens
cccagcgcccucuaccucc

SEQ ID NO: 17522 - RNA, 19 nt, Homo sapiens
ccccaccucccugcagcuu

SEQ ID NO: 17523 - RNA, 21 nt, Homo sapiens
cccugccaggggguuugagga

SEQ ID NO: 17524 - RNA, 21 nt, Homo sapiens
cucuugagagccccaccccug

SEQ ID NO: 17525 - RNA, 17 nt, Homo sapiens
gccaggggguuugagga

SEQ ID NO: 17526 - RNA, 22 nt, Homo sapiens
gggcggccugcagacccugcca

SEQ ID NO: 17527 - RNA, 20 nt, Homo sapiens
ccaugugaucauugaucaga

SEQ ID NO: 17528 - RNA, 23 nt, Homo sapiens
cucaccaaaugaagcuuuuucua

SEQ ID NO: 17529 - RNA, 18 nt, Homo sapiens
guccuuagauuuugauca

SEQ ID NO: 17530 - RNA, 18 nt, Homo sapiens
guuuugccauugcagcaa

SEQ ID NO: 17531 - RNA, 18 nt, Homo sapiens
uguugggaagguaauuuu

SEQ ID NO: 17532 - RNA, 22 nt, Homo sapiens
cccagcacguggccccagacca

SEQ ID NO: 17533 - RNA, 17 nt, Homo sapiens
cuccccaggagcaggga

SEQ ID NO: 17534 - RNA, 20 nt, Homo sapiens
gauuguguuccuccccagga

SEQ ID NO: 17535 - RNA, 20 nt, Homo sapiens
gcauagcuggccacagugcu

SEQ ID NO: 17536 - RNA, 19 nt, Homo sapiens
agugucaaaguuguguguu

SEQ ID NO: 17537 - RNA, 20 nt, Homo sapiens
cacacauagcccuuuucaug

SEQ ID NO: 17538 - RNA, 21 nt, Homo sapiens
cagcccuucucuaaccacccu

SEQ ID NO: 17539 - RNA, 18 nt, Homo sapiens
cuggaacacuacaguguu

SEQ ID NO: 17540 - RNA, 19 nt, Homo sapiens
cuuuucauggauagaccuu

SEQ ID NO: 17541 - RNA, 20 nt, Homo sapiens
gaaggggggaaccaagcacc

SEQ ID NO: 17542 - RNA, 19 nt, Homo sapiens
gguuucccauguugcagca

SEQ ID NO: 17543 - RNA, 16 nt, Homo sapiens
ugccuugucauuauua

SEQ ID NO: 17544 - RNA, 23 nt, Homo sapiens
uggaguggacuucuguucaggga

SEQ ID NO: 17545 - RNA, 22 nt, Homo sapiens
aagguaccagauguaagaguca

SEQ ID NO: 17546 - RNA, 18 nt, Homo sapiens
agaccugugcgucagcua

SEQ ID NO: 17547 - RNA, 22 nt, Homo sapiens
gaaaaacuauugauuucccaug

SEQ ID NO: 17548 - RNA, 18 nt, Homo sapiens
gaguauuugccaacaguc

SEQ ID NO: 17549 - RNA, 16 nt, Homo sapiens
guuaggagaaaucuga

SEQ ID NO: 17550 - RNA, 19 nt, Homo sapiens
uacuuauaaaaauagugug

SEQ ID NO: 17551 - RNA, 21 nt, Homo sapiens
aaugaagucaucccuucuccc

SEQ ID NO: 17552 - RNA, 18 nt, Homo sapiens
caccauucuccugccuca

SEQ ID NO: 17553 - RNA, 19 nt, Homo sapiens
cagcaacgccagacuauau

SEQ ID NO: 17554 - RNA, 18 nt, Homo sapiens
caguggugcaaucucacu

SEQ ID NO: 17555 - RNA, 19 nt, Homo sapiens
ccauuaaaaauugcacuua

SEQ ID NO: 17556 - RNA, 18 nt, Homo sapiens
cgcaaaggcuuuacuucu

SEQ ID NO: 17557 - RNA, 19 nt, Homo sapiens
cugcaagcucugccuccca

SEQ ID NO: 17558 - RNA, 23 nt, Homo sapiens
gagaaggcccugaaaucacauug

SEQ ID NO: 17559 - RNA, 20 nt, Homo sapiens
uagacagauacaguggagau

SEQ ID NO: 17560 - RNA, 22 nt, Homo sapiens
agaaaucucaaacuguacugua

SEQ ID NO: 17561 - RNA, 19 nt, Homo sapiens
caggacaguuuaugaaaua

SEQ ID NO: 17562 - RNA, 18 nt, Homo sapiens
ggaguuaaauguccugca

SEQ ID NO: 17563 - RNA, 19 nt, Homo sapiens
ggaguuaaauguccugcaa

SEQ ID NO: 17564 - RNA, 19 nt, Homo sapiens
uuagguggucaguccuuuu

SEQ ID NO: 17565 - RNA, 18 nt, Homo sapiens
augccaccucguuuaacc

SEQ ID NO: 17566 - RNA, 19 nt, Homo sapiens
caccgagaaccaccagcca

SEQ ID NO: 17567 - RNA, 22 nt, Homo sapiens
cuaauauuuguuguaaaaguga

SEQ ID NO: 17568 - RNA, 20 nt, Homo sapiens
cuauaucccuucuuaccuga

SEQ ID NO: 17569 - RNA, 20 nt, Homo sapiens
cucauuguggccuuguugaa

SEQ ID NO: 17570 - RNA, 18 nt, Homo sapiens
gaacucauucaugaggaa

SEQ ID NO: 17571 - RNA, 17 nt, Homo sapiens
gcuaggucgcggcagca

SEQ ID NO: 17572 - RNA, 16 nt, Homo sapiens
guuguggaaacugcac

SEQ ID NO: 17573 - RNA, 17 nt, Homo sapiens
uccagaaaccacgucca

SEQ ID NO: 17574 - RNA, 17 nt, Homo sapiens
ugauaaaacuaauggca

SEQ ID NO: 17575 - RNA, 21 nt, Homo sapiens
aucugggucucuguguggucu

SEQ ID NO: 17576 - RNA, 16 nt, Homo sapiens
gcuuuugugucccuga

SEQ ID NO: 17577 - RNA, 19 nt, Homo sapiens
ucuacucucaauccaguua

SEQ ID NO: 17578 - RNA, 20 nt, Homo sapiens
agccauggucuuggcacugu

SEQ ID NO: 17579 - RNA, 22 nt, Homo sapiens
cuucuuuguguuucuuugccuu

SEQ ID NO: 17580 - RNA, 22 nt, Homo sapiens
ggacuggggacaacaguauuaa

SEQ ID NO: 17581 - RNA, 20 nt, Homo sapiens
aaggcgccaacagaguaguc

SEQ ID NO: 17582 - RNA, 18 nt, Homo sapiens
cuuuccuccccacuggag

SEQ ID NO: 17583 - RNA, 25 nt, Homo sapiens
uuuugguuucuaggaaggucuuugg

SEQ ID NO: 17584 - RNA, 19 nt, Homo sapiens
aagcaauucuccugccuca

SEQ ID NO: 17585 - RNA, 19 nt, Homo sapiens
caugccagcacuugaacug

SEQ ID NO: 17586 - RNA, 21 nt, Homo sapiens
ccuaccgagaggauuaugcaa

SEQ ID NO: 17587 - RNA, 19 nt, Homo sapiens
ccuccagacccugcuaacc

SEQ ID NO: 17588 - RNA, 23 nt, Homo sapiens
gcuuggaucaugcucgucugccc

SEQ ID NO: 17589 - RNA, 17 nt, Homo sapiens
ggcuguucccucuccaa

SEQ ID NO: 17590 - RNA, 19 nt, Homo sapiens
uacuagugguggcaguggc

SEQ ID NO: 17591 - RNA, 21 nt, Homo sapiens
ucaggaggugggaggccgugg

SEQ ID NO: 17592 - RNA, 22 nt, Homo sapiens
ugaguggacucugugcucacug

SEQ ID NO: 17593 - RNA, 20 nt, Homo sapiens
uggccaggcuggucuugaac

SEQ ID NO: 17594 - RNA, 19 nt, Homo sapiens
aaguauagauaacauuuca

SEQ ID NO: 17595 - RNA, 19 nt, Homo sapiens
aauaggcagcacucugaaa

SEQ ID NO: 17596 - RNA, 19 nt, Homo sapiens
agcccuaaagcagauuuaa

SEQ ID NO: 17597 - RNA, 20 nt, Homo sapiens
aggguuuuaaacuuuauaau

SEQ ID NO: 17598 - RNA, 20 nt, Homo sapiens
augucauguuugacauuuuu

SEQ ID NO: 17599 - RNA, 19 nt, Homo sapiens
auguccuaacauggaguua

SEQ ID NO: 17600 - RNA, 22 nt, Homo sapiens
ccuaggucacaagacccaggga

SEQ ID NO: 17601 - RNA, 17 nt, Homo sapiens
guuuuacaucugugaac

SEQ ID NO: 17602 - RNA, 20 nt, Homo sapiens
uacugaguaccuacuaggua

SEQ ID NO: 17603 - RNA, 22 nt, Homo sapiens
ucguagcuacauacguaccaca

SEQ ID NO: 17604 - RNA, 23 nt, Homo sapiens
ugaaucuuugguguauugaaaua

SEQ ID NO: 17605 - RNA, 21 nt, Homo sapiens
agacagagacuugacuugauc

SEQ ID NO: 17606 - RNA, 19 nt, Homo sapiens
ucacucaacagguauagua

SEQ ID NO: 17607 - RNA, 22 nt, Homo sapiens
agaaagagcuuaccccuuuccc

SEQ ID NO: 17608 - RNA, 20 nt, Homo sapiens
agcuuaccccuuucccccgg

SEQ ID NO: 17609 - RNA, 18 nt, Homo sapiens
ccuucuuuaucaacagcu

SEQ ID NO: 17610 - RNA, 24 nt, Homo sapiens
ccuugaucuguauauacuugugag

SEQ ID NO: 17611 - RNA, 18 nt, Homo sapiens
guaugaauuguuucuaac

SEQ ID NO: 17612 - RNA, 19 nt, Homo sapiens
ccccacuguccucaacccu

SEQ ID NO: 17613 - RNA, 16 nt, Homo sapiens
ucugucuuccugccuu

SEQ ID NO: 17614 - RNA, 18 nt, Homo sapiens
ucccaaacuaccaacaag

SEQ ID NO: 17615 - RNA, 19 nt, Homo sapiens
uccccggacucaugaauuc

SEQ ID NO: 17616 - RNA, 21 nt, Homo sapiens
uagcccaaaacaguugccaaa

SEQ ID NO: 17617 - RNA, 17 nt, Homo sapiens
ucuuccgugucugaugu

SEQ ID NO: 17618 - RNA, 25 nt, Homo sapiens
ugccucuuacuauacgacuguagug

SEQ ID NO: 17619 - RNA, 22 nt, Homo sapiens
ugucuuuggcuagagcuuaguu

SEQ ID NO: 17620 - RNA, 23 nt, Homo sapiens
accaauauggcccaugugucaga

SEQ ID NO: 17621 - RNA, 23 nt, Homo sapiens
acccaccuccgucgcccaccuca

SEQ ID NO: 17622 - RNA, 19 nt, Homo sapiens
augaggcagcuucaugugc

SEQ ID NO: 17623 - RNA, 19 nt, Homo sapiens
caugugcucagucugcagg

SEQ ID NO: 17624 - RNA, 22 nt, Homo sapiens
gagaggcagggccugcuuguca

SEQ ID NO: 17625 - RNA, 24 nt, Homo sapiens
gcuagcaucagcaccacuauagca

SEQ ID NO: 17626 - RNA, 26 nt, Homo sapiens
guauauauagugguauuguuuuauua

SEQ ID NO: 17627 - RNA, 19 nt, Homo sapiens
uaaaguuaaaaucuccgca

SEQ ID NO: 17628 - RNA, 21 nt, Homo sapiens
uuuguuugcuaaaggaugggg

SEQ ID NO: 17629 - RNA, 23 nt, Homo sapiens
uuuuuuggugcaguggucuugug

SEQ ID NO: 17630 - RNA, 24 nt, Homo sapiens
uccagauuucuguuucuguccuaa

SEQ ID NO: 17631 - RNA, 21 nt, Homo sapiens
uuuuaugagcuuuuuggcuuu

SEQ ID NO: 17632 - RNA, 17 nt, Homo sapiens
gucuuaauggugcucac

SEQ ID NO: 17633 - RNA, 22 nt, Homo sapiens
aguaggaaccagauagagauga

SEQ ID NO: 17634 - RNA, 28 nt, Homo sapiens
gauaauuccagaaugccuguauaugaug

SEQ ID NO: 17635 - RNA, 19 nt, Homo sapiens
ugaguggagaccuaucaga

SEQ ID NO: 17636 - RNA, 25 nt, Homo sapiens
aaguuuuuaauggaaaguugagcca

SEQ ID NO: 17637 - RNA, 21 nt, Homo sapiens
cagagccccacgcagguucac

SEQ ID NO: 17638 - RNA, 18 nt, Homo sapiens
ccagacccuggcacccuc

SEQ ID NO: 17639 - RNA, 22 nt, Homo sapiens
ccgacgaccucaacucugccca

SEQ ID NO: 17640 - RNA, 21 nt, Homo sapiens
ggcagaauccacuucccaaac

SEQ ID NO: 17641 - RNA, 19 nt, Homo sapiens
cucggccuccucugcgucu

SEQ ID NO: 17642 - RNA, 19 nt, Homo sapiens
ggcgcacggcagcugcagc

SEQ ID NO: 17643 - RNA, 24 nt, Homo sapiens
ccuuguuauuugggagacuuugag

SEQ ID NO: 17644 - RNA, 22 nt, Homo sapiens
cuguggcgaccuugcuuugguu

SEQ ID NO: 17645 - RNA, 17 nt, Homo sapiens
gacuggcccagucucca

SEQ ID NO: 17646 - RNA, 19 nt, Homo sapiens
aucuaguuuaccuagcaaa

SEQ ID NO: 17647 - RNA, 21 nt, Homo sapiens
gguuuauuuuaucugccuuuu

SEQ ID NO: 17648 - RNA, 18 nt, Homo sapiens
ucugccuuaggcacuucu

SEQ ID NO: 17649 - RNA, 19 nt, Homo sapiens
caaguguuaaugcccaugc

SEQ ID NO: 17650 - RNA, 16 nt, Homo sapiens
cagacgguuggcauac

SEQ ID NO: 17651 - RNA, 21 nt, Homo sapiens
ccucugaacuguuuugauuuu

SEQ ID NO: 17652 - RNA, 24 nt, Homo sapiens
aagauguguuuaacugugaggcua

SEQ ID NO: 17653 - RNA, 23 nt, Homo sapiens
acaaaugucaucaaauauguuga

SEQ ID NO: 17654 - RNA, 21 nt, Homo sapiens
accaucagaugcaguucccua

SEQ ID NO: 17655 - RNA, 18 nt, Homo sapiens
acuugaacauuuugcuug

SEQ ID NO: 17656 - RNA, 19 nt, Homo sapiens
caccaucagaugcaguucc

SEQ ID NO: 17657 - RNA, 16 nt, Homo sapiens
gauuuuugccucugga

SEQ ID NO: 17658 - RNA, 23 nt, Homo sapiens
acauccuggcugacaacugugaa

SEQ ID NO: 17659 - RNA, 20 nt, Homo sapiens
auuugcaaggcuguacaaug

SEQ ID NO: 17660 - RNA, 18 nt, Homo sapiens
cacaaugugacccaacuu

SEQ ID NO: 17661 - RNA, 20 nt, Homo sapiens
cugcccucucccaucuuuga

SEQ ID NO: 17662 - RNA, 20 nt, Homo sapiens
ugcauuugaugagugcugga

SEQ ID NO: 17663 - RNA, 17 nt, Homo sapiens
uuccccugaaucucuaa

SEQ ID NO: 17664 - RNA, 19 nt, Homo sapiens
uaacuuaauucucuucguu

SEQ ID NO: 17665 - RNA, 21 nt, Homo sapiens
accaaaauaguccuaaucagu

SEQ ID NO: 17666 - RNA, 18 nt, Homo sapiens
ccccacuugugagugcaa

SEQ ID NO: 17667 - RNA, 20 nt, Homo sapiens
cguacucucagcugccucuc

SEQ ID NO: 17668 - RNA, 22 nt, Homo sapiens
accccacccaggcugcuuccca

SEQ ID NO: 17669 - RNA, 19 nt, Homo sapiens
caucuauucauuuaugaga

SEQ ID NO: 17670 - RNA, 22 nt, Homo sapiens
ccaggcugcuucccaggccuca

SEQ ID NO: 17671 - RNA, 21 nt, Homo sapiens
cugccucagcuccgugcaggg

SEQ ID NO: 17672 - RNA, 23 nt, Homo sapiens
ucaggccucuugggaucgccuca

SEQ ID NO: 17673 - RNA, 23 nt, Homo sapiens
acuacuauccauaaaugcaauga

SEQ ID NO: 17674 - RNA, 19 nt, Homo sapiens
ugggacugagccugugaau

SEQ ID NO: 17675 - RNA, 19 nt, Homo sapiens
cacccaccagagacugcca

SEQ ID NO: 17676 - RNA, 19 nt, Homo sapiens
ccaauuccacauuucugaa

SEQ ID NO: 17677 - RNA, 18 nt, Homo sapiens
cugauaucauauuccucc

SEQ ID NO: 17678 - RNA, 19 nt, Homo sapiens
gagugagacuccaucucca

SEQ ID NO: 17679 - RNA, 25 nt, Homo sapiens
gcuucucccugucuuccucuccucu

SEQ ID NO: 17680 - RNA, 18 nt, Homo sapiens
uccgccuccuggguucaa

SEQ ID NO: 17681 - RNA, 19 nt, Homo sapiens
uggguggaucgccugagau

SEQ ID NO: 17682 - RNA, 19 nt, Homo sapiens
agaagagauauuuucgguu

SEQ ID NO: 17683 - RNA, 20 nt, Homo sapiens
ucugaagacaauggacccac

SEQ ID NO: 17684 - RNA, 18 nt, Homo sapiens
ucuacgggaaauggguca

SEQ ID NO: 17685 - RNA, 21 nt, Homo sapiens
uggaugcauuggcugaaauug

SEQ ID NO: 17686 - RNA, 18 nt, Homo sapiens
ccaagaccaaaucccuca

SEQ ID NO: 17687 - RNA, 20 nt, Homo sapiens
gaaacagagauuuccaauug

SEQ ID NO: 17688 - RNA, 20 nt, Homo sapiens
gacgacuuguccugccacca

SEQ ID NO: 17689 - RNA, 23 nt, Homo sapiens
ucuuuucccauauccuuggcuuu

SEQ ID NO: 17690 - RNA, 19 nt, Homo sapiens
ugaguuaccucuucccaca

SEQ ID NO: 17691 - RNA, 19 nt, Homo sapiens
ugcccaagaccaaaucccu

SEQ ID NO: 17692 - RNA, 22 nt, Homo sapiens
accagagaucuugaucucucuc

SEQ ID NO: 17693 - RNA, 19 nt, Homo sapiens
caacacaucuccacuacca

SEQ ID NO: 17694 - RNA, 18 nt, Homo sapiens
caucaaagaagcuuuuga

SEQ ID NO: 17695 - RNA, 21 nt, Homo sapiens
gccaaacuuacugauauccuc

SEQ ID NO: 17696 - RNA, 22 nt, Homo sapiens
uuaauaacccacaaaagauuca

SEQ ID NO: 17697 - RNA, 17 nt, Homo sapiens
uuguaagaggauaucua

SEQ ID NO: 17698 - RNA, 22 nt, Homo sapiens
aaaucuuuccugcaugaagcua

SEQ ID NO: 17699 - RNA, 19 nt, Homo sapiens
aguuugaaugaaauguuau

SEQ ID NO: 17700 - RNA, 21 nt, Homo sapiens
cauggaaacuugugcucaaac

SEQ ID NO: 17701 - RNA, 18 nt, Homo sapiens
gccugauuaacaggcacu

SEQ ID NO: 17702 - RNA, 17 nt, Homo sapiens
ggaaguacaggaaccag

SEQ ID NO: 17703 - RNA, 18 nt, Homo sapiens
ugaaauaacacuuucaca

SEQ ID NO: 17704 - RNA, 15 nt, Homo sapiens
ugauguaguucacuu

SEQ ID NO: 17705 - RNA, 24 nt, Homo sapiens
ugggcuuacccuugacaggaacug

SEQ ID NO: 17706 - RNA, 19 nt, Homo sapiens
uuuccaggaucaugcuguu

SEQ ID NO: 17707 - RNA, 23 nt, Homo sapiens
ccccuccccaccucgcuucuucc

SEQ ID NO: 17708 - RNA, 24 nt, Homo sapiens
cccuccccaccucgcuucuuccca

SEQ ID NO: 17709 - RNA, 22 nt, Homo sapiens
uagcacugggacacagauccuu

SEQ ID NO: 17710 - RNA, 20 nt, Homo sapiens
uauguauuuauaguguuuua

SEQ ID NO: 17711 - RNA, 22 nt, Homo sapiens
ucaaaaacacagcuaucauaga

SEQ ID NO: 17712 - RNA, 20 nt, Homo sapiens
cuggcuguggcccccauucc

SEQ ID NO: 17713 - RNA, 25 nt, Homo sapiens
gugugugugagcgugugugugagug

SEQ ID NO: 17714 - RNA, 21 nt, Homo sapiens
uccuggcgaugcccuggugga

SEQ ID NO: 17715 - RNA, 22 nt, Homo sapiens
gagccgguacucaccuccgccc

SEQ ID NO: 17716 - RNA, 20 nt, Homo sapiens
acuggcaugggcuaaccacu

SEQ ID NO: 17717 - RNA, 17 nt, Homo sapiens
ggugaaaacagcacucc

SEQ ID NO: 17718 - RNA, 18 nt, Homo sapiens
ucuuuucugggcuguauu

SEQ ID NO: 17719 - RNA, 23 nt, Homo sapiens
ccgcuaagcugcuucucacccca

SEQ ID NO: 17720 - RNA, 20 nt, Homo sapiens
gccuggagcaccugcuccag

SEQ ID NO: 17721 - RNA, 23 nt, Homo sapiens
aaccagagugacugauauauaua

SEQ ID NO: 17722 - RNA, 18 nt, Homo sapiens
aauugaaucuagagucuu

SEQ ID NO: 17723 - RNA, 20 nt, Homo sapiens
ugaaaaacuuugucuuguca

SEQ ID NO: 17724 - RNA, 16 nt, Homo sapiens
uuuaccccucuaauua

SEQ ID NO: 17725 - RNA, 20 nt, Homo sapiens
uuuuaacaaaagccuccaga

SEQ ID NO: 17726 - RNA, 21 nt, Homo sapiens
aauacuagauguuuauuauua

SEQ ID NO: 17727 - RNA, 19 nt, Homo sapiens
cacaccaaaccugcuccca

SEQ ID NO: 17728 - RNA, 20 nt, Homo sapiens
ccaccauaaauguuacaaua

SEQ ID NO: 17729 - RNA, 19 nt, Homo sapiens
ggccaaaauacugccugua

SEQ ID NO: 17730 - RNA, 17 nt, Homo sapiens
gcucacugucuuccaca

SEQ ID NO: 17731 - RNA, 18 nt, Homo sapiens
ggaggcugaugccugcca

SEQ ID NO: 17732 - RNA, 18 nt, Homo sapiens
ggaggcugaugccugcca

SEQ ID NO: 17733 - RNA, 19 nt, Homo sapiens
ucaucacccagucuggaga

SEQ ID NO: 17734 - RNA, 18 nt, Homo sapiens
ugcuacuuccccaucuuu

SEQ ID NO: 17735 - RNA, 20 nt, Homo sapiens
uucccccaguagcgcuuuuu

SEQ ID NO: 17736 - RNA, 20 nt, Homo sapiens
aaggugugaauguaauguga

SEQ ID NO: 17737 - RNA, 20 nt, Homo sapiens
aguucuuuaccucaaccuga

SEQ ID NO: 17738 - RNA, 18 nt, Homo sapiens
cggacuucaggcggaucu

SEQ ID NO: 17739 - RNA, 22 nt, Homo sapiens
guagcuuaauuaguauuuuguu

SEQ ID NO: 17740 - RNA, 18 nt, Homo sapiens
aaaacauuauaggcuggg

SEQ ID NO: 17741 - RNA, 20 nt, Homo sapiens
aacaggaguaauguuucguu

SEQ ID NO: 17742 - RNA, 19 nt, Homo sapiens
aagaaaacuuagggucuca

SEQ ID NO: 17743 - RNA, 22 nt, Homo sapiens
ccugcuuuagagcuguguguug

SEQ ID NO: 17744 - RNA, 28 nt, Homo sapiens
cgauuuguaauaaaacugaguuguacaa

SEQ ID NO: 17745 - RNA, 26 nt, Homo sapiens
gagggaguuuguauuaggucugguca

SEQ ID NO: 17746 - RNA, 22 nt, Homo sapiens
ggauaguuuaugaguaaucuuu

SEQ ID NO: 17747 - RNA, 22 nt, Homo sapiens
uccauggguggaaacuugugag

SEQ ID NO: 17748 - RNA, 19 nt, Homo sapiens
ucguguaguugucugguuu

SEQ ID NO: 17749 - RNA, 21 nt, Homo sapiens
uucuuauugcacugguuuaua

SEQ ID NO: 17750 - RNA, 19 nt, Homo sapiens
uucuucucuuuuugucuca

SEQ ID NO: 17751 - RNA, 17 nt, Homo sapiens
uuuaaacacucugacca

SEQ ID NO: 17752 - RNA, 20 nt, Homo sapiens
uugugguuuauuggaaccua

SEQ ID NO: 17753 - RNA, 21 nt, Homo sapiens
gggcgggacggcggccgccgc

SEQ ID NO: 17754 - RNA, 20 nt, Homo sapiens
auuugagcuguuuacugucu

SEQ ID NO: 17755 - RNA, 23 nt, Homo sapiens
ccuuuaauccaauauaguugaua

SEQ ID NO: 17756 - RNA, 24 nt, Homo sapiens
cagacagaacacaaaagguuucug

SEQ ID NO: 17757 - RNA, 20 nt, Homo sapiens
caggaaaggcuagguucagu

SEQ ID NO: 17758 - RNA, 19 nt, Homo sapiens
guguuuuuuguuguuuuug

SEQ ID NO: 17759 - RNA, 18 nt, Homo sapiens
uucuucagaaaaccucca

SEQ ID NO: 17760 - RNA, 16 nt, Homo sapiens
ccauuccuucugugau

SEQ ID NO: 17761 - RNA, 23 nt, Homo sapiens
agcuaagcagcugcugggacuca

SEQ ID NO: 17762 - RNA, 18 nt, Homo sapiens
ugccuguggagugcugag

SEQ ID NO: 17763 - RNA, 17 nt, Homo sapiens
uguguacgccgccagcu

SEQ ID NO: 17764 - RNA, 16 nt, Homo sapiens
guacccuguucucuuu

SEQ ID NO: 17765 - RNA, 23 nt, Homo sapiens
gccccugccgcggugccuggccu

SEQ ID NO: 17766 - RNA, 25 nt, Homo sapiens
cuguaaaauuugucucaucuuuuaa

SEQ ID NO: 17767 - RNA, 20 nt, Homo sapiens
cuuccuucuccacuaaccca

SEQ ID NO: 17768 - RNA, 18 nt, Homo sapiens
ggacauguuaaaauucca

SEQ ID NO: 17769 - RNA, 20 nt, Homo sapiens
uuauguauuugaauuccuga

SEQ ID NO: 17770 - RNA, 22 nt, Homo sapiens
aaccagaaagguuucugcccag

SEQ ID NO: 17771 - RNA, 20 nt, Homo sapiens
caaagaggcuguacccaucc

SEQ ID NO: 17772 - RNA, 15 nt, Homo sapiens
gggccccuucccaca

SEQ ID NO: 17773 - RNA, 18 nt, Homo sapiens
ugaaugagaaggaauuga

SEQ ID NO: 17774 - RNA, 19 nt, Homo sapiens
ccccacccauccccacagc

SEQ ID NO: 17775 - RNA, 23 nt, Homo sapiens
ucuggauccuucccugccggcuc

SEQ ID NO: 17776 - RNA, 17 nt, Homo sapiens
aaaaacaaacaaacaaa

SEQ ID NO: 17777 - RNA, 19 nt, Homo sapiens
accaaacugauucauguac

SEQ ID NO: 17778 - RNA, 21 nt, Homo sapiens
agaacacauacacauauccau

SEQ ID NO: 17779 - RNA, 19 nt, Homo sapiens
agggacaucaacaaagcug

SEQ ID NO: 17780 - RNA, 20 nt, Homo sapiens
ccugcgccuccuggguucaa

SEQ ID NO: 17781 - RNA, 19 nt, Homo sapiens
gaaauaaagugacuccuca

SEQ ID NO: 17782 - RNA, 17 nt, Homo sapiens
ucaagugauucuucugc

SEQ ID NO: 17783 - RNA, 17 nt, Homo sapiens
uuuacauuuucuuaaca

SEQ ID NO: 17784 - RNA, 18 nt, Homo sapiens
acccugagauagagauuc

SEQ ID NO: 17785 - RNA, 22 nt, Homo sapiens
caccccacauggcccacagcuc

SEQ ID NO: 17786 - RNA, 17 nt, Homo sapiens
ccaugucacccagaaag

SEQ ID NO: 17787 - RNA, 16 nt, Homo sapiens
ccuuugggggacccca

SEQ ID NO: 17788 - RNA, 23 nt, Homo sapiens
gaaaauccaaucccaagucccca

SEQ ID NO: 17789 - RNA, 19 nt, Homo sapiens
gaccaccaaggacagcuca

SEQ ID NO: 17790 - RNA, 23 nt, Homo sapiens
gccccauucuaggacucugggga

SEQ ID NO: 17791 - RNA, 22 nt, Homo sapiens
uauuaacagauacucccauaau

SEQ ID NO: 17792 - RNA, 20 nt, Homo sapiens
gaaaugucccccaucucccu

SEQ ID NO: 17793 - RNA, 20 nt, Homo sapiens
gguggaacccaauguuuaca

SEQ ID NO: 17794 - RNA, 19 nt, Homo sapiens
uccucgccagcugcugauc

SEQ ID NO: 17795 - RNA, 20 nt, Homo sapiens
uccuggugaugggagucagc

SEQ ID NO: 17796 - RNA, 18 nt, Homo sapiens
ccuccuugagcuccgcca

SEQ ID NO: 17797 - RNA, 21 nt, Homo sapiens
auauucuaugccuaauacuca

SEQ ID NO: 17798 - RNA, 23 nt, Homo sapiens
ggacccucccugcccacccccuc

SEQ ID NO: 17799 - RNA, 21 nt, Homo sapiens
ucccugcuuacuuagaccuca

SEQ ID NO: 17800 - RNA, 18 nt, Homo sapiens
ggcaugaucagcacauca

SEQ ID NO: 17801 - RNA, 20 nt, Homo sapiens
uggccccugacguggaccug

SEQ ID NO: 17802 - RNA, 17 nt, Homo sapiens
caacaccggaacaagcc

SEQ ID NO: 17803 - RNA, 18 nt, Homo sapiens
gaggcagaaacaccagcc

SEQ ID NO: 17804 - RNA, 19 nt, Homo sapiens
uuuuuuguuuucccccacu

SEQ ID NO: 17805 - RNA, 21 nt, Homo sapiens
guuuucaagaaaauugagcca

SEQ ID NO: 17806 - RNA, 16 nt, Homo sapiens
augugcucggccccca

SEQ ID NO: 17807 - RNA, 22 nt, Homo sapiens
cugcacacucacauauguggca

SEQ ID NO: 17808 - RNA, 23 nt, Homo sapiens
gccugggccgccccgccggguuc

SEQ ID NO: 17809 - RNA, 20 nt, Homo sapiens
acccacacgcagucuuugca

SEQ ID NO: 17810 - RNA, 21 nt, Homo sapiens
cguuagggauaccucaugaca

SEQ ID NO: 17811 - RNA, 21 nt, Homo sapiens
ucugacagccacagcacuaca

SEQ ID NO: 17812 - RNA, 22 nt, Homo sapiens
aaggcugguauuccuugaguca

SEQ ID NO: 17813 - RNA, 20 nt, Homo sapiens
agaccuuuuaguuaugagua

SEQ ID NO: 17814 - RNA, 20 nt, Homo sapiens
caacuucuguccagaugaca

SEQ ID NO: 17815 - RNA, 22 nt, Homo sapiens
cacuucccuccccaggccccaa

SEQ ID NO: 17816 - RNA, 17 nt, Homo sapiens
uccugcuucccacccca

SEQ ID NO: 17817 - RNA, 20 nt, Homo sapiens
uccugugcuugccuucugaa

SEQ ID NO: 17818 - RNA, 21 nt, Homo sapiens
ucuauuuuugcuaccagauga

SEQ ID NO: 17819 - RNA, 23 nt, Homo sapiens
ucuuuaagucuauauuuuccuca

SEQ ID NO: 17820 - RNA, 21 nt, Homo sapiens
uuguaaaaguuuagcaaaaua

SEQ ID NO: 17821 - RNA, 20 nt, Homo sapiens
uuucuuaaaugcuguuuuag

SEQ ID NO: 17822 - RNA, 23 nt, Homo sapiens
uuugggccacccaaaauguuuuu

SEQ ID NO: 17823 - RNA, 25 nt, Homo sapiens
ggggauucguggcgacggcggcggc

SEQ ID NO: 17824 - RNA, 21 nt, Homo sapiens
cagaagguggaauucuaguga

SEQ ID NO: 17825 - RNA, 18 nt, Homo sapiens
ccuuggcaugcuguucca

SEQ ID NO: 17826 - RNA, 17 nt, Homo sapiens
guugugaaacauacuca

SEQ ID NO: 17827 - RNA, 22 nt, Homo sapiens
ucauuaacuuacuugcugccuu

SEQ ID NO: 17828 - RNA, 20 nt, Homo sapiens
ucucgauggaauugugugau

SEQ ID NO: 17829 - RNA, 24 nt, Homo sapiens
aagucucagcccaguucaauucag

SEQ ID NO: 17830 - RNA, 17 nt, Homo sapiens
aggcagcacagagguga

SEQ ID NO: 17831 - RNA, 17 nt, Homo sapiens
auagccaaggcuagcga

SEQ ID NO: 17832 - RNA, 20 nt, Homo sapiens
caaaugauaaggaugccaca

SEQ ID NO: 17833 - RNA, 21 nt, Homo sapiens
ccaauaaaaaugagcccuaug

SEQ ID NO: 17834 - RNA, 18 nt, Homo sapiens
gaacggaacagcaucaca

SEQ ID NO: 17835 - RNA, 18 nt, Homo sapiens
gcuuuuuccugaucuuca

SEQ ID NO: 17836 - RNA, 20 nt, Homo sapiens
ggaauugacugaacuuccca

SEQ ID NO: 17837 - RNA, 20 nt, Homo sapiens
guaaccuauuuuacauagua

SEQ ID NO: 17838 - RNA, 19 nt, Homo sapiens
uaagccaaaaaucuguacu

SEQ ID NO: 17839 - RNA, 16 nt, Homo sapiens
uuccagagggauaucc

SEQ ID NO: 17840 - RNA, 18 nt, Homo sapiens
uuuuuaauugccuguaga

SEQ ID NO: 17841 - RNA, 21 nt, Homo sapiens
agugacuucacacacaccuca

SEQ ID NO: 17842 - RNA, 18 nt, Homo sapiens
auguuauuaaaaaaugug

SEQ ID NO: 17843 - RNA, 18 nt, Homo sapiens
cuuguggagccaucgcga

SEQ ID NO: 17844 - RNA, 17 nt, Homo sapiens
uuaggaagcuuuuguua

SEQ ID NO: 17845 - RNA, 19 nt, Homo sapiens
caacagccccuucugcccc

SEQ ID NO: 17846 - RNA, 21 nt, Homo sapiens
gcacagaaaugcugcagagua

SEQ ID NO: 17847 - RNA, 22 nt, Homo sapiens
uauuggauaaggaccaaugaca

SEQ ID NO: 17848 - RNA, 22 nt, Homo sapiens
cucuccucucaugcaguuuaug

SEQ ID NO: 17849 - RNA, 19 nt, Homo sapiens
uauauucugauuccuaaca

SEQ ID NO: 17850 - RNA, 21 nt, Homo sapiens
uguuuucuuugcuucucaaca

SEQ ID NO: 17851 - RNA, 20 nt, Homo sapiens
aaggcuggccuccucauaag

SEQ ID NO: 17852 - RNA, 20 nt, Homo sapiens
aguaaaccucuccaccaagg

SEQ ID NO: 17853 - RNA, 22 nt, Homo sapiens
gccuggaggaguuuccuggccu

SEQ ID NO: 17854 - RNA, 19 nt, Homo sapiens
ugccuacaccauguuccag

SEQ ID NO: 17855 - RNA, 22 nt, Homo sapiens
uuuucuucagaagacccaugug

SEQ ID NO: 17856 - RNA, 19 nt, Homo sapiens
ucuguuucaugugcccauc

SEQ ID NO: 17857 - RNA, 20 nt, Homo sapiens
ugggaaagauuugcuaggua

SEQ ID NO: 17858 - RNA, 19 nt, Homo sapiens
aaaccaaagcccccuuucu

SEQ ID NO: 17859 - RNA, 16 nt, Homo sapiens
aacauggggggccaga

SEQ ID NO: 17860 - RNA, 20 nt, Homo sapiens
acuggugcagcugcuggcca

SEQ ID NO: 17861 - RNA, 16 nt, Homo sapiens
agcaaacaaaaucaug

SEQ ID NO: 17862 - RNA, 21 nt, Homo sapiens
cacaucgcugccuuguuccuc

SEQ ID NO: 17863 - RNA, 21 nt, Homo sapiens
cacgaaaggguaccaagccca

SEQ ID NO: 17864 - RNA, 19 nt, Homo sapiens
cugaccaccacuuaucgga

SEQ ID NO: 17865 - RNA, 19 nt, Homo sapiens
gacccaauaagcuaccaaa

SEQ ID NO: 17866 - RNA, 18 nt, Homo sapiens
gagggugggaggccucgg

SEQ ID NO: 17867 - RNA, 20 nt, Homo sapiens
ggaacccggaacugaccccc

SEQ ID NO: 17868 - RNA, 23 nt, Homo sapiens
ggcagcaaacaaaaucaugcaca

SEQ ID NO: 17869 - RNA, 22 nt, Homo sapiens
ucccagguuccaagcccugggc

SEQ ID NO: 17870 - RNA, 20 nt, Homo sapiens
uggguggauccuaggugcau

SEQ ID NO: 17871 - RNA, 20 nt, Homo sapiens
ccucugcuuccuagguucaa

SEQ ID NO: 17872 - RNA, 18 nt, Homo sapiens
gcugagcaguucacuuca

SEQ ID NO: 17873 - RNA, 17 nt, Homo sapiens
ucaagugauucuccugc

SEQ ID NO: 17874 - RNA, 21 nt, Homo sapiens
ugggauuguaagaguaugcca

SEQ ID NO: 17875 - RNA, 18 nt, Homo sapiens
accauuaucuccuauucc

SEQ ID NO: 17876 - RNA, 22 nt, Homo sapiens
guagagacaggauuucaccaug

SEQ ID NO: 17877 - RNA, 17 nt, Homo sapiens
ucaagugauucuccugc

SEQ ID NO: 17878 - RNA, 20 nt, Homo sapiens
uggccaggcuggucuugaac

SEQ ID NO: 17879 - RNA, 18 nt, Homo sapiens
auugacagcacauauacc

SEQ ID NO: 17880 - RNA, 22 nt, Homo sapiens
acuugaaagguugccuggacuc

SEQ ID NO: 17881 - RNA, 24 nt, Homo sapiens
acagccaaaugggggaagagguga

SEQ ID NO: 17882 - RNA, 23 nt, Homo sapiens
caggauuaugggagccccagcca

SEQ ID NO: 17883 - RNA, 24 nt, Homo sapiens
ccacuuaguuucuuuuucauuccu

SEQ ID NO: 17884 - RNA, 22 nt, Homo sapiens
cucuagguguuuccacuccacc

SEQ ID NO: 17885 - RNA, 18 nt, Homo sapiens
uguccaccucauaaguca

SEQ ID NO: 17886 - RNA, 19 nt, Homo sapiens
acauuuuguaucuuguaaa

SEQ ID NO: 17887 - RNA, 19 nt, Homo sapiens
ccgcggcaaggacaugccu

SEQ ID NO: 17888 - RNA, 21 nt, Homo sapiens
uagauggacuuuuugguaaau

SEQ ID NO: 17889 - RNA, 19 nt, Homo sapiens
uauugcauuauaucauugc

SEQ ID NO: 17890 - RNA, 23 nt, Homo sapiens
ugaauggauuuuaaaaaauaauu

SEQ ID NO: 17891 - RNA, 17 nt, Homo sapiens
uuuaauguaguaacuca

SEQ ID NO: 17892 - RNA, 22 nt, Homo sapiens
accauucacaccuaaagacuga

SEQ ID NO: 17893 - RNA, 18 nt, Homo sapiens
ucuaaacuagacaucuua

SEQ ID NO: 17894 - RNA, 16 nt, Homo sapiens
ugguuccuuugugaac

SEQ ID NO: 17895 - RNA, 23 nt, Homo sapiens
cuugugcaguaacagugcacaca

SEQ ID NO: 17896 - RNA, 15 nt, Homo sapiens
ccuuuaagaggcgga

SEQ ID NO: 17897 - RNA, 22 nt, Homo sapiens
gauguuaaaugguggacgagua

SEQ ID NO: 17898 - RNA, 18 nt, Homo sapiens
agcagugaacuucccucu

SEQ ID NO: 17899 - RNA, 16 nt, Homo sapiens
ccugaagaggaccugc

SEQ ID NO: 17900 - RNA, 24 nt, Homo sapiens
agggcaucuuccagguggggaaac

SEQ ID NO: 17901 - RNA, 22 nt, Homo sapiens
ugaagagagcgucaggccauca

SEQ ID NO: 17902 - RNA, 21 nt, Homo sapiens
uguuccucacccuccaucucu

SEQ ID NO: 17903 - RNA, 21 nt, Homo sapiens
acugacaggauuuacuaguua

SEQ ID NO: 17904 - RNA, 18 nt, Homo sapiens
agaagcaaaaaaggcugc

SEQ ID NO: 17905 - RNA, 22 nt, Homo sapiens
cauagacaguuccagcaucaca

SEQ ID NO: 17906 - RNA, 20 nt, Homo sapiens
cucgaggaacaagguugcac

SEQ ID NO: 17907 - RNA, 19 nt, Homo sapiens
ucugggagaaacagagcca

SEQ ID NO: 17908 - RNA, 19 nt, Homo sapiens
cucgacccggcacugggua

SEQ ID NO: 17909 - RNA, 19 nt, Homo sapiens
ucacggaggcucuuuguca

SEQ ID NO: 17910 - RNA, 25 nt, Homo sapiens
aaacaaaaggcugcagcacauguua

SEQ ID NO: 17911 - RNA, 18 nt, Homo sapiens
aagcccugaccccaggga

SEQ ID NO: 17912 - RNA, 16 nt, Homo sapiens
cacccggcuuugggga

SEQ ID NO: 17913 - RNA, 20 nt, Homo sapiens
ccaaaagcagcuccaacaga

SEQ ID NO: 17914 - RNA, 20 nt, Homo sapiens
ccaccccaccacccuaaucu

SEQ ID NO: 17915 - RNA, 19 nt, Homo sapiens
cccccaaccuacccccacc

SEQ ID NO: 17916 - RNA, 15 nt, Homo sapiens
cucagggagcugcaa

SEQ ID NO: 17917 - RNA, 24 nt, Homo sapiens
cuggauaugcccaccccugccaaa

SEQ ID NO: 17918 - RNA, 16 nt, Homo sapiens
gcccagagcucuccag

SEQ ID NO: 17919 - RNA, 17 nt, Homo sapiens
gccgaauaggcuacugc

SEQ ID NO: 17920 - RNA, 21 nt, Homo sapiens
gggaaggaggcugcucaccca

SEQ ID NO: 17921 - RNA, 22 nt, Homo sapiens
gucccagacugauuacaugaga

SEQ ID NO: 17922 - RNA, 26 nt, Homo sapiens
ugaaugggagggcgggccuggagcug

SEQ ID NO: 17923 - RNA, 22 nt, Homo sapiens
aacaugaauuuccagccgauga

SEQ ID NO: 17924 - RNA, 18 nt, Homo sapiens
aauccaaacaauaccuca

SEQ ID NO: 17925 - RNA, 22 nt, Homo sapiens
ccaaugcaaacucaaauggugc

SEQ ID NO: 17926 - RNA, 20 nt, Homo sapiens
uccaguugggcagcagggaa

SEQ ID NO: 17927 - RNA, 20 nt, Homo sapiens
ccuuccccguccccuccucc

SEQ ID NO: 17928 - RNA, 16 nt, Homo sapiens
cucuuuccuccuccuc

SEQ ID NO: 17929 - RNA, 22 nt, Homo sapiens
uaaaccuaaauucaaaucuccu

SEQ ID NO: 17930 - RNA, 17 nt, Homo sapiens
aucaaaguuacuccaga

SEQ ID NO: 17931 - RNA, 25 nt, Homo sapiens
gccugaacccguucuucucugguuc

SEQ ID NO: 17932 - RNA, 21 nt, Homo sapiens
cucaccuccccaggcucaccu

SEQ ID NO: 17933 - RNA, 18 nt, Homo sapiens
gaccccuacccccacccc

SEQ ID NO: 17934 - RNA, 22 nt, Homo sapiens
uugaacccccaugcaaugagcu

SEQ ID NO: 17935 - RNA, 19 nt, Homo sapiens
cccugcaggggaucugugg

SEQ ID NO: 17936 - RNA, 20 nt, Homo sapiens
cccugcaggggaucuguggg

SEQ ID NO: 17937 - RNA, 18 nt, Homo sapiens
agucauuaaucuaaggaa

SEQ ID NO: 17938 - RNA, 16 nt, Homo sapiens
ccaguucccuucuuua

SEQ ID NO: 17939 - RNA, 17 nt, Homo sapiens
gccuauuuccucaggag

SEQ ID NO: 17940 - RNA, 22 nt, Homo sapiens
uagguggggcaggcuggggcug

SEQ ID NO: 17941 - RNA, 26 nt, Homo sapiens
ucucuuugguuuagguuuuugaccuu

SEQ ID NO: 17942 - RNA, 17 nt, Homo sapiens
ggaggagggggccgugc

SEQ ID NO: 17943 - RNA, 22 nt, Homo sapiens
uccggccccgccucugcccuca

SEQ ID NO: 17944 - RNA, 22 nt, Homo sapiens
accgacuuuccccaagagaaaa

SEQ ID NO: 17945 - RNA, 22 nt, Homo sapiens
cgggauuccaagggcucgguua

SEQ ID NO: 17946 - RNA, 24 nt, Homo sapiens
gcacacaagcucugcgccaaucac

SEQ ID NO: 17947 - RNA, 19 nt, Homo sapiens
ggacccuaagaugaagcug

SEQ ID NO: 17948 - RNA, 19 nt, Homo sapiens
gcgcccagcgugcacggga

SEQ ID NO: 17949 - RNA, 19 nt, Homo sapiens
uggcucuuuuuccuucuca

SEQ ID NO: 17950 - RNA, 22 nt, Homo sapiens
aaaccugaauggucgcuaccuc

SEQ ID NO: 17951 - RNA, 16 nt, Homo sapiens
ccugugaucucugcca

SEQ ID NO: 17952 - RNA, 17 nt, Homo sapiens
ccugacugugcucugug

SEQ ID NO: 17953 - RNA, 16 nt, Homo sapiens
ccugugaucucugcca

SEQ ID NO: 17954 - RNA, 21 nt, Homo sapiens
uccucccacggcuuguggcug

SEQ ID NO: 17955 - RNA, 21 nt, Homo sapiens
uggaccgugaguguggggcug

SEQ ID NO: 17956 - RNA, 24 nt, Homo sapiens
cagcacccucagaugauuucccuc

SEQ ID NO: 17957 - RNA, 17 nt, Homo sapiens
cagccauccucccaucc

SEQ ID NO: 17958 - RNA, 23 nt, Homo sapiens
cggucuugauuagguuucaguca

SEQ ID NO: 17959 - RNA, 20 nt, Homo sapiens
cugaacuguggcuacugugc

SEQ ID NO: 17960 - RNA, 19 nt, Homo sapiens
gccagcugccucuucuuua

SEQ ID NO: 17961 - RNA, 19 nt, Homo sapiens
gcccccaugccccucugag

SEQ ID NO: 17962 - RNA, 19 nt, Homo sapiens
uaugugucccuugauaaca

SEQ ID NO: 17963 - RNA, 24 nt, Homo sapiens
cagcacccucagaugauuucccuc

SEQ ID NO: 17964 - RNA, 17 nt, Homo sapiens
cagccauccucccaucc

SEQ ID NO: 17965 - RNA, 23 nt, Homo sapiens
cggucuugauuagguuucaguca

SEQ ID NO: 17966 - RNA, 20 nt, Homo sapiens
cugaacuguggcuacugugc

SEQ ID NO: 17967 - RNA, 19 nt, Homo sapiens
gccagcugccucuucuuua

SEQ ID NO: 17968 - RNA, 19 nt, Homo sapiens
gcccccaugccccucugag

SEQ ID NO: 17969 - RNA, 19 nt, Homo sapiens
uaugugucccuugauaaca

SEQ ID NO: 17970 - RNA, 16 nt, Homo sapiens
gauucuaccacuuuug

SEQ ID NO: 17971 - RNA, 18 nt, Homo sapiens
gucuggauguguuuacug

SEQ ID NO: 17972 - RNA, 31 nt, Homo sapiens; identical to SEQ ID NO: 8202

SEQ ID NO: 17973 - RNA, 31 nt, Homo sapiens; identical to SEQ ID NO: 8202

SEQ ID NO: 17974 - RNA, 31 nt, Homo sapiens; identical to SEQ ID NO: 8202

SEQ ID NO: 17975 - RNA, 18 nt, Homo sapiens
cccucucccuccaccucc

SEQ ID NO: 17976 - RNA, 22 nt, Homo sapiens
ccucccugccaccaggcacugc

SEQ ID NO: 17977 - RNA, 19 nt, Homo sapiens
cgcacgguacccgugcugc

SEQ ID NO: 17978 - RNA, 18 nt, Homo sapiens
cuguuuugccuucaccca

SEQ ID NO: 17979 - RNA, 21 nt, Homo sapiens
gcacaagccacggcggacucu

SEQ ID NO: 17980 - RNA, 22 nt, Homo sapiens
gcuacuuuugcuguuuuauuuu

SEQ ID NO: 17981 - RNA, 19 nt, Homo sapiens
gcuugaaaagccgcggaac

SEQ ID NO: 17982 - RNA, 21 nt, Homo sapiens
aucucuccggccuccugguuc

SEQ ID NO: 17983 - RNA, 18 nt, Homo sapiens
ccuccugguucccacaac

SEQ ID NO: 17984 - RNA, 18 nt, Homo sapiens
ccugcaaccuccaccucc

SEQ ID NO: 17985 - RNA, 19 nt, Homo sapiens
cugcaaccuccaccuccca

SEQ ID NO: 17986 - RNA, 18 nt, Homo sapiens
uccaccucccagguucag

SEQ ID NO: 17987 - RNA, 21 nt, Homo sapiens
caagaagaaagugcuaagcug

SEQ ID NO: 17988 - RNA, 21 nt, Homo sapiens
caccaccccucuaccucuuca

SEQ ID NO: 17989 - RNA, 19 nt, Homo sapiens
gccccagaauggaaccuca

SEQ ID NO: 17990 - RNA, 18 nt, Homo sapiens
ggcccgcgccccgagccc

SEQ ID NO: 17991 - RNA, 23 nt, Homo sapiens
ggggauggaggccaggccguggc

SEQ ID NO: 17992 - RNA, 18 nt, Homo sapiens
ucccccaguucgcagugc

SEQ ID NO: 17993 - RNA, 21 nt, Homo sapiens
uggaauuccagucugagguua

SEQ ID NO: 17994 - RNA, 18 nt, Homo sapiens
cauuacaucuggauguac

SEQ ID NO: 17995 - RNA, 18 nt, Homo sapiens
gggcaucuccugcuacuu

SEQ ID NO: 17996 - RNA, 24 nt, Homo sapiens
ucugguauggaauuugaaacccca

SEQ ID NO: 17997 - RNA, 22 nt, Homo sapiens
ugaugugcucugguauggaauu

SEQ ID NO: 17998 - RNA, 21 nt, Homo sapiens
ugggugacaagagugaaacug

SEQ ID NO: 17999 - RNA, 19 nt, Homo sapiens
ugugcucugguauggaauu

SEQ ID NO: 18000 - RNA, 19 nt, Homo sapiens
ccugaggcacccacuuggg

SEQ ID NO: 18001 - RNA, 18 nt, Homo sapiens
cugcaccgucuacccuuc

SEQ ID NO: 18002 - RNA, 17 nt, Homo sapiens
cuguauugaacuuugcu

SEQ ID NO: 18003 - RNA, 18 nt, Homo sapiens
cuuaggcguuuugaccuu

SEQ ID NO: 18004 - RNA, 25 nt, Homo sapiens
gaacuggcuccucgucaugggacug

SEQ ID NO: 18005 - RNA, 19 nt, Homo sapiens
gagauccaaagagaagggc

SEQ ID NO: 18006 - RNA, 17 nt, Homo sapiens
uaauggagcccuaccuc

SEQ ID NO: 18007 - RNA, 20 nt, Homo sapiens
ugcuguuaguuauuuuauug

SEQ ID NO: 18008 - RNA, 21 nt, Homo sapiens
uuuuagcaguaguuuguugua

SEQ ID NO: 18009 - RNA, 18 nt, Homo sapiens
accagaaaauccacuggg

SEQ ID NO: 18010 - RNA, 17 nt, Homo sapiens
acuaucuaaauuugcug

SEQ ID NO: 18011 - RNA, 16 nt, Homo sapiens
agaaaauccacugggg

SEQ ID NO: 18012 - RNA, 19 nt, Homo sapiens
aggaaaaaaaaaugaacag

SEQ ID NO: 18013 - RNA, 19 nt, Homo sapiens
ccacguguguaauguuaua

SEQ ID NO: 18014 - RNA, 19 nt, Homo sapiens
ccuaacaucuuuaaaucgc

SEQ ID NO: 18015 - RNA, 18 nt, Homo sapiens
gagugaaugauugucauu

SEQ ID NO: 18016 - RNA, 18 nt, Homo sapiens
ggaagcuaugugaaauua

SEQ ID NO: 18017 - RNA, 22 nt, Homo sapiens
gguucuucugaaauugcagcag

SEQ ID NO: 18018 - RNA, 23 nt, Homo sapiens
uuagaaauuauuauuaguagcau

SEQ ID NO: 18019 - RNA, 20 nt, Homo sapiens
accagacaaaaucagcuuuc

SEQ ID NO: 18020 - RNA, 25 nt, Homo sapiens
cuccuucggccgccgccgccacugc

SEQ ID NO: 18021 - RNA, 17 nt, Homo sapiens
gcagccuauggcccagg

SEQ ID NO: 18022 - RNA, 19 nt, Homo sapiens
uacaagaacacaguuuuua

SEQ ID NO: 18023 - RNA, 23 nt, Homo sapiens
uacauacaagaacacaguuuuua

SEQ ID NO: 18024 - RNA, 19 nt, Homo sapiens
acucacaggucaccucgca

SEQ ID NO: 18025 - RNA, 18 nt, Homo sapiens
cagacagauaauaacauu

SEQ ID NO: 18026 - RNA, 20 nt, Homo sapiens
ccuccucgccggcacccuca

SEQ ID NO: 18027 - RNA, 18 nt, Homo sapiens
cucggcugcagccuggca

SEQ ID NO: 18028 - RNA, 21 nt, Homo sapiens
uucaaacauuuagcaagcaug

SEQ ID NO: 18029 - RNA, 23 nt, Homo sapiens
gcuugaguucaacauuuguuugg

SEQ ID NO: 18030 - RNA, 20 nt, Homo sapiens
uuuuuucauagacccuaacu

SEQ ID NO: 18031 - RNA, 19 nt, Homo sapiens
ccuuaaaacacacauggga

SEQ ID NO: 18032 - RNA, 19 nt, Homo sapiens
ccuuaaaacacacauggga

SEQ ID NO: 18033 - RNA, 23 nt, Homo sapiens
gguugcuuggggggcguuggccg

SEQ ID NO: 18034 - RNA, 24 nt, Homo sapiens
uguccucagagcaccacacacuga

SEQ ID NO: 18035 - RNA, 19 nt, Homo sapiens
uucugccuuggggaccugc

SEQ ID NO: 18036 - RNA, 20 nt, Homo sapiens
ccacugccccaucucccucu

SEQ ID NO: 18037 - RNA, 21 nt, Homo sapiens
ccccacccccgcccccagcuu

SEQ ID NO: 18038 - RNA, 22 nt, Homo sapiens
ccccugcagggcucagggguca

SEQ ID NO: 18039 - RNA, 21 nt, Homo sapiens
uccuucuuucccuuggacgcc

SEQ ID NO: 18040 - RNA, 21 nt, Homo sapiens
ucuagaugcaacuuuuguucc

SEQ ID NO: 18041 - RNA, 21 nt, Homo sapiens
ugagaccaccuggcgugaggu

SEQ ID NO: 18042 - RNA, 17 nt, Homo sapiens
cugauaauccccgggga

SEQ ID NO: 18043 - RNA, 16 nt, Homo sapiens
gaguuugcugaaaaca

SEQ ID NO: 18044 - RNA, 21 nt, Homo sapiens
cuauaucacaaaaaccugcca

SEQ ID NO: 18045 - RNA, 20 nt, Homo sapiens
gccgcggccgcaccaaggcc

SEQ ID NO: 18046 - RNA, 20 nt, Homo sapiens
aaguuuacucugguuccuaa

SEQ ID NO: 18047 - RNA, 18 nt, Homo sapiens
guucuuuuacuucagugu

SEQ ID NO: 18048 - RNA, 18 nt, Homo sapiens
agguacggcggcgaagug

SEQ ID NO: 18049 - RNA, 22 nt, Homo sapiens
ccugaaguucuuggauuacuuu

SEQ ID NO: 18050 - RNA, 19 nt, Homo sapiens
ggcgaugaacaaauguaau

SEQ ID NO: 18051 - RNA, 18 nt, Homo sapiens
uauuaaucuacuguauca

SEQ ID NO: 18052 - RNA, 23 nt, Homo sapiens
ucaaaccaauuucaaauuauuuu

SEQ ID NO: 18053 - RNA, 27 nt, Homo sapiens
uaagaauaauauuuacugugucagugc

SEQ ID NO: 18054 - RNA, 21 nt, Homo sapiens
acugcagugucccggagccug

SEQ ID NO: 18055 - RNA, 19 nt, Homo sapiens
gcccuccugccuagacuga

SEQ ID NO: 18056 - RNA, 19 nt, Homo sapiens
guucccugcugaagccccu

SEQ ID NO: 18057 - RNA, 17 nt, Homo sapiens
aagagauugagcaagug

SEQ ID NO: 18058 - RNA, 23 nt, Homo sapiens
cacuaaauaaagagauugagcaa

SEQ ID NO: 18059 - RNA, 19 nt, Homo sapiens
cauaaauaucuuccuacca

SEQ ID NO: 18060 - RNA, 20 nt, Homo sapiens
uuguucuuuuguuguuuuug

SEQ ID NO: 18061 - RNA, 20 nt, Homo sapiens
gcaaauaucuugagaacuuc

SEQ ID NO: 18062 - RNA, 17 nt, Homo sapiens
cagcaaccucugccucc

SEQ ID NO: 18063 - RNA, 21 nt, Homo sapiens
cuccuucucuuugaugauuca

SEQ ID NO: 18064 - RNA, 22 nt, Homo sapiens
cucuugacuauugggaguagug

SEQ ID NO: 18065 - RNA, 20 nt, Homo sapiens
uggucaggcuggucuugaac

SEQ ID NO: 18066 - RNA, 17 nt, Homo sapiens
uucuccugcuucagccu

SEQ ID NO: 18067 - RNA, 18 nt, Homo sapiens
ccgccgccuccucauuca

SEQ ID NO: 18068 - RNA, 16 nt, Homo sapiens
auccccuggacuuuca

SEQ ID NO: 18069 - RNA, 22 nt, Homo sapiens
ucugugguuucaucauuccuuc

SEQ ID NO: 18070 - RNA, 22 nt, Homo sapiens
ggacgaccacacgccgcuuccu

SEQ ID NO: 18071 - RNA, 20 nt, Homo sapiens
agguaauauaaaaacaggua

SEQ ID NO: 18072 - RNA, 19 nt, Homo sapiens
auuuauagccaaggauccu

SEQ ID NO: 18073 - RNA, 16 nt, Homo sapiens
cugcaguauuuuucgu

SEQ ID NO: 18074 - RNA, 23 nt, Homo sapiens
ugauaaguaauuacacuggaccu

SEQ ID NO: 18075 - RNA, 17 nt, Homo sapiens
uuucuagaucccauuca

SEQ ID NO: 18076 - RNA, 21 nt, Homo sapiens
uuucuuugacuuccuuaacuu

SEQ ID NO: 18077 - RNA, 22 nt, Homo sapiens
cuucccuuaaaacuuugggcug

SEQ ID NO: 18078 - RNA, 23 nt, Homo sapiens
ugccauuuucagcaauuacggcu

SEQ ID NO: 18079 - RNA, 17 nt, Homo sapiens
ugcugcagaaccacauc

SEQ ID NO: 18080 - RNA, 21 nt, Homo sapiens
ccauaugaagcuagaaaaugc

SEQ ID NO: 18081 - RNA, 17 nt, Homo sapiens
aaaaacaaacaaacaaa

SEQ ID NO: 18082 - RNA, 19 nt, Homo sapiens
aauaggcaauuuuaaaaca

SEQ ID NO: 18083 - RNA, 19 nt, Homo sapiens
auuucagacauaccaguua

SEQ ID NO: 18084 - RNA, 19 nt, Homo sapiens
cuccccgaccuugcugacu

SEQ ID NO: 18085 - RNA, 20 nt, Homo sapiens
guccaagacuggggcccacc

SEQ ID NO: 18086 - RNA, 18 nt, Homo sapiens
guuacugaaagcaaauca

SEQ ID NO: 18087 - RNA, 17 nt, Homo sapiens
cuguucugguucuuuga

SEQ ID NO: 18088 - RNA, 19 nt, Homo sapiens
caccaacuuuuaccuagcc

SEQ ID NO: 18089 - RNA, 21 nt, Homo sapiens
cacugggcaauaaacuuucca

SEQ ID NO: 18090 - RNA, 19 nt, Homo sapiens
ccuaaccuguuucuugcca

SEQ ID NO: 18091 - RNA, 17 nt, Homo sapiens
cggcgcuucggcccggg

SEQ ID NO: 18092 - RNA, 21 nt, Homo sapiens
augaguauuacuaguuacuca

SEQ ID NO: 18093 - RNA, 18 nt, Homo sapiens
ccuauauugcccuuugaa

SEQ ID NO: 18094 - RNA, 24 nt, Homo sapiens
gguauaaucuaagaauuguuuaca

SEQ ID NO: 18095 - RNA, 21 nt, Homo sapiens
uuuccuauauugcccuuugaa

SEQ ID NO: 18096 - RNA, 20 nt, Homo sapiens
gcccuguauuucuccaucuc

SEQ ID NO: 18097 - RNA, 19 nt, Homo sapiens
uccuugggcuauauuuucu

SEQ ID NO: 18098 - RNA, 18 nt, Homo sapiens
ugcccaagacucaccucc

SEQ ID NO: 18099 - RNA, 21 nt, Homo sapiens
uugaaucugcacuuaucccca

SEQ ID NO: 18100 - RNA, 21 nt, Homo sapiens
auuuuuaaaaucagccagcuc

SEQ ID NO: 18101 - RNA, 19 nt, Homo sapiens
ucccugucccuagcaacca

SEQ ID NO: 18102 - RNA, 21 nt, Homo sapiens
uccugaacuuugguucauaaa

SEQ ID NO: 18103 - RNA, 24 nt, Homo sapiens
ucugucuaguuccaaaacauuuuu

SEQ ID NO: 18104 - RNA, 20 nt, Homo sapiens
ugaaacccuguagccauuaa

SEQ ID NO: 18105 - RNA, 18 nt, Homo sapiens
aacacauacauuuaugca

SEQ ID NO: 18106 - RNA, 24 nt, Homo sapiens
aacccagccucauucagauacaga

SEQ ID NO: 18107 - RNA, 18 nt, Homo sapiens
caaauacuuagcaccaua

SEQ ID NO: 18108 - RNA, 24 nt, Homo sapiens
cggcggugauccgagcgagcggcc

SEQ ID NO: 18109 - RNA, 20 nt, Homo sapiens
cagucuuuaugcaaaugaaa

SEQ ID NO: 18110 - RNA, 18 nt, Homo sapiens
uaaaaacaaacaaacaaa

SEQ ID NO: 18111 - RNA, 17 nt, Homo sapiens
uugcuucuguuacugcc

SEQ ID NO: 18112 - RNA, 18 nt, Homo sapiens
ccaggcagcugcgccccc

SEQ ID NO: 18113 - RNA, 19 nt, Homo sapiens
ugaacgaacacaugaugga

SEQ ID NO: 18114 - RNA, 19 nt, Homo sapiens
aacugaaugaagccauauu

SEQ ID NO: 18115 - RNA, 24 nt, Homo sapiens
aauucuugaugagcaauaaugaua

SEQ ID NO: 18116 - RNA, 21 nt, Homo sapiens
cucugcaacacuugcagaaca

SEQ ID NO: 18117 - RNA, 19 nt, Homo sapiens
guuguacuuaaguguguaa

SEQ ID NO: 18118 - RNA, 19 nt, Homo sapiens
ucaaaugaaaauucuuuau

SEQ ID NO: 18119 - RNA, 20 nt, Homo sapiens
uucauuauuaccagcaguua

SEQ ID NO: 18120 - RNA, 22 nt, Homo sapiens
aagugaaauaacauuucagcua

SEQ ID NO: 18121 - RNA, 17 nt, Homo sapiens
auuuuacauuugccuaa

SEQ ID NO: 18122 - RNA, 19 nt, Homo sapiens
ccagaacagagcagagcca

SEQ ID NO: 18123 - RNA, 20 nt, Homo sapiens
cuugccuuuauuuuacagug

SEQ ID NO: 18124 - RNA, 22 nt, Homo sapiens
aauagaugccgauucugaaaca

SEQ ID NO: 18125 - RNA, 20 nt, Homo sapiens
gugauauuggaaauagccua

SEQ ID NO: 18126 - RNA, 19 nt, Homo sapiens
uuccagaaaaaucuuccag

SEQ ID NO: 18127 - RNA, 21 nt, Homo sapiens
gggaacaguggcggcuucggc

SEQ ID NO: 18128 - RNA, 22 nt, Homo sapiens
ugacaaacauggagaaaccuca

SEQ ID NO: 18129 - RNA, 24 nt, Homo sapiens
accugugggaucguugccugguuu

SEQ ID NO: 18130 - RNA, 21 nt, Homo sapiens
cacccuuccuauucuuuuuca

SEQ ID NO: 18131 - RNA, 21 nt, Homo sapiens
cccagaacuuccuccccacaa

SEQ ID NO: 18132 - RNA, 20 nt, Homo sapiens
ucuuuuucauucuucuugca

SEQ ID NO: 18133 - RNA, 22 nt, Homo sapiens
caagauuuuuauauguucaguu

SEQ ID NO: 18134 - RNA, 18 nt, Homo sapiens
ugcaugucugcucugaua

SEQ ID NO: 18135 - RNA, 21 nt, Homo sapiens
uucuucucgucucccacccca

SEQ ID NO: 18136 - RNA, 22 nt, Homo sapiens
gcacuaugugcauuugcuguca

SEQ ID NO: 18137 - RNA, 18 nt, Homo sapiens
ugguccuguguugcuuuu

SEQ ID NO: 18138 - RNA, 18 nt, Homo sapiens
ucuugagaccuuuauugu

SEQ ID NO: 18139 - RNA, 24 nt, Homo sapiens
aaauaacuuuugauaauguuuacu

SEQ ID NO: 18140 - RNA, 18 nt, Homo sapiens
gcaagaauaguaucugcu

SEQ ID NO: 18141 - RNA, 23 nt, Homo sapiens
guucuuuacaggaguuuaaaacg

SEQ ID NO: 18142 - RNA, 20 nt, Homo sapiens
uagggaaacauuucaacagc

SEQ ID NO: 18143 - RNA, 21 nt, Homo sapiens
ucaaguguauuuucuguaaca

SEQ ID NO: 18144 - RNA, 20 nt, Homo sapiens
ugauugcacuauuuuguuuu

SEQ ID NO: 18145 - RNA, 20 nt, Homo sapiens
auaaugaaugcugcauauua

SEQ ID NO: 18146 - RNA, 19 nt, Homo sapiens
caccaucaucaaacacuca

SEQ ID NO: 18147 - RNA, 20 nt, Homo sapiens
gaaguugcccuuaaccacua

SEQ ID NO: 18148 - RNA, 21 nt, Homo sapiens
gauuuauuuuuuucccagugc

SEQ ID NO: 18149 - RNA, 19 nt, Homo sapiens
augucuucaacauaccaaa

SEQ ID NO: 18150 - RNA, 20 nt, Homo sapiens
aaauccaucugcucaugaag

SEQ ID NO: 18151 - RNA, 22 nt, Homo sapiens
aggagcugaccaggagcacacu

SEQ ID NO: 18152 - RNA, 23 nt, Homo sapiens
ccaauaguuacuuuucugguccu

SEQ ID NO: 18153 - RNA, 20 nt, Homo sapiens
gaaaggaaugagugugugac

SEQ ID NO: 18154 - RNA, 19 nt, Homo sapiens
uaacuguguuggaugagug

SEQ ID NO: 18155 - RNA, 18 nt, Homo sapiens
aacccaucucaccugaca

SEQ ID NO: 18156 - RNA, 17 nt, Homo sapiens
acuacaaugauucugaa

SEQ ID NO: 18157 - RNA, 18 nt, Homo sapiens
agcaccggguggcagaug

SEQ ID NO: 18158 - RNA, 22 nt, Homo sapiens
auguagagcaaguugaaaaugg

SEQ ID NO: 18159 - RNA, 18 nt, Homo sapiens
gccaugaaacuuugccuu

SEQ ID NO: 18160 - RNA, 19 nt, Homo sapiens
aaaacauucuaucuacuga

SEQ ID NO: 18161 - RNA, 27 nt, Homo sapiens
aaccccauaauuagauccauuaauuua

SEQ ID NO: 18162 - RNA, 18 nt, Homo sapiens
aagagaccacccauauca

SEQ ID NO: 18163 - RNA, 21 nt, Homo sapiens
augccaaggaccuuuugcugc

SEQ ID NO: 18164 - RNA, 19 nt, Homo sapiens
guaaguuuuauaaggucug

SEQ ID NO: 18165 - RNA, 21 nt, Homo sapiens
uagaggauuaguaagaucucu

SEQ ID NO: 18166 - RNA, 22 nt, Homo sapiens
ucuaacuguauauuuguaugau

SEQ ID NO: 18167 - RNA, 22 nt, Homo sapiens
ccaagacugggacuauucccca

SEQ ID NO: 18168 - RNA, 20 nt, Homo sapiens
ccagcccgagcggagccgga

SEQ ID NO: 18169 - RNA, 20 nt, Homo sapiens
agccuaagagcuaaggcagu

SEQ ID NO: 18170 - RNA, 18 nt, Homo sapiens
gauccugaaacaugcggg

SEQ ID NO: 18171 - RNA, 19 nt, Homo sapiens
guggucuuucuuguuuuua

SEQ ID NO: 18172 - RNA, 17 nt, Homo sapiens
uccugaaacaugcggga

SEQ ID NO: 18173 - RNA, 18 nt, Homo sapiens
caaauccaagauucuuua

SEQ ID NO: 18174 - RNA, 22 nt, Homo sapiens
gugucuggaauugguggguucu

SEQ ID NO: 18175 - RNA, 21 nt, Homo sapiens
uccuugggagucgcugugaua

SEQ ID NO: 18176 - RNA, 21 nt, Homo sapiens
ugucucuccucacacuccagc

SEQ ID NO: 18177 - RNA, 17 nt, Homo sapiens
aauaaggauccuuuuua

SEQ ID NO: 18178 - RNA, 18 nt, Homo sapiens
ggaaguuaaaauaucucu

SEQ ID NO: 18179 - RNA, 22 nt, Homo sapiens
guuagauaaaaugguaaaaugu

SEQ ID NO: 18180 - RNA, 20 nt, Homo sapiens
aauuacacuguacuacccaa

SEQ ID NO: 18181 - RNA, 21 nt, Homo sapiens
gucucagaccaucuugugaga

SEQ ID NO: 18182 - RNA, 20 nt, Homo sapiens
uuguuuuauuauagcaauua

SEQ ID NO: 18183 - RNA, 24 nt, Homo sapiens
aaaacggguucaaaccccacuucu

SEQ ID NO: 18184 - RNA, 20 nt, Homo sapiens
gcuuauuguuaucugugaua

SEQ ID NO: 18185 - RNA, 19 nt, Homo sapiens
ggacuucuuauuuacugua

SEQ ID NO: 18186 - RNA, 21 nt, Homo sapiens
aaagaacuucaucauuguaca

SEQ ID NO: 18187 - RNA, 19 nt, Homo sapiens
caguaguuccgauuuuuuc

SEQ ID NO: 18188 - RNA, 18 nt, Homo sapiens
guguuagguauuauuuga

SEQ ID NO: 18189 - RNA, 19 nt, Homo sapiens
ugcuguuaguugugcauua

SEQ ID NO: 18190 - RNA, 17 nt, Homo sapiens
acuugguggcaucagca

SEQ ID NO: 18191 - RNA, 19 nt, Homo sapiens
cgcgcggcgccugagcgcg

SEQ ID NO: 18192 - RNA, 19 nt, Homo sapiens
cucugcucccucuuccucu

SEQ ID NO: 18193 - RNA, 27 nt, Homo sapiens
ucaaacccccaccuuccaguucccuca

SEQ ID NO: 18194 - RNA, 20 nt, Homo sapiens
uccucuagcugagagugggc

SEQ ID NO: 18195 - RNA, 16 nt, Homo sapiens
ccgugccggcuggcca

SEQ ID NO: 18196 - RNA, 19 nt, Homo sapiens
accguccucacugcgccac

SEQ ID NO: 18197 - RNA, 24 nt, Homo sapiens
uccugcuucccacgcugccaucuc

SEQ ID NO: 18198 - RNA, 19 nt, Homo sapiens
ugaccuuccugcuucccac

SEQ ID NO: 18199 - RNA, 16 nt, Homo sapiens
ugagugccaggugcau

SEQ ID NO: 18200 - RNA, 23 nt, Homo sapiens
uguccagggcaggguccugggaa

SEQ ID NO: 18201 - RNA, 18 nt, Homo sapiens
uuagggauuaccauuucc

SEQ ID NO: 18202 - RNA, 18 nt, Homo sapiens
ggaaaacucagauuccaa

SEQ ID NO: 18203 - RNA, 19 nt, Homo sapiens
caagcauuagcaauauuaa

SEQ ID NO: 18204 - RNA, 19 nt, Homo sapiens
gauggaaacuuuucuuacc

SEQ ID NO: 18205 - RNA, 20 nt, Homo sapiens
uacauauaguuacugugaca

SEQ ID NO: 18206 - RNA, 20 nt, Homo sapiens
ucauuuucugauucucauca

SEQ ID NO: 18207 - RNA, 20 nt, Homo sapiens
aaggagugggaaauacccuu

SEQ ID NO: 18208 - RNA, 23 nt, Homo sapiens
aagucuaauuuugguuccuaaca

SEQ ID NO: 18209 - RNA, 23 nt, Homo sapiens
ccaaaacacuugaaugugccuca

SEQ ID NO: 18210 - RNA, 18 nt, Homo sapiens
gcaggaggaacaacauca

SEQ ID NO: 18211 - RNA, 26 nt, Homo sapiens
ugagugggugccugugguuggagcug

SEQ ID NO: 18212 - RNA, 20 nt, Homo sapiens
ugguuccaagcauggaacua

SEQ ID NO: 18213 - RNA, 19 nt, Homo sapiens
aagcaauucuccugccuca

SEQ ID NO: 18214 - RNA, 18 nt, Homo sapiens
aaucaugugcuucauaga

SEQ ID NO: 18215 - RNA, 21 nt, Homo sapiens
aggcacccaccacaucuggcu

SEQ ID NO: 18216 - RNA, 22 nt, Homo sapiens
aucuuggcucacugcaaccucu

SEQ ID NO: 18217 - RNA, 19 nt, Homo sapiens
cugcaaccuccgccuccca

SEQ ID NO: 18218 - RNA, 18 nt, Homo sapiens
uccgccucccagguucaa

SEQ ID NO: 18219 - RNA, 18 nt, Homo sapiens
ucuaccuccuggguucaa

SEQ ID NO: 18220 - RNA, 25 nt, Homo sapiens
agagccgcccuaucagauuaucuua

SEQ ID NO: 18221 - RNA, 22 nt, Homo sapiens
acaaaagauaauuggaaacaug

SEQ ID NO: 18222 - RNA, 26 nt, Homo sapiens
uaccucauccucuccacagugugaga

SEQ ID NO: 18223 - RNA, 19 nt, Homo sapiens
uccucuccacagugugaga

SEQ ID NO: 18224 - RNA, 24 nt, Homo sapiens
ugggcauuuguuugaaauuagaua

SEQ ID NO: 18225 - RNA, 21 nt, Homo sapiens
acuuguauggagaacucacca

SEQ ID NO: 18226 - RNA, 21 nt, Homo sapiens
ggaauuauuucugacacauga

SEQ ID NO: 18227 - RNA, 19 nt, Homo sapiens
aaauagugaguaguauggu

SEQ ID NO: 18228 - RNA, 16 nt, Homo sapiens
auguaucaaggagcgu

SEQ ID NO: 18229 - RNA, 25 nt, Homo sapiens
ggaaacaaaagugaauaccauauug

SEQ ID NO: 18230 - RNA, 21 nt, Homo sapiens
acccagagaggccaagauccc

SEQ ID NO: 18231 - RNA, 18 nt, Homo sapiens
cugucuccucuccauccc

SEQ ID NO: 18232 - RNA, 15 nt, Homo sapiens
ggcuccccugcuccu

SEQ ID NO: 18233 - RNA, 21 nt, Homo sapiens
guccaccccuccucaacaucg

SEQ ID NO: 18234 - RNA, 21 nt, Homo sapiens
ugcccaggcacgccauuucca

SEQ ID NO: 18235 - RNA, 22 nt, Homo sapiens
aaggggggaccagaauucccca

SEQ ID NO: 18236 - RNA, 20 nt, Homo sapiens
augacauaacuacacaguua

SEQ ID NO: 18237 - RNA, 19 nt, Homo sapiens
ccaucuccacuuccucccc

SEQ ID NO: 18238 - RNA, 22 nt, Homo sapiens
cuuccucccccucgaguguaca

SEQ ID NO: 18239 - RNA, 18 nt, Homo sapiens
gacauuuucuagcuacuu

SEQ ID NO: 18240 - RNA, 18 nt, Homo sapiens
uuguucaaucacuaugaa

SEQ ID NO: 18241 - RNA, 25 nt, Homo sapiens
cuacagccugacccaugggcaccgu

SEQ ID NO: 18242 - RNA, 18 nt, Homo sapiens
acauuauauuggaaugaa

SEQ ID NO: 18243 - RNA, 21 nt, Homo sapiens
augcaucugccauuuuccuca

SEQ ID NO: 18244 - RNA, 18 nt, Homo sapiens
uagucucugcauaccuca

SEQ ID NO: 18245 - RNA, 21 nt, Homo sapiens
ugcaaauucuguaauuucacu

SEQ ID NO: 18246 - RNA, 21 nt, Homo sapiens
uugaucacuuuucaacuucca

SEQ ID NO: 18247 - RNA, 19 nt, Homo sapiens
auuucagauauacagacug

SEQ ID NO: 18248 - RNA, 25 nt, Homo sapiens
ggauuucacuugucaacuuacccca

SEQ ID NO: 18249 - RNA, 20 nt, Homo sapiens
acuaaaauugaaaaauccac

SEQ ID NO: 18250 - RNA, 23 nt, Homo sapiens
agagggugagguucagcacauca

SEQ ID NO: 18251 - RNA, 22 nt, Homo sapiens
ccaccucuuaacaucucuuuca

SEQ ID NO: 18252 - RNA, 18 nt, Homo sapiens
ccaguacugcagaucuca

SEQ ID NO: 18253 - RNA, 22 nt, Homo sapiens
cuggccuucccccaccacagca

SEQ ID NO: 18254 - RNA, 23 nt, Homo sapiens
gacaggguaucacacauuucuca

SEQ ID NO: 18255 - RNA, 18 nt, Homo sapiens
gcagacucagcugcaauu

SEQ ID NO: 18256 - RNA, 18 nt, Homo sapiens
gcccguaucuuucucuuc

SEQ ID NO: 18257 - RNA, 26 nt, Homo sapiens
gcuccucauugcucccaucugccucu

SEQ ID NO: 18258 - RNA, 19 nt, Homo sapiens
ucccugccugcagccugca

SEQ ID NO: 18259 - RNA, 21 nt, Homo sapiens
ucucuuucacuuugguuuugc

SEQ ID NO: 18260 - RNA, 19 nt, Homo sapiens
ugaaugggucucaaagacu

SEQ ID NO: 18261 - RNA, 16 nt, Homo sapiens
ggcgcccugccuuggc

SEQ ID NO: 18262 - RNA, 21 nt, Homo sapiens
ggagagugacggcggcccggc

SEQ ID NO: 18263 - RNA, 17 nt, Homo sapiens
auccacuucuucaagcu

SEQ ID NO: 18264 - RNA, 18 nt, Homo sapiens
caaaauggcagugucuua

SEQ ID NO: 18265 - RNA, 20 nt, Homo sapiens
cccucaggcguccaucugau

SEQ ID NO: 18266 - RNA, 20 nt, Homo sapiens
ccuauggaauccaguucuga

SEQ ID NO: 18267 - RNA, 22 nt, Homo sapiens
ccuugauuuuaagcccugugaa

SEQ ID NO: 18268 - RNA, 21 nt, Homo sapiens
ccuuuuuauccccauagcuuu

SEQ ID NO: 18269 - RNA, 16 nt, Homo sapiens
cucccagguagcacug

SEQ ID NO: 18270 - RNA, 24 nt, Homo sapiens
gcccagaaaaaugugcagcuugac

SEQ ID NO: 18271 - RNA, 22 nt, Homo sapiens
ucagggaaagccaggcccaccu

SEQ ID NO: 18272 - RNA, 22 nt, Homo sapiens
ucccagaaucugccccucacca

SEQ ID NO: 18273 - RNA, 18 nt, Homo sapiens
uccccaccaccaccagca

SEQ ID NO: 18274 - RNA, 22 nt, Homo sapiens
uucuggaggggagggucuggag

SEQ ID NO: 18275 - RNA, 18 nt, Homo sapiens
uugggcagaugacuucac

SEQ ID NO: 18276 - RNA, 20 nt, Homo sapiens
aucucacuucugagaacgaa

SEQ ID NO: 18277 - RNA, 20 nt, Homo sapiens
ccccaccucuucccugccgc

SEQ ID NO: 18278 - RNA, 19 nt, Homo sapiens
guggcugucccggacccca

SEQ ID NO: 18279 - RNA, 18 nt, Homo sapiens
ucggaucccgagcgcggg

SEQ ID NO: 18280 - RNA, 17 nt, Homo sapiens
cccucugucuacucccu

SEQ ID NO: 18281 - RNA, 16 nt, Homo sapiens
ugugaacuucacuuug

SEQ ID NO: 18282 - RNA, 18 nt, Homo sapiens
accagguccccacugagg

SEQ ID NO: 18283 - RNA, 19 nt, Homo sapiens
ccagcugacugagcccccu

SEQ ID NO: 18284 - RNA, 24 nt, Homo sapiens
gcuaaaucuaguggguucugagga

SEQ ID NO: 18285 - RNA, 21 nt, Homo sapiens
cgagaucaugcgcggguuugg

SEQ ID NO: 18286 - RNA, 18 nt, Homo sapiens
aaaacauguauauacauu

SEQ ID NO: 18287 - RNA, 17 nt, Homo sapiens
ccccaccucccccugca

SEQ ID NO: 18288 - RNA, 21 nt, Homo sapiens
ccauccucgucacuugggacc

SEQ ID NO: 18289 - RNA, 21 nt, Homo sapiens
cccagggaagccucccagcgg

SEQ ID NO: 18290 - RNA, 23 nt, Homo sapiens
gcucucccuccagggcugcugag

SEQ ID NO: 18291 - RNA, 20 nt, Homo sapiens
augaaaguaauaugaacaca

SEQ ID NO: 18292 - RNA, 17 nt, Homo sapiens
acuuugacuucuggucu

SEQ ID NO: 18293 - RNA, 20 nt, Homo sapiens
ccaggauugcugccgcauuc

SEQ ID NO: 18294 - RNA, 21 nt, Homo sapiens
cccaccuggaggguuugggag

SEQ ID NO: 18295 - RNA, 20 nt, Homo sapiens
uguuaaagcugcucgauucc

SEQ ID NO: 18296 - RNA, 19 nt, Homo sapiens
aaacagauuuagggauuga

SEQ ID NO: 18297 - RNA, 17 nt, Homo sapiens
acagauuuagggauuga

SEQ ID NO: 18298 - RNA, 22 nt, Homo sapiens
cgggguuuugcagagcucaguu

SEQ ID NO: 18299 - RNA, 17 nt, Homo sapiens
ugcccgcuaacacagca

SEQ ID NO: 18300 - RNA, 19 nt, Homo sapiens
aggaaaaaaacugugcaag

SEQ ID NO: 18301 - RNA, 19 nt, Homo sapiens
aguagacauucagauccag

SEQ ID NO: 18302 - RNA, 19 nt, Homo sapiens
ucgccuucacccccacccc

SEQ ID NO: 18303 - RNA, 23 nt, Homo sapiens
uggaugggauuauguggaaacua

SEQ ID NO: 18304 - RNA, 17 nt, Homo sapiens
aaacaauacagcauuaa

SEQ ID NO: 18305 - RNA, 18 nt, Homo sapiens
aaugcacaaagcuguagu

SEQ ID NO: 18306 - RNA, 16 nt, Homo sapiens
agcccaugauaccuua

SEQ ID NO: 18307 - RNA, 21 nt, Homo sapiens
aucuuucagccacagaaucua

SEQ ID NO: 18308 - RNA, 22 nt, Homo sapiens
auguugggggaaaauuaacuca

SEQ ID NO: 18309 - RNA, 19 nt, Homo sapiens
caccagaacuaauuugcua

SEQ ID NO: 18310 - RNA, 18 nt, Homo sapiens
cauucagcaagcuccuga

SEQ ID NO: 18311 - RNA, 17 nt, Homo sapiens
cucuuacuaaaauguua

SEQ ID NO: 18312 - RNA, 18 nt, Homo sapiens
gggaaacauucugugaca

SEQ ID NO: 18313 - RNA, 21 nt, Homo sapiens
ugaccuuaauaccccaagcuu

SEQ ID NO: 18314 - RNA, 24 nt, Homo sapiens
ugcaaccucugccuccuggauuca

SEQ ID NO: 18315 - RNA, 23 nt, Homo sapiens
uggagugcaguagugcgaucuca

SEQ ID NO: 18316 - RNA, 20 nt, Homo sapiens
uggaugggcuccauuaaaac

SEQ ID NO: 18317 - RNA, 17 nt, Homo sapiens
uguuugaaacaauacag

SEQ ID NO: 18318 - RNA, 17 nt, Homo sapiens
uucgcugacgccgggca

SEQ ID NO: 18319 - RNA, 19 nt, Homo sapiens
acaaauguaaaaaacgugg

SEQ ID NO: 18320 - RNA, 17 nt, Homo sapiens
agaaaauauaagccuuu

SEQ ID NO: 18321 - RNA, 22 nt, Homo sapiens
cagaguaauauauaggguuuac

SEQ ID NO: 18322 - RNA, 22 nt, Homo sapiens
gcccagggucacugggaacucu

SEQ ID NO: 18323 - RNA, 23 nt, Homo sapiens
gccugagucucuccugccugccu

SEQ ID NO: 18324 - RNA, 18 nt, Homo sapiens
ucauacuggagagaaacu

SEQ ID NO: 18325 - RNA, 21 nt, Homo sapiens
ucuccugccugccuuauccuu

SEQ ID NO: 18326 - RNA, 24 nt, Homo sapiens
uuuguagauguauaauuacauuca

SEQ ID NO: 18327 - RNA, 19 nt, Homo sapiens
aacacuuuuuggacuuugu

SEQ ID NO: 18328 - RNA, 20 nt, Homo sapiens
auguccucagcgacauuucu

SEQ ID NO: 18329 - RNA, 18 nt, Homo sapiens
cuauguuuguauauuuuu

SEQ ID NO: 18330 - RNA, 19 nt, Homo sapiens
cucccgcugcuuucauuuu

SEQ ID NO: 18331 - RNA, 25 nt, Homo sapiens
gaggccuaaguggcaacauggcaua

SEQ ID NO: 18332 - RNA, 23 nt, Homo sapiens
uagauggaaaaguguagggacug

SEQ ID NO: 18333 - RNA, 19 nt, Homo sapiens
aagcaauucuccugccuca

SEQ ID NO: 18334 - RNA, 18 nt, Homo sapiens
aaucaugugcuucauaga

SEQ ID NO: 18335 - RNA, 21 nt, Homo sapiens
aggcacccaccacaucuggcu

SEQ ID NO: 18336 - RNA, 22 nt, Homo sapiens
aucuuggcucacugcaaccucu

SEQ ID NO: 18337 - RNA, 19 nt, Homo sapiens
cugcaaccuccgccuccca

SEQ ID NO: 18338 - RNA, 18 nt, Homo sapiens
uccgccucccagguucaa

SEQ ID NO: 18339 - RNA, 18 nt, Homo sapiens
ucuaccuccuggguucaa

SEQ ID NO: 18340 - RNA, 23 nt, Homo sapiens
cuuuuugaaagggagagaauuga

SEQ ID NO: 18341 - RNA, 23 nt, Homo sapiens
uuaaacuugccuaauaccuuucu

SEQ ID NO: 18342 - RNA, 22 nt, Homo sapiens
acuugacgaggcucuuugguuu

SEQ ID NO: 18343 - RNA, 18 nt, Homo sapiens
ugaagaagaagcuugaug

SEQ ID NO: 18344 - RNA, 26 nt, Homo sapiens
aauaauucauuucugggcuaauuuca

SEQ ID NO: 18345 - RNA, 23 nt, Homo sapiens
cacgugagcugaucguggcugca

SEQ ID NO: 18346 - RNA, 18 nt, Homo sapiens
uugagccauuccuaaaga

SEQ ID NO: 18347 - RNA, 22 nt, Homo sapiens
uggguggguacuagggagacug

SEQ ID NO: 18348 - RNA, 18 nt, Homo sapiens
acacagacacguaauacc

SEQ ID NO: 18349 - RNA, 23 nt, Homo sapiens
accaucacauuuggaaagugauc

SEQ ID NO: 18350 - RNA, 24 nt, Homo sapiens
agcccccauguucucugcacuguu

SEQ ID NO: 18351 - RNA, 21 nt, Homo sapiens
auguuucaauaaaccuuuuga

SEQ ID NO: 18352 - RNA, 19 nt, Homo sapiens
ccucaauccccgcaaacua

SEQ ID NO: 18353 - RNA, 18 nt, Homo sapiens
agaggagaugaauuaugg

SEQ ID NO: 18354 - RNA, 18 nt, Homo sapiens
cugaaccucucaggauca

SEQ ID NO: 18355 - RNA, 18 nt, Homo sapiens
agccccuccucacacaua

SEQ ID NO: 18356 - RNA, 21 nt, Homo sapiens
agcugugguccucugauucca

SEQ ID NO: 18357 - RNA, 20 nt, Homo sapiens
cauacauaugcacgcacaca

SEQ ID NO: 18358 - RNA, 20 nt, Homo sapiens
cgcacaugcacacauacaca

SEQ ID NO: 18359 - RNA, 20 nt, Homo sapiens
gccucugcccuucaggagca

SEQ ID NO: 18360 - RNA, 19 nt, Homo sapiens
ggguggggcguuacugcca

SEQ ID NO: 18361 - RNA, 19 nt, Homo sapiens
uggagaugggagacagagg

SEQ ID NO: 18362 - RNA, 18 nt, Homo sapiens
auccuacccauugccacu

SEQ ID NO: 18363 - RNA, 21 nt, Homo sapiens
gagaaauaccuuuagagguga

SEQ ID NO: 18364 - RNA, 18 nt, Homo sapiens
ugaauaucaugaacucuc

SEQ ID NO: 18365 - RNA, 18 nt, Homo sapiens
acuguauuccugcucuga

SEQ ID NO: 18366 - RNA, 15 nt, Homo sapiens
augacagaccaguua

SEQ ID NO: 18367 - RNA, 22 nt, Homo sapiens
auuacguuuucauuuuuucuga

SEQ ID NO: 18368 - RNA, 19 nt, Homo sapiens
cccacucucucucaucucu

SEQ ID NO: 18369 - RNA, 30 nt, Homo sapiens
cguauguguggguguguguguauuugggug

SEQ ID NO: 18370 - RNA, 18 nt, Homo sapiens
cuaggauaaaucacuuuu

SEQ ID NO: 18371 - RNA, 16 nt, Homo sapiens
uauaaagauugugcag

SEQ ID NO: 18372 - RNA, 18 nt, Homo sapiens
uauacacauguguagugu

SEQ ID NO: 18373 - RNA, 20 nt, Homo sapiens
uccaaagauguucuagaucu

SEQ ID NO: 18374 - RNA, 19 nt, Homo sapiens
ucuaacuaucaaauugugu

SEQ ID NO: 18375 - RNA, 19 nt, Homo sapiens
ucucuucccccuccccccu

SEQ ID NO: 18376 - RNA, 19 nt, Homo sapiens
ugaaugagaccucugauag

SEQ ID NO: 18377 - RNA, 20 nt, Homo sapiens
gugccaggagucaaggccug

SEQ ID NO: 18378 - RNA, 18 nt, Homo sapiens
ccuuuaacccgugauucc

SEQ ID NO: 18379 - RNA, 19 nt, Homo sapiens
ggaugugauaaaaacaucc

SEQ ID NO: 18380 - RNA, 17 nt, Homo sapiens
caaacuaguccaguuua

SEQ ID NO: 18381 - RNA, 20 nt, Homo sapiens
gcacucaccuuccgauuuua

SEQ ID NO: 18382 - RNA, 18 nt, Homo sapiens
ugccaccaauuuguauua

SEQ ID NO: 18383 - RNA, 16 nt, Homo sapiens
uguuugccuggauaaa

SEQ ID NO: 18384 - RNA, 18 nt, Homo sapiens
uugcucccacugguuuaa

SEQ ID NO: 18385 - RNA, 23 nt, Homo sapiens
acacagggcuaagacuugaacca

SEQ ID NO: 18386 - RNA, 21 nt, Homo sapiens
cauacuuacuccgguugggug

SEQ ID NO: 18387 - RNA, 19 nt, Homo sapiens
caugcuccugcauacuccu

SEQ ID NO: 18388 - RNA, 22 nt, Homo sapiens
ugcccaagcccuuccuccccuc

SEQ ID NO: 18389 - RNA, 23 nt, Homo sapiens
agcaguccauuucuaccaaggca

SEQ ID NO: 18390 - RNA, 19 nt, Homo sapiens
agcugagcagcuuuucucc

SEQ ID NO: 18391 - RNA, 20 nt, Homo sapiens
ccaguggaggaguucaugga

SEQ ID NO: 18392 - RNA, 18 nt, Homo sapiens
ugcccaaaacugucaucc

SEQ ID NO: 18393 - RNA, 18 nt, Homo sapiens
uguuaaaaugagcauuga

SEQ ID NO: 18394 - RNA, 20 nt, Homo sapiens
acuucaucaucuugauaagu

SEQ ID NO: 18395 - RNA, 20 nt, Homo sapiens
ccuuuuuaagacuuuugacc

SEQ ID NO: 18396 - RNA, 18 nt, Homo sapiens
gcugaauaacagcucuuu

SEQ ID NO: 18397 - RNA, 18 nt, Homo sapiens
uaggaaagcuauuucaac

SEQ ID NO: 18398 - RNA, 21 nt, Homo sapiens
uugaccauaguguuuuccagu

SEQ ID NO: 18399 - RNA, 21 nt, Homo sapiens
uguaacaagcucauaggguau

SEQ ID NO: 18400 - RNA, 19 nt, Homo sapiens
gcaaaaugagcuuggguuu

SEQ ID NO: 18401 - RNA, 22 nt, Homo sapiens
gguaaacccuuaaaucuugcca

SEQ ID NO: 18402 - RNA, 23 nt, Homo sapiens
ugcugcucacugagaacccagcu

SEQ ID NO: 18403 - RNA, 20 nt, Homo sapiens
cacaacuagaaagugucacc

SEQ ID NO: 18404 - RNA, 23 nt, Homo sapiens
gcagaaucuaaagaaagcauuga

SEQ ID NO: 18405 - RNA, 20 nt, Homo sapiens
cccuuccuccccccguguca

SEQ ID NO: 18406 - RNA, 18 nt, Homo sapiens
ggaagcggcggcggcggc

SEQ ID NO: 18407 - RNA, 22 nt, Homo sapiens
ucauaaucauuucugcugugca

SEQ ID NO: 18408 - RNA, 19 nt, Homo sapiens
ucucucucucuuacucuua

SEQ ID NO: 18409 - RNA, 24 nt, Homo sapiens
aguaagugguucuuauguguuuug

SEQ ID NO: 18410 - RNA, 20 nt, Homo sapiens
ugugccaaaugauucggaua

SEQ ID NO: 18411 - RNA, 19 nt, Homo sapiens
uucuccugcucugcagcuu

SEQ ID NO: 18412 - RNA, 20 nt, Homo sapiens
aacuaacaacugacaaauca

SEQ ID NO: 18413 - RNA, 17 nt, Homo sapiens
acauggcuggguucaug

SEQ ID NO: 18414 - RNA, 16 nt, Homo sapiens
aguaucacagcauuaa

SEQ ID NO: 18415 - RNA, 16 nt, Homo sapiens
aguaucacagcauuaa

SEQ ID NO: 18416 - RNA, 19 nt, Homo sapiens
gcagaggaauguuauugua

SEQ ID NO: 18417 - RNA, 18 nt, Homo sapiens
ucccaauugcuguuucag

SEQ ID NO: 18418 - RNA, 21 nt, Homo sapiens
uuaaaauggcagucuacauca

SEQ ID NO: 18419 - RNA, 18 nt, Homo sapiens
aaauagugaauaaggugc

SEQ ID NO: 18420 - RNA, 15 nt, Homo sapiens
gagcugccugccaaa

SEQ ID NO: 18421 - RNA, 21 nt, Homo sapiens
uguugacccucaaagggcaua

SEQ ID NO: 18422 - RNA, 23 nt, Homo sapiens
acuugaaucugauaggccggccu

SEQ ID NO: 18423 - RNA, 18 nt, Homo sapiens
ccaaaaaagacaugucac

SEQ ID NO: 18424 - RNA, 25 nt, Homo sapiens
gcuuuggaaauuauugccucugaua

SEQ ID NO: 18425 - RNA, 16 nt, Homo sapiens
uugaugggacaugaag

SEQ ID NO: 18426 - RNA, 22 nt, Homo sapiens
aaucuuucauaacuacaucuca

SEQ ID NO: 18427 - RNA, 21 nt, Homo sapiens
gcuuuagucugacauaaucua

SEQ ID NO: 18428 - RNA, 19 nt, Homo sapiens
ucauugcacuuuggucaga

SEQ ID NO: 18429 - RNA, 23 nt, Homo sapiens
aacacaauggaguacuaagaugg

SEQ ID NO: 18430 - RNA, 19 nt, Homo sapiens
caacaaacauguuacuauu

SEQ ID NO: 18431 - RNA, 19 nt, Homo sapiens
caucuaagcaucaucugau

SEQ ID NO: 18432 - RNA, 18 nt, Homo sapiens
gguauuauucauguguca

SEQ ID NO: 18433 - RNA, 23 nt, Homo sapiens
guauauaugagccuucuuguuua

SEQ ID NO: 18434 - RNA, 20 nt, Homo sapiens
ugaaaaugugacuuagagua

SEQ ID NO: 18435 - RNA, 20 nt, Homo sapiens
ccuucccccggcccuccucc

SEQ ID NO: 18436 - RNA, 22 nt, Homo sapiens
ucacacuacagucauuucuuuu

SEQ ID NO: 18437 - RNA, 19 nt, Homo sapiens
ucuauauauaauaugacgc

SEQ ID NO: 18438 - RNA, 18 nt, Homo sapiens
acccuccaucuaccccuu

SEQ ID NO: 18439 - RNA, 21 nt, Homo sapiens
agcauuucccacccuccaucu

SEQ ID NO: 18440 - RNA, 19 nt, Homo sapiens
ccaggcacuuugcaucaca

SEQ ID NO: 18441 - RNA, 22 nt, Homo sapiens
ccaggguauucuuuuuccaucc

SEQ ID NO: 18442 - RNA, 19 nt, Homo sapiens
ccgaaccgcgcuuucugaa

SEQ ID NO: 18443 - RNA, 18 nt, Homo sapiens
gcaggcagagggccuuug

SEQ ID NO: 18444 - RNA, 20 nt, Homo sapiens
guugguuuggucccugguuu

SEQ ID NO: 18445 - RNA, 18 nt, Homo sapiens
aaaaacaaaacaaacaaa

SEQ ID NO: 18446 - RNA, 21 nt, Homo sapiens
agaaaagauaauuuauccuca

SEQ ID NO: 18447 - RNA, 21 nt, Homo sapiens
cuuucuucccauccuuaacug

SEQ ID NO: 18448 - RNA, 19 nt, Homo sapiens
guaguuuuggggaacuuuu

SEQ ID NO: 18449 - RNA, 27 nt, Homo sapiens
uaguuacaguggguuuuauuguuuuug

SEQ ID NO: 18450 - RNA, 16 nt, Homo sapiens
uaugcuuaaauagauc

SEQ ID NO: 18451 - RNA, 19 nt, Homo sapiens
ccccgcccuccgccgcagc

SEQ ID NO: 18452 - RNA, 25 nt, Homo sapiens
gccguccucgccucccucugccucu

SEQ ID NO: 18453 - RNA, 21 nt, Homo sapiens
aucucgggucaccacaaccuc

SEQ ID NO: 18454 - RNA, 19 nt, Homo sapiens
cagccucccgaguagcuca

SEQ ID NO: 18455 - RNA, 18 nt, Homo sapiens
cccacaaccuccgccucc

SEQ ID NO: 18456 - RNA, 22 nt, Homo sapiens
acuuucuggaguaaucaggugg

SEQ ID NO: 18457 - RNA, 19 nt, Homo sapiens
caggccugggcugugcagc

SEQ ID NO: 18458 - RNA, 19 nt, Homo sapiens
gcggaaguagcuugccuca

SEQ ID NO: 18459 - RNA, 22 nt, Homo sapiens
caaaauucauuaaauuuggcug

SEQ ID NO: 18460 - RNA, 21 nt, Homo sapiens
acacacuuauuccaucagcua

SEQ ID NO: 18461 - RNA, 24 nt, Homo sapiens
auuugaauuguugugguuuuguuu

SEQ ID NO: 18462 - RNA, 19 nt, Homo sapiens
cagacauacccauuuggau

SEQ ID NO: 18463 - RNA, 26 nt, Homo sapiens
cagacauacccauuuggaugacccca

SEQ ID NO: 18464 - RNA, 17 nt, Homo sapiens
caucuccucaaggcucc

SEQ ID NO: 18465 - RNA, 23 nt, Homo sapiens
ccuugagaggacauacuuuucca

SEQ ID NO: 18466 - RNA, 19 nt, Homo sapiens
ugaauacaaguuuaccuca

SEQ ID NO: 18467 - RNA, 17 nt, Homo sapiens
ugcuaacgaacagcuca

SEQ ID NO: 18468 - RNA, 20 nt, Homo sapiens
uggaaggccaaaugaagcug

SEQ ID NO: 18469 - RNA, 18 nt, Homo sapiens
aaaguuuggaagcacuga

SEQ ID NO: 18470 - RNA, 17 nt, Homo sapiens
aguguuuaucuuucucu

SEQ ID NO: 18471 - RNA, 19 nt, Homo sapiens
ugguuccauggaguucuga

SEQ ID NO: 18472 - RNA, 17 nt, Homo sapiens
acaaggggaggggucaa

SEQ ID NO: 18473 - RNA, 19 nt, Homo sapiens
acuggaggcugccuggcuc

SEQ ID NO: 18474 - RNA, 20 nt, Homo sapiens
gagaugcauugguagcaacu

SEQ ID NO: 18475 - RNA, 22 nt, Homo sapiens
ucaucaucaccaccaucuccca

SEQ ID NO: 18476 - RNA, 20 nt, Homo sapiens
ucaugacauaccagaugcca

SEQ ID NO: 18477 - RNA, 22 nt, Homo sapiens
uucugaaauuggguccuccucc

SEQ ID NO: 18478 - RNA, 19 nt, Homo sapiens
aagcaauucuccugccuca

SEQ ID NO: 18479 - RNA, 17 nt, Homo sapiens
aggucucucccucccuc

SEQ ID NO: 18480 - RNA, 22 nt, Homo sapiens
aucuuggcucaccacaaccucu

SEQ ID NO: 18481 - RNA, 20 nt, Homo sapiens
ccucugccuccuggguucaa

SEQ ID NO: 18482 - RNA, 20 nt, Homo sapiens
uaggugggucucaaagauga

SEQ ID NO: 18483 - RNA, 19 nt, Homo sapiens
ucuggccuggauaaucuca

SEQ ID NO: 18484 - RNA, 21 nt, Homo sapiens
aaucugcuucaagaaaucuca

SEQ ID NO: 18485 - RNA, 18 nt, Homo sapiens
acgguacauuucuauuac

SEQ ID NO: 18486 - RNA, 19 nt, Homo sapiens
aucacauagaaacuccauu

SEQ ID NO: 18487 - RNA, 17 nt, Homo sapiens
ccgacgccgccgccuca

SEQ ID NO: 18488 - RNA, 18 nt, Homo sapiens
cuccauuaaucaucugau

SEQ ID NO: 18489 - RNA, 18 nt, Homo sapiens
gcccaggagcccguccag

SEQ ID NO: 18490 - RNA, 19 nt, Homo sapiens
guauuaagaauuauaugaa

SEQ ID NO: 18491 - RNA, 18 nt, Homo sapiens
uaaaaauaccuaaagugc

SEQ ID NO: 18492 - RNA, 21 nt, Homo sapiens
uaauuccagccuuuuguuuuc

SEQ ID NO: 18493 - RNA, 24 nt, Homo sapiens
uuagagcacguuuuggucauuuuu

SEQ ID NO: 18494 - RNA, 17 nt, Homo sapiens
uuucaccuguggauucg

SEQ ID NO: 18495 - RNA, 23 nt, Homo sapiens
aagcagguaucccagcaugaaau

SEQ ID NO: 18496 - RNA, 23 nt, Homo sapiens
uaauacaacagagcacuuuuuga

SEQ ID NO: 18497 - RNA, 18 nt, Homo sapiens
ugcaauauuuuaguaaua

SEQ ID NO: 18498 - RNA, 20 nt, Homo sapiens
ugagggcaaccaaguuguua

SEQ ID NO: 18499 - RNA, 19 nt, Homo sapiens
uucuaacauugcuuacuua

SEQ ID NO: 18500 - RNA, 20 nt, Homo sapiens
uuguaaauauuccuguauuc

SEQ ID NO: 18501 - RNA, 21 nt, Homo sapiens
uauagaaaaguggaaucgagu

SEQ ID NO: 18502 - RNA, 22 nt, Homo sapiens
aguggguggggagggugguuua

SEQ ID NO: 18503 - RNA, 21 nt, Homo sapiens
agagcagucacaacagaguga

SEQ ID NO: 18504 - RNA, 25 nt, Homo sapiens
cgcagaacuaccagguggcaaagua

SEQ ID NO: 18505 - RNA, 18 nt, Homo sapiens
guuaaucccuuugucugu

SEQ ID NO: 18506 - RNA, 22 nt, Homo sapiens
ugaccaagacugagccagcuua

SEQ ID NO: 18507 - RNA, 21 nt, Homo sapiens
uggggagacaaaucucagaac

SEQ ID NO: 18508 - RNA, 21 nt, Homo sapiens
ccagggagcccgagcggccgc

SEQ ID NO: 18509 - RNA, 18 nt, Homo sapiens
cgggggggauuuuucguc

SEQ ID NO: 18510 - RNA, 17 nt, Homo sapiens
cuccccccaaccaggga

SEQ ID NO: 18511 - RNA, 22 nt, Homo sapiens
cuuggcacuuaagugcacuuuu

SEQ ID NO: 18512 - RNA, 19 nt, Homo sapiens
gcccuucuuccccaucucu

SEQ ID NO: 18513 - RNA, 17 nt, Homo sapiens
ugaacugcuuuuccuca

SEQ ID NO: 18514 - RNA, 18 nt, Homo sapiens
uuucacuuguauugacuu

SEQ ID NO: 18515 - RNA, 23 nt, Homo sapiens
acacagcuaucaagugcuaaguu

SEQ ID NO: 18516 - RNA, 18 nt, Homo sapiens
caaaccaacauuugguga

SEQ ID NO: 18517 - RNA, 18 nt, Homo sapiens
ucuggugcaaucugugaa

SEQ ID NO: 18518 - RNA, 20 nt, Homo sapiens
uaacaccauacuuuggcaua

SEQ ID NO: 18519 - RNA, 18 nt, Homo sapiens
uuaauacauaacacggua

SEQ ID NO: 18520 - RNA, 19 nt, Homo sapiens
ccgccacugcugccagcga

SEQ ID NO: 18521 - RNA, 22 nt, Homo sapiens
uccugaugugacggacugugaa

SEQ ID NO: 18522 - RNA, 22 nt, Homo sapiens
ucuggcaccacugcccuggucc

SEQ ID NO: 18523 - RNA, 21 nt, Homo sapiens
cauguucuauuuaaguucuga

SEQ ID NO: 18524 - RNA, 21 nt, Homo sapiens
ccagagcacaugcugaccuga

SEQ ID NO: 18525 - RNA, 16 nt, Homo sapiens
ccuuuucuccccucuc

SEQ ID NO: 18526 - RNA, 23 nt, Homo sapiens
gaacuggcuggcagguucugcac

SEQ ID NO: 18527 - RNA, 21 nt, Homo sapiens
uggaagagccguauguacuca

SEQ ID NO: 18528 - RNA, 17 nt, Homo sapiens
caaauguaaggccauga

SEQ ID NO: 18529 - RNA, 17 nt, Homo sapiens
ccaaugggcaauagccc

SEQ ID NO: 18530 - RNA, 15 nt, Homo sapiens
cuuucuuuccaguca

SEQ ID NO: 18531 - RNA, 22 nt, Homo sapiens
gaagaaaaauaaaagccaauga

SEQ ID NO: 18532 - RNA, 19 nt, Homo sapiens
uauuucaaaaauugucaaa

SEQ ID NO: 18533 - RNA, 21 nt, Homo sapiens
uucugauuguuaagacuuucc

SEQ ID NO: 18534 - RNA, 19 nt, Homo sapiens
caaagaacggcacuuuuuc

SEQ ID NO: 18535 - RNA, 20 nt, Homo sapiens
ccuuuuuacauuuuugaccu

SEQ ID NO: 18536 - RNA, 21 nt, Homo sapiens
cgagguuauguacuuccuguu

SEQ ID NO: 18537 - RNA, 21 nt, Homo sapiens
cuuuuccuccccauccuggag

SEQ ID NO: 18538 - RNA, 23 nt, Homo sapiens
ucuugccgcuggcccagucacua

SEQ ID NO: 18539 - RNA, 18 nt, Homo sapiens
acccaacgucucaucuuc

SEQ ID NO: 18540 - RNA, 21 nt, Homo sapiens
gcccuggggcugggggcugga

SEQ ID NO: 18541 - RNA, 17 nt, Homo sapiens
gggacggcguggcugug

SEQ ID NO: 18542 - RNA, 19 nt, Homo sapiens
gggccguuguugccucucc

SEQ ID NO: 18543 - RNA, 19 nt, Homo sapiens
aagcaauucucccgccuca

SEQ ID NO: 18544 - RNA, 18 nt, Homo sapiens
cccgcaaccuccgccucc

SEQ ID NO: 18545 - RNA, 23 nt, Homo sapiens
guuugagcuguggcagaagcacc

SEQ ID NO: 18546 - RNA, 22 nt, Homo sapiens
uucccagaaccaaagaauguga

SEQ ID NO: 18547 - RNA, 19 nt, Homo sapiens
uaaauggacuuauugaagc

SEQ ID NO: 18548 - RNA, 19 nt, Homo sapiens
cuggcuucccccuuccucu

SEQ ID NO: 18549 - RNA, 20 nt, Homo sapiens
auuuggcuucaaaaaucuga

SEQ ID NO: 18550 - RNA, 23 nt, Homo sapiens
gcgcggagaacucagcgcugaga

SEQ ID NO: 18551 - RNA, 19 nt, Homo sapiens
aagugaugcccuccugcca

SEQ ID NO: 18552 - RNA, 24 nt, Homo sapiens
ccuuacgcuugugggggucugcgg

SEQ ID NO: 18553 - RNA, 16 nt, Homo sapiens
cuagacgcugcuagga

SEQ ID NO: 18554 - RNA, 20 nt, Homo sapiens
auggugaaaccccaucgcua

SEQ ID NO: 18555 - RNA, 23 nt, Homo sapiens
cagagucugcaggggacagcccu

SEQ ID NO: 18556 - RNA, 21 nt, Homo sapiens
gccccuggccuguguccccca

SEQ ID NO: 18557 - RNA, 25 nt, Homo sapiens
agacccuggugggggaaugacauca

SEQ ID NO: 18558 - RNA, 23 nt, Homo sapiens
ccugguaacauaaaagcaguuca

SEQ ID NO: 18559 - RNA, 20 nt, Homo sapiens
cuuuauuaaaaucuuccuca

SEQ ID NO: 18560 - RNA, 20 nt, Homo sapiens
gaggagggagagggugacga

SEQ ID NO: 18561 - RNA, 19 nt, Homo sapiens
gcauucccacuuuuccuca

SEQ ID NO: 18562 - RNA, 17 nt, Homo sapiens
uuacacuuuuugcugcu

SEQ ID NO: 18563 - RNA, 23 nt, Homo sapiens
uuuagcaucuucaaauuucuuuu

SEQ ID NO: 18564 - RNA, 20 nt, Homo sapiens
cuucucaaaaagcacugcac

SEQ ID NO: 18565 - RNA, 21 nt, Homo sapiens
gagcggaacccugacuucuca

SEQ ID NO: 18566 - RNA, 23 nt, Homo sapiens
aacuacgagccacgaguuugcag

SEQ ID NO: 18567 - RNA, 18 nt, Homo sapiens
aggcuggaccagaccccc

SEQ ID NO: 18568 - RNA, 15 nt, Homo sapiens
ccacacccaugugua

SEQ ID NO: 18569 - RNA, 19 nt, Homo sapiens
acccugcccucaacccuug

SEQ ID NO: 18570 - RNA, 18 nt, Homo sapiens
cagccacccucugccccu

SEQ ID NO: 18571 - RNA, 24 nt, Homo sapiens
gccugggccacuccucccuggccu

SEQ ID NO: 18572 - RNA, 28 nt, Homo sapiens
gcuucucccccagccacccucugccccu

SEQ ID NO: 18573 - RNA, 20 nt, Homo sapiens
ucaccugccaguuauguggc

SEQ ID NO: 18574 - RNA, 24 nt, Homo sapiens
ugagaccuggccucaaagggcuga

SEQ ID NO: 18575 - RNA, 20 nt, Homo sapiens
ugugcaguguugcuaccagc

SEQ ID NO: 18576 - RNA, 19 nt, Homo sapiens
gcaauguguucccauuuua

SEQ ID NO: 18577 - RNA, 24 nt, Homo sapiens
aaaucucaagccaaacucaaagaa

SEQ ID NO: 18578 - RNA, 23 nt, Homo sapiens
ccugcuucccgacaccagccuca

SEQ ID NO: 18579 - RNA, 22 nt, Homo sapiens
cccauggcuugaugugaagaca

SEQ ID NO: 18580 - RNA, 17 nt, Homo sapiens
caccgacacguauuuua

SEQ ID NO: 18581 - RNA, 20 nt, Homo sapiens
gccaccccucagauguuuug

SEQ ID NO: 18582 - RNA, 22 nt, Homo sapiens
gaaauuguguuagguuugguua

SEQ ID NO: 18583 - RNA, 22 nt, Homo sapiens
uucggaggaaaauuucaggcug

SEQ ID NO: 18584 - RNA, 16 nt, Homo sapiens
auuaacuucgcuccca

SEQ ID NO: 18585 - RNA, 21 nt, Homo sapiens
cucucucucucuuucucucuc

SEQ ID NO: 18586 - RNA, 21 nt, Homo sapiens
cucuuucucucucucucucuc

SEQ ID NO: 18587 - RNA, 23 nt, Homo sapiens
aaacacuugccagaaacuaaauu

SEQ ID NO: 18588 - RNA, 22 nt, Homo sapiens
aacacuugccagaaacuaaauu

SEQ ID NO: 18589 - RNA, 23 nt, Homo sapiens
caccgcccaccaccccuccugcu

SEQ ID NO: 18590 - RNA, 20 nt, Homo sapiens
agaaauauauccccaucucc

SEQ ID NO: 18591 - RNA, 22 nt, Homo sapiens
ucugauaauugucuccccucca

SEQ ID NO: 18592 - RNA, 19 nt, Homo sapiens
uuagcucucuuucuucuca

SEQ ID NO: 18593 - RNA, 20 nt, Homo sapiens
auuugggagacagucacguc

SEQ ID NO: 18594 - RNA, 22 nt, Homo sapiens
gcuuuucuccuccccgcgccuc

SEQ ID NO: 18595 - RNA, 18 nt, Homo sapiens
uuuuacauguacauuuua

SEQ ID NO: 18596 - RNA, 21 nt, Homo sapiens
acccucuaggggcuuugggga

SEQ ID NO: 18597 - RNA, 18 nt, Homo sapiens
caaccuuccucccuacuc

SEQ ID NO: 18598 - RNA, 20 nt, Homo sapiens
cccucuaggggcuuugggga

SEQ ID NO: 18599 - RNA, 22 nt, Homo sapiens
gcacaaccuuccucccuacuca

SEQ ID NO: 18600 - RNA, 18 nt, Homo sapiens
ugaaaccagcuagugugu

SEQ ID NO: 18601 - RNA, 22 nt, Homo sapiens
uggccuguccccacauccagca

SEQ ID NO: 18602 - RNA, 17 nt, Homo sapiens
cccacugcuuccuucug

SEQ ID NO: 18603 - RNA, 22 nt, Homo sapiens
ccugaguuaaaaagugauuuuu

SEQ ID NO: 18604 - RNA, 23 nt, Homo sapiens
gccugguaaaguuguuugugucu

SEQ ID NO: 18605 - RNA, 18 nt, Homo sapiens
uccgccucccagguucaa

SEQ ID NO: 18606 - RNA, 20 nt, Homo sapiens
uggucaggcuggucuugaac

SEQ ID NO: 18607 - RNA, 17 nt, Homo sapiens
acacaaagguuaaauua

SEQ ID NO: 18608 - RNA, 21 nt, Homo sapiens
gaagauuuggaagaagcuauu

SEQ ID NO: 18609 - RNA, 24 nt, Homo sapiens
guuuggaucugcacaguuugguuu

SEQ ID NO: 18610 - RNA, 24 nt, Homo sapiens
uuaucaagcuucaaaaagcuuuuu

SEQ ID NO: 18611 - RNA, 16 nt, Homo sapiens
agcuagacccgcuuca

SEQ ID NO: 18612 - RNA, 20 nt, Homo sapiens
cccuccccaccuuucucucc

SEQ ID NO: 18613 - RNA, 21 nt, Homo sapiens
aauuuaucucuaaaaaauggc

SEQ ID NO: 18614 - RNA, 22 nt, Homo sapiens
auagugaaaccccaucuccaaa

SEQ ID NO: 18615 - RNA, 21 nt, Homo sapiens
auccuauucacaucacuguug

SEQ ID NO: 18616 - RNA, 18 nt, Homo sapiens
cagaagccaggugagccc

SEQ ID NO: 18617 - RNA, 24 nt, Homo sapiens
gcagacaccccaccugugccccua

SEQ ID NO: 18618 - RNA, 25 nt, Homo sapiens
ugauaagauuuuggcuguuugguuu

SEQ ID NO: 18619 - RNA, 20 nt, Homo sapiens
aucucacuucugagaacgaa

SEQ ID NO: 18620 - RNA, 16 nt, Homo sapiens
ggaaacugaacgauua

SEQ ID NO: 18621 - RNA, 19 nt, Homo sapiens
guggcugucccggacccca

SEQ ID NO: 18622 - RNA, 18 nt, Homo sapiens
ucggaucccgagcgcggg

SEQ ID NO: 18623 - RNA, 20 nt, Homo sapiens
acaaaguucauugaugucga

SEQ ID NO: 18624 - RNA, 18 nt, Homo sapiens
acaauaacaauggcauua

SEQ ID NO: 18625 - RNA, 18 nt, Homo sapiens
uguuaccuguucucacug

SEQ ID NO: 18626 - RNA, 19 nt, Homo sapiens
agcgggaucaagaauuuca

SEQ ID NO: 18627 - RNA, 22 nt, Homo sapiens
cagggcgcaguggcucaccccu

SEQ ID NO: 18628 - RNA, 22 nt, Homo sapiens
gaaccaagaucacaccacugca

SEQ ID NO: 18629 - RNA, 20 nt, Homo sapiens
ggcuucuguggcuuucauuu

SEQ ID NO: 18630 - RNA, 20 nt, Homo sapiens
aacaucugcauuauucugaa

SEQ ID NO: 18631 - RNA, 20 nt, Homo sapiens
augacacagaacuauauaca

SEQ ID NO: 18632 - RNA, 18 nt, Homo sapiens
gaauaacacucugcugua

SEQ ID NO: 18633 - RNA, 22 nt, Homo sapiens
agaugcaugccucuuuggcucu

SEQ ID NO: 18634 - RNA, 18 nt, Homo sapiens
auaauuuucccaauguca

SEQ ID NO: 18635 - RNA, 17 nt, Homo sapiens
cacugccaucugaacaa

SEQ ID NO: 18636 - RNA, 19 nt, Homo sapiens
caggaagccuaggcucggu

SEQ ID NO: 18637 - RNA, 21 nt, Homo sapiens
caggcuucccgacccacaggc

SEQ ID NO: 18638 - RNA, 17 nt, Homo sapiens
ccagagccuggcccucc

SEQ ID NO: 18639 - RNA, 17 nt, Homo sapiens
gcacgucccgcaggcua

SEQ ID NO: 18640 - RNA, 20 nt, Homo sapiens
uugucccccagaacaugacc

SEQ ID NO: 18641 - RNA, 18 nt, Homo sapiens
guucuuucucuuuccugu

SEQ ID NO: 18642 - RNA, 18 nt, Homo sapiens
acugugggaaugaccaug

SEQ ID NO: 18643 - RNA, 21 nt, Homo sapiens
aucuuggcucacuccaaccuc

SEQ ID NO: 18644 - RNA, 21 nt, Homo sapiens
cauuccaugggcuccuugcca

SEQ ID NO: 18645 - RNA, 21 nt, Homo sapiens
cccggaugaccuuuccagacu

SEQ ID NO: 18646 - RNA, 20 nt, Homo sapiens
ccucugccucccggguucaa

SEQ ID NO: 18647 - RNA, 20 nt, Homo sapiens
cucuugccucccagguucaa

SEQ ID NO: 18648 - RNA, 18 nt, Homo sapiens
ggaggaggaagauggcca

SEQ ID NO: 18649 - RNA, 21 nt, Homo sapiens
gggaaugaccauggucauggc

SEQ ID NO: 18650 - RNA, 17 nt, Homo sapiens
ucaagugauucuccugc

SEQ ID NO: 18651 - RNA, 18 nt, Homo sapiens
uccgccuccuggguucaa

SEQ ID NO: 18652 - RNA, 25 nt, Homo sapiens
agcccucagauucaucgcuaccccg

SEQ ID NO: 18653 - RNA, 20 nt, Homo sapiens
cuuccuccgccuccgccucu

SEQ ID NO: 18654 - RNA, 23 nt, Homo sapiens
gccucucucuccuccuccuccuc

SEQ ID NO: 18655 - RNA, 21 nt, Homo sapiens
gacagugaaaguaccaucaua

SEQ ID NO: 18656 - RNA, 19 nt, Homo sapiens
gcacuugugcuuuagcuuu

SEQ ID NO: 18657 - RNA, 22 nt, Homo sapiens
ucauacauaagucauuuaguaa

SEQ ID NO: 18658 - RNA, 18 nt, Homo sapiens
ggcaguuuaccucugaug

SEQ ID NO: 18659 - RNA, 17 nt, Homo sapiens
aguguguuuuaacuagc

SEQ ID NO: 18660 - RNA, 20 nt, Homo sapiens
cuguauauuguuuacuuuau

SEQ ID NO: 18661 - RNA, 23 nt, Homo sapiens
gcaguuuaggaccugcugucaua

SEQ ID NO: 18662 - RNA, 26 nt, Homo sapiens
gcguuggaagaguuguuggggguuuu

SEQ ID NO: 18663 - RNA, 20 nt, Homo sapiens
gcccacccacacucacucca

SEQ ID NO: 18664 - RNA, 17 nt, Homo sapiens
ucuuucucuccucccuc

SEQ ID NO: 18665 - RNA, 22 nt, Homo sapiens
aaauuacuaaugcaccacguca

SEQ ID NO: 18666 - RNA, 28 nt, Homo sapiens
aucugggccaagaaugauugcuaggucc

SEQ ID NO: 18667 - RNA, 18 nt, Homo sapiens
uugucggaggggaaaagg

SEQ ID NO: 18668 - RNA, 19 nt, Homo sapiens
aaacacuguagggaaccuc

SEQ ID NO: 18669 - RNA, 22 nt, Homo sapiens
acaaaacacuguagggaaccuc

SEQ ID NO: 18670 - RNA, 20 nt, Homo sapiens
agguguccaaaauuccauac

SEQ ID NO: 18671 - RNA, 23 nt, Homo sapiens
cagacaauauaagacacacuaua

SEQ ID NO: 18672 - RNA, 23 nt, Homo sapiens
uaaauggagucaguguggaauug

SEQ ID NO: 18673 - RNA, 21 nt, Homo sapiens
uaccaccauucuucauaauuc

SEQ ID NO: 18674 - RNA, 21 nt, Homo sapiens
ugauuuucuguuaauauucca

SEQ ID NO: 18675 - RNA, 17 nt, Homo sapiens
uuuggggcagcauuugc

SEQ ID NO: 18676 - RNA, 17 nt, Homo sapiens
acagauggcugcgcacc

SEQ ID NO: 18677 - RNA, 18 nt, Homo sapiens
accccgagaaccaguuca

SEQ ID NO: 18678 - RNA, 17 nt, Homo sapiens
ccaccauagggcaugau

SEQ ID NO: 18679 - RNA, 20 nt, Homo sapiens
cucagucuccucuguccucu

SEQ ID NO: 18680 - RNA, 22 nt, Homo sapiens
ggagccgcucucugcagagcca

SEQ ID NO: 18681 - RNA, 18 nt, Homo sapiens
uuaguucaagaacacauu

SEQ ID NO: 18682 - RNA, 20 nt, Homo sapiens
cuggcuguggcccccauucc

SEQ ID NO: 18683 - RNA, 25 nt, Homo sapiens
gugugugugagcgugugugugagug

SEQ ID NO: 18684 - RNA, 21 nt, Homo sapiens
uccuggcgaugcccuggugga

SEQ ID NO: 18685 - RNA, 19 nt, Homo sapiens
acguaccugugucuuaucu

SEQ ID NO: 18686 - RNA, 19 nt, Homo sapiens
cuucucuggccucugguuu

SEQ ID NO: 18687 - RNA, 22 nt, Homo sapiens
gaaacccccuuuuuuagcuuuu

SEQ ID NO: 18688 - RNA, 19 nt, Homo sapiens
gagccgcggcgccucguuc

SEQ ID NO: 18689 - RNA, 20 nt, Homo sapiens
gggaaggcagcggcggcggc

SEQ ID NO: 18690 - RNA, 18 nt, Homo sapiens
gucuggcaugacuaaugu

SEQ ID NO: 18691 - RNA, 19 nt, Homo sapiens
uccacagacacaccuaagc

SEQ ID NO: 18692 - RNA, 18 nt, Homo sapiens
cuucugugauagauguuu

SEQ ID NO: 18693 - RNA, 19 nt, Homo sapiens
ucccauuucaauucaguua

SEQ ID NO: 18694 - RNA, 18 nt, Homo sapiens
ugaagaccuauucagagu

SEQ ID NO: 18695 - RNA, 23 nt, Homo sapiens
accacagacuguccucuccaccu

SEQ ID NO: 18696 - RNA, 23 nt, Homo sapiens
cucugauggugcucagauuugug

SEQ ID NO: 18697 - RNA, 18 nt, Homo sapiens
cugcccuuuuuguguggu

SEQ ID NO: 18698 - RNA, 22 nt, Homo sapiens
gcaaaauauuaugccuaaagua

SEQ ID NO: 18699 - RNA, 16 nt, Homo sapiens
gcacuauuacauagua

SEQ ID NO: 18700 - RNA, 22 nt, Homo sapiens
ccccacccccuccccacuagcu

SEQ ID NO: 18701 - RNA, 22 nt, Homo sapiens
ccccuccccacuagcucgaucu

SEQ ID NO: 18702 - RNA, 23 nt, Homo sapiens
ccuccacuuuagcuguuuugacu

SEQ ID NO: 18703 - RNA, 19 nt, Homo sapiens
gaauugaaccugacauuuu

SEQ ID NO: 18704 - RNA, 17 nt, Homo sapiens
gcccucuagagaaucca

SEQ ID NO: 18705 - RNA, 24 nt, Homo sapiens
gcccugggagcuggaggaaccgcg

SEQ ID NO: 18706 - RNA, 19 nt, Homo sapiens
ucuugaguagaguugcaca

SEQ ID NO: 18707 - RNA, 21 nt, Homo sapiens
caacccuccauccuaggcucu

SEQ ID NO: 18708 - RNA, 18 nt, Homo sapiens
ccaaacucuggcaccuca

SEQ ID NO: 18709 - RNA, 19 nt, Homo sapiens
ggauggaagacagggauug

SEQ ID NO: 18710 - RNA, 18 nt, Homo sapiens
ucuggaaggggcuuggaa

SEQ ID NO: 18711 - RNA, 19 nt, Homo sapiens
ugcccaggguccccauccu

SEQ ID NO: 18712 - RNA, 19 nt, Homo sapiens
agucccacagccuuccucc

SEQ ID NO: 18713 - RNA, 23 nt, Homo sapiens
agggaucggcagggaccacuucc

SEQ ID NO: 18714 - RNA, 22 nt, Homo sapiens
cccagacccaagccugacccca

SEQ ID NO: 18715 - RNA, 23 nt, Homo sapiens
cccuggccccggcccuucccuca

SEQ ID NO: 18716 - RNA, 19 nt, Homo sapiens
cuucccucacuuccaucca

SEQ ID NO: 18717 - RNA, 16 nt, Homo sapiens
uguaggguccggcgug

SEQ ID NO: 18718 - RNA, 24 nt, Homo sapiens
caucaaccucaagcccguuuagca

SEQ ID NO: 18719 - RNA, 24 nt, Homo sapiens
ccuauggaaaucauucacaucuga

SEQ ID NO: 18720 - RNA, 25 nt, Homo sapiens
cuuuuuagaagcuggcuuuaacuuu

SEQ ID NO: 18721 - RNA, 17 nt, Homo sapiens
gcacuguaugcauacuu

SEQ ID NO: 18722 - RNA, 20 nt, Homo sapiens
ugaucaauuuuccucaugac

SEQ ID NO: 18723 - RNA, 19 nt, Homo sapiens
aaaaagcucaaggaaauac

SEQ ID NO: 18724 - RNA, 18 nt, Homo sapiens
agggaaaacaaaauacuu

SEQ ID NO: 18725 - RNA, 17 nt, Homo sapiens
agugcuugaccuccugu

SEQ ID NO: 18726 - RNA, 18 nt, Homo sapiens
ugaaauuaccagauauuc

SEQ ID NO: 18727 - RNA, 20 nt, Homo sapiens
uggccuugucaacauacaga

SEQ ID NO: 18728 - RNA, 24 nt, Homo sapiens
caagaacaagcagagcccgggcca

SEQ ID NO: 18729 - RNA, 21 nt, Homo sapiens
guucuuuuuuucuuuaaggaa

SEQ ID NO: 18730 - RNA, 22 nt, Homo sapiens
ucaaauaagcaguauuuaauca

SEQ ID NO: 18731 - RNA, 16 nt, Homo sapiens
aggagaaaggauaaca

SEQ ID NO: 18732 - RNA, 18 nt, Homo sapiens
agguaaaagccugaaaca

SEQ ID NO: 18733 - RNA, 17 nt, Homo sapiens
caagugcgugucuacuu

SEQ ID NO: 18734 - RNA, 18 nt, Homo sapiens
cagagccucagcauccaa

SEQ ID NO: 18735 - RNA, 26 nt, Homo sapiens
caguggugcaaucauagcucauugaa

SEQ ID NO: 18736 - RNA, 22 nt, Homo sapiens
ccuuuuuauacuaggucugguu

SEQ ID NO: 18737 - RNA, 21 nt, Homo sapiens
ggaaacagaaauuuagaaugg

SEQ ID NO: 18738 - RNA, 21 nt, Homo sapiens
ugauggauuuucauuucuucg

SEQ ID NO: 18739 - RNA, 19 nt, Homo sapiens
uucagauccuuuaaugugg

SEQ ID NO: 18740 - RNA, 18 nt, Homo sapiens
acaaaagcagcugugaca

SEQ ID NO: 18741 - RNA, 20 nt, Homo sapiens
ggaggguacuuggcauuaca

SEQ ID NO: 18742 - RNA, 19 nt, Homo sapiens
cuuacagaaagauacccuc

SEQ ID NO: 18743 - RNA, 17 nt, Homo sapiens
ugcaaaauuagcuuuuu

SEQ ID NO: 18744 - RNA, 22 nt, Homo sapiens
ccucuuugguuuucuuagcuuu

SEQ ID NO: 18745 - RNA, 20 nt, Homo sapiens
ucuccacuaagccuguguaa

SEQ ID NO: 18746 - RNA, 17 nt, Homo sapiens
guguugccaccaugcac

SEQ ID NO: 18747 - RNA, 18 nt, Homo sapiens
augccgccugugugccgu

SEQ ID NO: 18748 - RNA, 23 nt, Homo sapiens
cauccagcagcuccucaucccca

SEQ ID NO: 18749 - RNA, 22 nt, Homo sapiens
acacuuggcccuugguuacguc

SEQ ID NO: 18750 - RNA, 23 nt, Homo sapiens
agugcccaccccacaucacuaca

SEQ ID NO: 18751 - RNA, 16 nt, Homo sapiens
cguggaggauuuggaa

SEQ ID NO: 18752 - RNA, 19 nt, Homo sapiens
acugccauccaucuccaga

SEQ ID NO: 18753 - RNA, 19 nt, Homo sapiens
agcaggcagcauugaugaa

SEQ ID NO: 18754 - RNA, 24 nt, Homo sapiens
aguaggugggacuacagaugugug

SEQ ID NO: 18755 - RNA, 22 nt, Homo sapiens
caagaucauuucaccucacucc

SEQ ID NO: 18756 - RNA, 19 nt, Homo sapiens
cacauuuugaucauugcua

SEQ ID NO: 18757 - RNA, 22 nt, Homo sapiens
gagccaagaucauuucaccuca

SEQ ID NO: 18758 - RNA, 21 nt, Homo sapiens
gccccuggcaaccaccauccu

SEQ ID NO: 18759 - RNA, 18 nt, Homo sapiens
ugaccaaaaaucaguuuu

SEQ ID NO: 18760 - RNA, 20 nt, Homo sapiens
uuauuuuaaaaaucagcucu

SEQ ID NO: 18761 - RNA, 23 nt, Homo sapiens
accacaggccgcuguacccccuu

SEQ ID NO: 18762 - RNA, 25 nt, Homo sapiens
cccacugcagucggccuugccuccu

SEQ ID NO: 18763 - RNA, 21 nt, Homo sapiens
cuccuccuccuccucuaccuc

SEQ ID NO: 18764 - RNA, 17 nt, Homo sapiens
cugcugggcguucccuu

SEQ ID NO: 18765 - RNA, 18 nt, Homo sapiens
ugaccagccuggcccacc

SEQ ID NO: 18766 - RNA, 17 nt, Homo sapiens
cccaccagaagaagcac

SEQ ID NO: 18767 - RNA, 17 nt, Homo sapiens
acauacaauagugugaa

SEQ ID NO: 18768 - RNA, 19 nt, Homo sapiens
auugcuuuuuguauaccaa

SEQ ID NO: 18769 - RNA, 23 nt, Homo sapiens
cguauggaugcuagugccuuuaa

SEQ ID NO: 18770 - RNA, 22 nt, Homo sapiens
gguauaaaaccagauguuuaca

SEQ ID NO: 18771 - RNA, 20 nt, Homo sapiens
aacugcauuaaccgaucuga

SEQ ID NO: 18772 - RNA, 20 nt, Homo sapiens
aucuuugauggcuacuuuuu

SEQ ID NO: 18773 - RNA, 22 nt, Homo sapiens
cuuaauuuucauuuuccucauu

SEQ ID NO: 18774 - RNA, 19 nt, Homo sapiens
ucucuuuauaguuaggcuu

SEQ ID NO: 18775 - RNA, 23 nt, Homo sapiens
aagaggauaaaacaacgcuccau

SEQ ID NO: 18776 - RNA, 21 nt, Homo sapiens
accaaaggagcaaagaggaua

SEQ ID NO: 18777 - RNA, 18 nt, Homo sapiens
accuucuaauugagacua

SEQ ID NO: 18778 - RNA, 19 nt, Homo sapiens
gaacugaucuggcuuguca

SEQ ID NO: 18779 - RNA, 22 nt, Homo sapiens
uauuggucacccagugaucaua

SEQ ID NO: 18780 - RNA, 22 nt, Homo sapiens
uuggccuuaaagcuagccagcu

SEQ ID NO: 18781 - RNA, 18 nt, Homo sapiens
aagcuaagccucaagaua

SEQ ID NO: 18782 - RNA, 19 nt, Homo sapiens
aaggugcagggggcaaagg

SEQ ID NO: 18783 - RNA, 18 nt, Homo sapiens
caaaggaucaccugguau

SEQ ID NO: 18784 - RNA, 18 nt, Homo sapiens
ccuggcaguggauugugg

SEQ ID NO: 18785 - RNA, 23 nt, Homo sapiens
gaaaaccuccaucuuggcuccca

SEQ ID NO: 18786 - RNA, 18 nt, Homo sapiens
gccugaggcagucacaga

SEQ ID NO: 18787 - RNA, 21 nt, Homo sapiens
gugaaccugccugugaacucu

SEQ ID NO: 18788 - RNA, 22 nt, Homo sapiens
aaaagaccuagcccaacuuccc

SEQ ID NO: 18789 - RNA, 21 nt, Homo sapiens
aggagucucacugggcugguu

SEQ ID NO: 18790 - RNA, 18 nt, Homo sapiens
cuuccccuccucucucca

SEQ ID NO: 18791 - RNA, 23 nt, Homo sapiens
ggagugauuuugacaugggggug

SEQ ID NO: 18792 - RNA, 16 nt, Homo sapiens
ucuuccucucuuccuc

SEQ ID NO: 18793 - RNA, 21 nt, Homo sapiens
aaacugccccccgagcuucuu

SEQ ID NO: 18794 - RNA, 20 nt, Homo sapiens
cagccccugcagucaucuca

SEQ ID NO: 18795 - RNA, 22 nt, Homo sapiens
cccagaggacguuccucaagga

SEQ ID NO: 18796 - RNA, 22 nt, Homo sapiens
ccccaaacugccccccgagcuu

SEQ ID NO: 18797 - RNA, 16 nt, Homo sapiens
ccugagggccugcgga

SEQ ID NO: 18798 - RNA, 22 nt, Homo sapiens
ccuggaccgcuacugcccccca

SEQ ID NO: 18799 - RNA, 24 nt, Homo sapiens
ccuuuccacacgccgcugccccag

SEQ ID NO: 18800 - RNA, 21 nt, Homo sapiens
cuacaaggacaagaggcucaa

SEQ ID NO: 18801 - RNA, 23 nt, Homo sapiens
cuccucaugccccucuguccucu

SEQ ID NO: 18802 - RNA, 17 nt, Homo sapiens
cugccacugggcccaca

SEQ ID NO: 18803 - RNA, 25 nt, Homo sapiens
gcucccugccccuccucaugccccu

SEQ ID NO: 18804 - RNA, 19 nt, Homo sapiens
ggaccgggcagguguccac

SEQ ID NO: 18805 - RNA, 24 nt, Homo sapiens
auuagcuccuccuuuuuccuucca

SEQ ID NO: 18806 - RNA, 22 nt, Homo sapiens
cuuuuuccuuggcuuuagccuu

SEQ ID NO: 18807 - RNA, 22 nt, Homo sapiens
gacggcaggcagcagcuguggc

SEQ ID NO: 18808 - RNA, 17 nt, Homo sapiens
gaggaaagcaugagcag

SEQ ID NO: 18809 - RNA, 22 nt, Homo sapiens
gcagagagcccagugccggcca

SEQ ID NO: 18810 - RNA, 21 nt, Homo sapiens
uaaaggucaugucuccuagcu

SEQ ID NO: 18811 - RNA, 24 nt, Homo sapiens
ucuuggugaagacaggguucgugg

SEQ ID NO: 18812 - RNA, 22 nt, Homo sapiens
gacggcaggcagcagcuguggc

SEQ ID NO: 18813 - RNA, 17 nt, Homo sapiens
gaggaaagcaugagcag

SEQ ID NO: 18814 - RNA, 22 nt, Homo sapiens
gcagagagcccagugccggcca

SEQ ID NO: 18815 - RNA, 21 nt, Homo sapiens
uaaaggucaugucuccuagcu

SEQ ID NO: 18816 - RNA, 24 nt, Homo sapiens
ucuuggugaagacaggguucgugg

SEQ ID NO: 18817 - RNA, 22 nt, Homo sapiens
acauaauuuuuuaaaaaguuuu

SEQ ID NO: 18818 - RNA, 24 nt, Homo sapiens
gagaauuuuuauuucucaauaccu

SEQ ID NO: 18819 - RNA, 19 nt, Homo sapiens
uggcuuugaauuuuaagca

SEQ ID NO: 18820 - RNA, 23 nt, Homo sapiens
acaaguaauguaaaagcuaguau

SEQ ID NO: 18821 - RNA, 17 nt, Homo sapiens
gaaaccggugucuguca

SEQ ID NO: 18822 - RNA, 26 nt, Homo sapiens
uccaugaugaccauccucauagcuca

SEQ ID NO: 18823 - RNA, 23 nt, Homo sapiens
ucuuuuuguaguugaauugucuu

SEQ ID NO: 18824 - RNA, 20 nt, Homo sapiens
ugagcgugacccccuggcuc

SEQ ID NO: 18825 - RNA, 20 nt, Homo sapiens
acugccuauaccccucauca

SEQ ID NO: 18826 - RNA, 17 nt, Homo sapiens
caccacagccaccuucu

SEQ ID NO: 18827 - RNA, 21 nt, Homo sapiens
cacugccuauaccccucauca

SEQ ID NO: 18828 - RNA, 23 nt, Homo sapiens
cccaccuucugccgccgccacca

SEQ ID NO: 18829 - RNA, 19 nt, Homo sapiens
cugagcggccgccuguccu

SEQ ID NO: 18830 - RNA, 20 nt, Homo sapiens
gagcccccuguccuucccac

SEQ ID NO: 18831 - RNA, 20 nt, Homo sapiens
acugccuauaccccucauca

SEQ ID NO: 18832 - RNA, 17 nt, Homo sapiens
caccacagccaccuucu

SEQ ID NO: 18833 - RNA, 21 nt, Homo sapiens
cacugccuauaccccucauca

SEQ ID NO: 18834 - RNA, 23 nt, Homo sapiens
cccaccuucugccgccgccacca

SEQ ID NO: 18835 - RNA, 19 nt, Homo sapiens
cugagcggccgccuguccu

SEQ ID NO: 18836 - RNA, 20 nt, Homo sapiens
gagcccccuguccuucccac

SEQ ID NO: 18837 - RNA, 20 nt, Homo sapiens
acugccuauaccccucauca

SEQ ID NO: 18838 - RNA, 17 nt, Homo sapiens
caccacagccaccuucu

SEQ ID NO: 18839 - RNA, 21 nt, Homo sapiens
cacugccuauaccccucauca

SEQ ID NO: 18840 - RNA, 23 nt, Homo sapiens
cccaccuucugccgccgccacca

SEQ ID NO: 18841 - RNA, 19 nt, Homo sapiens
cugagcggccgccuguccu

SEQ ID NO: 18842 - RNA, 20 nt, Homo sapiens
gagcccccuguccuucccac

SEQ ID NO: 18843 - RNA, 18 nt, Homo sapiens
uccagaaggcugucccgg

SEQ ID NO: 18844 - RNA, 23 nt, Homo sapiens
acuuuuaaaaaggccuucucuca

SEQ ID NO: 18845 - RNA, 18 nt, Homo sapiens
aggccaaggacaaacgcc

SEQ ID NO: 18846 - RNA, 18 nt, Homo sapiens
caguuuguugcagugcca

SEQ ID NO: 18847 - RNA, 18 nt, Homo sapiens
ggcagcggcaggagcgca

SEQ ID NO: 18848 - RNA, 23 nt, Homo sapiens
uggagagcccacauaugggauug

SEQ ID NO: 18849 - RNA, 18 nt, Homo sapiens
agccggguagggcagaua

SEQ ID NO: 18850 - RNA, 17 nt, Homo sapiens
cuuucucucuccuucuc

SEQ ID NO: 18851 - RNA, 22 nt, Homo sapiens
uucugucuuucucccucuccuu

SEQ ID NO: 18852 - RNA, 27 nt, Homo sapiens
acaaaacucaggccagagccacagcug

SEQ ID NO: 18853 - RNA, 23 nt, Homo sapiens
guaaugaaagagcgaaugacuga

SEQ ID NO: 18854 - RNA, 22 nt, Homo sapiens
ucuggcugcaguaagcucccug

SEQ ID NO: 18855 - RNA, 16 nt, Homo sapiens
gccauugccugucucu

SEQ ID NO: 18856 - RNA, 18 nt, Homo sapiens
gcuccaauuugccagcca

SEQ ID NO: 18857 - RNA, 21 nt, Homo sapiens
acagaccucccuacagcugua

SEQ ID NO: 18858 - RNA, 22 nt, Homo sapiens
acuugggggaucuccuuggccu

SEQ ID NO: 18859 - RNA, 22 nt, Homo sapiens
agaagguacuuacucuuguacc

SEQ ID NO: 18860 - RNA, 18 nt, Homo sapiens
augccucaaagccuugcu

SEQ ID NO: 18861 - RNA, 23 nt, Homo sapiens
cagcuguucuagagcgggaauua

SEQ ID NO: 18862 - RNA, 20 nt, Homo sapiens
cuauuuggaaaucccuaaca

SEQ ID NO: 18863 - RNA, 22 nt, Homo sapiens
cuuauuugucuucuacacccca

SEQ ID NO: 18864 - RNA, 18 nt, Homo sapiens
uccgccucccggguucaa

SEQ ID NO: 18865 - RNA, 18 nt, Homo sapiens
ugucuguggaaaauggga

SEQ ID NO: 18866 - RNA, 22 nt, Homo sapiens
auggaaaaccauggauucugaa

SEQ ID NO: 18867 - RNA, 25 nt, Homo sapiens
gguuuuggauccaaggaccugugga

SEQ ID NO: 18868 - RNA, 20 nt, Homo sapiens
uaauuuuggauuuuuccuua

SEQ ID NO: 18869 - RNA, 22 nt, Homo sapiens
uguguuauccaaagaacauugg

SEQ ID NO: 18870 - RNA, 21 nt, Homo sapiens
aauacaguauuucuuuguuau

SEQ ID NO: 18871 - RNA, 24 nt, Homo sapiens
cccuucuuccugcccccacacccc

SEQ ID NO: 18872 - RNA, 21 nt, Homo sapiens
gucccugaugccgcuucccga

SEQ ID NO: 18873 - RNA, 21 nt, Homo sapiens
cagagucugcaccugccgccu

SEQ ID NO: 18874 - RNA, 18 nt, Homo sapiens
gcccuggacauggaacua

SEQ ID NO: 18875 - RNA, 21 nt, Homo sapiens
uccagauccagauccuugugc

SEQ ID NO: 18876 - RNA, 18 nt, Homo sapiens
agaauggcaaguaaguua

SEQ ID NO: 18877 - RNA, 18 nt, Homo sapiens
gagcuugugaugaaaucu

SEQ ID NO: 18878 - RNA, 17 nt, Homo sapiens
gaggaaguuuguuuuuu

SEQ ID NO: 18879 - RNA, 20 nt, Homo sapiens
uacuuuucuccaauaccugc

SEQ ID NO: 18880 - RNA, 19 nt, Homo sapiens
ugauccuguaaucauggua

SEQ ID NO: 18881 - RNA, 18 nt, Homo sapiens
aaguucaugucacugucu

SEQ ID NO: 18882 - RNA, 25 nt, Homo sapiens
ccuggguggucucauccauuccuuu

SEQ ID NO: 18883 - RNA, 18 nt, Homo sapiens
gagcucacaggaaucuca

SEQ ID NO: 18884 - RNA, 17 nt, Homo sapiens
uccacucccggguucaa

SEQ ID NO: 18885 - RNA, 23 nt, Homo sapiens
uccuucuuuccccuuuugucuug

SEQ ID NO: 18886 - RNA, 20 nt, Homo sapiens
ugccugagcuaugacaacag

SEQ ID NO: 18887 - RNA, 24 nt, Homo sapiens
uuugcuuacaacgcagugcguuua

SEQ ID NO: 18888 - RNA, 17 nt, Homo sapiens
gcaccccagucuaacac

SEQ ID NO: 18889 - RNA, 18 nt, Homo sapiens
ucuccauuuugggacauu

SEQ ID NO: 18890 - RNA, 24 nt, Homo sapiens
cauguuugaaaggugaauuucuga

SEQ ID NO: 18891 - RNA, 18 nt, Homo sapiens
uauauauuagcuguacuc

SEQ ID NO: 18892 - RNA, 18 nt, Homo sapiens
uugcuuugugcucauuga

SEQ ID NO: 18893 - RNA, 20 nt, Homo sapiens
aaggaugaaccucagggcac

SEQ ID NO: 18894 - RNA, 18 nt, Homo sapiens
agauugagggcccgggag

SEQ ID NO: 18895 - RNA, 18 nt, Homo sapiens
ccagugggaggcugugga

SEQ ID NO: 18896 - RNA, 20 nt, Homo sapiens
ugcaaugggcugcccaggcu

SEQ ID NO: 18897 - RNA, 21 nt, Homo sapiens
accaugguggugguuuggcuu

SEQ ID NO: 18898 - RNA, 18 nt, Homo sapiens
cggacagccccuugaaca

SEQ ID NO: 18899 - RNA, 18 nt, Homo sapiens
uacaaaaacagauggcau

SEQ ID NO: 18900 - RNA, 21 nt, Homo sapiens
uagucccccaaauaaguaaua

SEQ ID NO: 18901 - RNA, 24 nt, Homo sapiens
agacagccagagggaaagcgaccc

SEQ ID NO: 18902 - RNA, 23 nt, Homo sapiens
ccaggacauuccccucuguuccu

SEQ ID NO: 18903 - RNA, 19 nt, Homo sapiens
ccucuguuccucuguuccu

SEQ ID NO: 18904 - RNA, 19 nt, Homo sapiens
cugcaaccuccgccuccca

SEQ ID NO: 18905 - RNA, 21 nt, Homo sapiens
ggacagcccuggacccacucc

SEQ ID NO: 18906 - RNA, 15 nt, Homo sapiens
gucuagucugugaau

SEQ ID NO: 18907 - RNA, 17 nt, Homo sapiens
ucaagugauucuccugc

SEQ ID NO: 18908 - RNA, 18 nt, Homo sapiens
uccgccucccagguucaa

SEQ ID NO: 18909 - RNA, 19 nt, Homo sapiens
ugucuagucugugaauuuu

SEQ ID NO: 18910 - RNA, 19 nt, Homo sapiens
gaauuuuucugucuuugga

SEQ ID NO: 18911 - RNA, 19 nt, Homo sapiens
aaaucccaacauauauacu

SEQ ID NO: 18912 - RNA, 22 nt, Homo sapiens
acaaagaucauauccaugugua

SEQ ID NO: 18913 - RNA, 18 nt, Homo sapiens
ccuugaauaagucuccca

SEQ ID NO: 18914 - RNA, 22 nt, Homo sapiens
cuuccauucauuguuuacgcug

SEQ ID NO: 18915 - RNA, 23 nt, Homo sapiens
gacccaacuuuucuagugugcca

SEQ ID NO: 18916 - RNA, 26 nt, Homo sapiens
uccacggccacuccgccucuucccuc

SEQ ID NO: 18917 - RNA, 19 nt, Homo sapiens
aaaucccaacauauauacu

SEQ ID NO: 18918 - RNA, 22 nt, Homo sapiens
acaaagaucauauccaugugua

SEQ ID NO: 18919 - RNA, 18 nt, Homo sapiens
ccuugaauaagucuccca

SEQ ID NO: 18920 - RNA, 22 nt, Homo sapiens
cuuccauucauuguuuacgcug

SEQ ID NO: 18921 - RNA, 23 nt, Homo sapiens
gacccaacuuuucuagugugcca

SEQ ID NO: 18922 - RNA, 26 nt, Homo sapiens
uccacggccacuccgccucuucccuc

SEQ ID NO: 18923 - RNA, 19 nt, Homo sapiens
aaaucccaacauauauacu

SEQ ID NO: 18924 - RNA, 22 nt, Homo sapiens
acaaagaucauauccaugugua

SEQ ID NO: 18925 - RNA, 18 nt, Homo sapiens
ccuugaauaagucuccca

SEQ ID NO: 18926 - RNA, 22 nt, Homo sapiens
cuuccauucauuguuuacgcug

SEQ ID NO: 18927 - RNA, 23 nt, Homo sapiens
gacccaacuuuucuagugugcca

SEQ ID NO: 18928 - RNA, 26 nt, Homo sapiens
uccacggccacuccgccucuucccuc

SEQ ID NO: 18929 - RNA, 17 nt, Homo sapiens
caccacaaugacugucu

SEQ ID NO: 18930 - RNA, 17 nt, Homo sapiens
uaagcuggaacagucca

SEQ ID NO: 18931 - RNA, 22 nt, Homo sapiens
acccaacugucucgaugcaaug

SEQ ID NO: 18932 - RNA, 21 nt, Homo sapiens
ucugaaaugaagaugggcuuc

SEQ ID NO: 18933 - RNA, 20 nt, Homo sapiens
gcaaauggaggccaaccuca

SEQ ID NO: 18934 - RNA, 21 nt, Homo sapiens
uucugacggcagggcugugag

SEQ ID NO: 18935 - RNA, 18 nt, Homo sapiens
acccuggaccacauucgg

SEQ ID NO: 18936 - RNA, 21 nt, Homo sapiens
uucugacggcagggcugugag

SEQ ID NO: 18937 - RNA, 20 nt, Homo sapiens
uuguuuaaugcucagggcag

SEQ ID NO: 18938 - RNA, 20 nt, Homo sapiens
gcaaauggaggccaaccuca

SEQ ID NO: 18939 - RNA, 21 nt, Homo sapiens
uucugacggcagggcugugag

SEQ ID NO: 18940 - RNA, 18 nt, Homo sapiens
acccuggaccacauucgg

SEQ ID NO: 18941 - RNA, 21 nt, Homo sapiens
uucugacggcagggcugugag

SEQ ID NO: 18942 - RNA, 20 nt, Homo sapiens
uuguuuaaugcucagggcag

SEQ ID NO: 18943 - RNA, 18 nt, Homo sapiens
acccuggaccacauucgg

SEQ ID NO: 18944 - RNA, 21 nt, Homo sapiens
uucugacggcagggcugugag

SEQ ID NO: 18945 - RNA, 20 nt, Homo sapiens
uuguuuaaugcucagggcag

SEQ ID NO: 18946 - RNA, 20 nt, Homo sapiens
gcaaauggaggccaaccuca

SEQ ID NO: 18947 - RNA, 21 nt, Homo sapiens
uucugacggcagggcugugag

SEQ ID NO: 18948 - RNA, 18 nt, Homo sapiens
acccuggaccacauucgg

SEQ ID NO: 18949 - RNA, 21 nt, Homo sapiens
uucugacggcagggcugugag

SEQ ID NO: 18950 - RNA, 20 nt, Homo sapiens
uuguuuaaugcucagggcag

SEQ ID NO: 18951 - RNA, 18 nt, Homo sapiens
aauuugacuuuuguucca

SEQ ID NO: 18952 - RNA, 19 nt, Homo sapiens
aggucaagugauucuccug

SEQ ID NO: 18953 - RNA, 18 nt, Homo sapiens
cccccaaauccuguucca

SEQ ID NO: 18954 - RNA, 20 nt, Homo sapiens
auuucucuauuucugugacg

SEQ ID NO: 18955 - RNA, 19 nt, Homo sapiens
cccccaugcccccacccca

SEQ ID NO: 18956 - RNA, 20 nt, Homo sapiens
ucaugacccucgucucugca

SEQ ID NO: 18957 - RNA, 17 nt, Homo sapiens
cgccccccaugcugcug

SEQ ID NO: 18958 - RNA, 22 nt, Homo sapiens
ggacuuuaagaaugacugagaa

SEQ ID NO: 18959 - RNA, 19 nt, Homo sapiens
ugucuugagggaggacuuu

SEQ ID NO: 18960 - RNA, 20 nt, Homo sapiens
cagagaugacauggagaucc

SEQ ID NO: 18961 - RNA, 19 nt, Homo sapiens
ccacaauuuguucacuuuu

SEQ ID NO: 18962 - RNA, 19 nt, Homo sapiens
cucuuucucucucucucuc

SEQ ID NO: 18963 - RNA, 16 nt, Homo sapiens
accaaaauagagcaga

SEQ ID NO: 18964 - RNA, 23 nt, Homo sapiens
cagaauggacacucuacaacccu

SEQ ID NO: 18965 - RNA, 27 nt, Homo sapiens
ccuaggaaccuucccacaauuguuuuu

SEQ ID NO: 18966 - RNA, 23 nt, Homo sapiens
gcuugagccaccgugccaggccu

SEQ ID NO: 18967 - RNA, 18 nt, Homo sapiens
ucuccaucacucauucca

SEQ ID NO: 18968 - RNA, 24 nt, Homo sapiens
uguaaccucugccuccuggauuca

SEQ ID NO: 18969 - RNA, 17 nt, Homo sapiens
ggccggguacaccagcc

SEQ ID NO: 18970 - RNA, 20 nt, Homo sapiens
cccacucuggacccaggaca

SEQ ID NO: 18971 - RNA, 21 nt, Homo sapiens
aggcacuugccucugcacuuu

SEQ ID NO: 18972 - RNA, 22 nt, Homo sapiens
aaaaucagcuugucuuguucca

SEQ ID NO: 18973 - RNA, 23 nt, Homo sapiens
aggagggagcucguggcgaggca

SEQ ID NO: 18974 - RNA, 19 nt, Homo sapiens
aggucgugcagccaguggc

SEQ ID NO: 18975 - RNA, 21 nt, Homo sapiens
ccauucaccaucucuaacauu

SEQ ID NO: 18976 - RNA, 20 nt, Homo sapiens
cgcacauuagugcauacgug

SEQ ID NO: 18977 - RNA, 20 nt, Homo sapiens
gcuguccuuguucuguuuug

SEQ ID NO: 18978 - RNA, 26 nt, Homo sapiens
uccugaagaaauugggauacuugugg

SEQ ID NO: 18979 - RNA, 23 nt, Homo sapiens
ucucgaggagguuccuuaaccuu

SEQ ID NO: 18980 - RNA, 20 nt, Homo sapiens
ucugagugauuuuaauuugu

SEQ ID NO: 18981 - RNA, 20 nt, Homo sapiens
uguuuuauguauuucuggug

SEQ ID NO: 18982 - RNA, 17 nt, Homo sapiens
ggcaauuacuggccuca

SEQ ID NO: 18983 - RNA, 17 nt, Homo sapiens
auauugcugugucccuc

SEQ ID NO: 18984 - RNA, 18 nt, Homo sapiens
caaggcacaccacagcug

SEQ ID NO: 18985 - RNA, 19 nt, Homo sapiens
cacgguuuggaugugcagc

SEQ ID NO: 18986 - RNA, 21 nt, Homo sapiens
cgaaugacaguugaguauguc

SEQ ID NO: 18987 - RNA, 24 nt, Homo sapiens
gcuugaacuguuuguucuuggugc

SEQ ID NO: 18988 - RNA, 17 nt, Homo sapiens
ggcuucugaguccauuu

SEQ ID NO: 18989 - RNA, 23 nt, Homo sapiens
ucuuugacaguuuccuugguuuu

SEQ ID NO: 18990 - RNA, 19 nt, Homo sapiens
gaaauaaaaguuuaccuca

SEQ ID NO: 18991 - RNA, 24 nt, Homo sapiens
gccuggguccuacccugucugguc

SEQ ID NO: 18992 - RNA, 20 nt, Homo sapiens
uccuguucggaggucuaugg

SEQ ID NO: 18993 - RNA, 22 nt, Homo sapiens
uucuuaacauugcugcauggua

SEQ ID NO: 18994 - RNA, 24 nt, Homo sapiens
acuuggguuaaaacguuuggaccu

SEQ ID NO: 18995 - RNA, 18 nt, Homo sapiens
cccuuccuccuccuccag

SEQ ID NO: 18996 - RNA, 20 nt, Homo sapiens
caaggaucgggcggaagcug

SEQ ID NO: 18997 - RNA, 18 nt, Homo sapiens
cagccugcacagcggugc

SEQ ID NO: 18998 - RNA, 16 nt, Homo sapiens
ccaguguagcacggaa

SEQ ID NO: 18999 - RNA, 22 nt, Homo sapiens
ccauccucuuccaacccacgcc

SEQ ID NO: 19000 - RNA, 25 nt, Homo sapiens
ccccaaggaaaccaauuuccuucua

SEQ ID NO: 19001 - RNA, 19 nt, Homo sapiens
cccggaaaaacugacacug

SEQ ID NO: 19002 - RNA, 19 nt, Homo sapiens
ccguggcacacuccugucc

SEQ ID NO: 19003 - RNA, 24 nt, Homo sapiens
cgcagcauaccauguagcccgugc

SEQ ID NO: 19004 - RNA, 22 nt, Homo sapiens
cuccuuagcuccccucuccucu

SEQ ID NO: 19005 - RNA, 20 nt, Homo sapiens
gcacacaguugaccggugug

SEQ ID NO: 19006 - RNA, 19 nt, Homo sapiens
gcugagggagggccuucuc

SEQ ID NO: 19007 - RNA, 18 nt, Homo sapiens
guaccguguaggggagcc

SEQ ID NO: 19008 - RNA, 21 nt, Homo sapiens
ucauuuauuuccacugucuua

SEQ ID NO: 19009 - RNA, 21 nt, Homo sapiens
ugccucucaguuucuccaucu

SEQ ID NO: 19010 - RNA, 21 nt, Homo sapiens
ccccacgaaacccccuaaagc

SEQ ID NO: 19011 - RNA, 15 nt, Homo sapiens
cuuccucuauuaugc

SEQ ID NO: 19012 - RNA, 19 nt, Homo sapiens
cuugaacuaagauuggcuu

SEQ ID NO: 19013 - RNA, 18 nt, Homo sapiens
gaggauaaacaggacaau

SEQ ID NO: 19014 - RNA, 19 nt, Homo sapiens
gcccuuugauuuaaccuga

SEQ ID NO: 19015 - RNA, 22 nt, Homo sapiens
ucacuuagaauaccaacaguca

SEQ ID NO: 19016 - RNA, 16 nt, Homo sapiens
uuccagaaaauguucc

SEQ ID NO: 19017 - RNA, 19 nt, Homo sapiens
uuuugugauguuuauuuaa

SEQ ID NO: 19018 - RNA, 20 nt, Homo sapiens
agacuugggacaacugccug

SEQ ID NO: 19019 - RNA, 21 nt, Homo sapiens
aggacaaugauggcuauucua

SEQ ID NO: 19020 - RNA, 24 nt, Homo sapiens
cucuaacucuacccacacccaccu

SEQ ID NO: 19021 - RNA, 20 nt, Homo sapiens
uaggacuacuuuucuaguca

SEQ ID NO: 19022 - RNA, 24 nt, Homo sapiens
uccagacuagagccuccuuaccua

SEQ ID NO: 19023 - RNA, 21 nt, Homo sapiens
agagauauuuuuaguauauga

SEQ ID NO: 19024 - RNA, 19 nt, Homo sapiens
ccaaaggagccugcacugg

SEQ ID NO: 19025 - RNA, 22 nt, Homo sapiens
ccucaauggcugcuuugaacuu

SEQ ID NO: 19026 - RNA, 24 nt, Homo sapiens
cuuuucucuacuuccaaaucacaa

SEQ ID NO: 19027 - RNA, 19 nt, Homo sapiens
gccaaauuaacucucugga

SEQ ID NO: 19028 - RNA, 23 nt, Homo sapiens
ggaaaagagccccuuugauccac

SEQ ID NO: 19029 - RNA, 21 nt, Homo sapiens
uuccaaaucacaauuucuuac

SEQ ID NO: 19030 - RNA, 22 nt, Homo sapiens
aacguagucauaucaucgcgcu

SEQ ID NO: 19031 - RNA, 22 nt, Homo sapiens
cgagagugaaacuccgucccca

SEQ ID NO: 19032 - RNA, 22 nt, Homo sapiens
ccacccucucccugguguggcc

SEQ ID NO: 19033 - RNA, 19 nt, Homo sapiens
cugggcuguguguggcgcc

SEQ ID NO: 19034 - RNA, 18 nt, Homo sapiens
gccaggccuacccaggga

SEQ ID NO: 19035 - RNA, 17 nt, Homo sapiens
gccccucccucccuguc

SEQ ID NO: 19036 - RNA, 24 nt, Homo sapiens
guuccuccggggccaccuuccuca

SEQ ID NO: 19037 - RNA, 23 nt, Homo sapiens
uggccucucugaccgugaggcug

SEQ ID NO: 19038 - RNA, 22 nt, Homo sapiens
caccaccaccaccaccuacuuc

SEQ ID NO: 19039 - RNA, 20 nt, Homo sapiens
cagcagcagcagcaccacca

SEQ ID NO: 19040 - RNA, 21 nt, Homo sapiens
ccccucaagaguucucaccag

SEQ ID NO: 19041 - RNA, 17 nt, Homo sapiens
uucagcaacaccuguua

SEQ ID NO: 19042 - RNA, 19 nt, Homo sapiens
agaacauuuacuggcccca

SEQ ID NO: 19043 - RNA, 21 nt, Homo sapiens
cuuccugucacccgccuggca

SEQ ID NO: 19044 - RNA, 19 nt, Homo sapiens
uacuggccccaacuguggc

SEQ ID NO: 19045 - RNA, 20 nt, Homo sapiens
ucacaaacauguauaugcca

SEQ ID NO: 19046 - RNA, 19 nt, Homo sapiens
uggaaaaugcauuuaaaua

SEQ ID NO: 19047 - RNA, 21 nt, Homo sapiens
uuucaguuggcagaacauuua

SEQ ID NO: 19048 - RNA, 20 nt, Homo sapiens
uccagaaaaaggguguccag

SEQ ID NO: 19049 - RNA, 17 nt, Homo sapiens
aacaggcggagccuggc

SEQ ID NO: 19050 - RNA, 19 nt, Homo sapiens
agccuuugagguggucaga

SEQ ID NO: 19051 - RNA, 25 nt, Homo sapiens
ccucagcuguccagcccugcugccu

SEQ ID NO: 19052 - RNA, 19 nt, Homo sapiens
gacucuguccccuugagcu

SEQ ID NO: 19053 - RNA, 23 nt, Homo sapiens
gcagaggagggaacugcuccuuc

SEQ ID NO: 19054 - RNA, 16 nt, Homo sapiens
guucaguccugugaac

SEQ ID NO: 19055 - RNA, 19 nt, Homo sapiens
ucauuaggcuccugcuguc

SEQ ID NO: 19056 - RNA, 23 nt, Homo sapiens
uggauggggccaagguggagcug

SEQ ID NO: 19057 - RNA, 23 nt, Homo sapiens
uggcucuguccaaagugagauug

SEQ ID NO: 19058 - RNA, 19 nt, Homo sapiens
uuuaagccccauguuguac

SEQ ID NO: 19059 - RNA, 17 nt, Homo sapiens
ccuuccuccccuuucuc

SEQ ID NO: 19060 - RNA, 25 nt, Homo sapiens
aaaaccaaauggaucuuguuccgca

SEQ ID NO: 19061 - RNA, 19 nt, Homo sapiens
aagcaauucucccaccuca

SEQ ID NO: 19062 - RNA, 26 nt, Homo sapiens
ccacagacgcucagccaaugcuugaa

SEQ ID NO: 19063 - RNA, 17 nt, Homo sapiens
cccacgcagccccuguu

SEQ ID NO: 19064 - RNA, 22 nt, Homo sapiens
ccuuggcgcucagauuugagag

SEQ ID NO: 19065 - RNA, 18 nt, Homo sapiens
gcagccccuguucugcug

SEQ ID NO: 19066 - RNA, 17 nt, Homo sapiens
gugacaaauucuagcaa

SEQ ID NO: 19067 - RNA, 18 nt, Homo sapiens
ucuggugggacccgugaa

SEQ ID NO: 19068 - RNA, 18 nt, Homo sapiens
caucaaaucccuaucuca

SEQ ID NO: 19069 - RNA, 20 nt, Homo sapiens
cuagguccuuaguuauuuuu

SEQ ID NO: 19070 - RNA, 16 nt, Homo sapiens
cugccuacuaacauca

SEQ ID NO: 19071 - RNA, 18 nt, Homo sapiens
ugaaugcagacuucauuu

SEQ ID NO: 19072 - RNA, 17 nt, Homo sapiens
ugcuguuuuauuugugg

SEQ ID NO: 19073 - RNA, 23 nt, Homo sapiens
uuuuuuccaugcuguuuuaacuu

SEQ ID NO: 19074 - RNA, 21 nt, Homo sapiens
agagcaaauuggccauggcca

SEQ ID NO: 19075 - RNA, 18 nt, Homo sapiens
ugaaauccuuuuuaccuc

SEQ ID NO: 19076 - RNA, 20 nt, Homo sapiens
agaaauaacagugcuguuuu

SEQ ID NO: 19077 - RNA, 19 nt, Homo sapiens
caugaguauucauuaucuc

SEQ ID NO: 19078 - RNA, 20 nt, Homo sapiens
gcccccuccuuucuugcugc

SEQ ID NO: 19079 - RNA, 18 nt, Homo sapiens
gccccuacccccaccucc

SEQ ID NO: 19080 - RNA, 16 nt, Homo sapiens
ggacagccccgucccc

SEQ ID NO: 19081 - RNA, 18 nt, Homo sapiens
uucuguacauaguuccca

SEQ ID NO: 19082 - RNA, 19 nt, Homo sapiens
uugagugacauugaccuca

SEQ ID NO: 19083 - RNA, 19 nt, Homo sapiens
acaggccagaaaccagcag

SEQ ID NO: 19084 - RNA, 20 nt, Homo sapiens
agcagccacaggagauguca

SEQ ID NO: 19085 - RNA, 20 nt, Homo sapiens
aguguccagugcccaucucu

SEQ ID NO: 19086 - RNA, 20 nt, Homo sapiens
auggcaaugcauucucaagc

SEQ ID NO: 19087 - RNA, 21 nt, Homo sapiens
caggacccgccccacccugcg

SEQ ID NO: 19088 - RNA, 20 nt, Homo sapiens
cagguccccaaaugaucuua

SEQ ID NO: 19089 - RNA, 20 nt, Homo sapiens
cccgccccacccugcgguuc

SEQ ID NO: 19090 - RNA, 20 nt, Homo sapiens
gaggaggcucugcaugucca

SEQ ID NO: 19091 - RNA, 21 nt, Homo sapiens
gcagcaaagcuguaucugcua

SEQ ID NO: 19092 - RNA, 19 nt, Homo sapiens
gcugcagugugguuuuguu

SEQ ID NO: 19093 - RNA, 20 nt, Homo sapiens
gcugucuccccagcgugucc

SEQ ID NO: 19094 - RNA, 23 nt, Homo sapiens
ucccguggcucggauucucugag

SEQ ID NO: 19095 - RNA, 24 nt, Homo sapiens
ugagcugugggcggggccuaguca

SEQ ID NO: 19096 - RNA, 24 nt, Homo sapiens
ugagcugugggcggggccuaguca

SEQ ID NO: 19097 - RNA, 24 nt, Homo sapiens
ugagcugugggcggggccuaguca

SEQ ID NO: 19098 - RNA, 21 nt, Homo sapiens
ugagugaccugacugagacua

SEQ ID NO: 19099 - RNA, 17 nt, Homo sapiens
uguggauggggccuagc

SEQ ID NO: 19100 - RNA, 17 nt, Homo sapiens
aaugguaccuugucuga

SEQ ID NO: 19101 - RNA, 18 nt, Homo sapiens
gcaauuuuguaauuucag

SEQ ID NO: 19102 - RNA, 21 nt, Homo sapiens
uaggugggcuuuuagaaacua

SEQ ID NO: 19103 - RNA, 19 nt, Homo sapiens
ucgaugugacuuuuuucag

SEQ ID NO: 19104 - RNA, 26 nt, Homo sapiens
cuuauaaaggucccaggaucacuuuu

SEQ ID NO: 19105 - RNA, 21 nt, Homo sapiens
caggguucccugggcccaguc

SEQ ID NO: 19106 - RNA, 26 nt, Homo sapiens
ccuggucuggucucagaaucacuuuu

SEQ ID NO: 19107 - RNA, 23 nt, Homo sapiens
gcucugggagugugaaacuggga

SEQ ID NO: 19108 - RNA, 17 nt, Homo sapiens
ggccuguuuggcuccga

SEQ ID NO: 19109 - RNA, 16 nt, Homo sapiens
acuaauuuuugccuug

SEQ ID NO: 19110 - RNA, 20 nt, Homo sapiens
ccagacccacuccugccucc

SEQ ID NO: 19111 - RNA, 18 nt, Homo sapiens
uccgccucccggguucaa

SEQ ID NO: 19112 - RNA, 18 nt, Homo sapiens
ugcuauuucaaagcaaua

SEQ ID NO: 19113 - RNA, 21 nt, Homo sapiens
ugguuuuccuguuugucccuc

SEQ ID NO: 19114 - RNA, 20 nt, Homo sapiens
uguuuucccuuucuacauuu

SEQ ID NO: 19115 - RNA, 22 nt, Homo sapiens
agcgagagaggcaccuuguucu

SEQ ID NO: 19116 - RNA, 20 nt, Homo sapiens
cccuucccuuccagcccaca

SEQ ID NO: 19117 - RNA, 20 nt, Homo sapiens
uucaagaccagccugaccaa

SEQ ID NO: 19118 - RNA, 20 nt, Homo sapiens
auggcgaaaccccaucgcua

SEQ ID NO: 19119 - RNA, 23 nt, Homo sapiens
ugucucucccauucuccgagcuu

SEQ ID NO: 19120 - RNA, 20 nt, Homo sapiens
uucaagaccagccugaccaa

SEQ ID NO: 19121 - RNA, 22 nt, Homo sapiens
gagccaagaucacgccacugca

SEQ ID NO: 19122 - RNA, 19 nt, Homo sapiens
uccaccuggaccguggcca

SEQ ID NO: 19123 - RNA, 21 nt, Homo sapiens
cgccugcccccauccccucca

SEQ ID NO: 19124 - RNA, 18 nt, Homo sapiens
cuucucugcccaccugcu

SEQ ID NO: 19125 - RNA, 20 nt, Homo sapiens
uguccucagaacuagacauc

SEQ ID NO: 19126 - RNA, 21 nt, Homo sapiens
cucaaccaauuuggcacccca

SEQ ID NO: 19127 - RNA, 19 nt, Homo sapiens
uucagguggucuucuacca

SEQ ID NO: 19128 - RNA, 21 nt, Homo sapiens
agcauccaccagauucuaugg

SEQ ID NO: 19129 - RNA, 18 nt, Homo sapiens
aucuggcauuucuggcuc

SEQ ID NO: 19130 - RNA, 21 nt, Homo sapiens
cacucaauccuaagcuccuca

SEQ ID NO: 19131 - RNA, 21 nt, Homo sapiens
ccuccaagagccucauuuuca

SEQ ID NO: 19132 - RNA, 20 nt, Homo sapiens
ccucugccucccggguucaa

SEQ ID NO: 19133 - RNA, 20 nt, Homo sapiens
cggaucucagcuggaucccu

SEQ ID NO: 19134 - RNA, 23 nt, Homo sapiens
ggacuguccccucgcuugcucca

SEQ ID NO: 19135 - RNA, 23 nt, Homo sapiens
gguagguggggaggggccacgcg

SEQ ID NO: 19136 - RNA, 18 nt, Homo sapiens
guagauggagaaguuguu

SEQ ID NO: 19137 - RNA, 17 nt, Homo sapiens
ucaagugauucuccugc

SEQ ID NO: 19138 - RNA, 19 nt, Homo sapiens
uggccucggggugggauug

SEQ ID NO: 19139 - RNA, 19 nt, Homo sapiens
ucaaacagaguugcaauca

SEQ ID NO: 19140 - RNA, 27 nt, Homo sapiens
ccuaagacucuuuucagguucauuuuu

SEQ ID NO: 19141 - RNA, 16 nt, Homo sapiens
cuauaucuacauaugc

SEQ ID NO: 19142 - RNA, 24 nt, Homo sapiens
ucauuuaauucaaaugccaaauag

SEQ ID NO: 19143 - RNA, 19 nt, Homo sapiens
aggcaauucucccaccuca

SEQ ID NO: 19144 - RNA, 18 nt, Homo sapiens
gauuucacuuucaugaca

SEQ ID NO: 19145 - RNA, 22 nt, Homo sapiens
uguaauugugacucauguguca

SEQ ID NO: 19146 - RNA, 20 nt, Homo sapiens
gacucaacaacaauaucaca

SEQ ID NO: 19147 - RNA, 21 nt, Homo sapiens
uggagucacaguauucuugga

SEQ ID NO: 19148 - RNA, 21 nt, Homo sapiens
acaaggaaucagauuccccgu

SEQ ID NO: 19149 - RNA, 18 nt, Homo sapiens
aucuuagagaacuauaca

SEQ ID NO: 19150 - RNA, 22 nt, Homo sapiens
ugaguaaucuuguaagcauuaa

SEQ ID NO: 19151 - RNA, 19 nt, Homo sapiens
auuugagugaauggcagga

SEQ ID NO: 19152 - RNA, 22 nt, Homo sapiens
cuauuauuaaaagcagcacaga

SEQ ID NO: 19153 - RNA, 22 nt, Homo sapiens
ccaaacagggauucagaaacca

SEQ ID NO: 19154 - RNA, 17 nt, Homo sapiens
cuggcugcacccgccca

SEQ ID NO: 19155 - RNA, 22 nt, Homo sapiens
gagggaacuuuggggauugcca

SEQ ID NO: 19156 - RNA, 21 nt, Homo sapiens
agguacagcugggcccagcca

SEQ ID NO: 19157 - RNA, 19 nt, Homo sapiens
ucaacaacaccagccugac

SEQ ID NO: 19158 - RNA, 19 nt, Homo sapiens
ugcccagauguauacccag

SEQ ID NO: 19159 - RNA, 15 nt, Homo sapiens
uggaauuucucuuca

SEQ ID NO: 19160 - RNA, 18 nt, Homo sapiens
uuguuggucaaaguauug

SEQ ID NO: 19161 - RNA, 18 nt, Homo sapiens
uccucagcacucauucua

SEQ ID NO: 19162 - RNA, 23 nt, Homo sapiens
agucccucauccagaagaugcca

SEQ ID NO: 19163 - RNA, 21 nt, Homo sapiens
aucagaaaaauuugaacacag

SEQ ID NO: 19164 - RNA, 21 nt, Homo sapiens
caugugcuuggcacucaagga

SEQ ID NO: 19165 - RNA, 21 nt, Homo sapiens
acuggggagaaauacuaugaa

SEQ ID NO: 19166 - RNA, 24 nt, Homo sapiens
agugauucuccugccucacccuca

SEQ ID NO: 19167 - RNA, 23 nt, Homo sapiens
auuucauauugcucaaacacaca

SEQ ID NO: 19168 - RNA, 24 nt, Homo sapiens
auuuuguuuauggccaguuucuca

SEQ ID NO: 19169 - RNA, 22 nt, Homo sapiens
cauagccaucacgagcauguca

SEQ ID NO: 19170 - RNA, 23 nt, Homo sapiens
ccacacuuugaggauucucuuca

SEQ ID NO: 19171 - RNA, 17 nt, Homo sapiens
ccagauuucauauugcu

SEQ ID NO: 19172 - RNA, 20 nt, Homo sapiens
cuagugagagcucucuuccu

SEQ ID NO: 19173 - RNA, 23 nt, Homo sapiens
cuugagcaguuuuccaguuuucu

SEQ ID NO: 19174 - RNA, 21 nt, Homo sapiens
ggccagguguugcuugcccuc

SEQ ID NO: 19175 - RNA, 18 nt, Homo sapiens
ggggagaaauacuaugaa

SEQ ID NO: 19176 - RNA, 20 nt, Homo sapiens
ucaccgcaaccuccaccucc

SEQ ID NO: 19177 - RNA, 21 nt, Homo sapiens
uccaagguucucuucuguucc

SEQ ID NO: 19178 - RNA, 21 nt, Homo sapiens
uccuaccagagagaaaccuuu

SEQ ID NO: 19179 - RNA, 22 nt, Homo sapiens
ucuaccuuccguaaaaugcuag

SEQ ID NO: 19180 - RNA, 18 nt, Homo sapiens
ggaggcggcggcggcggc

SEQ ID NO: 19181 - RNA, 17 nt, Homo sapiens
gggcauuauaacgagau

SEQ ID NO: 19182 - RNA, 15 nt, Homo sapiens
ugggcccgggaguuu

SEQ ID NO: 19183 - RNA, 18 nt, Homo sapiens
acgccuccauugcugcuu

SEQ ID NO: 19184 - RNA, 24 nt, Homo sapiens
caggauuuccguuugggucuaguu

SEQ ID NO: 19185 - RNA, 18 nt, Homo sapiens
ccucaugaaaagcagucc

SEQ ID NO: 19186 - RNA, 19 nt, Homo sapiens
ggacggccggcccgccccc

SEQ ID NO: 19187 - RNA, 16 nt, Homo sapiens
aacaucaaauucugaa

SEQ ID NO: 19188 - RNA, 19 nt, Homo sapiens
aagugauguuucuggcuua

SEQ ID NO: 19189 - RNA, 22 nt, Homo sapiens
acagaauauuugaaucuuugua

SEQ ID NO: 19190 - RNA, 18 nt, Homo sapiens
acuuaauuuuggauuuaa

SEQ ID NO: 19191 - RNA, 18 nt, Homo sapiens
cagaaacaucaaauucug

SEQ ID NO: 19192 - RNA, 17 nt, Homo sapiens
guucagaaaacauaauc

SEQ ID NO: 19193 - RNA, 18 nt, Homo sapiens
accucagugcugcacuca

SEQ ID NO: 19194 - RNA, 18 nt, Homo sapiens
acuacuauuugucaccuc

SEQ ID NO: 19195 - RNA, 20 nt, Homo sapiens
agaggcagaguuugcuugcc

SEQ ID NO: 19196 - RNA, 20 nt, Homo sapiens
aggaagguggaaaaccaaga

SEQ ID NO: 19197 - RNA, 16 nt, Homo sapiens
agggcacuuugcagcu

SEQ ID NO: 19198 - RNA, 25 nt, Homo sapiens
ccuuucuuauuauaagcuguuccag

SEQ ID NO: 19199 - RNA, 19 nt, Homo sapiens
cuuugggagcagggccugc

SEQ ID NO: 19200 - RNA, 23 nt, Homo sapiens
gaugucugugaugacaguggcca

SEQ ID NO: 19201 - RNA, 23 nt, Homo sapiens
gcaagaagaucccagugcuugcc

SEQ ID NO: 19202 - RNA, 31 nt, Homo sapiens
gccuggguuugaaaaauuccaacuuauuuuu

SEQ ID NO: 19203 - RNA, 19 nt, Homo sapiens
gccuucugagccucacauc

SEQ ID NO: 19204 - RNA, 18 nt, Homo sapiens
aacugucaggucaaaaua

SEQ ID NO: 19205 - RNA, 22 nt, Homo sapiens
ucuuuuucaaugaagcuuugca

SEQ ID NO: 19206 - RNA, 23 nt, Homo sapiens
uuguacuuuuuuuauauacuuca

SEQ ID NO: 19207 - RNA, 18 nt, Homo sapiens
acucacaauuugugcuca

SEQ ID NO: 19208 - RNA, 19 nt, Homo sapiens
caucacaguauucugugau

SEQ ID NO: 19209 - RNA, 19 nt, Homo sapiens
uucugugaugucuuuuuaa

SEQ ID NO: 19210 - RNA, 21 nt, Homo sapiens
ucagucuuugcaugcugcuca

SEQ ID NO: 19211 - RNA, 23 nt, Homo sapiens
ucauaggccccaccuccacgucc

SEQ ID NO: 19212 - RNA, 24 nt, Homo sapiens
acuuggcaagggacccccugguuc

SEQ ID NO: 19213 - RNA, 18 nt, Homo sapiens
ccaacaaggcaagccaaa

SEQ ID NO: 19214 - RNA, 21 nt, Homo sapiens
gacuuuggcuuuuguaaauca

SEQ ID NO: 19215 - RNA, 23 nt, Homo sapiens
uaagauugcucuaaggcccagca

SEQ ID NO: 19216 - RNA, 16 nt, Homo sapiens
ucugccuugagacugc

SEQ ID NO: 19217 - RNA, 23 nt, Homo sapiens
uuuaguugacuuuuuaguuauag

SEQ ID NO: 19218 - RNA, 20 nt, Homo sapiens
gcccucagggccagccagga

SEQ ID NO: 19219 - RNA, 18 nt, Homo sapiens
gaaaacaucagggagaug

SEQ ID NO: 19220 - RNA, 19 nt, Homo sapiens
gagcagagaaucuacauua

SEQ ID NO: 19221 - RNA, 18 nt, Homo sapiens
acuccagcacggggugaa

SEQ ID NO: 19222 - RNA, 19 nt, Homo sapiens
caacccucggcucucuccu

SEQ ID NO: 19223 - RNA, 21 nt, Homo sapiens
cagacagaaaccgaaagcucu

SEQ ID NO: 19224 - RNA, 21 nt, Homo sapiens
cucaucuuuucuucuuacaca

SEQ ID NO: 19225 - RNA, 22 nt, Homo sapiens
ucuauuaauaaugguaguauua

SEQ ID NO: 19226 - RNA, 21 nt, Homo sapiens
agucuggucuccuguguuuca

SEQ ID NO: 19227 - RNA, 22 nt, Homo sapiens
aucuuggcucacugcaaucucu

SEQ ID NO: 19228 - RNA, 19 nt, Homo sapiens
caucaucauucauguuuuu

SEQ ID NO: 19229 - RNA, 20 nt, Homo sapiens
cauuguuuacaggugugaaa

SEQ ID NO: 19230 - RNA, 23 nt, Homo sapiens
ccuggguaauuuuuuuuuuuuuu

SEQ ID NO: 19231 - RNA, 20 nt, Homo sapiens
ucaagacucugaaauaugua

SEQ ID NO: 19232 - RNA, 20 nt, Homo sapiens
ucucugccucucggguucaa

SEQ ID NO: 19233 - RNA, 16 nt, Homo sapiens
ugugaagcaaagguca

SEQ ID NO: 19234 - RNA, 17 nt, Homo sapiens
acaccugggaauuauga

SEQ ID NO: 19235 - RNA, 19 nt, Homo sapiens
gauaguagauaugagacua

SEQ ID NO: 19236 - RNA, 18 nt, Homo sapiens
ggcuuacacuaagcuuuu

SEQ ID NO: 19237 - RNA, 22 nt, Homo sapiens
ugauugcaccacugcacucuaa

SEQ ID NO: 19238 - RNA, 19 nt, Homo sapiens
uggugaaaccccaucucca

SEQ ID NO: 19239 - RNA, 23 nt, Homo sapiens
agagcaucuuccaagacuccagc

SEQ ID NO: 19240 - RNA, 23 nt, Homo sapiens
uuguggugggguaucuucaguua

SEQ ID NO: 19241 - RNA, 24 nt, Homo sapiens
aucauagaaggugagaauguguuu

SEQ ID NO: 19242 - RNA, 21 nt, Homo sapiens
guggauuaugaacaaaugaaa

SEQ ID NO: 19243 - RNA, 23 nt, Homo sapiens
cuuugagugcuggguaccugugg

SEQ ID NO: 19244 - RNA, 22 nt, Homo sapiens
uggcccccucugacauaaacug

SEQ ID NO: 19245 - RNA, 21 nt, Homo sapiens
uccacuggcugaaugaucagg

SEQ ID NO: 19246 - RNA, 18 nt, Homo sapiens
ugagucucagcagccgcc

SEQ ID NO: 19247 - RNA, 21 nt, Homo sapiens
cguuuccaugguaacccugag

SEQ ID NO: 19248 - RNA, 25 nt, Homo sapiens
caggauuaggaauuuggguuuguca

SEQ ID NO: 19249 - RNA, 20 nt, Homo sapiens
cuucuaucccagauuaccua

SEQ ID NO: 19250 - RNA, 22 nt, Homo sapiens
uccaguccuuccaugcccuucu

SEQ ID NO: 19251 - RNA, 22 nt, Homo sapiens
cauggaguuguccagugacuca

SEQ ID NO: 19252 - RNA, 19 nt, Homo sapiens
cucuccuugccucccugau

SEQ ID NO: 19253 - RNA, 18 nt, Homo sapiens
cuguauaaagacaguaga

SEQ ID NO: 19254 - RNA, 21 nt, Homo sapiens
cuuaagcaugaagugacuuuu

SEQ ID NO: 19255 - RNA, 18 nt, Homo sapiens
gccgaccacaguauaaga

SEQ ID NO: 19256 - RNA, 15 nt, Homo sapiens
ggagcagaucuugug

SEQ ID NO: 19257 - RNA, 18 nt, Homo sapiens
gagcaacagaagcuauua

SEQ ID NO: 19258 - RNA, 17 nt, Homo sapiens
gccccccagccaggaua

SEQ ID NO: 19259 - RNA, 20 nt, Homo sapiens
agcuuucuggucaaaucuca

SEQ ID NO: 19260 - RNA, 20 nt, Homo sapiens
acagcaagcagcaugcagca

SEQ ID NO: 19261 - RNA, 23 nt, Homo sapiens
cucuguuaaggaagcuucauuuu

SEQ ID NO: 19262 - RNA, 21 nt, Homo sapiens
cucuuucucucucucuccuca

SEQ ID NO: 19263 - RNA, 24 nt, Homo sapiens
gcagcaggcuuaggauuuuuguca

SEQ ID NO: 19264 - RNA, 20 nt, Homo sapiens
gccccucuuccccuaccccu

SEQ ID NO: 19265 - RNA, 21 nt, Homo sapiens
gguucugaagccacagacuca

SEQ ID NO: 19266 - RNA, 17 nt, Homo sapiens
gugggcacagcucccca

SEQ ID NO: 19267 - RNA, 21 nt, Homo sapiens
caucugucacuuuauguagau

SEQ ID NO: 19268 - RNA, 22 nt, Homo sapiens
ccucaucacucugacucugccu

SEQ ID NO: 19269 - RNA, 19 nt, Homo sapiens
cugcauccaagucaacuca

SEQ ID NO: 19270 - RNA, 20 nt, Homo sapiens
gguaaguggggggauucucg

SEQ ID NO: 19271 - RNA, 21 nt, Homo sapiens
uccaguugucacccugcccag

SEQ ID NO: 19272 - RNA, 24 nt, Homo sapiens
ucccccagguuucugaugccauca

SEQ ID NO: 19273 - RNA, 20 nt, Homo sapiens
gauaaaaaccccuugcuauu

SEQ ID NO: 19274 - RNA, 19 nt, Homo sapiens
ucacuugugccaggcauac

SEQ ID NO: 19275 - RNA, 18 nt, Homo sapiens
aggaaacugaaagcccca

SEQ ID NO: 19276 - RNA, 22 nt, Homo sapiens
ccucugggaagccuaguuccca

SEQ ID NO: 19277 - RNA, 20 nt, Homo sapiens
ugggaagccuaguucccaca

SEQ ID NO: 19278 - RNA, 20 nt, Homo sapiens
acaggggaaaaggaauuagu

SEQ ID NO: 19279 - RNA, 18 nt, Homo sapiens
agagcaaguaacauauua

SEQ ID NO: 19280 - RNA, 16 nt, Homo sapiens
auuauaacauucuucc

SEQ ID NO: 19281 - RNA, 21 nt, Homo sapiens
cccccgccccagccuaccuuc

SEQ ID NO: 19282 - RNA, 19 nt, Homo sapiens
uguuuuucucccuuuucca

SEQ ID NO: 19283 - RNA, 20 nt, Homo sapiens
accuaagccaucaucaacca

SEQ ID NO: 19284 - RNA, 21 nt, Homo sapiens
cucuuucucuuggucaacuca

SEQ ID NO: 19285 - RNA, 21 nt, Homo sapiens
ugcaggggugguccuuuggug

SEQ ID NO: 19286 - RNA, 21 nt, Homo sapiens
uggcgguucuuuccuaucuca

SEQ ID NO: 19287 - RNA, 19 nt, Homo sapiens
ccagacccccggggaccca

SEQ ID NO: 19288 - RNA, 21 nt, Homo sapiens
gcuacuuguuuucucacuuga

SEQ ID NO: 19289 - RNA, 19 nt, Homo sapiens
ggguugagcucugugcagu

SEQ ID NO: 19290 - RNA, 17 nt, Homo sapiens
uuguaccaauuuuaguc

SEQ ID NO: 19291 - RNA, 20 nt, Homo sapiens
ugccauccuaggcaucauuc

SEQ ID NO: 19292 - RNA, 24 nt, Homo sapiens
augccacuuuugccuccugcccug

SEQ ID NO: 19293 - RNA, 19 nt, Homo sapiens
cgaccuugaacugugcuca

SEQ ID NO: 19294 - RNA, 20 nt, Homo sapiens
guugauggguuucugugaaa

SEQ ID NO: 19295 - RNA, 22 nt, Homo sapiens
agagcauuguagucagcaguaa

SEQ ID NO: 19296 - RNA, 21 nt, Homo sapiens
agccaagauugcgccacugca

SEQ ID NO: 19297 - RNA, 23 nt, Homo sapiens
ccaugggggucccauuugugacc

SEQ ID NO: 19298 - RNA, 18 nt, Homo sapiens
acugucgcugaugugaua

SEQ ID NO: 19299 - RNA, 20 nt, Homo sapiens
cuccucauugugugaccagg

SEQ ID NO: 19300 - RNA, 21 nt, Homo sapiens
ucgugcacugcucgagacaca

SEQ ID NO: 19301 - RNA, 23 nt, Homo sapiens
ugcgcguaugugcgcacauaugu

SEQ ID NO: 19302 - RNA, 17 nt, Homo sapiens
ccaugaaauuccaguga

SEQ ID NO: 19303 - RNA, 18 nt, Homo sapiens
cccacggucuccaucuca

SEQ ID NO: 19304 - RNA, 22 nt, Homo sapiens
ugcacucgaguaauuagcaaag

SEQ ID NO: 19305 - RNA, 22 nt, Homo sapiens
aacaaaaagaugcucuguguaa

SEQ ID NO: 19306 - RNA, 22 nt, Homo sapiens
aguuauauccuuuggcucagcu

SEQ ID NO: 19307 - RNA, 22 nt, Homo sapiens
auggcaccuuuuaacuaaccca

SEQ ID NO: 19308 - RNA, 19 nt, Homo sapiens
ccaaaacaauaaucaaaga

SEQ ID NO: 19309 - RNA, 22 nt, Homo sapiens
cccuuccccacucuucagcccc

SEQ ID NO: 19310 - RNA, 18 nt, Homo sapiens
gcuguauuauagccuuau

SEQ ID NO: 19311 - RNA, 20 nt, Homo sapiens
aaaccaauucacccagcugg

SEQ ID NO: 19312 - RNA, 21 nt, Homo sapiens
accaauucacccagcugggca

SEQ ID NO: 19313 - RNA, 23 nt, Homo sapiens
ccuuuuaguacuguuuugaguuu

SEQ ID NO: 19314 - RNA, 23 nt, Homo sapiens
cuagagggacugacuuuugucca

SEQ ID NO: 19315 - RNA, 20 nt, Homo sapiens
acuuuucuggcccuacugca

SEQ ID NO: 19316 - RNA, 20 nt, Homo sapiens
gcaucucagccuccuaccca

SEQ ID NO: 19317 - RNA, 24 nt, Homo sapiens
agcuccuggcuguuccucaccuga

SEQ ID NO: 19318 - RNA, 17 nt, Homo sapiens
ugacaucuccuuccuuc

SEQ ID NO: 19319 - RNA, 19 nt, Homo sapiens
acaugugucugucuggccu

SEQ ID NO: 19320 - RNA, 19 nt, Homo sapiens
auuuuuuauucuauugaua

SEQ ID NO: 19321 - RNA, 18 nt, Homo sapiens
cuugccaucugucagugu

SEQ ID NO: 19322 - RNA, 15 nt, Homo sapiens
gucagauccuugcca

SEQ ID NO: 19323 - RNA, 16 nt, Homo sapiens
ucuguugauugccaac

SEQ ID NO: 19324 - RNA, 15 nt, Homo sapiens
ugaggaaaugggcaa

SEQ ID NO: 19325 - RNA, 19 nt, Homo sapiens
aaucaaaaggagaauaaua

SEQ ID NO: 19326 - RNA, 21 nt, Homo sapiens
acaaaaacauuuucuucuucu

SEQ ID NO: 19327 - RNA, 16 nt, Homo sapiens
auugaaucugcucuca

SEQ ID NO: 19328 - RNA, 24 nt, Homo sapiens
cucucauugaugugcugguuuaug

SEQ ID NO: 19329 - RNA, 25 nt, Homo sapiens
uccaacuaucaauagucagguucaa

SEQ ID NO: 19330 - RNA, 23 nt, Homo sapiens
ccuggagggccuggauuucuuuu

SEQ ID NO: 19331 - RNA, 23 nt, Homo sapiens
cgugugggcuucagugugaggcu

SEQ ID NO: 19332 - RNA, 18 nt, Homo sapiens
uauuaccuuuuucugguu

SEQ ID NO: 19333 - RNA, 21 nt, Homo sapiens
augugacuuuguagauauucc

SEQ ID NO: 19334 - RNA, 17 nt, Homo sapiens
cccccaaccacccacca

SEQ ID NO: 19335 - RNA, 17 nt, Homo sapiens
guagcaggcaguuccca

SEQ ID NO: 19336 - RNA, 20 nt, Homo sapiens
uacugacaccccacuggcua

SEQ ID NO: 19337 - RNA, 17 nt, Homo sapiens
ucuucaccacugaucuc

SEQ ID NO: 19338 - RNA, 22 nt, Homo sapiens
uuucuucauucagcuuagccuu

SEQ ID NO: 19339 - RNA, 26 nt, Homo sapiens
uuuuaaggagaaaaaaaaaugaguaa

SEQ ID NO: 19340 - RNA, 18 nt, Homo sapiens
accuauuucacugccuca

SEQ ID NO: 19341 - RNA, 19 nt, Homo sapiens
gcguacaccagacccuuca

SEQ ID NO: 19342 - RNA, 18 nt, Homo sapiens
gguaauagaaccacauug

SEQ ID NO: 19343 - RNA, 21 nt, Homo sapiens
cagcccuccaccucucgggga

SEQ ID NO: 19344 - RNA, 21 nt, Homo sapiens
ccaagcagaaaccggaccuca

SEQ ID NO: 19345 - RNA, 18 nt, Homo sapiens
ccuccuccucuuccucag

SEQ ID NO: 19346 - RNA, 22 nt, Homo sapiens
cucuuaacuguacguguaguuu

SEQ ID NO: 19347 - RNA, 18 nt, Homo sapiens
gcccagaggaugauccag

SEQ ID NO: 19348 - RNA, 18 nt, Homo sapiens
gcccagaggaugauccag

SEQ ID NO: 19349 - RNA, 26 nt, Homo sapiens
gccugagccagggcuuggcuuggccu

SEQ ID NO: 19350 - RNA, 18 nt, Homo sapiens
ucauuaaaaugaugacau

SEQ ID NO: 19351 - RNA, 20 nt, Homo sapiens
uccacugcgaguugaccaau

SEQ ID NO: 19352 - RNA, 21 nt, Homo sapiens
ugaaggugaggguucagagua

SEQ ID NO: 19353 - RNA, 20 nt, Homo sapiens
ugccugccgaccagcggaga

SEQ ID NO: 19354 - RNA, 23 nt, Homo sapiens
ugcucccagaggccgggcaacug

SEQ ID NO: 19355 - RNA, 18 nt, Homo sapiens
ggcuucugcucucauuca

SEQ ID NO: 19356 - RNA, 20 nt, Homo sapiens
ugcacaguucuacacuguca

SEQ ID NO: 19357 - RNA, 19 nt, Homo sapiens
agaugggugcugguccuca

SEQ ID NO: 19358 - RNA, 18 nt, Homo sapiens
cagcuacgcucugugaca

SEQ ID NO: 19359 - RNA, 19 nt, Homo sapiens
caguaacaucaagugcuca

SEQ ID NO: 19360 - RNA, 24 nt, Homo sapiens
ccuugggcugagaggaccugggaa

SEQ ID NO: 19361 - RNA, 23 nt, Homo sapiens
ugagaggaccugggaagccccuc

SEQ ID NO: 19362 - RNA, 20 nt, Homo sapiens
aucccuaggaauugccuauc

SEQ ID NO: 19363 - RNA, 19 nt, Homo sapiens
uaucuaaaauauuaccauu

SEQ ID NO: 19364 - RNA, 18 nt, Homo sapiens
uuaugacuguuuugguuc

SEQ ID NO: 19365 - RNA, 18 nt, Homo sapiens
caggugccacugucagcu

SEQ ID NO: 19366 - RNA, 19 nt, Homo sapiens
gucaccuaguuauacaaac

SEQ ID NO: 19367 - RNA, 16 nt, Homo sapiens
aucgaggcugcgguga

SEQ ID NO: 19368 - RNA, 19 nt, Homo sapiens
ccccgccgcucaccggcgc

SEQ ID NO: 19369 - RNA, 19 nt, Homo sapiens
ggccgggugcgguggcuca

SEQ ID NO: 19370 - RNA, 18 nt, Homo sapiens
augagaucacugacauuc

SEQ ID NO: 19371 - RNA, 19 nt, Homo sapiens
ugagaucacugacauucca

SEQ ID NO: 19372 - RNA, 18 nt, Homo sapiens
aaugcaguaugggacuau

SEQ ID NO: 19373 - RNA, 20 nt, Homo sapiens
agaaaaugugaauuuuucgu

SEQ ID NO: 19374 - RNA, 21 nt, Homo sapiens
aguggguggaaagggcauuug

SEQ ID NO: 19375 - RNA, 21 nt, Homo sapiens
aguuccgagcuugaagucacu

SEQ ID NO: 19376 - RNA, 21 nt, Homo sapiens
guauguauguuauacuugauu

SEQ ID NO: 19377 - RNA, 21 nt, Homo sapiens
uaacuucaaaaucuccuuuau

SEQ ID NO: 19378 - RNA, 22 nt, Homo sapiens
cccagaggcccagcuccccagu

SEQ ID NO: 19379 - RNA, 21 nt, Homo sapiens
gcaaccagcugcugccugugg

SEQ ID NO: 19380 - RNA, 22 nt, Homo sapiens
uacgacuuggcuuucugaaacg

SEQ ID NO: 19381 - RNA, 22 nt, Homo sapiens
accugggucugggaccuggcuc

SEQ ID NO: 19382 - RNA, 23 nt, Homo sapiens
cugagccuugugacuugagcaga

SEQ ID NO: 19383 - RNA, 18 nt, Homo sapiens
ggugcagcccugccuggc

SEQ ID NO: 19384 - RNA, 21 nt, Homo sapiens
ugaggcugccccuccuaccac

SEQ ID NO: 19385 - RNA, 21 nt, Homo sapiens
guugaauacuguucuuuggca

SEQ ID NO: 19386 - RNA, 18 nt, Homo sapiens
acaaaaguagaccaaagu

SEQ ID NO: 19387 - RNA, 22 nt, Homo sapiens
agccuagguuauacagaugcca

SEQ ID NO: 19388 - RNA, 24 nt, Homo sapiens
uauuaccucagauaccuguuguca

SEQ ID NO: 19389 - RNA, 18 nt, Homo sapiens
ugcaagauuuucauaauu

SEQ ID NO: 19390 - RNA, 20 nt, Homo sapiens
uuugaguucauaaaucauuu

SEQ ID NO: 19391 - RNA, 22 nt, Homo sapiens
acacccucaagucucuuugcca

SEQ ID NO: 19392 - RNA, 18 nt, Homo sapiens
agcugagcagcuggagcc

SEQ ID NO: 19393 - RNA, 24 nt, Homo sapiens
ccucuuuguagcagauaugauuuu

SEQ ID NO: 19394 - RNA, 17 nt, Homo sapiens
uuacugucaccuucacu

SEQ ID NO: 19395 - RNA, 18 nt, Homo sapiens
aaaaacaaaacaaacaaa

SEQ ID NO: 19396 - RNA, 18 nt, Homo sapiens
gaacagaucaguuguugu

SEQ ID NO: 19397 - RNA, 23 nt, Homo sapiens
agcagucuucuugccucagccuc

SEQ ID NO: 19398 - RNA, 20 nt, Homo sapiens
ccucugccuccuggguucaa

SEQ ID NO: 19399 - RNA, 20 nt, Homo sapiens
aauaucuuaguuugcuacca

SEQ ID NO: 19400 - RNA, 23 nt, Homo sapiens
uaccagcauccagcaugaaguug

SEQ ID NO: 19401 - RNA, 21 nt, Homo sapiens
ugugggggugggaugugagug

SEQ ID NO: 19402 - RNA, 19 nt, Homo sapiens
aguauuauauccaugcugu

SEQ ID NO: 19403 - RNA, 21 nt, Homo sapiens
aucuuggcucacugcaaccuc

SEQ ID NO: 19404 - RNA, 17 nt, Homo sapiens
cugucucaguugucaga

SEQ ID NO: 19405 - RNA, 18 nt, Homo sapiens
uccgccucuuggguucaa

SEQ ID NO: 19406 - RNA, 18 nt, Homo sapiens
uggccuugacucacuuuu

SEQ ID NO: 19407 - RNA, 19 nt, Homo sapiens
uuaaaaauggagccuuuca

SEQ ID NO: 19408 - RNA, 18 nt, Homo sapiens
acccaggccgggcugcca

SEQ ID NO: 19409 - RNA, 19 nt, Homo sapiens
gagccuuccucuucccgca

SEQ ID NO: 19410 - RNA, 20 nt, Homo sapiens
ggagaggcggcggcggcggc

SEQ ID NO: 19411 - RNA, 20 nt, Homo sapiens
uuccucuucccgcagcacgc

SEQ ID NO: 19412 - RNA, 19 nt, Homo sapiens
caaggcccacauucuccuu

SEQ ID NO: 19413 - RNA, 20 nt, Homo sapiens
gagcgccuccagggccccgc

SEQ ID NO: 19414 - RNA, 19 nt, Homo sapiens
aaaaaugaaauaucugguu

SEQ ID NO: 19415 - RNA, 22 nt, Homo sapiens
caguguuuugucuguccgcgcc

SEQ ID NO: 19416 - RNA, 24 nt, Homo sapiens
ugagaaguugcuucuuuuacauca

SEQ ID NO: 19417 - RNA, 24 nt, Homo sapiens
uggauggggguuggcaggaagcug

SEQ ID NO: 19418 - RNA, 23 nt, Homo sapiens
caggaagucaaucaucugugaca

SEQ ID NO: 19419 - RNA, 22 nt, Homo sapiens
guacccguucuuauccuagugg

SEQ ID NO: 19420 - RNA, 23 nt, Homo sapiens
aaggcaucuuccuccucucugug

SEQ ID NO: 19421 - RNA, 21 nt, Homo sapiens
gcacaggcaccagcuaccuca

SEQ ID NO: 19422 - RNA, 21 nt, Homo sapiens
aagagaggcccaggcuacugg

SEQ ID NO: 19423 - RNA, 21 nt, Homo sapiens
cccugcugcggagaccgcgga

SEQ ID NO: 19424 - RNA, 20 nt, Homo sapiens
acuccaucagaacagcucca

SEQ ID NO: 19425 - RNA, 17 nt, Homo sapiens
cuggccucagcauauca

SEQ ID NO: 19426 - RNA, 19 nt, Homo sapiens
cugaaauuggaacacccuu

SEQ ID NO: 19427 - RNA, 18 nt, Homo sapiens
uauugcaaugacaccauu

SEQ ID NO: 19428 - RNA, 25 nt, Homo sapiens
uuaugguauauuuuaagugacuuuu

SEQ ID NO: 19429 - RNA, 22 nt, Homo sapiens
ccagacucgccaggaaaggcua

SEQ ID NO: 19430 - RNA, 21 nt, Homo sapiens
gcgcggagcacccggcgccga

SEQ ID NO: 19431 - RNA, 22 nt, Homo sapiens
accacacugccccucuccuccu

SEQ ID NO: 19432 - RNA, 24 nt, Homo sapiens
acuuggauuuucuuuauuuggcuu

SEQ ID NO: 19433 - RNA, 21 nt, Homo sapiens
gccacccugcuguccuugaga

SEQ ID NO: 19434 - RNA, 20 nt, Homo sapiens
auguggacguggguggguga

SEQ ID NO: 19435 - RNA, 19 nt, Homo sapiens
caugcugggccuuuccagu

SEQ ID NO: 19436 - RNA, 16 nt, Homo sapiens
cucuccuccucuccuc

SEQ ID NO: 19437 - RNA, 20 nt, Homo sapiens
gguggaaaggggcaugugug

SEQ ID NO: 19438 - RNA, 19 nt, Homo sapiens
agaauggggccccagccgg

SEQ ID NO: 19439 - RNA, 24 nt, Homo sapiens
aggcccuguggagacaaucccuca

SEQ ID NO: 19440 - RNA, 20 nt, Homo sapiens
aacucccgggacacccagga

SEQ ID NO: 19441 - RNA, 18 nt, Homo sapiens
gcuccauuaaguacucca

SEQ ID NO: 19442 - RNA, 22 nt, Homo sapiens
uaacgacaacaaaccggucaca

SEQ ID NO: 19443 - RNA, 20 nt, Homo sapiens
uuggcagaaauuguguucuu

SEQ ID NO: 19444 - RNA, 16 nt, Homo sapiens
ccaccuucccaucuca

SEQ ID NO: 19445 - RNA, 20 nt, Homo sapiens
acuaaaauuaauacagcucu

SEQ ID NO: 19446 - RNA, 19 nt, Homo sapiens
guuuaggugguccugaauc

SEQ ID NO: 19447 - RNA, 17 nt, Homo sapiens
gcugggccgccuggccc

SEQ ID NO: 19448 - RNA, 19 nt, Homo sapiens
gugagcuggagcugggcca

SEQ ID NO: 19449 - RNA, 20 nt, Homo sapiens
aaaauagacaagugauaccu

SEQ ID NO: 19450 - RNA, 23 nt, Homo sapiens
accaacuucacaggguguucaga

SEQ ID NO: 19451 - RNA, 21 nt, Homo sapiens
agccuccuuccuccccgggga

SEQ ID NO: 19452 - RNA, 27 nt, Homo sapiens
gucugagcagagacauugauuugguuu

SEQ ID NO: 19453 - RNA, 19 nt, Homo sapiens
uccuuuaaaaaccgaucgg

SEQ ID NO: 19454 - RNA, 19 nt, Homo sapiens
ugcacuccagcgugggcua

SEQ ID NO: 19455 - RNA, 19 nt, Homo sapiens
ugggagaaaaugucugcaa

SEQ ID NO: 19456 - RNA, 16 nt, Homo sapiens
auuuguggauagacug

SEQ ID NO: 19457 - RNA, 18 nt, Homo sapiens
cuagaugaucucuaaagg

SEQ ID NO: 19458 - RNA, 19 nt, Homo sapiens
gugagacuguagugucagg

SEQ ID NO: 19459 - RNA, 20 nt, Homo sapiens
ugaagagacuaugcugagug

SEQ ID NO: 19460 - RNA, 17 nt, Homo sapiens
ggagagaaaauguaccu

SEQ ID NO: 19461 - RNA, 19 nt, Homo sapiens
cccgcgcggcgccuggccc

SEQ ID NO: 19462 - RNA, 22 nt, Homo sapiens
accacguccuacaacucugaca

SEQ ID NO: 19463 - RNA, 16 nt, Homo sapiens
acgcgcuuccucucuu

SEQ ID NO: 19464 - RNA, 17 nt, Homo sapiens
cgcgcuuccucucuuga

SEQ ID NO: 19465 - RNA, 17 nt, Homo sapiens
cugguccuuugcagcca

SEQ ID NO: 19466 - RNA, 17 nt, Homo sapiens
acaauuuugcagagaua

SEQ ID NO: 19467 - RNA, 23 nt, Homo sapiens
ccagcggaaggagcugugccccg

SEQ ID NO: 19468 - RNA, 20 nt, Homo sapiens
cccacucagcacucugccag

SEQ ID NO: 19469 - RNA, 21 nt, Homo sapiens
ccccacucagcacucugccag

SEQ ID NO: 19470 - RNA, 18 nt, Homo sapiens
cuugggcugaccugaccc

SEQ ID NO: 19471 - RNA, 18 nt, Homo sapiens
gggauggacggcuucggc

SEQ ID NO: 19472 - RNA, 22 nt, Homo sapiens
agacacaguggauauuuugggc

SEQ ID NO: 19473 - RNA, 19 nt, Homo sapiens
cagggaucucgaaauucug

SEQ ID NO: 19474 - RNA, 18 nt, Homo sapiens
gacagagcuggggucuca

SEQ ID NO: 19475 - RNA, 21 nt, Homo sapiens
aaacuaucucaauacuggcug

SEQ ID NO: 19476 - RNA, 17 nt, Homo sapiens
aaugagauuuuguggug

SEQ ID NO: 19477 - RNA, 20 nt, Homo sapiens
aucgccgccuccccgccuca

SEQ ID NO: 19478 - RNA, 21 nt, Homo sapiens
cagggcuuccagaucacuuuu

SEQ ID NO: 19479 - RNA, 18 nt, Homo sapiens
cccgaauugaacacuuuu

SEQ ID NO: 19480 - RNA, 21 nt, Homo sapiens
gaggucauuguuuuuggcuua

SEQ ID NO: 19481 - RNA, 18 nt, Homo sapiens
gcaggagggaggguuuuu

SEQ ID NO: 19482 - RNA, 19 nt, Homo sapiens
gccugaccaugaagcaaca

SEQ ID NO: 19483 - RNA, 18 nt, Homo sapiens
uauguaugauuuuggcua

SEQ ID NO: 19484 - RNA, 17 nt, Homo sapiens
uuuucuuguucacagua

SEQ ID NO: 19485 - RNA, 22 nt, Homo sapiens
ccagcagcgaaaaagcuggcca

SEQ ID NO: 19486 - RNA, 18 nt, Homo sapiens
cugaguacagauauuaca

SEQ ID NO: 19487 - RNA, 23 nt, Homo sapiens
ucuagguggucuuuuccuuauuu

SEQ ID NO: 19488 - RNA, 22 nt, Homo sapiens
uggcaugguuuggcuucugaua

SEQ ID NO: 19489 - RNA, 18 nt, Homo sapiens
cuguccacacaugcacac

SEQ ID NO: 19490 - RNA, 16 nt, Homo sapiens
ucuggccucccagauc

SEQ ID NO: 19491 - RNA, 21 nt, Homo sapiens
ugaccaugccugaaccaguca

SEQ ID NO: 19492 - RNA, 23 nt, Homo sapiens
uucugccccugaucgcuugguuu

SEQ ID NO: 19493 - RNA, 19 nt, Homo sapiens
aacaaagugcagacauuca

SEQ ID NO: 19494 - RNA, 19 nt, Homo sapiens
cguguuggcgggcaucugu

SEQ ID NO: 19495 - RNA, 22 nt, Homo sapiens
aagggcuauaacauacauguca

SEQ ID NO: 19496 - RNA, 20 nt, Homo sapiens
cucuaacaacuggcaugcaa

SEQ ID NO: 19497 - RNA, 17 nt, Homo sapiens
gaagaguuuuaaguagc

SEQ ID NO: 19498 - RNA, 16 nt, Homo sapiens
uuaugccaacaagaug

SEQ ID NO: 19499 - RNA, 18 nt, Homo sapiens
uugauucuauucaaucca

SEQ ID NO: 19500 - RNA, 23 nt, Homo sapiens
cacccuucggagccccgcuuuca

SEQ ID NO: 19501 - RNA, 16 nt, Homo sapiens
agccggggccuucuca

SEQ ID NO: 19502 - RNA, 18 nt, Homo sapiens
ccucugggaggccugagg

SEQ ID NO: 19503 - RNA, 22 nt, Homo sapiens
guggccccucugggaggccuga

SEQ ID NO: 19504 - RNA, 19 nt, Homo sapiens
ucaauccugguagcaacac

SEQ ID NO: 19505 - RNA, 23 nt, Homo sapiens
cguuuccauucugccuucucaga

SEQ ID NO: 19506 - RNA, 20 nt, Homo sapiens
ggguuuccauccccgcugcc

SEQ ID NO: 19507 - RNA, 22 nt, Homo sapiens
ugcagcucggccuccgcgccgc

SEQ ID NO: 19508 - RNA, 23 nt, Homo sapiens
ucagagauaaacaagaacaaaua

SEQ ID NO: 19509 - RNA, 19 nt, Homo sapiens
ccacagaacaugccugcca

SEQ ID NO: 19510 - RNA, 20 nt, Homo sapiens
ccucugccuccuggguucaa

SEQ ID NO: 19511 - RNA, 20 nt, Homo sapiens
cgcccccaggccaccugcuc

SEQ ID NO: 19512 - RNA, 21 nt, Homo sapiens
cuccucaggacugcagcacug

SEQ ID NO: 19513 - RNA, 22 nt, Homo sapiens
gaaggucauccaaguuuccucc

SEQ ID NO: 19514 - RNA, 22 nt, Homo sapiens
gcccccaggccaccugcuccgg

SEQ ID NO: 19515 - RNA, 22 nt, Homo sapiens
guuccgcacgauccggaaccca

SEQ ID NO: 19516 - RNA, 21 nt, Homo sapiens
ccaaaucuuuguguuugccua

SEQ ID NO: 19517 - RNA, 21 nt, Homo sapiens
cuaucaucgauacauacuguu

SEQ ID NO: 19518 - RNA, 19 nt, Homo sapiens
cugcccuuggcaucaucca

SEQ ID NO: 19519 - RNA, 19 nt, Homo sapiens
gcuuuggcugucuggacuu

SEQ ID NO: 19520 - RNA, 26 nt, Homo sapiens
ucucacgcuuuggcugucuggacuuu

SEQ ID NO: 19521 - RNA, 19 nt, Homo sapiens
uuccagaaccugccaccag

SEQ ID NO: 19522 - RNA, 19 nt, Homo sapiens
cacuaccacaguuuuuaca

SEQ ID NO: 19523 - RNA, 23 nt, Homo sapiens
cccugacggcccauuguccgcgg

SEQ ID NO: 19524 - RNA, 21 nt, Homo sapiens
ucucacaaagcugccuugacu

SEQ ID NO: 19525 - RNA, 21 nt, Homo sapiens
ugacuugagacacccaagagg

SEQ ID NO: 19526 - RNA, 20 nt, Homo sapiens
acucuggaccugccugccuc

SEQ ID NO: 19527 - RNA, 19 nt, Homo sapiens
cccuuuaauacagaacccu

SEQ ID NO: 19528 - RNA, 21 nt, Homo sapiens
cugcugauaagaggagggagu

SEQ ID NO: 19529 - RNA, 17 nt, Homo sapiens
gguguucauuuucccca

SEQ ID NO: 19530 - RNA, 25 nt, Homo sapiens
uaggguccuguccggcuuggggcug

SEQ ID NO: 19531 - RNA, 18 nt, Homo sapiens
ugccuagcagccgcugac

SEQ ID NO: 19532 - RNA, 20 nt, Homo sapiens
agacaaauaccacuaccugu

SEQ ID NO: 19533 - RNA, 18 nt, Homo sapiens
cgcccacgagcuccacca

SEQ ID NO: 19534 - RNA, 16 nt, Homo sapiens
cugucugaacuacaca

SEQ ID NO: 19535 - RNA, 19 nt, Homo sapiens
gaaaacagagcuucccgug

SEQ ID NO: 19536 - RNA, 21 nt, Homo sapiens
accugcaaugauuacugugca

SEQ ID NO: 19537 - RNA, 18 nt, Homo sapiens
auaaauuacgacucucaa

SEQ ID NO: 19538 - RNA, 19 nt, Homo sapiens
guggucuucuugccuucau

SEQ ID NO: 19539 - RNA, 18 nt, Homo sapiens
uacaaaauuccaucucag

SEQ ID NO: 19540 - RNA, 17 nt, Homo sapiens
cuguauuguuccauagc

SEQ ID NO: 19541 - RNA, 19 nt, Homo sapiens
gccuaaauaguauuuuaua

SEQ ID NO: 19542 - RNA, 22 nt, Homo sapiens
accugagccgcccgccucgucc

SEQ ID NO: 19543 - RNA, 24 nt, Homo sapiens
gaaucauuuuuagauugugacaua

SEQ ID NO: 19544 - RNA, 22 nt, Homo sapiens
ggcaacgagcgaaacuacaucu

SEQ ID NO: 19545 - RNA, 19 nt, Homo sapiens
gcauuagaagagggucuuu

SEQ ID NO: 19546 - RNA, 19 nt, Homo sapiens
uuuuugaucugggagauga

SEQ ID NO: 19547 - RNA, 19 nt, Homo sapiens
caagaacaaaacugcucca

SEQ ID NO: 19548 - RNA, 22 nt, Homo sapiens
gcaaaauucaagaacaaaacug

SEQ ID NO: 19549 - RNA, 23 nt, Homo sapiens
agccacggggacgcgggauucaa

SEQ ID NO: 19550 - RNA, 18 nt, Homo sapiens
cugcccuccucugcaccu

SEQ ID NO: 19551 - RNA, 20 nt, Homo sapiens
gcccaggcucaggcccauga

SEQ ID NO: 19552 - RNA, 18 nt, Homo sapiens
cgggacgcucacauucca

SEQ ID NO: 19553 - RNA, 18 nt, Homo sapiens
gccgcuccggggggccuc

SEQ ID NO: 19554 - RNA, 18 nt, Homo sapiens
cuuaggauaacagcagua

SEQ ID NO: 19555 - RNA, 21 nt, Homo sapiens
gaaggggaagagcguguugug

SEQ ID NO: 19556 - RNA, 16 nt, Homo sapiens
ucuuuucuugacuuag

SEQ ID NO: 19557 - RNA, 21 nt, Homo sapiens
aucugagggguggccuggccu

SEQ ID NO: 19558 - RNA, 21 nt, Homo sapiens
cacugccucacugcaccugcc

SEQ ID NO: 19559 - RNA, 20 nt, Homo sapiens
cccccacaagucacugccuc

SEQ ID NO: 19560 - RNA, 18 nt, Homo sapiens
cccgagaccccucugaga

SEQ ID NO: 19561 - RNA, 19 nt, Homo sapiens
cggggucugcagggcucag

SEQ ID NO: 19562 - RNA, 18 nt, Homo sapiens
gaggcuccuccccaccac

SEQ ID NO: 19563 - RNA, 26 nt, Homo sapiens
ggaaccagcacaaaguguuggcaucg

SEQ ID NO: 19564 - RNA, 22 nt, Homo sapiens
ucacccaaccucucccaccucc

SEQ ID NO: 19565 - RNA, 23 nt, Homo sapiens
uucugacugagcucccccauucc

SEQ ID NO: 19566 - RNA, 20 nt, Homo sapiens
uggccccggcccaguuccca

SEQ ID NO: 19567 - RNA, 18 nt, Homo sapiens
uguuuccuagaaaaccca

SEQ ID NO: 19568 - RNA, 21 nt, Homo sapiens
acaggcaugucuuugacccca

SEQ ID NO: 19569 - RNA, 18 nt, Homo sapiens
gcaagaguaggggccuga

SEQ ID NO: 19570 - RNA, 20 nt, Homo sapiens
gaagaguccucccauccccu

SEQ ID NO: 19571 - RNA, 24 nt, Homo sapiens
gcgcccguggccgcugccgccucc

SEQ ID NO: 19572 - RNA, 20 nt, Homo sapiens
aaagagacuuucucuuucau

SEQ ID NO: 19573 - RNA, 19 nt, Homo sapiens
aagagacuuucucuuucau

SEQ ID NO: 19574 - RNA, 18 nt, Homo sapiens
caaggagaaaaaaaccac

SEQ ID NO: 19575 - RNA, 25 nt, Homo sapiens
gcuucugaacucuuccucugccucu

SEQ ID NO: 19576 - RNA, 17 nt, Homo sapiens
gugaacucuacccaugu

SEQ ID NO: 19577 - RNA, 21 nt, Homo sapiens
uugccuuacuuaacgcuuuuu

SEQ ID NO: 19578 - RNA, 20 nt, Homo sapiens
agcagaaguaggccuugcuc

SEQ ID NO: 19579 - RNA, 20 nt, Homo sapiens
ugaccucacagaccagcuca

SEQ ID NO: 19580 - RNA, 17 nt, Homo sapiens
caacuucaucaucuaca

SEQ ID NO: 19581 - RNA, 17 nt, Homo sapiens
cacagauacuguuuccu

SEQ ID NO: 19582 - RNA, 18 nt, Homo sapiens
gcugucauugaugcucua

SEQ ID NO: 19583 - RNA, 19 nt, Homo sapiens
uaauagggggaaaauguca

SEQ ID NO: 19584 - RNA, 23 nt, Homo sapiens
uacugauuucaguacugagauua

SEQ ID NO: 19585 - RNA, 23 nt, Homo sapiens
uaggauuggcaaugguucguuua

SEQ ID NO: 19586 - RNA, 20 nt, Homo sapiens
uuaccacagauacuguuucc

SEQ ID NO: 19587 - RNA, 17 nt, Homo sapiens
uuuugacaaagcugaca

SEQ ID NO: 19588 - RNA, 18 nt, Homo sapiens
acuugaauugcgaugugu

SEQ ID NO: 19589 - RNA, 20 nt, Homo sapiens
uacugacacauuuuuccuga

SEQ ID NO: 19590 - RNA, 19 nt, Homo sapiens
aagcaauucuccugccuca

SEQ ID NO: 19591 - RNA, 23 nt, Homo sapiens
accuggauuccauuggcugguuu

SEQ ID NO: 19592 - RNA, 23 nt, Homo sapiens
ggcaacauggugaaacugucucu

SEQ ID NO: 19593 - RNA, 18 nt, Homo sapiens
uucuccugccucaaccuu

SEQ ID NO: 19594 - RNA, 20 nt, Homo sapiens
guguuuuggagcgccucuca

SEQ ID NO: 19595 - RNA, 23 nt, Homo sapiens
uaaucucaagaagaauggugaua

SEQ ID NO: 19596 - RNA, 19 nt, Homo sapiens
uggguggaucacuugaggc

SEQ ID NO: 19597 - RNA, 24 nt, Homo sapiens
uucugccucuguggaaaacuacuu

SEQ ID NO: 19598 - RNA, 22 nt, Homo sapiens
agcuguauuguauuuuaccuca

SEQ ID NO: 19599 - RNA, 21 nt, Homo sapiens
guaaaaugucuuuuugacaug

SEQ ID NO: 19600 - RNA, 24 nt, Homo sapiens
ugaguugagaccuguauggaauug

SEQ ID NO: 19601 - RNA, 20 nt, Homo sapiens
cgccuuagugcuucagaccc

SEQ ID NO: 19602 - RNA, 19 nt, Homo sapiens
cugaggaugauuguuagcu

SEQ ID NO: 19603 - RNA, 19 nt, Homo sapiens
aaguacuguguauuucaca

SEQ ID NO: 19604 - RNA, 23 nt, Homo sapiens
acaccugucuaggugaagacuca

SEQ ID NO: 19605 - RNA, 21 nt, Homo sapiens
accccaaagaaaaugacuuca

SEQ ID NO: 19606 - RNA, 19 nt, Homo sapiens
auuacugcccuuuuccuga

SEQ ID NO: 19607 - RNA, 18 nt, Homo sapiens
cagcacuuugggaagcca

SEQ ID NO: 19608 - RNA, 20 nt, Homo sapiens
cucuucaccuccucugcccu

SEQ ID NO: 19609 - RNA, 22 nt, Homo sapiens
ggcuuucaacauguucagugga

SEQ ID NO: 19610 - RNA, 19 nt, Homo sapiens
aucccggagccucugggga

SEQ ID NO: 19611 - RNA, 18 nt, Homo sapiens
caaagcaggaccagcagg

SEQ ID NO: 19612 - RNA, 18 nt, Homo sapiens
cauagaacagauaccuuu

SEQ ID NO: 19613 - RNA, 24 nt, Homo sapiens
cguaucaacaguggauuugcuggu

SEQ ID NO: 19614 - RNA, 24 nt, Homo sapiens
gccuggugaagugacccuuggccu

SEQ ID NO: 19615 - RNA, 19 nt, Homo sapiens
uggucuuguaauugugaac

SEQ ID NO: 19616 - RNA, 19 nt, Homo sapiens
cacugccuguccccguccc

SEQ ID NO: 19617 - RNA, 20 nt, Homo sapiens
cauccaccacccuucuuaca

SEQ ID NO: 19618 - RNA, 21 nt, Homo sapiens
gauucaucagggcaggaagca

SEQ ID NO: 19619 - RNA, 15 nt, Homo sapiens
ugcagugagccagcc

SEQ ID NO: 19620 - RNA, 22 nt, Homo sapiens
ucucuuugugguuccugguccu

SEQ ID NO: 19621 - RNA, 21 nt, Homo sapiens
aagugaacacacucuauguca

SEQ ID NO: 19622 - RNA, 19 nt, Homo sapiens
accaugaaauaccaugaua

SEQ ID NO: 19623 - RNA, 16 nt, Homo sapiens
aaaacuucagauuuca

SEQ ID NO: 19624 - RNA, 16 nt, Homo sapiens
aacaaaagacagccag

SEQ ID NO: 19625 - RNA, 19 nt, Homo sapiens
aagaggaaacuacaccuua

SEQ ID NO: 19626 - RNA, 21 nt, Homo sapiens
ccugaaaacauuauuauuuga

SEQ ID NO: 19627 - RNA, 23 nt, Homo sapiens
gccugaauuuggauugccugcuc

SEQ ID NO: 19628 - RNA, 22 nt, Homo sapiens
aaggauuaaaacugagauuuga

SEQ ID NO: 19629 - RNA, 22 nt, Homo sapiens
gaaaaacuaaaagagugcccca

SEQ ID NO: 19630 - RNA, 23 nt, Homo sapiens
caaauaucaacuuguaauacuca

SEQ ID NO: 19631 - RNA, 18 nt, Homo sapiens
cagcauucaagauuauga

SEQ ID NO: 19632 - RNA, 17 nt, Homo sapiens
gucaggcugaacgcagc

SEQ ID NO: 19633 - RNA, 19 nt, Homo sapiens
aagaaaauccaaagcauug

SEQ ID NO: 19634 - RNA, 21 nt, Homo sapiens
ccauccucccuacucaugacu

SEQ ID NO: 19635 - RNA, 18 nt, Homo sapiens
ggccgaggcggcugcggc

SEQ ID NO: 19636 - RNA, 23 nt, Homo sapiens
acucuagaagaaucuguacauca

SEQ ID NO: 19637 - RNA, 18 nt, Homo sapiens
uaugguguuuacagugua

SEQ ID NO: 19638 - RNA, 15 nt, Homo sapiens
cguaaggaauuguga

SEQ ID NO: 19639 - RNA, 18 nt, Homo sapiens
aaacacauguugacuuuu

SEQ ID NO: 19640 - RNA, 20 nt, Homo sapiens
gcaaguaaagagcaacggga

SEQ ID NO: 19641 - RNA, 19 nt, Homo sapiens
uacuaauucaagcugugac

SEQ ID NO: 19642 - RNA, 22 nt, Homo sapiens
ucucagaauuuuaauuuuuaga

SEQ ID NO: 19643 - RNA, 19 nt, Homo sapiens
cuacaauaacauuguauca

SEQ ID NO: 19644 - RNA, 22 nt, Homo sapiens
cuuugaauagaagacuucugga

SEQ ID NO: 19645 - RNA, 22 nt, Homo sapiens
gagccaagauugugccacugca

SEQ ID NO: 19646 - RNA, 19 nt, Homo sapiens
agaugggugcugguccuca

SEQ ID NO: 19647 - RNA, 17 nt, Homo sapiens
cagaaacucugcuccag

SEQ ID NO: 19648 - RNA, 18 nt, Homo sapiens
cagcuacgcucugugaca

SEQ ID NO: 19649 - RNA, 19 nt, Homo sapiens
caguaacaucaagugcuca

SEQ ID NO: 19650 - RNA, 19 nt, Homo sapiens
ccucccacgagaucuggag

SEQ ID NO: 19651 - RNA, 24 nt, Homo sapiens
ccuugggcugagaggaccugggaa

SEQ ID NO: 19652 - RNA, 21 nt, Homo sapiens
gugccuauuucauccuggugg

SEQ ID NO: 19653 - RNA, 23 nt, Homo sapiens
ugagaggaccugggaagccccuc

SEQ ID NO: 19654 - RNA, 18 nt, Homo sapiens
acuuugaaccucagauca

SEQ ID NO: 19655 - RNA, 17 nt, Homo sapiens
uagcugcuggaaucaca

SEQ ID NO: 19656 - RNA, 18 nt, Homo sapiens
cucuccuuugcacuugau

SEQ ID NO: 19657 - RNA, 21 nt, Homo sapiens
guguuuugauaugucuagcaa

SEQ ID NO: 19658 - RNA, 18 nt, Homo sapiens
uggcuuuuuaauaugcuu

SEQ ID NO: 19659 - RNA, 23 nt, Homo sapiens
cacggagggugcgccugccgcca

SEQ ID NO: 19660 - RNA, 21 nt, Homo sapiens
cagcggcccagccuugcugcc

SEQ ID NO: 19661 - RNA, 20 nt, Homo sapiens
ccccgccucaccccacaugc

SEQ ID NO: 19662 - RNA, 21 nt, Homo sapiens
cuaggcccgucccacucaccu

SEQ ID NO: 19663 - RNA, 20 nt, Homo sapiens
ugagugcucacagccgccuc

SEQ ID NO: 19664 - RNA, 19 nt, Homo sapiens
ccauugauaacagaaaaug

SEQ ID NO: 19665 - RNA, 18 nt, Homo sapiens
gauccugggacacauggg

SEQ ID NO: 19666 - RNA, 18 nt, Homo sapiens
ggcuucugugguugucca

SEQ ID NO: 19667 - RNA, 20 nt, Homo sapiens
uugcaaaaugagaguuucuu

SEQ ID NO: 19668 - RNA, 20 nt, Homo sapiens
ucagcccuccaccuccggcg

SEQ ID NO: 19669 - RNA, 19 nt, Homo sapiens
auuuauuuucauguuaugc

SEQ ID NO: 19670 - RNA, 22 nt, Homo sapiens
gagccaagauagugccacugca

SEQ ID NO: 19671 - RNA, 23 nt, Homo sapiens
guuugaacugugcuauuuuguuc

SEQ ID NO: 19672 - RNA, 17 nt, Homo sapiens
uguuguaugccuauuga

SEQ ID NO: 19673 - RNA, 18 nt, Homo sapiens
aagaguaaauccaaguca

SEQ ID NO: 19674 - RNA, 18 nt, Homo sapiens
cagcuucaaaugcugcuu

SEQ ID NO: 19675 - RNA, 19 nt, Homo sapiens
ugccuucuccuccauuucu

SEQ ID NO: 19676 - RNA, 20 nt, Homo sapiens
ugggugcaacaauggcaaug

SEQ ID NO: 19677 - RNA, 21 nt, Homo sapiens
aacuccaccucccggguucac

SEQ ID NO: 19678 - RNA, 18 nt, Homo sapiens
auaucuucauccuucuca

SEQ ID NO: 19679 - RNA, 18 nt, Homo sapiens
uccugaccucaugaucca

SEQ ID NO: 19680 - RNA, 21 nt, Homo sapiens
ugucaaacuuuuuuuguacaa

SEQ ID NO: 19681 - RNA, 22 nt, Homo sapiens
gagccaagaucgcgccacugca

SEQ ID NO: 19682 - RNA, 20 nt, Homo sapiens
agucucacucugucgcccag

SEQ ID NO: 19683 - RNA, 25 nt, Homo sapiens
auuuggauuuugguaucuuugguuu

SEQ ID NO: 19684 - RNA, 22 nt, Homo sapiens
cugggauuacaggcaccugcca

SEQ ID NO: 19685 - RNA, 17 nt, Homo sapiens
ggcuuuaaauaggcuuc

SEQ ID NO: 19686 - RNA, 18 nt, Homo sapiens
uccugaccucaugaucca

SEQ ID NO: 19687 - RNA, 20 nt, Homo sapiens
uggccaggcuggucuugaac

SEQ ID NO: 19688 - RNA, 20 nt, Homo sapiens
uuugcauugacuguuuaauc

SEQ ID NO: 19689 - RNA, 26 nt, Homo sapiens
uuuugggaaagggaaaaaugucuguu

SEQ ID NO: 19690 - RNA, 19 nt, Homo sapiens
acggcagcaucuuaucuca

SEQ ID NO: 19691 - RNA, 22 nt, Homo sapiens
ccaaaccaugcuccccaugaca

SEQ ID NO: 19692 - RNA, 22 nt, Homo sapiens
gagccaagaucgcgccacugca

SEQ ID NO: 19693 - RNA, 23 nt, Homo sapiens
uucuggccugcacgcagugugug

SEQ ID NO: 19694 - RNA, 22 nt, Homo sapiens
agcuggguuuuugcuguuuuua

SEQ ID NO: 19695 - RNA, 18 nt, Homo sapiens
caacccuccagggcuacu

SEQ ID NO: 19696 - RNA, 21 nt, Homo sapiens
ccagccccuugccaacccucc

SEQ ID NO: 19697 - RNA, 21 nt, Homo sapiens
ggccagagugauggcaccauc

SEQ ID NO: 19698 - RNA, 23 nt, Homo sapiens
uaucuacaacccaauaacagaca

SEQ ID NO: 19699 - RNA, 17 nt, Homo sapiens
ugaaguauccagcgcuc

SEQ ID NO: 19700 - RNA, 18 nt, Homo sapiens
uguccacgugccgccuca

SEQ ID NO: 19701 - RNA, 23 nt, Homo sapiens
uuacugcgccucaccacucccgu

SEQ ID NO: 19702 - RNA, 22 nt, Homo sapiens
agcuguauuguauuuuaccuca

SEQ ID NO: 19703 - RNA, 21 nt, Homo sapiens
guaaaaugucuuuuugacaug

SEQ ID NO: 19704 - RNA, 24 nt, Homo sapiens
ugaguugagaccuguauggaauug

SEQ ID NO: 19705 - RNA, 18 nt, Homo sapiens
aagauauaauggaggaug

SEQ ID NO: 19706 - RNA, 23 nt, Homo sapiens
agcaauuuuggcuuaauggcaca

SEQ ID NO: 19707 - RNA, 18 nt, Homo sapiens
cuguccauccauuccucc

SEQ ID NO: 19708 - RNA, 17 nt, Homo sapiens
gggagagacugaccuca

SEQ ID NO: 19709 - RNA, 18 nt, Homo sapiens
acaggacccaccuccauc

SEQ ID NO: 19710 - RNA, 20 nt, Homo sapiens
caggagcaaauugcaccaca

SEQ ID NO: 19711 - RNA, 18 nt, Homo sapiens
gggacaggacccaccucc

SEQ ID NO: 19712 - RNA, 19 nt, Homo sapiens
cgaaucaucacgcauccca

SEQ ID NO: 19713 - RNA, 22 nt, Homo sapiens
gaauguguucaaauacaucuca

SEQ ID NO: 19714 - RNA, 18 nt, Homo sapiens
aaacacugaacaguuauc

SEQ ID NO: 19715 - RNA, 24 nt, Homo sapiens
aucaaauguauuugccuuacuucc

SEQ ID NO: 19716 - RNA, 18 nt, Homo sapiens
ccccacgaacuagaugcc

SEQ ID NO: 19717 - RNA, 22 nt, Homo sapiens
uccaacuauacggucagcccuc

SEQ ID NO: 19718 - RNA, 19 nt, Homo sapiens
uggauucaaccaacaugga

SEQ ID NO: 19719 - RNA, 20 nt, Homo sapiens
ccccuccccaccccuuuccu

SEQ ID NO: 19720 - RNA, 23 nt, Homo sapiens
cccuccccaccccuuuccuucua

SEQ ID NO: 19721 - RNA, 19 nt, Homo sapiens
cacagaauuaggcuguguu

SEQ ID NO: 19722 - RNA, 20 nt, Homo sapiens
caugcaacuccaccuuagaa

SEQ ID NO: 19723 - RNA, 18 nt, Homo sapiens
ccugggaaccccagacuc

SEQ ID NO: 19724 - RNA, 21 nt, Homo sapiens
gcugugaugguucuguuuuua

SEQ ID NO: 19725 - RNA, 19 nt, Homo sapiens
cgccacgcgccgccacgag

SEQ ID NO: 19726 - RNA, 19 nt, Homo sapiens
aaaaguuuauuugugguau

SEQ ID NO: 19727 - RNA, 21 nt, Homo sapiens
uggacgcuggcgcgguggccg

SEQ ID NO: 19728 - RNA, 16 nt, Homo sapiens
acucaucuuggcauua

SEQ ID NO: 19729 - RNA, 21 nt, Homo sapiens
ggaccaauggaagacugagaa

SEQ ID NO: 19730 - RNA, 19 nt, Homo sapiens
ggcuauacugacaaacuca

SEQ ID NO: 19731 - RNA, 19 nt, Homo sapiens
acagaugcauauuuccuca

SEQ ID NO: 19732 - RNA, 22 nt, Homo sapiens
cuucauuuucacauguuacuca

SEQ ID NO: 19733 - RNA, 21 nt, Homo sapiens
ucacacuacaacauucucuuu

SEQ ID NO: 19734 - RNA, 17 nt, Homo sapiens
aaaaacauuauuccucu

SEQ ID NO: 19735 - RNA, 18 nt, Homo sapiens
ccuaucucucccaucucu

SEQ ID NO: 19736 - RNA, 18 nt, Homo sapiens
uuugauaaagacuuuacc

SEQ ID NO: 19737 - RNA, 23 nt, Homo sapiens
accaucuucccucuggggggauu

SEQ ID NO: 19738 - RNA, 16 nt, Homo sapiens
cuuccgauuccgccac

SEQ ID NO: 19739 - RNA, 17 nt, Homo sapiens
aggauaaaugaaugaug

SEQ ID NO: 19740 - RNA, 18 nt, Homo sapiens
augacaaauaugccaguu

SEQ ID NO: 19741 - RNA, 19 nt, Homo sapiens
caccugguggcucauuuuu

SEQ ID NO: 19742 - RNA, 21 nt, Homo sapiens
cugccuuugccucagcuuuau

SEQ ID NO: 19743 - RNA, 19 nt, Homo sapiens
gcagaugcugcugcuguca

SEQ ID NO: 19744 - RNA, 21 nt, Homo sapiens
auggaaaaacuuuguauggua

SEQ ID NO: 19745 - RNA, 15 nt, Homo sapiens
gauacagguaaggaa

SEQ ID NO: 19746 - RNA, 18 nt, Homo sapiens
ugcuacaucauaaugcug

SEQ ID NO: 19747 - RNA, 21 nt, Homo sapiens
aaaccaaugaaaacaagaggg

SEQ ID NO: 19748 - RNA, 19 nt, Homo sapiens
caaugacaccagcugguca

SEQ ID NO: 19749 - RNA, 19 nt, Homo sapiens
cacuaagaauugugauuug

SEQ ID NO: 19750 - RNA, 22 nt, Homo sapiens
uuuugauggcggagaggggugg

SEQ ID NO: 19751 - RNA, 16 nt, Homo sapiens
aaacagacccacauug

SEQ ID NO: 19752 - RNA, 16 nt, Homo sapiens
cacauuggaacaguga

SEQ ID NO: 19753 - RNA, 19 nt, Homo sapiens
cucaguauaaggcauccua

SEQ ID NO: 19754 - RNA, 20 nt, Homo sapiens
uaauuucaguaacuguuuuc

SEQ ID NO: 19755 - RNA, 24 nt, Homo sapiens
ucaaccugcacuucuuacaaccaa

SEQ ID NO: 19756 - RNA, 18 nt, Homo sapiens
agcaccauuuuuuucuuc

SEQ ID NO: 19757 - RNA, 21 nt, Homo sapiens
aguuuucuuucuucacaguca

SEQ ID NO: 19758 - RNA, 24 nt, Homo sapiens
auuaaaauucauauauacugcagg

SEQ ID NO: 19759 - RNA, 20 nt, Homo sapiens
ugccgucuccucauccugca

SEQ ID NO: 19760 - RNA, 18 nt, Homo sapiens
auuuccuugaaauuucac

SEQ ID NO: 19761 - RNA, 21 nt, Homo sapiens
cagcagggcauagggcacgca

SEQ ID NO: 19762 - RNA, 21 nt, Homo sapiens
gcuuuucugcaaagucugugg

SEQ ID NO: 19763 - RNA, 18 nt, Homo sapiens
ucaaauagucuauaccug

SEQ ID NO: 19764 - RNA, 19 nt, Homo sapiens
uugagacuauuaucaaaga

SEQ ID NO: 19765 - RNA, 20 nt, Homo sapiens
agggguaauauugugagcug

SEQ ID NO: 19766 - RNA, 19 nt, Homo sapiens
accuucccccgcccgcgga

SEQ ID NO: 19767 - RNA, 19 nt, Homo sapiens
cugccugggacggccuacc

SEQ ID NO: 19768 - RNA, 24 nt, Homo sapiens
cgagcgcuccccagaucugggcca

SEQ ID NO: 19769 - RNA, 24 nt, Homo sapiens
gcucaaucagauccuggugucaga

SEQ ID NO: 19770 - RNA, 23 nt, Homo sapiens
cuuagugcucugaauuuacuuuu

SEQ ID NO: 19771 - RNA, 19 nt, Homo sapiens
gauuuuaaucaccauuaca

SEQ ID NO: 19772 - RNA, 21 nt, Homo sapiens
aucuuggcucacugcaaccuc

SEQ ID NO: 19773 - RNA, 19 nt, Homo sapiens
cugcagcagugacucucaa

SEQ ID NO: 19774 - RNA, 18 nt, Homo sapiens
uccgccucccggguucaa

SEQ ID NO: 19775 - RNA, 24 nt, Homo sapiens
gaagcaccaggcggucagcagcug

SEQ ID NO: 19776 - RNA, 23 nt, Homo sapiens
gguccuuaaagcauuugcugcca

SEQ ID NO: 19777 - RNA, 20 nt, Homo sapiens
uccugaagcagaucaacaaa

SEQ ID NO: 19778 - RNA, 19 nt, Homo sapiens
auaacuuuguccuguccuc

SEQ ID NO: 19779 - RNA, 20 nt, Homo sapiens
aucgucuuuccguccucuga

SEQ ID NO: 19780 - RNA, 23 nt, Homo sapiens
ccuuucuaucccuauguauuuaa

SEQ ID NO: 19781 - RNA, 18 nt, Homo sapiens
ggcggcggcggccguggc

SEQ ID NO: 19782 - RNA, 19 nt, Homo sapiens
aaucuucaacagacauuca

SEQ ID NO: 19783 - RNA, 21 nt, Homo sapiens
acagguucaucuuugacuuca

SEQ ID NO: 19784 - RNA, 16 nt, Homo sapiens
aguuaccaaacuaguc

SEQ ID NO: 19785 - RNA, 19 nt, Homo sapiens
ccucuuccauacucuuccg

SEQ ID NO: 19786 - RNA, 23 nt, Homo sapiens
ucugcuugcuucaaauuacuuuu

SEQ ID NO: 19787 - RNA, 17 nt, Homo sapiens
uuuguuuguguguuugu

SEQ ID NO: 19788 - RNA, 18 nt, Homo sapiens
aucccaguuaucccugga

SEQ ID NO: 19789 - RNA, 19 nt, Homo sapiens
ugauacuaaacaacucucu

SEQ ID NO: 19790 - RNA, 20 nt, Homo sapiens
cucaacuccccuguaguuua

SEQ ID NO: 19791 - RNA, 22 nt, Homo sapiens
cugagacaacauacucugucca

SEQ ID NO: 19792 - RNA, 18 nt, Homo sapiens
cuucuccgccucagcccu

SEQ ID NO: 19793 - RNA, 23 nt, Homo sapiens
uucugcugaacacccacuguucc

SEQ ID NO: 19794 - RNA, 23 nt, Homo sapiens
aaaauguugcgaaaacaugggua

SEQ ID NO: 19795 - RNA, 20 nt, Homo sapiens
augacgaagccauuaccagu

SEQ ID NO: 19796 - RNA, 19 nt, Homo sapiens
aauguccagcagaguuacc

SEQ ID NO: 19797 - RNA, 20 nt, Homo sapiens
cuuuccucuccuuuuccuca

SEQ ID NO: 19798 - RNA, 17 nt, Homo sapiens
ucauuguaguggccuaa

SEQ ID NO: 19799 - RNA, 20 nt, Homo sapiens
uggugucuggcaugaaauua

SEQ ID NO: 19800 - RNA, 19 nt, Homo sapiens
augcaugcccauugccuuc

SEQ ID NO: 19801 - RNA, 18 nt, Homo sapiens
guugcugauggacaguga

SEQ ID NO: 19802 - RNA, 22 nt, Homo sapiens
ugugcaguaugaaaucguauug

SEQ ID NO: 19803 - RNA, 25 nt, Homo sapiens
uuuuuuuguagugcuauuuaauuuu

SEQ ID NO: 19804 - RNA, 22 nt, Homo sapiens
cgggacuggcccugcccagcca

SEQ ID NO: 19805 - RNA, 25 nt, Homo sapiens
gccuggaucuguuuuguuuugguuu

SEQ ID NO: 19806 - RNA, 24 nt, Homo sapiens
ggcaugagccgccacacccggcca

SEQ ID NO: 19807 - RNA, 17 nt, Homo sapiens
agaaacagguuaggaca

SEQ ID NO: 19808 - RNA, 22 nt, Homo sapiens
ccugggugauuuuuguauuuuu

SEQ ID NO: 19809 - RNA, 18 nt, Homo sapiens
uccgucuccuggguucaa

SEQ ID NO: 19810 - RNA, 17 nt, Homo sapiens
agagacagacagaggga

SEQ ID NO: 19811 - RNA, 21 nt, Homo sapiens
uccaaagagaaaaguaauuca

SEQ ID NO: 19812 - RNA, 17 nt, Homo sapiens
agaaccucugggaucuc

SEQ ID NO: 19813 - RNA, 21 nt, Homo sapiens
gaggauaagcuaacgaugcug

SEQ ID NO: 19814 - RNA, 21 nt, Homo sapiens
aaaaaaauccaaaacaaagaa

SEQ ID NO: 19815 - RNA, 24 nt, Homo sapiens
agggaaacaauguguucaaggcua

SEQ ID NO: 19816 - RNA, 23 nt, Homo sapiens
cugugaauacaggaacauaguca

SEQ ID NO: 19817 - RNA, 20 nt, Homo sapiens
gcucuugcuggaggccuuac

SEQ ID NO: 19818 - RNA, 19 nt, Homo sapiens
cccacccucccacaccucc

SEQ ID NO: 19819 - RNA, 25 nt, Homo sapiens
uucugcuagcucauagcacucuucg

SEQ ID NO: 19820 - RNA, 18 nt, Homo sapiens
aacccagccccggguccc

SEQ ID NO: 19821 - RNA, 19 nt, Homo sapiens
acauuuugaaauaauguaa

SEQ ID NO: 19822 - RNA, 16 nt, Homo sapiens
accacucaucaucaua

SEQ ID NO: 19823 - RNA, 22 nt, Homo sapiens
auucauuuuguuuguuugauau

SEQ ID NO: 19824 - RNA, 17 nt, Homo sapiens
cuacagaauacuggaca

SEQ ID NO: 19825 - RNA, 23 nt, Homo sapiens
gcuucucugccaacagcuccucu

SEQ ID NO: 19826 - RNA, 21 nt, Homo sapiens
cacuuggcacaaaaccuggca

SEQ ID NO: 19827 - RNA, 16 nt, Homo sapiens
ggaacucacaaagcua

SEQ ID NO: 19828 - RNA, 22 nt, Homo sapiens
cagcugcuccuggaguuugagc

SEQ ID NO: 19829 - RNA, 21 nt, Homo sapiens
aaccacgagagaugacugcag

SEQ ID NO: 19830 - RNA, 17 nt, Homo sapiens
aaaguaaugcugugcug

SEQ ID NO: 19831 - RNA, 17 nt, Homo sapiens
gcuuuucccccauuugu

SEQ ID NO: 19832 - RNA, 18 nt, Homo sapiens
ucuuuauuagaauacuug

SEQ ID NO: 19833 - RNA, 20 nt, Homo sapiens
uucaagccucaagcuuccaa

SEQ ID NO: 19834 - RNA, 18 nt, Homo sapiens
ccgcgacccgcuuggcuc

SEQ ID NO: 19835 - RNA, 18 nt, Homo sapiens
cguccccgaccccacccg

SEQ ID NO: 19836 - RNA, 20 nt, Homo sapiens
gaggcggaagaaccccccug

SEQ ID NO: 19837 - RNA, 19 nt, Homo sapiens
cugcaagcuccaccuccca

SEQ ID NO: 19838 - RNA, 18 nt, Homo sapiens
ggcugcccauauaaguca

SEQ ID NO: 19839 - RNA, 20 nt, Homo sapiens
caauaggagaaaugauacac

SEQ ID NO: 19840 - RNA, 17 nt, Homo sapiens
agccauccuggcugagg

SEQ ID NO: 19841 - RNA, 21 nt, Homo sapiens
acaagugauacauccaaugca

SEQ ID NO: 19842 - RNA, 23 nt, Homo sapiens
auuugauuuggucagccuggcuu

SEQ ID NO: 19843 - RNA, 17 nt, Homo sapiens
caauuaaaucuugccuu

SEQ ID NO: 19844 - RNA, 16 nt, Homo sapiens
uguaccaugcaauacu

SEQ ID NO: 19845 - RNA, 15 nt, Homo sapiens
aagaacagaauacca

SEQ ID NO: 19846 - RNA, 19 nt, Homo sapiens
agcaagcguugaaaacuca

SEQ ID NO: 19847 - RNA, 18 nt, Homo sapiens
agcucgauuagaagaauc

SEQ ID NO: 19848 - RNA, 20 nt, Homo sapiens
acccuggcagccuuccuuga

SEQ ID NO: 19849 - RNA, 16 nt, Homo sapiens
caugagugugugguca

SEQ ID NO: 19850 - RNA, 18 nt, Homo sapiens
cuuccagaagcaacccag

SEQ ID NO: 19851 - RNA, 18 nt, Homo sapiens
ugucaaggagaaucucca

SEQ ID NO: 19852 - RNA, 19 nt, Homo sapiens
gcgccgacucgcugcccag

SEQ ID NO: 19853 - RNA, 19 nt, Homo sapiens
uuccccgugaaaccagaga

SEQ ID NO: 19854 - RNA, 24 nt, Homo sapiens
agaaaucugaaagcaccucugaca

SEQ ID NO: 19855 - RNA, 20 nt, Homo sapiens
agagguugaguuugcugcca

SEQ ID NO: 19856 - RNA, 20 nt, Homo sapiens
gcaccucugacauuccuuuu

SEQ ID NO: 19857 - RNA, 16 nt, Homo sapiens
ucugaaagcaccucug

SEQ ID NO: 19858 - RNA, 20 nt, Homo sapiens
ucuggccaguugucugguuu

SEQ ID NO: 19859 - RNA, 23 nt, Homo sapiens
uggaugcuguugucauggagcug

SEQ ID NO: 19860 - RNA, 23 nt, Homo sapiens
aaguacaagugguuaauguacca

SEQ ID NO: 19861 - RNA, 17 nt, Homo sapiens
aguaaagaaucauuuca

SEQ ID NO: 19862 - RNA, 21 nt, Homo sapiens
aggaaauguaacuuugguuuu

SEQ ID NO: 19863 - RNA, 22 nt, Homo sapiens
guugauacaaauaaaaguuuuu

SEQ ID NO: 19864 - RNA, 20 nt, Homo sapiens
ucuagaauucaggauguucc

SEQ ID NO: 19865 - RNA, 24 nt, Homo sapiens
cagggucauggucugaacuacuca

SEQ ID NO: 19866 - RNA, 15 nt, Homo sapiens
gagaacaaaggcuga

SEQ ID NO: 19867 - RNA, 20 nt, Homo sapiens
uccuagaauccccaugacuc

SEQ ID NO: 19868 - RNA, 20 nt, Homo sapiens
uaggugggcagaucaugagg

SEQ ID NO: 19869 - RNA, 24 nt, Homo sapiens
ugaggucaugguugcaaugaguca

SEQ ID NO: 19870 - RNA, 18 nt, Homo sapiens
uggguggaucaccugagg

SEQ ID NO: 19871 - RNA, 20 nt, Homo sapiens
cauguaugugccacuucuga

SEQ ID NO: 19872 - RNA, 18 nt, Homo sapiens
agagacuucuucccuuca

SEQ ID NO: 19873 - RNA, 20 nt, Homo sapiens
cacccucccaucccagcuga

SEQ ID NO: 19874 - RNA, 18 nt, Homo sapiens
cgggagguuuaggcucag

SEQ ID NO: 19875 - RNA, 17 nt, Homo sapiens
uuagaauaacuguucca

SEQ ID NO: 19876 - RNA, 21 nt, Homo sapiens
cugcauugaauaccuguuucu

SEQ ID NO: 19877 - RNA, 23 nt, Homo sapiens
uuccaucuuccuuuguauacuug

SEQ ID NO: 19878 - RNA, 21 nt, Homo sapiens
uguaggaaaugccuugugaua

SEQ ID NO: 19879 - RNA, 19 nt, Homo sapiens
aggcuguuuuugaguauga

SEQ ID NO: 19880 - RNA, 24 nt, Homo sapiens
ccauccuccauggcacagcccucc

SEQ ID NO: 19881 - RNA, 19 nt, Homo sapiens
ccggggaaugaccacccag

SEQ ID NO: 19882 - RNA, 28 nt, Homo sapiens
ucugaaaccaagaccuucccauuccucc

SEQ ID NO: 19883 - RNA, 21 nt, Homo sapiens
uggaguuuuaagcagagguga

SEQ ID NO: 19884 - RNA, 23 nt, Homo sapiens
auauuuuagauauaaacaucaua

SEQ ID NO: 19885 - RNA, 26 nt, Homo sapiens
uuucuaguggcuacuguuuuaguuuu

SEQ ID NO: 19886 - RNA, 20 nt, Homo sapiens
auauuuaguucaucauuuga

SEQ ID NO: 19887 - RNA, 19 nt, Homo sapiens
guuuguguccuugcucuga

SEQ ID NO: 19888 - RNA, 21 nt, Homo sapiens
cacaguaaccucauuuuugaa

SEQ ID NO: 19889 - RNA, 21 nt, Homo sapiens
acacugcgccaagagcuccuc

SEQ ID NO: 19890 - RNA, 22 nt, Homo sapiens
caacaaaagcaacaggauguca

SEQ ID NO: 19891 - RNA, 22 nt, Homo sapiens
cagacauuauuuuaagcugcua

SEQ ID NO: 19892 - RNA, 19 nt, Homo sapiens
ccaagcacuaugcaauuga

SEQ ID NO: 19893 - RNA, 17 nt, Homo sapiens
ccacagauaccaugaua

SEQ ID NO: 19894 - RNA, 25 nt, Homo sapiens
gcaccaagaaguuacuguuaccuca

SEQ ID NO: 19895 - RNA, 18 nt, Homo sapiens
uggauggaucaagugaag

SEQ ID NO: 19896 - RNA, 18 nt, Homo sapiens
uggcucuuaucaucaucu

SEQ ID NO: 19897 - RNA, 20 nt, Homo sapiens
aacaaaaaucaaaugccuau

SEQ ID NO: 19898 - RNA, 19 nt, Homo sapiens
cauggguccacuguuaaaa

SEQ ID NO: 19899 - RNA, 18 nt, Homo sapiens
cccuagaaaaacaacucu

SEQ ID NO: 19900 - RNA, 19 nt, Homo sapiens
uaccucauccguaggugug

SEQ ID NO: 19901 - RNA, 21 nt, Homo sapiens
ucauuuucuuuucaagccuca

SEQ ID NO: 19902 - RNA, 18 nt, Homo sapiens
agcauaaaucucuucugu

SEQ ID NO: 19903 - RNA, 21 nt, Homo sapiens
aacuugucucaucuccacaca

SEQ ID NO: 19904 - RNA, 20 nt, Homo sapiens
cuuagagaguguccucucau

SEQ ID NO: 19905 - RNA, 21 nt, Homo sapiens
gcauuaguacauuaaauuugg

SEQ ID NO: 19906 - RNA, 18 nt, Homo sapiens
ggugucuaguaguucuga

SEQ ID NO: 19907 - RNA, 24 nt, Homo sapiens
uaaagccuuccccaugugaagcug

SEQ ID NO: 19908 - RNA, 20 nt, Homo sapiens
uguguccgguuuauuucuga

SEQ ID NO: 19909 - RNA, 17 nt, Homo sapiens
uuguccagccugaccaa

SEQ ID NO: 19910 - RNA, 21 nt, Homo sapiens
cucagagggcacagcugcagg

SEQ ID NO: 19911 - RNA, 21 nt, Homo sapiens
gcacuugugugucaccagccu

SEQ ID NO: 19912 - RNA, 18 nt, Homo sapiens
uguuuuggggaggaguuu

SEQ ID NO: 19913 - RNA, 21 nt, Homo sapiens
agaaaauuuuacugugcugug

SEQ ID NO: 19914 - RNA, 18 nt, Homo sapiens
gugauaaauauaccaguu

SEQ ID NO: 19915 - RNA, 19 nt, Homo sapiens
aagcaauucuccugccuca

SEQ ID NO: 19916 - RNA, 22 nt, Homo sapiens
aucuuggcucacugcaaccucu

SEQ ID NO: 19917 - RNA, 20 nt, Homo sapiens
ccucugccucccagguucaa

SEQ ID NO: 19918 - RNA, 21 nt, Homo sapiens
ccuggccaaucagauuguuuu

SEQ ID NO: 19919 - RNA, 19 nt, Homo sapiens
cugcaaccucugccuccca

SEQ ID NO: 19920 - RNA, 19 nt, Homo sapiens
gagccaccacacccagcga

SEQ ID NO: 19921 - RNA, 19 nt, Homo sapiens
uaauuccauaauuauuuuu

SEQ ID NO: 19922 - RNA, 21 nt, Homo sapiens
ucuucagagcuaauccucuaa

SEQ ID NO: 19923 - RNA, 18 nt, Homo sapiens
uggcccagaguggagcua

SEQ ID NO: 19924 - RNA, 20 nt, Homo sapiens
cuuaggugguuuuauucauu

SEQ ID NO: 19925 - RNA, 24 nt, Homo sapiens
uggguuguuuccaguuuggggcug

SEQ ID NO: 19926 - RNA, 19 nt, Homo sapiens
caaggaucuuaacuguguu

SEQ ID NO: 19927 - RNA, 18 nt, Homo sapiens
cuugaauuacauuagcac

SEQ ID NO: 19928 - RNA, 21 nt, Homo sapiens
gacacuccagcaugcuaguga

SEQ ID NO: 19929 - RNA, 19 nt, Homo sapiens
ggacuuggcgaccauuuca

SEQ ID NO: 19930 - RNA, 20 nt, Homo sapiens
uuuauuaucuccugauaugc

SEQ ID NO: 19931 - RNA, 18 nt, Homo sapiens
ggccgggugcaguggcuc

SEQ ID NO: 19932 - RNA, 18 nt, Homo sapiens
ugaguggaucaccugagg

SEQ ID NO: 19933 - RNA, 23 nt, Homo sapiens
aucucuccagagccauauuuucu

SEQ ID NO: 19934 - RNA, 19 nt, Homo sapiens
ccuuuucaguuuuguuuug

SEQ ID NO: 19935 - RNA, 20 nt, Homo sapiens
ugguguucugaaauagccua

SEQ ID NO: 19936 - RNA, 21 nt, Homo sapiens
cccaaaugaaaaaguugguga

SEQ ID NO: 19937 - RNA, 24 nt, Homo sapiens
ggcgcccgccaccacgcccggcca

SEQ ID NO: 19938 - RNA, 20 nt, Homo sapiens
cccagagccaagugcaccga

SEQ ID NO: 19939 - RNA, 28 nt, Homo sapiens
ccugaaagaggcaagacuacaaugggcu

SEQ ID NO: 19940 - RNA, 18 nt, Homo sapiens
gacugaauauacuucaca

SEQ ID NO: 19941 - RNA, 19 nt, Homo sapiens
uguuuguuaggagaugucu

SEQ ID NO: 19942 - RNA, 23 nt, Homo sapiens
aaagcuauaggaacaaagcacau

SEQ ID NO: 19943 - RNA, 16 nt, Homo sapiens
aagagggaucagagug

SEQ ID NO: 19944 - RNA, 21 nt, Homo sapiens
aagaucauaccuuaccuacca

SEQ ID NO: 19945 - RNA, 24 nt, Homo sapiens
agggcuggaccacuugauaacuuc

SEQ ID NO: 19946 - RNA, 22 nt, Homo sapiens
uacacauggguagagccugcaa

SEQ ID NO: 19947 - RNA, 21 nt, Homo sapiens
ugaguggaucuccugccaggc

SEQ ID NO: 19948 - RNA, 23 nt, Homo sapiens
aacguuuuuuuauuuuugugcuu

SEQ ID NO: 19949 - RNA, 19 nt, Homo sapiens
acuuggaguugucgaccuu

SEQ ID NO: 19950 - RNA, 17 nt, Homo sapiens
ugcuauuccuccugucc

SEQ ID NO: 19951 - RNA, 22 nt, Homo sapiens
uucaaagucuuccauuuuacuu

SEQ ID NO: 19952 - RNA, 19 nt, Homo sapiens
uuuccagaauaguaacuca

SEQ ID NO: 19953 - RNA, 24 nt, Homo sapiens
gccccuguucuucgcucaggagca

SEQ ID NO: 19954 - RNA, 17 nt, Homo sapiens
ugcugagaaccauuccu

SEQ ID NO: 19955 - RNA, 20 nt, Homo sapiens
aauacgcuuuuggaaaugaa

SEQ ID NO: 19956 - RNA, 21 nt, Homo sapiens
aggaggaggcaagaggcgaga

SEQ ID NO: 19957 - RNA, 21 nt, Homo sapiens
cacagccaccaccucucuccu

SEQ ID NO: 19958 - RNA, 20 nt, Homo sapiens
cuccugaagacaauguugaa

SEQ ID NO: 19959 - RNA, 19 nt, Homo sapiens
gaaaucaucaauauuccca

SEQ ID NO: 19960 - RNA, 23 nt, Homo sapiens
uccagaugucaacauauauuaua

SEQ ID NO: 19961 - RNA, 23 nt, Homo sapiens
uggaaaagcuaaccaugaaauug

SEQ ID NO: 19962 - RNA, 20 nt, Homo sapiens
uucaagaccagccugaccaa

SEQ ID NO: 19963 - RNA, 19 nt, Homo sapiens
gcuuuuccucuacaggccu

SEQ ID NO: 19964 - RNA, 19 nt, Homo sapiens
ucagcaggaugcugaggaa

SEQ ID NO: 19965 - RNA, 19 nt, Homo sapiens
aguaaaauguugauuucuc

SEQ ID NO: 19966 - RNA, 23 nt, Homo sapiens
ucacaccacauuacuuggccuuu

SEQ ID NO: 19967 - RNA, 18 nt, Homo sapiens
aauaucaaauauucugaa

SEQ ID NO: 19968 - RNA, 23 nt, Homo sapiens
ggaauagcccuuaacaugaaauu

SEQ ID NO: 19969 - RNA, 19 nt, Homo sapiens
ugcaaaacauugguuuucu

SEQ ID NO: 19970 - RNA, 21 nt, Homo sapiens
uucagauauugucagcuuuga

SEQ ID NO: 19971 - RNA, 17 nt, Homo sapiens
augcccuugcuuuggcu

SEQ ID NO: 19972 - RNA, 19 nt, Homo sapiens
caggaacacacacauccuc

SEQ ID NO: 19973 - RNA, 19 nt, Homo sapiens
cgugccaaagcacuuacca

SEQ ID NO: 19974 - RNA, 23 nt, Homo sapiens
gacccugucauuaauuccaugug

SEQ ID NO: 19975 - RNA, 18 nt, Homo sapiens
ucauacagagcugcaguu

SEQ ID NO: 19976 - RNA, 20 nt, Homo sapiens
cugggcggcugucuggaccu

SEQ ID NO: 19977 - RNA, 19 nt, Homo sapiens
aaacacuuggguuugguga

SEQ ID NO: 19978 - RNA, 19 nt, Homo sapiens
augaaaugugaaguuuguc

SEQ ID NO: 19979 - RNA, 21 nt, Homo sapiens
cugucuuucuuauaugacccu

SEQ ID NO: 19980 - RNA, 18 nt, Homo sapiens
gagcuuccacugcuguuu

SEQ ID NO: 19981 - RNA, 20 nt, Homo sapiens
guaacugggugauugccauu

SEQ ID NO: 19982 - RNA, 21 nt, Homo sapiens
ucacaccauuacguuucuuuu

SEQ ID NO: 19983 - RNA, 20 nt, Homo sapiens
ucuauuaacucagaggcuca

SEQ ID NO: 19984 - RNA, 20 nt, Homo sapiens
uuacuagaaagaccauuaca

SEQ ID NO: 19985 - RNA, 16 nt, Homo sapiens
ugccuguguagggaua

SEQ ID NO: 19986 - RNA, 22 nt, Homo sapiens
gagccaagaucacuccacugca

SEQ ID NO: 19987 - RNA, 18 nt, Homo sapiens
aaauagugacucccuuga

SEQ ID NO: 19988 - RNA, 26 nt, Homo sapiens
auuaacaugguaagccuuagcagcaa

SEQ ID NO: 19989 - RNA, 22 nt, Homo sapiens
cuuuucuccacauacagugcag

SEQ ID NO: 19990 - RNA, 19 nt, Homo sapiens
ugauccaaggccuugugag

SEQ ID NO: 19991 - RNA, 18 nt, Homo sapiens
ugccaguaucugcucuaa

SEQ ID NO: 19992 - RNA, 20 nt, Homo sapiens
uuguuuguauuucuucaggu

SEQ ID NO: 19993 - RNA, 20 nt, Homo sapiens
acagcuucccgagucauuca

SEQ ID NO: 19994 - RNA, 25 nt, Homo sapiens
ccaucccaggucaccaccuggcuga

SEQ ID NO: 19995 - RNA, 18 nt, Homo sapiens
cccaaaaacaaccccucc

SEQ ID NO: 19996 - RNA, 17 nt, Homo sapiens
ccuccaacuugacauca

SEQ ID NO: 19997 - RNA, 19 nt, Homo sapiens
gccucuggcccaggaguua

SEQ ID NO: 19998 - RNA, 17 nt, Homo sapiens
uugguuccucacaaagc

SEQ ID NO: 19999 - RNA, 17 nt, Homo sapiens
uugguuccucacaaagc

SEQ ID NO: 20000 - RNA, 22 nt, Homo sapiens
ccuguuuuguugaguugcugcu

SEQ ID NO: 20001 - RNA, 22 nt, Homo sapiens
cuucccugccagcccaccugcc

SEQ ID NO: 20002 - RNA, 18 nt, Homo sapiens
ucugaugagcauucggua

SEQ ID NO: 20003 - RNA, 23 nt, Homo sapiens
caagaagagguguagaguuugca

SEQ ID NO: 20004 - RNA, 22 nt, Homo sapiens
guccuaaaagucuuuugugaga

SEQ ID NO: 20005 - RNA, 18 nt, Homo sapiens
uagguggaucgccugagg

SEQ ID NO: 20006 - RNA, 21 nt, Homo sapiens
aauauauucucucaucccucu

SEQ ID NO: 20007 - RNA, 23 nt, Homo sapiens
aucugcauaauguucacugccaa

SEQ ID NO: 20008 - RNA, 19 nt, Homo sapiens
caucauuuuuguuuccuuu

SEQ ID NO: 20009 - RNA, 21 nt, Homo sapiens
ucuuucuggccaaaucucuaa

SEQ ID NO: 20010 - RNA, 22 nt, Homo sapiens
ugaacccacacacacccaauga

SEQ ID NO: 20011 - RNA, 19 nt, Homo sapiens
ugaaugagauaaaaaguga

SEQ ID NO: 20012 - RNA, 21 nt, Homo sapiens
ugucucucacugauuuagcuu

SEQ ID NO: 20013 - RNA, 24 nt, Homo sapiens
caagaaaguagugagaguuugcca

SEQ ID NO: 20014 - RNA, 19 nt, Homo sapiens
aguaacaggggcaguuccu

SEQ ID NO: 20015 - RNA, 16 nt, Homo sapiens
caggggcaguuccuga

SEQ ID NO: 20016 - RNA, 21 nt, Homo sapiens
gaauaucaaguauuucucugg

SEQ ID NO: 20017 - RNA, 20 nt, Homo sapiens
uauuucucuggcucuugaca

SEQ ID NO: 20018 - RNA, 21 nt, Homo sapiens
acaaaaacaaaaucuaccuua

SEQ ID NO: 20019 - RNA, 22 nt, Homo sapiens
cccuaacucaccuccccacagc

SEQ ID NO: 20020 - RNA, 19 nt, Homo sapiens
ggccauuuccagccagcuc

SEQ ID NO: 20021 - RNA, 20 nt, Homo sapiens
ugagcaugguucuaacaccu

SEQ ID NO: 20022 - RNA, 21 nt, Homo sapiens
augaaaugaaagguugcauau

SEQ ID NO: 20023 - RNA, 18 nt, Homo sapiens
caaucguuuuuuacuuca

SEQ ID NO: 20024 - RNA, 16 nt, Homo sapiens
acucuagaccugccug

SEQ ID NO: 20025 - RNA, 16 nt, Homo sapiens
augauacagagauguc

SEQ ID NO: 20026 - RNA, 20 nt, Homo sapiens
cuagaauuauuguccguucc

SEQ ID NO: 20027 - RNA, 18 nt, Homo sapiens
cugugugugauuuuguuu

SEQ ID NO: 20028 - RNA, 22 nt, Homo sapiens
gugucuauacauugcuuuccgc

SEQ ID NO: 20029 - RNA, 21 nt, Homo sapiens
uuuccugugcauuaaccucug

SEQ ID NO: 20030 - RNA, 18 nt, Homo sapiens
aauuuuuagaucucugga

SEQ ID NO: 20031 - RNA, 20 nt, Homo sapiens
caggcuucauggauucuuga

SEQ ID NO: 20032 - RNA, 22 nt, Homo sapiens
ccuuccccaggcucugcuucca

SEQ ID NO: 20033 - RNA, 17 nt, Homo sapiens
cucaaaaacgugagcgu

SEQ ID NO: 20034 - RNA, 22 nt, Homo sapiens
gugguacccguagugcccagca

SEQ ID NO: 20035 - RNA, 17 nt, Homo sapiens
guugcguauuggaaauu

SEQ ID NO: 20036 - RNA, 21 nt, Homo sapiens
uggauucuugacauguaauug

SEQ ID NO: 20037 - RNA, 20 nt, Homo sapiens
aauuauucgaugacaugaug

SEQ ID NO: 20038 - RNA, 21 nt, Homo sapiens
gcgggucggccguucugcccc

SEQ ID NO: 20039 - RNA, 22 nt, Homo sapiens
aggccacaucuaugguaauuaa

SEQ ID NO: 20040 - RNA, 21 nt, Homo sapiens
auuuggaaauguccuuggcuu

SEQ ID NO: 20041 - RNA, 16 nt, Homo sapiens
guacaggcaccugcca

SEQ ID NO: 20042 - RNA, 22 nt, Homo sapiens
gugcugcugacaggugaacucu

SEQ ID NO: 20043 - RNA, 18 nt, Homo sapiens
uccgccuccuggguucaa

SEQ ID NO: 20044 - RNA, 20 nt, Homo sapiens
agguagaacuugagaacuca

SEQ ID NO: 20045 - RNA, 20 nt, Homo sapiens
gaauucguucuacaacauga

SEQ ID NO: 20046 - RNA, 18 nt, Homo sapiens
gacugcugaaucaucaua

SEQ ID NO: 20047 - RNA, 22 nt, Homo sapiens
ggcuuuucuugagcccauuuua

SEQ ID NO: 20048 - RNA, 24 nt, Homo sapiens
caccacacccagcucucuuucuug

SEQ ID NO: 20049 - RNA, 22 nt, Homo sapiens
gcuuagagagaauaagcuucuu

SEQ ID NO: 20050 - RNA, 24 nt, Homo sapiens
ccaacagugauugaggauuugugg

SEQ ID NO: 20051 - RNA, 17 nt, Homo sapiens
cuuucuucauagcuucu

SEQ ID NO: 20052 - RNA, 26 nt, Homo sapiens
gaaagugguaauccugaaucucuuuu

SEQ ID NO: 20053 - RNA, 18 nt, Homo sapiens
guucccaagugguagaua

SEQ ID NO: 20054 - RNA, 21 nt, Homo sapiens
uacaaaaguuuugagcucuuc

SEQ ID NO: 20055 - RNA, 24 nt, Homo sapiens
uccaagacuggaugcuggaucuca

SEQ ID NO: 20056 - RNA, 18 nt, Homo sapiens
aggagcuuuggccauaua

SEQ ID NO: 20057 - RNA, 16 nt, Homo sapiens
cucauugguuaugagg

SEQ ID NO: 20058 - RNA, 21 nt, Homo sapiens
gcuggauccaauagugaccug

SEQ ID NO: 20059 - RNA, 23 nt, Homo sapiens
uccauugcuguauauuugccuaa

SEQ ID NO: 20060 - RNA, 19 nt, Homo sapiens
uucuaguuccauugcugua

SEQ ID NO: 20061 - RNA, 21 nt, Homo sapiens
uuucuucuaugccuuaggcuu

SEQ ID NO: 20062 - RNA, 19 nt, Homo sapiens
acucaucagugugguaauc

SEQ ID NO: 20063 - RNA, 20 nt, Homo sapiens
aacugcuuuuuaucugagaa

SEQ ID NO: 20064 - RNA, 18 nt, Homo sapiens
acaauaaaccuuuccuga

SEQ ID NO: 20065 - RNA, 19 nt, Homo sapiens
ccagggccuagcccugaca

SEQ ID NO: 20066 - RNA, 30 nt, Homo sapiens
gucuuggcugggucuggaggugucugugga

SEQ ID NO: 20067 - RNA, 21 nt, Homo sapiens
uccgcugugucccgagcacac

SEQ ID NO: 20068 - RNA, 19 nt, Homo sapiens
agaagugaacaaggaguca

SEQ ID NO: 20069 - RNA, 19 nt, Homo sapiens
aggcuggagaagugaacaa

SEQ ID NO: 20070 - RNA, 25 nt, Homo sapiens
gcagaaagaaccacaaacuccaucu

SEQ ID NO: 20071 - RNA, 20 nt, Homo sapiens
uuuucccaauucaacuucau

SEQ ID NO: 20072 - RNA, 22 nt, Homo sapiens
acacggugcucagugggugcca

SEQ ID NO: 20073 - RNA, 21 nt, Homo sapiens
augaaguuacaggcuagcaca

SEQ ID NO: 20074 - RNA, 18 nt, Homo sapiens
uccaacucuugggcucaa

SEQ ID NO: 20075 - RNA, 24 nt, Homo sapiens
ccagauucucaagcagaugcccaa

SEQ ID NO: 20076 - RNA, 17 nt, Homo sapiens
cccaccugcccugcacu

SEQ ID NO: 20077 - RNA, 20 nt, Homo sapiens
cccucccugccucggcucug

SEQ ID NO: 20078 - RNA, 16 nt, Homo sapiens
gcagcccuccugcccc

SEQ ID NO: 20079 - RNA, 20 nt, Homo sapiens
gcucugccgccccagccuca

SEQ ID NO: 20080 - RNA, 20 nt, Homo sapiens
gggagguccccacagagcca

SEQ ID NO: 20081 - RNA, 23 nt, Homo sapiens
ucaccaagucaccucccuccuug

SEQ ID NO: 20082 - RNA, 20 nt, Homo sapiens
uggucuucuccugggcucca

SEQ ID NO: 20083 - RNA, 19 nt, Homo sapiens
uucuccccaugcuucuagg

SEQ ID NO: 20084 - RNA, 18 nt, Homo sapiens
aagaaucccuuccucuug

SEQ ID NO: 20085 - RNA, 21 nt, Homo sapiens
ccuccccccacccccaucucc

SEQ ID NO: 20086 - RNA, 17 nt, Homo sapiens
cgccaaguagccggugg

SEQ ID NO: 20087 - RNA, 20 nt, Homo sapiens
cggcgccaaguagccggugg

SEQ ID NO: 20088 - RNA, 19 nt, Homo sapiens
gaacauaucauacugaaca

SEQ ID NO: 20089 - RNA, 24 nt, Homo sapiens
ucuagagaguaggacuuuuauucc

SEQ ID NO: 20090 - RNA, 18 nt, Homo sapiens
caaaucagagcucacagu

SEQ ID NO: 20091 - RNA, 19 nt, Homo sapiens
cagagucugcauggcacuc

SEQ ID NO: 20092 - RNA, 23 nt, Homo sapiens
cuguucauucugcucguauccca

SEQ ID NO: 20093 - RNA, 17 nt, Homo sapiens
gccuccucccuaaccca

SEQ ID NO: 20094 - RNA, 19 nt, Homo sapiens
gcucccuggagguuuuuaa

SEQ ID NO: 20095 - RNA, 27 nt, Homo sapiens
gcuugaagaaccuugacugcuuggucc

SEQ ID NO: 20096 - RNA, 17 nt, Homo sapiens
ugcaugccaagcugccu

SEQ ID NO: 20097 - RNA, 23 nt, Homo sapiens
uucucugaugugcacaaacacaa

SEQ ID NO: 20098 - RNA, 18 nt, Homo sapiens
aaaagcaacugcaggaca

SEQ ID NO: 20099 - RNA, 18 nt, Homo sapiens
accaccuuccugcccaca

SEQ ID NO: 20100 - RNA, 19 nt, Homo sapiens
agaggguggaguccacauc

SEQ ID NO: 20101 - RNA, 20 nt, Homo sapiens
cguccccgcgcccagcccuc

SEQ ID NO: 20102 - RNA, 19 nt, Homo sapiens
guccccgcgcccagcccuc

SEQ ID NO: 20103 - RNA, 21 nt, Homo sapiens
ugaacaagaguccagccaacc

SEQ ID NO: 20104 - RNA, 21 nt, Homo sapiens
aaugacuagagggagccaaga

SEQ ID NO: 20105 - RNA, 18 nt, Homo sapiens
agauccaaucaaaccuca

SEQ ID NO: 20106 - RNA, 21 nt, Homo sapiens
ugacuagagggagccaagagg

SEQ ID NO: 20107 - RNA, 25 nt, Homo sapiens
ccagcacaaagggcccaggaagcca

SEQ ID NO: 20108 - RNA, 24 nt, Homo sapiens
cccucaccuccccgaggacuggau

SEQ ID NO: 20109 - RNA, 22 nt, Homo sapiens
ccgucccaccaccaaguucacc

SEQ ID NO: 20110 - RNA, 16 nt, Homo sapiens
cuggcgcucacgcugc

SEQ ID NO: 20111 - RNA, 19 nt, Homo sapiens
agaaguaaacaggcaccuu

SEQ ID NO: 20112 - RNA, 23 nt, Homo sapiens
aucuggcugcugguguuuggcuu

SEQ ID NO: 20113 - RNA, 20 nt, Homo sapiens
cuucguuccuccucugcuuc

SEQ ID NO: 20114 - RNA, 25 nt, Homo sapiens
gaaaaacugugccauggacauuuuu

SEQ ID NO: 20115 - RNA, 19 nt, Homo sapiens
aaaccagccaaucaauaac

SEQ ID NO: 20116 - RNA, 24 nt, Homo sapiens
aaucaaauugcacugaucuaugua

SEQ ID NO: 20117 - RNA, 21 nt, Homo sapiens
agauggagaaagaugaucaua

SEQ ID NO: 20118 - RNA, 19 nt, Homo sapiens
auacucagaaaaauugguu

SEQ ID NO: 20119 - RNA, 19 nt, Homo sapiens
caccaccugguuuuguaaa

SEQ ID NO: 20120 - RNA, 23 nt, Homo sapiens
ugaguucacugaauaugaaauug

SEQ ID NO: 20121 - RNA, 18 nt, Homo sapiens
aagaucaccacgcauuga

SEQ ID NO: 20122 - RNA, 18 nt, Homo sapiens
acuuaaucuuuuacauca

SEQ ID NO: 20123 - RNA, 17 nt, Homo sapiens
aucuaugacuucuacau

SEQ ID NO: 20124 - RNA, 21 nt, Homo sapiens
auuucauuuuuagauuaaacu

SEQ ID NO: 20125 - RNA, 20 nt, Homo sapiens
caagaucaccacgcauugaa

SEQ ID NO: 20126 - RNA, 21 nt, Homo sapiens
cccuauaaaucuggucagcaa

SEQ ID NO: 20127 - RNA, 23 nt, Homo sapiens
gcacauuuuccacaauacauugc

SEQ ID NO: 20128 - RNA, 22 nt, Homo sapiens
uacguguuccugaaugaagcug

SEQ ID NO: 20129 - RNA, 17 nt, Homo sapiens
augagugcagugucaga

SEQ ID NO: 20130 - RNA, 21 nt, Homo sapiens
uguccuggauguggcagggaa

SEQ ID NO: 20131 - RNA, 23 nt, Homo sapiens
accaaacugucaccaucuuugca

SEQ ID NO: 20132 - RNA, 20 nt, Homo sapiens
accaugacuaguaaauguaa

SEQ ID NO: 20133 - RNA, 19 nt, Homo sapiens
cacuuugauucccauuugg

SEQ ID NO: 20134 - RNA, 18 nt, Homo sapiens
cggcacuccagccugggc

SEQ ID NO: 20135 - RNA, 20 nt, Homo sapiens
cuccaggcaggaagcagugc

SEQ ID NO: 20136 - RNA, 21 nt, Homo sapiens
cuguaucguagccguccacaa

SEQ ID NO: 20137 - RNA, 19 nt, Homo sapiens
guaguaauauucuaucaua

SEQ ID NO: 20138 - RNA, 24 nt, Homo sapiens
uacccaacugucaccaucuuugca

SEQ ID NO: 20139 - RNA, 16 nt, Homo sapiens
uauuaccuuguguuca

SEQ ID NO: 20140 - RNA, 17 nt, Homo sapiens
uucugccgugacuguuc

SEQ ID NO: 20141 - RNA, 20 nt, Homo sapiens
cagaggccuuaaaauucugg

SEQ ID NO: 20142 - RNA, 23 nt, Homo sapiens
gguccgcucccucuagccagcuc

SEQ ID NO: 20143 - RNA, 16 nt, Homo sapiens
uggaagacuugccaaa

SEQ ID NO: 20144 - RNA, 19 nt, Homo sapiens
acuaagugcucugcucuga

SEQ ID NO: 20145 - RNA, 22 nt, Homo sapiens
auaaucaauugugcugauauua

SEQ ID NO: 20146 - RNA, 18 nt, Homo sapiens
uccuccagaagucuguga

SEQ ID NO: 20147 - RNA, 22 nt, Homo sapiens
ccagggcuggaggcagguccca

SEQ ID NO: 20148 - RNA, 21 nt, Homo sapiens
cgcgccgcucccucaugcugc

SEQ ID NO: 20149 - RNA, 18 nt, Homo sapiens
uggcuuccgccugugcua

SEQ ID NO: 20150 - RNA, 22 nt, Homo sapiens
uuucaacuguugucuugcucuu

SEQ ID NO: 20151 - RNA, 19 nt, Homo sapiens
ccucauggaggacuuggag

SEQ ID NO: 20152 - RNA, 19 nt, Homo sapiens
ccuggauggcguugggucu

SEQ ID NO: 20153 - RNA, 20 nt, Homo sapiens
ccugucucaaaaaacaaauc

SEQ ID NO: 20154 - RNA, 20 nt, Homo sapiens
cuucacuguugucuuacuuu

SEQ ID NO: 20155 - RNA, 22 nt, Homo sapiens
gagccaagauccugccacugca

SEQ ID NO: 20156 - RNA, 23 nt, Homo sapiens
ucagaaaaaauagauuucuuuca

SEQ ID NO: 20157 - RNA, 16 nt, Homo sapiens
uucaaaaccuucugga

SEQ ID NO: 20158 - RNA, 21 nt, Homo sapiens
agaggaacaaggacacagaca

SEQ ID NO: 20159 - RNA, 21 nt, Homo sapiens
augccuccugucucaacacug

SEQ ID NO: 20160 - RNA, 20 nt, Homo sapiens
cucccagcucucuugcacug

SEQ ID NO: 20161 - RNA, 20 nt, Homo sapiens
gcagcccuauggugaccgcc

SEQ ID NO: 20162 - RNA, 20 nt, Homo sapiens
gggccuccagccugggacug

SEQ ID NO: 20163 - RNA, 19 nt, Homo sapiens
gggguuggcagccucaguu

SEQ ID NO: 20164 - RNA, 21 nt, Homo sapiens
ucccagcucucuugcacugca

SEQ ID NO: 20165 - RNA, 22 nt, Homo sapiens
auuugaguggguugguuggccc

SEQ ID NO: 20166 - RNA, 17 nt, Homo sapiens
ucugcugagcgccuucu

SEQ ID NO: 20167 - RNA, 17 nt, Homo sapiens
ucugcauaauucuacuu

SEQ ID NO: 20168 - RNA, 17 nt, Homo sapiens
ugggaaaugucuaguaa

SEQ ID NO: 20169 - RNA, 18 nt, Homo sapiens
caguccuggcagugccgu

SEQ ID NO: 20170 - RNA, 19 nt, Homo sapiens
ccccaccaugaaccuguca

SEQ ID NO: 20171 - RNA, 23 nt, Homo sapiens
cugugugggcugggcuggucaga

SEQ ID NO: 20172 - RNA, 19 nt, Homo sapiens
gauucagaccuuguccaca

SEQ ID NO: 20173 - RNA, 16 nt, Homo sapiens
gcuccauuucaugagu

SEQ ID NO: 20174 - RNA, 19 nt, Homo sapiens
guacauucucauuguuguc

SEQ ID NO: 20175 - RNA, 19 nt, Homo sapiens
guuaaacaccagccugaca

SEQ ID NO: 20176 - RNA, 21 nt, Homo sapiens
aaccagguugaucugccacag

SEQ ID NO: 20177 - RNA, 20 nt, Homo sapiens
acugcugucuucccuaccuc

SEQ ID NO: 20178 - RNA, 21 nt, Homo sapiens
cacugcugucuucccuaccuc

SEQ ID NO: 20179 - RNA, 17 nt, Homo sapiens
caugaccgaugcaggga

SEQ ID NO: 20180 - RNA, 22 nt, Homo sapiens
gccuggagucugugccuggucc

SEQ ID NO: 20181 - RNA, 19 nt, Homo sapiens
gucaccauagagccugcaa

SEQ ID NO: 20182 - RNA, 26 nt, Homo sapiens
cgagaucugcggucuggggucugguu

SEQ ID NO: 20183 - RNA, 18 nt, Homo sapiens
ucaccucacccuuuucca

SEQ ID NO: 20184 - RNA, 20 nt, Homo sapiens
uccuaaauaaaaaguaaaca

SEQ ID NO: 20185 - RNA, 22 nt, Homo sapiens
uuaaaaaugagccaaguguggu

SEQ ID NO: 20186 - RNA, 20 nt, Homo sapiens
aacauauccaguacaauuua

SEQ ID NO: 20187 - RNA, 19 nt, Homo sapiens
aggugccucagccauccca

SEQ ID NO: 20188 - RNA, 21 nt, Homo sapiens
ucccaggugauucuguaaguu

SEQ ID NO: 20189 - RNA, 18 nt, Homo sapiens
caaaucagagcucacagu

SEQ ID NO: 20190 - RNA, 19 nt, Homo sapiens
cagagucugcauggcacuc

SEQ ID NO: 20191 - RNA, 23 nt, Homo sapiens
cuguucauucugcucguauccca

SEQ ID NO: 20192 - RNA, 17 nt, Homo sapiens
gccuccucccuaaccca

SEQ ID NO: 20193 - RNA, 19 nt, Homo sapiens
gcucccuggagguuuuuaa

SEQ ID NO: 20194 - RNA, 27 nt, Homo sapiens
gcuugaagaaccuugacugcuuggucc

SEQ ID NO: 20195 - RNA, 17 nt, Homo sapiens
ugcaugccaagcugccu

SEQ ID NO: 20196 - RNA, 23 nt, Homo sapiens
uucucugaugugcacaaacacaa

SEQ ID NO: 20197 - RNA, 18 nt, Homo sapiens
cagagaacagggcucccc

SEQ ID NO: 20198 - RNA, 19 nt, Homo sapiens
cgccaauagcacccugaga

SEQ ID NO: 20199 - RNA, 19 nt, Homo sapiens
cugcaagcucugccuccca

SEQ ID NO: 20200 - RNA, 22 nt, Homo sapiens
guagagacagggucucaccaug

SEQ ID NO: 20201 - RNA, 19 nt, Homo sapiens
uacauuauaucauuaccug

SEQ ID NO: 20202 - RNA, 19 nt, Homo sapiens
gacauaccgaggaccaacu

SEQ ID NO: 20203 - RNA, 22 nt, Homo sapiens
agucuccuuucaguauuuggca

SEQ ID NO: 20204 - RNA, 19 nt, Homo sapiens
gcacgaagcaggccuguua

SEQ ID NO: 20205 - RNA, 22 nt, Homo sapiens
gccugagcuugugggucuguuc

SEQ ID NO: 20206 - RNA, 20 nt, Homo sapiens
uggaaauaggaaggaccaca

SEQ ID NO: 20207 - RNA, 17 nt, Homo sapiens
cugaacugaccucugaa

SEQ ID NO: 20208 - RNA, 22 nt, Homo sapiens
cugccgaguccggucggugacc

SEQ ID NO: 20209 - RNA, 21 nt, Homo sapiens
acuuuaaacauuuccuaacuc

SEQ ID NO: 20210 - RNA, 21 nt, Homo sapiens
agcaagaaugaccuccugcag

SEQ ID NO: 20211 - RNA, 17 nt, Homo sapiens
aggacagcacugcugcu

SEQ ID NO: 20212 - RNA, 20 nt, Homo sapiens
auguagauagcgcuuuugaa

SEQ ID NO: 20213 - RNA, 21 nt, Homo sapiens
auucuaccuucauccuaccca

SEQ ID NO: 20214 - RNA, 19 nt, Homo sapiens
cccaggaguaauuucucag

SEQ ID NO: 20215 - RNA, 16 nt, Homo sapiens
ccgggaucaugguguu

SEQ ID NO: 20216 - RNA, 18 nt, Homo sapiens
uaguugaacuugacagca

SEQ ID NO: 20217 - RNA, 20 nt, Homo sapiens
acauucauauagucucugug

SEQ ID NO: 20218 - RNA, 19 nt, Homo sapiens
caguacaguuauuugucaa

SEQ ID NO: 20219 - RNA, 21 nt, Homo sapiens
agccucugacaugcucuuuga

SEQ ID NO: 20220 - RNA, 18 nt, Homo sapiens
caucugucaguaaugaga

SEQ ID NO: 20221 - RNA, 19 nt, Homo sapiens
ggcucugacgaaacacuga

SEQ ID NO: 20222 - RNA, 17 nt, Homo sapiens
guauuucuguguuguca

SEQ ID NO: 20223 - RNA, 17 nt, Homo sapiens
uccucagagcaggucga

SEQ ID NO: 20224 - RNA, 22 nt, Homo sapiens
uuuaaguaacugagucauuuuu

SEQ ID NO: 20225 - RNA, 17 nt, Homo sapiens
aaccuugcaugucauca

SEQ ID NO: 20226 - RNA, 22 nt, Homo sapiens
aauguggcaaguuuuucagaca

SEQ ID NO: 20227 - RNA, 23 nt, Homo sapiens
uuugugacaaggauuucgggugu

SEQ ID NO: 20228 - RNA, 22 nt, Homo sapiens
ccacugcuccuucuaacauuuu

SEQ ID NO: 20229 - RNA, 17 nt, Homo sapiens
ccgucucccggguucaa

SEQ ID NO: 20230 - RNA, 20 nt, Homo sapiens
ccuaagcguccuuuacauua

SEQ ID NO: 20231 - RNA, 18 nt, Homo sapiens
gcuaugcuucugcucuga

SEQ ID NO: 20232 - RNA, 19 nt, Homo sapiens
guggacagcagccacccuu

SEQ ID NO: 20233 - RNA, 21 nt, Homo sapiens
ugaugcacacaccaaguggua

SEQ ID NO: 20234 - RNA, 23 nt, Homo sapiens
uucuaacguuuuuucaucauagu

SEQ ID NO: 20235 - RNA, 19 nt, Homo sapiens
aagauaggaccaaauaugu

SEQ ID NO: 20236 - RNA, 19 nt, Homo sapiens
aaguaaugauuaaagcuug

SEQ ID NO: 20237 - RNA, 22 nt, Homo sapiens
caaaaugcauauaugguuuuga

SEQ ID NO: 20238 - RNA, 21 nt, Homo sapiens
ugggcauaauaguuuaccuca

SEQ ID NO: 20239 - RNA, 21 nt, Homo sapiens
uuuauuuuuauugguuccuga

SEQ ID NO: 20240 - RNA, 19 nt, Homo sapiens
gaaagguacaaauagaggu

SEQ ID NO: 20241 - RNA, 17 nt, Homo sapiens
ugggcugacuggggcug

SEQ ID NO: 20242 - RNA, 22 nt, Homo sapiens
uaggauuaugccuaguuuguca

SEQ ID NO: 20243 - RNA, 22 nt, Homo sapiens
aacgugugugucaguuggacca

SEQ ID NO: 20244 - RNA, 17 nt, Homo sapiens
ccagggaaaaccucgga

SEQ ID NO: 20245 - RNA, 19 nt, Homo sapiens
ggccacagugauaccaucc

SEQ ID NO: 20246 - RNA, 21 nt, Homo sapiens
ggccacagugauaccauccca

SEQ ID NO: 20247 - RNA, 18 nt, Homo sapiens
ucagcccugguggcggca

SEQ ID NO: 20248 - RNA, 18 nt, Homo sapiens
ucccugugugacucaguu

SEQ ID NO: 20249 - RNA, 20 nt, Homo sapiens
agccuucagcagauuccguc

SEQ ID NO: 20250 - RNA, 17 nt, Homo sapiens
ugcugcucucuaccaga

SEQ ID NO: 20251 - RNA, 20 nt, Homo sapiens
aaacugcccaucaugugcac

SEQ ID NO: 20252 - RNA, 17 nt, Homo sapiens
agucccacccucaccau

SEQ ID NO: 20253 - RNA, 21 nt, Homo sapiens
aucuuggcucacugcaaccuc

SEQ ID NO: 20254 - RNA, 25 nt, Homo sapiens
ccugaucuugcuaucaauugcugcu

SEQ ID NO: 20255 - RNA, 22 nt, Homo sapiens
gaaaccacccucgccaccaaga

SEQ ID NO: 20256 - RNA, 23 nt, Homo sapiens
gcacaagcaauacgcuugccuua

SEQ ID NO: 20257 - RNA, 21 nt, Homo sapiens
gucauagaagaggaucuuaga

SEQ ID NO: 20258 - RNA, 20 nt, Homo sapiens
ugacccccagcaugggauug

SEQ ID NO: 20259 - RNA, 18 nt, Homo sapiens
cgaccacgcugccugugg

SEQ ID NO: 20260 - RNA, 22 nt, Homo sapiens
gccuggcagagcugccugucuu

SEQ ID NO: 20261 - RNA, 20 nt, Homo sapiens
gccugucuugugucugcuga

SEQ ID NO: 20262 - RNA, 19 nt, Homo sapiens
aaugcucagacgacacaca

SEQ ID NO: 20263 - RNA, 20 nt, Homo sapiens
cuccccuucaggcccccgga

SEQ ID NO: 20264 - RNA, 23 nt, Homo sapiens
cugacauguguauaguaaucuca

SEQ ID NO: 20265 - RNA, 18 nt, Homo sapiens
ucagacccucuaguugca

SEQ ID NO: 20266 - RNA, 19 nt, Homo sapiens
uugcacuccagcccggguu

SEQ ID NO: 20267 - RNA, 17 nt, Homo sapiens
aauaguuaacccuucua

SEQ ID NO: 20268 - RNA, 21 nt, Homo sapiens
ccaucuagacuccaucucaaa

SEQ ID NO: 20269 - RNA, 22 nt, Homo sapiens
cccgugggcuccggcgugaggc

SEQ ID NO: 20270 - RNA, 19 nt, Homo sapiens
gcagcugucgggacgugac

SEQ ID NO: 20271 - RNA, 20 nt, Homo sapiens
uccugaacuucucccauuaa

SEQ ID NO: 20272 - RNA, 23 nt, Homo sapiens
uguaggaaauaaaagugaugaua

SEQ ID NO: 20273 - RNA, 18 nt, Homo sapiens
aagaauaaggucugguua

SEQ ID NO: 20274 - RNA, 19 nt, Homo sapiens
aagcaauucuccuaccuca

SEQ ID NO: 20275 - RNA, 17 nt, Homo sapiens
acagaguauggcuguug

SEQ ID NO: 20276 - RNA, 18 nt, Homo sapiens
gcuuucgucugucaucag

SEQ ID NO: 20277 - RNA, 20 nt, Homo sapiens
ggaacaacuccauuuuaucu

SEQ ID NO: 20278 - RNA, 19 nt, Homo sapiens
ugaagagauucgucuagag

SEQ ID NO: 20279 - RNA, 19 nt, Homo sapiens
uucgcauaugucuaugaaa

SEQ ID NO: 20280 - RNA, 23 nt, Homo sapiens
cuuucuucucaagauucaugacu

SEQ ID NO: 20281 - RNA, 19 nt, Homo sapiens
gagagguacuaugugggug

SEQ ID NO: 20282 - RNA, 20 nt, Homo sapiens
gucagaagaucuagaacagc

SEQ ID NO: 20283 - RNA, 20 nt, Homo sapiens
cuugaggcucaucuugcaca

SEQ ID NO: 20284 - RNA, 21 nt, Homo sapiens
caacccugauuuccugcuucu

SEQ ID NO: 20285 - RNA, 23 nt, Homo sapiens
caaaggacuuuuuauucccuucc

SEQ ID NO: 20286 - RNA, 16 nt, Homo sapiens
caggugagagcucugc

SEQ ID NO: 20287 - RNA, 19 nt, Homo sapiens
gguuuuugccuccagauga

SEQ ID NO: 20288 - RNA, 21 nt, Homo sapiens
ucaaaagucagugcuaauguu

SEQ ID NO: 20289 - RNA, 18 nt, Homo sapiens
ucuaccuccuggguucaa

SEQ ID NO: 20290 - RNA, 18 nt, Homo sapiens
aguaaaaccauucaauca

SEQ ID NO: 20291 - RNA, 19 nt, Homo sapiens
gcccuacugccuaaacacu

SEQ ID NO: 20292 - RNA, 20 nt, Homo sapiens
cccagaaaaauguacaugac

SEQ ID NO: 20293 - RNA, 22 nt, Homo sapiens
uugagagaaacaaaaacacuga

SEQ ID NO: 20294 - RNA, 20 nt, Homo sapiens
acacagaguaauaaucaaac

SEQ ID NO: 20295 - RNA, 19 nt, Homo sapiens
cuguaauucuguugugugu

SEQ ID NO: 20296 - RNA, 26 nt, Homo sapiens
cuuauguuagucucuaaauuauuuuu

SEQ ID NO: 20297 - RNA, 18 nt, Homo sapiens
gcuuauaaagcauuuuca

SEQ ID NO: 20298 - RNA, 27 nt, Homo sapiens
acaucauaguugauaaauugauguuau

SEQ ID NO: 20299 - RNA, 18 nt, Homo sapiens
acugguggcacacguggc

SEQ ID NO: 20300 - RNA, 24 nt, Homo sapiens
caagcaucaccaaugaacauuuca

SEQ ID NO: 20301 - RNA, 22 nt, Homo sapiens
ccuuguuaacaagcaucaccaa

SEQ ID NO: 20302 - RNA, 19 nt, Homo sapiens
guauuugaaacauaacuuu

SEQ ID NO: 20303 - RNA, 19 nt, Homo sapiens
gugccuaaacauuacauug

SEQ ID NO: 20304 - RNA, 19 nt, Homo sapiens
uguuuucuguauuguuuaa

SEQ ID NO: 20305 - RNA, 25 nt, Homo sapiens
uuucccgggugagccccucucugaa

SEQ ID NO: 20306 - RNA, 20 nt, Homo sapiens
ccuuagccaaacaggaagaa

SEQ ID NO: 20307 - RNA, 19 nt, Homo sapiens
cucaaaacaccuauuccag

SEQ ID NO: 20308 - RNA, 18 nt, Homo sapiens
ugagaccacgccacucua

SEQ ID NO: 20309 - RNA, 20 nt, Homo sapiens
cuggcugcgaguccauccga

SEQ ID NO: 20310 - RNA, 19 nt, Homo sapiens
ucggugguauaugacucac

SEQ ID NO: 20311 - RNA, 18 nt, Homo sapiens
accaaaacaauauuuaga

SEQ ID NO: 20312 - RNA, 21 nt, Homo sapiens
aagggaagccuuggggccuca

SEQ ID NO: 20313 - RNA, 18 nt, Homo sapiens
auuuugccacuacucagu

SEQ ID NO: 20314 - RNA, 19 nt, Homo sapiens
ucaagaagggagaccuguu

SEQ ID NO: 20315 - RNA, 18 nt, Homo sapiens
uggauuuuaaugcugcuu

SEQ ID NO: 20316 - RNA, 20 nt, Homo sapiens
uuaaugcugcuuuuccagua

SEQ ID NO: 20317 - RNA, 22 nt, Homo sapiens
cacagagaccagccaucuugca

SEQ ID NO: 20318 - RNA, 18 nt, Homo sapiens
cuuccuauuaaaaucuca

SEQ ID NO: 20319 - RNA, 17 nt, Homo sapiens
caaccucaccucccuca

SEQ ID NO: 20320 - RNA, 26 nt, Homo sapiens
cacacuucugcccccacugcauugaa

SEQ ID NO: 20321 - RNA, 22 nt, Homo sapiens
aagucucagcaauagaauugaa

SEQ ID NO: 20322 - RNA, 17 nt, Homo sapiens
cgaaacuaagcaucaua

SEQ ID NO: 20323 - RNA, 20 nt, Homo sapiens
ggaaauagauggcuuaaagu

SEQ ID NO: 20324 - RNA, 20 nt, Homo sapiens
uucaccuagguacacuguca

SEQ ID NO: 20325 - RNA, 18 nt, Homo sapiens
accaagaccucaucuaca

SEQ ID NO: 20326 - RNA, 22 nt, Homo sapiens
cugguaucugacuuuugcucca

SEQ ID NO: 20327 - RNA, 19 nt, Homo sapiens
gcaccucuauaccucagcu

SEQ ID NO: 20328 - RNA, 24 nt, Homo sapiens
ucaaaccaagaccucaucuacaua

SEQ ID NO: 20329 - RNA, 22 nt, Homo sapiens
cucuccucaccacaacuuauua

SEQ ID NO: 20330 - RNA, 18 nt, Homo sapiens
cugauccucuugauggag

SEQ ID NO: 20331 - RNA, 28 nt, Homo sapiens
gauuguuucaaaauugguguuuauuuaa

SEQ ID NO: 20332 - RNA, 22 nt, Homo sapiens
uuaggaaaugugcauaccacuc

SEQ ID NO: 20333 - RNA, 21 nt, Homo sapiens
aacacgaaagucugaauccug

SEQ ID NO: 20334 - RNA, 18 nt, Homo sapiens
aaggggcugggccugguc

SEQ ID NO: 20335 - RNA, 17 nt, Homo sapiens
cacagauacuguuuccu

SEQ ID NO: 20336 - RNA, 19 nt, Homo sapiens
uaauagggggaaaauguca

SEQ ID NO: 20337 - RNA, 20 nt, Homo sapiens
uuaccacagauacuguuucc

SEQ ID NO: 20338 - RNA, 25 nt, Homo sapiens
uuucuuaaacauagcugcuuuaauu

SEQ ID NO: 20339 - RNA, 19 nt, Homo sapiens
gaggaaccugggcccauca

SEQ ID NO: 20340 - RNA, 22 nt, Homo sapiens
ccuuccccccucuucucucucc

SEQ ID NO: 20341 - RNA, 19 nt, Homo sapiens
gaggaccugggaccccuga

SEQ ID NO: 20342 - RNA, 19 nt, Homo sapiens
agccuucuuggauugccca

SEQ ID NO: 20343 - RNA, 20 nt, Homo sapiens
cucaucaccuccaacaaucu

SEQ ID NO: 20344 - RNA, 20 nt, Homo sapiens
cuuugaguuugcuauuuucu

SEQ ID NO: 20345 - RNA, 19 nt, Homo sapiens
uucugucuccucaucaccu

SEQ ID NO: 20346 - RNA, 22 nt, Homo sapiens
uuguuaaauagccauugcuuuu

SEQ ID NO: 20347 - RNA, 20 nt, Homo sapiens
agugaggcagaaauaccuug

SEQ ID NO: 20348 - RNA, 22 nt, Homo sapiens
gcagcaagcaccugccucagcu

SEQ ID NO: 20349 - RNA, 19 nt, Homo sapiens
gucuaucggacagcggaga

SEQ ID NO: 20350 - RNA, 21 nt, Homo sapiens
acagagagcagagcacacucg

SEQ ID NO: 20351 - RNA, 18 nt, Homo sapiens
cagaacacuccugagaca

SEQ ID NO: 20352 - RNA, 20 nt, Homo sapiens
gcccuucaaagaugcugcca

SEQ ID NO: 20353 - RNA, 22 nt, Homo sapiens
uggaaguccccuggcaugguca

SEQ ID NO: 20354 - RNA, 19 nt, Homo sapiens
acaaaagcagaugauguac

SEQ ID NO: 20355 - RNA, 20 nt, Homo sapiens
cagaagaugcuacaaaaccu

SEQ ID NO: 20356 - RNA, 22 nt, Homo sapiens
cauggcugggaauugccuacca

SEQ ID NO: 20357 - RNA, 20 nt, Homo sapiens
gguagaugggaggacauuuc

SEQ ID NO: 20358 - RNA, 22 nt, Homo sapiens
gugccucucauuaguggacuuu

SEQ ID NO: 20359 - RNA, 20 nt, Homo sapiens
guugggauggugcuucugag

SEQ ID NO: 20360 - RNA, 23 nt, Homo sapiens
augcaugcccuguggcacccucu

SEQ ID NO: 20361 - RNA, 21 nt, Homo sapiens
caccccagaguccucauuuga

SEQ ID NO: 20362 - RNA, 21 nt, Homo sapiens
ucugaaaugcaugcccugugg

SEQ ID NO: 20363 - RNA, 20 nt, Homo sapiens
acugaauuuagcacuaugaa

SEQ ID NO: 20364 - RNA, 18 nt, Homo sapiens
cacacuaaugcuuccuuu

SEQ ID NO: 20365 - RNA, 22 nt, Homo sapiens
ucugcagaaguuguuuagucuu

SEQ ID NO: 20366 - RNA, 18 nt, Homo sapiens
uguugaucucccacaauu

SEQ ID NO: 20367 - RNA, 24 nt, Homo sapiens
caagacauuaacuagagcucaguu

SEQ ID NO: 20368 - RNA, 20 nt, Homo sapiens
caagugauccgccugucuca

SEQ ID NO: 20369 - RNA, 27 nt, Homo sapiens
uaaaaggcagcuauuagugugggacug

SEQ ID NO: 20370 - RNA, 17 nt, Homo sapiens
ucagaugauuauuccag

SEQ ID NO: 20371 - RNA, 18 nt, Homo sapiens
ucaugacucaguacagug

SEQ ID NO: 20372 - RNA, 24 nt, Homo sapiens
uucaucuuuugugauuucuuuuaa

SEQ ID NO: 20373 - RNA, 23 nt, Homo sapiens
aaacacuguugucauuuuuucca

SEQ ID NO: 20374 - RNA, 16 nt, Homo sapiens
aaauugcaucacuuuu

SEQ ID NO: 20375 - RNA, 17 nt, Homo sapiens
aacuagaguguacaaaa

SEQ ID NO: 20376 - RNA, 21 nt, Homo sapiens
ggccacagccaaccagaauga

SEQ ID NO: 20377 - RNA, 20 nt, Homo sapiens
guaaaauccagauuguuuuu

SEQ ID NO: 20378 - RNA, 28 nt, Homo sapiens
uacuuuucaguuagauauacuucugcau

SEQ ID NO: 20379 - RNA, 26 nt, Homo sapiens
uuucuucaccuacuagccuuaguuuu

SEQ ID NO: 20380 - RNA, 19 nt, Homo sapiens
aaguagagaaaucuggcaa

SEQ ID NO: 20381 - RNA, 20 nt, Homo sapiens
agacuccaucuuuucaccca

SEQ ID NO: 20382 - RNA, 17 nt, Homo sapiens
augcuucauuuucacau

SEQ ID NO: 20383 - RNA, 18 nt, Homo sapiens
cagagauacaccuuugua

SEQ ID NO: 20384 - RNA, 24 nt, Homo sapiens
gaagaaaggcccaagagcgagaca

SEQ ID NO: 20385 - RNA, 22 nt, Homo sapiens
gcaccuuuugcucuugcugcua

SEQ ID NO: 20386 - RNA, 20 nt, Homo sapiens
gguuucaacaagucagguga

SEQ ID NO: 20387 - RNA, 19 nt, Homo sapiens
uggaagaguuugacagaga

SEQ ID NO: 20388 - RNA, 28 nt, Homo sapiens
uguggcuggaugucccacaacacuauaa

SEQ ID NO: 20389 - RNA, 15 nt, Homo sapiens
uugcuuuaccaguua

SEQ ID NO: 20390 - RNA, 25 nt, Homo sapiens
aacacgcuuaucaauguuaucgugc

SEQ ID NO: 20391 - RNA, 16 nt, Homo sapiens
aacauaauuuugguga

SEQ ID NO: 20392 - RNA, 20 nt, Homo sapiens
aauaggaaaaugaaauucag

SEQ ID NO: 20393 - RNA, 24 nt, Homo sapiens
auaaagugguacagacucauuaca

SEQ ID NO: 20394 - RNA, 17 nt, Homo sapiens
auuacaacaaguuucuc

SEQ ID NO: 20395 - RNA, 22 nt, Homo sapiens
caaauaaagugguacagacuca

SEQ ID NO: 20396 - RNA, 22 nt, Homo sapiens
uucaaacauuaucauuuaaugu

SEQ ID NO: 20397 - RNA, 19 nt, Homo sapiens
cacucucuuggaaccacca

SEQ ID NO: 20398 - RNA, 17 nt, Homo sapiens
caugguucccaccaugu

SEQ ID NO: 20399 - RNA, 21 nt, Homo sapiens
gcaccauuuaaagccacugga

SEQ ID NO: 20400 - RNA, 17 nt, Homo sapiens
gcuacuuuauccauuga

SEQ ID NO: 20401 - RNA, 19 nt, Homo sapiens
uccagccugccauuccauc

SEQ ID NO: 20402 - RNA, 19 nt, Homo sapiens
uuuauacucaaaagagaua

SEQ ID NO: 20403 - RNA, 24 nt, Homo sapiens
ccugacaguauuuuugaauuauuu

SEQ ID NO: 20404 - RNA, 21 nt, Homo sapiens
ucuguauuaauuauugcuuuu

SEQ ID NO: 20405 - RNA, 15 nt, Homo sapiens
ucaucacccagagca

SEQ ID NO: 20406 - RNA, 16 nt, Homo sapiens
aagaaaagaugaccca

SEQ ID NO: 20407 - RNA, 20 nt, Homo sapiens
acuugaaauaaaaccugaag

SEQ ID NO: 20408 - RNA, 17 nt, Homo sapiens
cugaagaccuuaucucc

SEQ ID NO: 20409 - RNA, 19 nt, Homo sapiens
cugaagaccuuaucuccca

SEQ ID NO: 20410 - RNA, 19 nt, Homo sapiens
gagagugaaccuuggcuua

SEQ ID NO: 20411 - RNA, 19 nt, Homo sapiens
gcuccacacaccguacuga

SEQ ID NO: 20412 - RNA, 22 nt, Homo sapiens
aggaaucuggacuccccauccc

SEQ ID NO: 20413 - RNA, 19 nt, Homo sapiens
aguccauguccucucacca

SEQ ID NO: 20414 - RNA, 21 nt, Homo sapiens
auaugccccaccacgaaacuc

SEQ ID NO: 20415 - RNA, 19 nt, Homo sapiens
cuucccuaucuccuuacca

SEQ ID NO: 20416 - RNA, 22 nt, Homo sapiens
ccuccuuaacugcgucugcuca

SEQ ID NO: 20417 - RNA, 21 nt, Homo sapiens
caagggacuuggguucaguua

SEQ ID NO: 20418 - RNA, 21 nt, Homo sapiens
gacauuugcuauauugacgcu

SEQ ID NO: 20419 - RNA, 21 nt, Homo sapiens
gcaagugauccgccugccuca

SEQ ID NO: 20420 - RNA, 22 nt, Homo sapiens
ggaaaaagaagcuaaaauacua

SEQ ID NO: 20421 - RNA, 20 nt, Homo sapiens
aguaccauuucuuguguugu

SEQ ID NO: 20422 - RNA, 21 nt, Homo sapiens
guauaugugugguguuugauu

SEQ ID NO: 20423 - RNA, 21 nt, Homo sapiens
acaaauuucggggccauacca

SEQ ID NO: 20424 - RNA, 17 nt, Homo sapiens
agaguugaaccccuucc

SEQ ID NO: 20425 - RNA, 22 nt, Homo sapiens
agcacaaacaagcaagcuccuu

SEQ ID NO: 20426 - RNA, 20 nt, Homo sapiens
ccugaugcccugaguuguuu

SEQ ID NO: 20427 - RNA, 23 nt, Homo sapiens
gcccccaugacccaaucagcucc

SEQ ID NO: 20428 - RNA, 18 nt, Homo sapiens
ugaugguaagacaccaac

SEQ ID NO: 20429 - RNA, 17 nt, Homo sapiens
uucugaaagcagagcca

SEQ ID NO: 20430 - RNA, 19 nt, Homo sapiens
uugaaccccuuccuucugc

SEQ ID NO: 20431 - RNA, 18 nt, Homo sapiens
ucugcuggggagccucuu

SEQ ID NO: 20432 - RNA, 18 nt, Homo sapiens
uuucagaagcauaauaaa

SEQ ID NO: 20433 - RNA, 24 nt, Homo sapiens
ccuuaaaccaccaauuuauuucca

SEQ ID NO: 20434 - RNA, 19 nt, Homo sapiens
guaaagaagcuggcaaaga

SEQ ID NO: 20435 - RNA, 17 nt, Homo sapiens
uuccugugccccuucuc

SEQ ID NO: 20436 - RNA, 22 nt, Homo sapiens
acacagguguccauucagauga

SEQ ID NO: 20437 - RNA, 18 nt, Homo sapiens
cauuccccaaagcaauca

SEQ ID NO: 20438 - RNA, 19 nt, Homo sapiens
gccaaagggguuaaacacu

SEQ ID NO: 20439 - RNA, 21 nt, Homo sapiens
ugcagaguguaaucagcaccc

SEQ ID NO: 20440 - RNA, 18 nt, Homo sapiens
uuguuacauccugcugaa

SEQ ID NO: 20441 - RNA, 20 nt, Homo sapiens
accaugaggaaauaaucaga

SEQ ID NO: 20442 - RNA, 16 nt, Homo sapiens
cuggcugcccaccauc

SEQ ID NO: 20443 - RNA, 19 nt, Homo sapiens
ggaacugaaugaaaucuca

SEQ ID NO: 20444 - RNA, 20 nt, Homo sapiens
guuuacuugucugccucuuu

SEQ ID NO: 20445 - RNA, 18 nt, Homo sapiens
agaaaauucauauugugu

SEQ ID NO: 20446 - RNA, 24 nt, Homo sapiens
ccuaaugagcaccuggugggaaua

SEQ ID NO: 20447 - RNA, 23 nt, Homo sapiens
ggcgugagccaccgcgcccggcc

SEQ ID NO: 20448 - RNA, 18 nt, Homo sapiens
uagauggauuuuauauga

SEQ ID NO: 20449 - RNA, 20 nt, Homo sapiens
uggucaggcuggucuugaac

SEQ ID NO: 20450 - RNA, 26 nt, Homo sapiens
ccuccacagacauggccuuaguaccu

SEQ ID NO: 20451 - RNA, 17 nt, Homo sapiens
gcagccugggguccuga

SEQ ID NO: 20452 - RNA, 19 nt, Homo sapiens
gugaccaucagugaccugu

SEQ ID NO: 20453 - RNA, 21 nt, Homo sapiens
ucuccggaaagaguccuggug

SEQ ID NO: 20454 - RNA, 22 nt, Homo sapiens
gcgcgauuucccgccgagcccg

SEQ ID NO: 20455 - RNA, 19 nt, Homo sapiens
ggugaaucaucccggcaga

SEQ ID NO: 20456 - RNA, 17 nt, Homo sapiens
auugguggaggagagua

SEQ ID NO: 20457 - RNA, 21 nt, Homo sapiens
ccucccccucccccuccucca

SEQ ID NO: 20458 - RNA, 18 nt, Homo sapiens
cuccuucuccucccccuc

SEQ ID NO: 20459 - RNA, 19 nt, Homo sapiens
cugcuuuucaugcauauua

SEQ ID NO: 20460 - RNA, 19 nt, Homo sapiens
cuucaauccuuacuucugc

SEQ ID NO: 20461 - RNA, 17 nt, Homo sapiens
ggcccuaaauuguuuuu

SEQ ID NO: 20462 - RNA, 24 nt, Homo sapiens
uagcauugcuggacacaaagugua

SEQ ID NO: 20463 - RNA, 22 nt, Homo sapiens
ucaggggacccaguuccccuca

SEQ ID NO: 20464 - RNA, 24 nt, Homo sapiens
uugggugaugugugcaaaacugca

SEQ ID NO: 20465 - RNA, 22 nt, Homo sapiens
cccugggagcagaggcccuucu

SEQ ID NO: 20466 - RNA, 24 nt, Homo sapiens
gccauuauuggaaauuucuaagga

SEQ ID NO: 20467 - RNA, 21 nt, Homo sapiens
ucaccuccagcccauacauca

SEQ ID NO: 20468 - RNA, 31 nt, Homo sapiens
ugcuugaaccuucccagcgcuugucuggcuu

SEQ ID NO: 20469 - RNA, 23 nt, Homo sapiens
aucugagcucuagugucugacuu

SEQ ID NO: 20470 - RNA, 17 nt, Homo sapiens
augucugggaccucuga

SEQ ID NO: 20471 - RNA, 20 nt, Homo sapiens
cccauuucuaaauguacacu

SEQ ID NO: 20472 - RNA, 24 nt, Homo sapiens
gaugcaaagagccagaauauucua

SEQ ID NO: 20473 - RNA, 19 nt, Homo sapiens
uaguuguauauaaauauua

SEQ ID NO: 20474 - RNA, 19 nt, Homo sapiens
uauaugauacauguaaaug

SEQ ID NO: 20475 - RNA, 22 nt, Homo sapiens
uuuuaacacauaaaugagggga

SEQ ID NO: 20476 - RNA, 21 nt, Homo sapiens
uuuuguuuaaacacacugccu

SEQ ID NO: 20477 - RNA, 19 nt, Homo sapiens
agcuucuaauuuucaauca

SEQ ID NO: 20478 - RNA, 23 nt, Homo sapiens
cuuuucugguuuauaacuacuaa

SEQ ID NO: 20479 - RNA, 23 nt, Homo sapiens
guucuuggaaucaauuccucuaa

SEQ ID NO: 20480 - RNA, 21 nt, Homo sapiens
ugagcccuacaugugggguug

SEQ ID NO: 20481 - RNA, 21 nt, Homo sapiens
ggaaggaacaucucccuucca

SEQ ID NO: 20482 - RNA, 21 nt, Homo sapiens
uccuuggucccaaucuucuca

SEQ ID NO: 20483 - RNA, 23 nt, Homo sapiens
ugggaacaauguucgagagaaca

SEQ ID NO: 20484 - RNA, 21 nt, Homo sapiens
uugccaagccuccuccaucuc

SEQ ID NO: 20485 - RNA, 22 nt, Homo sapiens
uuugauguaagaguucaguuug

SEQ ID NO: 20486 - RNA, 20 nt, Homo sapiens
auaccaauaaaagguaccuc

SEQ ID NO: 20487 - RNA, 17 nt, Homo sapiens
gaaauuuuuauugcuuu

SEQ ID NO: 20488 - RNA, 18 nt, Homo sapiens
guaaguggggucuuugug

SEQ ID NO: 20489 - RNA, 20 nt, Homo sapiens
guaguaaguggggucuuugu

SEQ ID NO: 20490 - RNA, 19 nt, Homo sapiens
ucuuuuccagggcuuugua

SEQ ID NO: 20491 - RNA, 23 nt, Homo sapiens
uuacagacaaaaugaagacuauc

SEQ ID NO: 20492 - RNA, 21 nt, Homo sapiens
cccaguacuuggaggaacugg

SEQ ID NO: 20493 - RNA, 19 nt, Homo sapiens
ugaaugaggacugcaauga

SEQ ID NO: 20494 - RNA, 23 nt, Homo sapiens
aaagaacccguuaguauuguuua

SEQ ID NO: 20495 - RNA, 18 nt, Homo sapiens
caauaaaauggcuuuuaa

SEQ ID NO: 20496 - RNA, 20 nt, Homo sapiens
ggcuuuuaauuauuuguuau

SEQ ID NO: 20497 - RNA, 21 nt, Homo sapiens
ucagcgaugcuuauuucuagc

SEQ ID NO: 20498 - RNA, 20 nt, Homo sapiens
aaacacagaauugaaggugg

SEQ ID NO: 20499 - RNA, 18 nt, Homo sapiens
gcaccaucagacaccuga

SEQ ID NO: 20500 - RNA, 20 nt, Homo sapiens
agaaacaacccuccccccca

SEQ ID NO: 20501 - RNA, 21 nt, Homo sapiens
auaaucccucugauuccacua

SEQ ID NO: 20502 - RNA, 16 nt, Homo sapiens
ccucccccccauuuuu

SEQ ID NO: 20503 - RNA, 26 nt, Homo sapiens
gcagagagaaggagcaaaccuuuuca

SEQ ID NO: 20504 - RNA, 22 nt, Homo sapiens
uagaugggaauugcagaagcug

SEQ ID NO: 20505 - RNA, 24 nt, Homo sapiens
uagcuuuucuucuugguuauauca

SEQ ID NO: 20506 - RNA, 22 nt, Homo sapiens
ugcaugauuuuguauauauggu

SEQ ID NO: 20507 - RNA, 24 nt, Homo sapiens
aaaaggcaggaaaguagguaugau

SEQ ID NO: 20508 - RNA, 19 nt, Homo sapiens
auuccugugguucauccca

SEQ ID NO: 20509 - RNA, 18 nt, Homo sapiens
cagcuuuuccuacacuga

SEQ ID NO: 20510 - RNA, 19 nt, Homo sapiens
ucaccacccacaaaagauc

SEQ ID NO: 20511 - RNA, 17 nt, Homo sapiens
ucuccccaaaguacuug

SEQ ID NO: 20512 - RNA, 18 nt, Homo sapiens
uguauggaaaagcugcac

SEQ ID NO: 20513 - RNA, 19 nt, Homo sapiens
ccaacagacaaugccaauu

SEQ ID NO: 20514 - RNA, 18 nt, Homo sapiens
ucacugagauuccaguga

SEQ ID NO: 20515 - RNA, 22 nt, Homo sapiens
ucuaagcauuuacccuuuugau

SEQ ID NO: 20516 - RNA, 21 nt, Homo sapiens
cugggaaccagcuuucaguga

SEQ ID NO: 20517 - RNA, 22 nt, Homo sapiens
uucugaaauaaaagacaucucc

SEQ ID NO: 20518 - RNA, 17 nt, Homo sapiens
cccagggcugcugcuca

SEQ ID NO: 20519 - RNA, 24 nt, Homo sapiens
ccucuuagaacugguuuuaaccuu

SEQ ID NO: 20520 - RNA, 24 nt, Homo sapiens
gcgccucggccgccgccgccgccu

SEQ ID NO: 20521 - RNA, 24 nt, Homo sapiens
gcuuuucccccaaaguaucaugug

SEQ ID NO: 20522 - RNA, 20 nt, Homo sapiens
gugaccgaaagaacccggug

SEQ ID NO: 20523 - RNA, 20 nt, Homo sapiens
uccagaaaaacggaucacag

SEQ ID NO: 20524 - RNA, 22 nt, Homo sapiens
ugcugcucauccugggcaagcu

SEQ ID NO: 20525 - RNA, 18 nt, Homo sapiens
uugagauuuuuucaguga

SEQ ID NO: 20526 - RNA, 18 nt, Homo sapiens
aaggacauuugaaauuuc

SEQ ID NO: 20527 - RNA, 19 nt, Homo sapiens
agacgccgaaacccaguga

SEQ ID NO: 20528 - RNA, 21 nt, Homo sapiens
ccuggccaucuuguugcugcu

SEQ ID NO: 20529 - RNA, 24 nt, Homo sapiens
cuugugauuggggagguuugugga

SEQ ID NO: 20530 - RNA, 20 nt, Homo sapiens
uuuuguugguugcacuaacu

SEQ ID NO: 20531 - RNA, 16 nt, Homo sapiens
cugaacugacuggccc

SEQ ID NO: 20532 - RNA, 16 nt, Homo sapiens
cuuugagcaguuugug

SEQ ID NO: 20533 - RNA, 20 nt, Homo sapiens
accacaaucagaauuauauc

SEQ ID NO: 20534 - RNA, 20 nt, Homo sapiens
cccacuccccacugucacug

SEQ ID NO: 20535 - RNA, 17 nt, Homo sapiens
gugguauuggcaggaua

SEQ ID NO: 20536 - RNA, 20 nt, Homo sapiens
uggccccaacacccauaagg

SEQ ID NO: 20537 - RNA, 19 nt, Homo sapiens
uucagguauuagucagcuu

SEQ ID NO: 20538 - RNA, 24 nt, Homo sapiens
guuugcguaccggucgccuggucc

SEQ ID NO: 20539 - RNA, 19 nt, Homo sapiens
gaggccccggucuuccucc

SEQ ID NO: 20540 - RNA, 21 nt, Homo sapiens
cacuaacuucuggacuuucca

SEQ ID NO: 20541 - RNA, 22 nt, Homo sapiens
accaguuucagaauacugugaa

SEQ ID NO: 20542 - RNA, 22 nt, Homo sapiens
auaucaauaacauggcacaaca

SEQ ID NO: 20543 - RNA, 21 nt, Homo sapiens
ugguguucggguaugaggcug

SEQ ID NO: 20544 - RNA, 15 nt, Homo sapiens
agcauccaucuucug

SEQ ID NO: 20545 - RNA, 19 nt, Homo sapiens
cuucuggagagucugugag

SEQ ID NO: 20546 - RNA, 25 nt, Homo sapiens
cuuugacuucuggagagucugugag

SEQ ID NO: 20547 - RNA, 20 nt, Homo sapiens
uagccccgggaccguguugc

SEQ ID NO: 20548 - RNA, 18 nt, Homo sapiens
gcacuuguaacugcugcc

SEQ ID NO: 20549 - RNA, 25 nt, Homo sapiens
gcagacuguuaaauugugguuuaua

SEQ ID NO: 20550 - RNA, 21 nt, Homo sapiens
gggggcggcgggggacaucgg

SEQ ID NO: 20551 - RNA, 24 nt, Homo sapiens
guauacauaggcauuacuuuauua

SEQ ID NO: 20552 - RNA, 22 nt, Homo sapiens
uauagaaaguaaacugugguca

SEQ ID NO: 20553 - RNA, 26 nt, Homo sapiens
auggauaacuauuucuaauaugaaau

SEQ ID NO: 20554 - RNA, 22 nt, Homo sapiens
ucuuugguuuuugcuuuaauuu

SEQ ID NO: 20555 - RNA, 19 nt, Homo sapiens
aagagacuuaagaucauuu

SEQ ID NO: 20556 - RNA, 21 nt, Homo sapiens
aggaacagguuagaagagcca

SEQ ID NO: 20557 - RNA, 20 nt, Homo sapiens
cuguguccaccccugccucu

SEQ ID NO: 20558 - RNA, 18 nt, Homo sapiens
gauuccaaugcggagcug

SEQ ID NO: 20559 - RNA, 21 nt, Homo sapiens
gcuccuguccaagcaucugag

SEQ ID NO: 20560 - RNA, 20 nt, Homo sapiens
uagccaacuccaucuagaua

SEQ ID NO: 20561 - RNA, 21 nt, Homo sapiens
ucaguccugauuugucugcca

SEQ ID NO: 20562 - RNA, 20 nt, Homo sapiens
uccuuccucaaucaauacag

SEQ ID NO: 20563 - RNA, 23 nt, Homo sapiens
uccuucucggcccgcgccgcagc

SEQ ID NO: 20564 - RNA, 24 nt, Homo sapiens
ucuguaggagucuuagguuuuuuu

SEQ ID NO: 20565 - RNA, 18 nt, Homo sapiens
acuucucuucacuucugc

SEQ ID NO: 20566 - RNA, 18 nt, Homo sapiens
agccuuuuugccaggcca

SEQ ID NO: 20567 - RNA, 20 nt, Homo sapiens
ucuuugaauucuuuaagcaa

SEQ ID NO: 20568 - RNA, 23 nt, Homo sapiens
auuuggguuucuggcuauggcuu

SEQ ID NO: 20569 - RNA, 19 nt, Homo sapiens
cuggcuacauagauaagua

SEQ ID NO: 20570 - RNA, 27 nt, Homo sapiens
uaagaugagaacuaaaaugccguugaa

SEQ ID NO: 20571 - RNA, 18 nt, Homo sapiens
ugaacauuuggguaauga

SEQ ID NO: 20572 - RNA, 23 nt, Homo sapiens
uuaggaaacacgacacaaacgcu

SEQ ID NO: 20573 - RNA, 24 nt, Homo sapiens
gcauuaguguggcauuucagugga

SEQ ID NO: 20574 - RNA, 20 nt, Homo sapiens
gguuguaagaaaggcuccca

SEQ ID NO: 20575 - RNA, 18 nt, Homo sapiens
uucaauacucuuuaaaag

SEQ ID NO: 20576 - RNA, 24 nt, Homo sapiens
cagcucaguggcugagcccaguca

SEQ ID NO: 20577 - RNA, 23 nt, Homo sapiens
uucugcuggacacaaccucuuuu

SEQ ID NO: 20578 - RNA, 24 nt, Homo sapiens
agucuuuggccaccucugaucuca

SEQ ID NO: 20579 - RNA, 21 nt, Homo sapiens
auaccucucaauguguuugcu

SEQ ID NO: 20580 - RNA, 19 nt, Homo sapiens
cauguguacccaccaccuu

SEQ ID NO: 20581 - RNA, 18 nt, Homo sapiens
gccucaugugugaaauua

SEQ ID NO: 20582 - RNA, 22 nt, Homo sapiens
ucaauauaaggcaagaaaaaau

SEQ ID NO: 20583 - RNA, 15 nt, Homo sapiens
aacccgaauuccuca

SEQ ID NO: 20584 - RNA, 17 nt, Homo sapiens
acaaaccaguaccaugg

SEQ ID NO: 20585 - RNA, 18 nt, Homo sapiens
auuuccauucauuacuua

SEQ ID NO: 20586 - RNA, 19 nt, Homo sapiens
ucccugacugcagguagcc

SEQ ID NO: 20587 - RNA, 15 nt, Homo sapiens
cuuggugucuggcuu

SEQ ID NO: 20588 - RNA, 18 nt, Homo sapiens
gcuauuuuguauccuuga

SEQ ID NO: 20589 - RNA, 22 nt, Homo sapiens
ucaaaguuaacaccuauacuca

SEQ ID NO: 20590 - RNA, 24 nt, Homo sapiens
ucucccuuggguguauaccaggga

SEQ ID NO: 20591 - RNA, 18 nt, Homo sapiens
acaugcuaaauuucugaa

SEQ ID NO: 20592 - RNA, 22 nt, Homo sapiens
agguuauguccuaauaacuauu

SEQ ID NO: 20593 - RNA, 26 nt, Homo sapiens
ccuuuuuacaauuugauuuuaacuuu

SEQ ID NO: 20594 - RNA, 18 nt, Homo sapiens
gaacagaggguaucauug

SEQ ID NO: 20595 - RNA, 17 nt, Homo sapiens
ucugagcaaucccuuuc

SEQ ID NO: 20596 - RNA, 21 nt, Homo sapiens
caugcugggccauacagcuca

SEQ ID NO: 20597 - RNA, 19 nt, Homo sapiens
cuggcacaauccuaggaua

SEQ ID NO: 20598 - RNA, 21 nt, Homo sapiens
aaugucacagagacuaguuca

SEQ ID NO: 20599 - RNA, 22 nt, Homo sapiens
agagcucaaaugauuacacauc

SEQ ID NO: 20600 - RNA, 18 nt, Homo sapiens
auauauuuucaucucuga

SEQ ID NO: 20601 - RNA, 20 nt, Homo sapiens
augucacagagacuaguuca

SEQ ID NO: 20602 - RNA, 20 nt, Homo sapiens
gacugugcuucauccaucca

SEQ ID NO: 20603 - RNA, 19 nt, Homo sapiens
augguguuaaugugugccu

SEQ ID NO: 20604 - RNA, 19 nt, Homo sapiens
aaguggauacauaagauua

SEQ ID NO: 20605 - RNA, 17 nt, Homo sapiens
agucacaucauauaugc

SEQ ID NO: 20606 - RNA, 20 nt, Homo sapiens
caccaacguagaagcuuuuu

SEQ ID NO: 20607 - RNA, 21 nt, Homo sapiens
ccaucaccauccagcccagca

SEQ ID NO: 20608 - RNA, 18 nt, Homo sapiens
gucauugagaaacacccu

SEQ ID NO: 20609 - RNA, 19 nt, Homo sapiens
uucuggccucugcccccca

SEQ ID NO: 20610 - RNA, 20 nt, Homo sapiens
uugguuaucaguuugcagau

SEQ ID NO: 20611 - RNA, 19 nt, Homo sapiens
uguuuaagguuucugacac

SEQ ID NO: 20612 - RNA, 19 nt, Homo sapiens
uugcauacaaucugaaacu

SEQ ID NO: 20613 - RNA, 21 nt, Homo sapiens
gcaggcuugcagugagccaug

SEQ ID NO: 20614 - RNA, 24 nt, Homo sapiens
aaaauccuacuggauaugaaacug

SEQ ID NO: 20615 - RNA, 20 nt, Homo sapiens
auguggaacaaauggaguga

SEQ ID NO: 20616 - RNA, 20 nt, Homo sapiens
cccccaaccccagcagacac

SEQ ID NO: 20617 - RNA, 20 nt, Homo sapiens
ugaacucaccaauguggaac

SEQ ID NO: 20618 - RNA, 15 nt, Homo sapiens
uauuauugcacuuca

SEQ ID NO: 20619 - RNA, 19 nt, Homo sapiens
aaacuccugaccucaggug

SEQ ID NO: 20620 - RNA, 22 nt, Homo sapiens
cccacauuacacuaaucauuga

SEQ ID NO: 20621 - RNA, 20 nt, Homo sapiens
ccucugccucccggguucaa

SEQ ID NO: 20622 - RNA, 17 nt, Homo sapiens
ucaagugauucuccugc

SEQ ID NO: 20623 - RNA, 19 nt, Homo sapiens
uugcaaagggccaaauuuc

SEQ ID NO: 20624 - RNA, 23 nt, Homo sapiens
aucugugguaguuugauacuaca

SEQ ID NO: 20625 - RNA, 18 nt, Homo sapiens
cuaacccuuucuaccuua

SEQ ID NO: 20626 - RNA, 21 nt, Homo sapiens
gcauuuuaaaucaaacauuuc

SEQ ID NO: 20627 - RNA, 19 nt, Homo sapiens
ucaguuauuauagaugaca

SEQ ID NO: 20628 - RNA, 19 nt, Homo sapiens
uuucaauaccuuucagauc

SEQ ID NO: 20629 - RNA, 17 nt, Homo sapiens
acggagaagugucuucu

SEQ ID NO: 20630 - RNA, 22 nt, Homo sapiens
agccugggcaaaaagagccaga

SEQ ID NO: 20631 - RNA, 21 nt, Homo sapiens
gcugaucuguauuuucauuaa

SEQ ID NO: 20632 - RNA, 23 nt, Homo sapiens
uaaauggacacgauaggaaacua

SEQ ID NO: 20633 - RNA, 21 nt, Homo sapiens
cuucucacuauugccuuggcc

SEQ ID NO: 20634 - RNA, 20 nt, Homo sapiens
gcuacuucggcaagacaucu

SEQ ID NO: 20635 - RNA, 18 nt, Homo sapiens
cuaaaaugaagaagcuuc

SEQ ID NO: 20636 - RNA, 19 nt, Homo sapiens
cuuccugugccuuggccuu

SEQ ID NO: 20637 - RNA, 22 nt, Homo sapiens
accagcuucgaguuacuuuccc

SEQ ID NO: 20638 - RNA, 21 nt, Homo sapiens
cuuuugggguuguuuugcuuu

SEQ ID NO: 20639 - RNA, 18 nt, Homo sapiens
cuuuuuguuccucugaua

SEQ ID NO: 20640 - RNA, 18 nt, Homo sapiens
guuggccgacugcacuug

SEQ ID NO: 20641 - RNA, 25 nt, Homo sapiens
uucccagucacauccauuuugugga

SEQ ID NO: 20642 - RNA, 25 nt, Homo sapiens
agaaaagugacaagggcagagauga

SEQ ID NO: 20643 - RNA, 18 nt, Homo sapiens
aaugacuguggaauaaua

SEQ ID NO: 20644 - RNA, 21 nt, Homo sapiens
cacauuuuauuguuuuccuuu

SEQ ID NO: 20645 - RNA, 22 nt, Homo sapiens
gagccaagauuaugccacugca

SEQ ID NO: 20646 - RNA, 18 nt, Homo sapiens
uggguggaucaccugagg

SEQ ID NO: 20647 - RNA, 17 nt, Homo sapiens
agggccagacuaccucu

SEQ ID NO: 20648 - RNA, 21 nt, Homo sapiens
ccaagagauccucccaccucg

SEQ ID NO: 20649 - RNA, 19 nt, Homo sapiens
ugaacuucagcaugagcug

SEQ ID NO: 20650 - RNA, 18 nt, Homo sapiens
gcuuagcacaaugaugaa

SEQ ID NO: 20651 - RNA, 21 nt, Homo sapiens
uggaaaugaucaaccagcuca

SEQ ID NO: 20652 - RNA, 23 nt, Homo sapiens
gugcccucacgccgccgggcucu

SEQ ID NO: 20653 - RNA, 20 nt, Homo sapiens
caucuggacaccauguugua

SEQ ID NO: 20654 - RNA, 19 nt, Homo sapiens
uauagauuaggaacaaugc

SEQ ID NO: 20655 - RNA, 19 nt, Homo sapiens
ugccugggcgccuacucca

SEQ ID NO: 20656 - RNA, 19 nt, Homo sapiens
acugcuguuaagcaauguu

SEQ ID NO: 20657 - RNA, 18 nt, Homo sapiens
auuuugaaaacuguuauc

SEQ ID NO: 20658 - RNA, 17 nt, Homo sapiens
agucccacaucaucuca

SEQ ID NO: 20659 - RNA, 17 nt, Homo sapiens
gaaauauggauagcagc

SEQ ID NO: 20660 - RNA, 21 nt, Homo sapiens
cuauuaguaaccuuagugaua

SEQ ID NO: 20661 - RNA, 18 nt, Homo sapiens
uuucacauccaagugcac

SEQ ID NO: 20662 - RNA, 17 nt, Homo sapiens
uugauuucuuuaucgug

SEQ ID NO: 20663 - RNA, 21 nt, Homo sapiens
aaugcugucaaguuuuccucc

SEQ ID NO: 20664 - RNA, 19 nt, Homo sapiens
auuuguaaacugcuacuga

SEQ ID NO: 20665 - RNA, 20 nt, Homo sapiens
gcagaauugauuuugccuug

SEQ ID NO: 20666 - RNA, 24 nt, Homo sapiens
ucugguuuuccugaacuuauuuuu

SEQ ID NO: 20667 - RNA, 26 nt, Homo sapiens
ucauuuauuguaaauaacacuuuucc

SEQ ID NO: 20668 - RNA, 18 nt, Homo sapiens
ugauucaguaaccaguuu

SEQ ID NO: 20669 - RNA, 17 nt, Homo sapiens
aaaaacuccuuaacuua

SEQ ID NO: 20670 - RNA, 20 nt, Homo sapiens
ggugcuauauuaauucaaua

SEQ ID NO: 20671 - RNA, 19 nt, Homo sapiens
ucaacaauaucaucauuca

SEQ ID NO: 20672 - RNA, 22 nt, Homo sapiens
uuccucuguuaauucauggaau

SEQ ID NO: 20673 - RNA, 20 nt, Homo sapiens
ggccgccugcgcgcuggccg

SEQ ID NO: 20674 - RNA, 19 nt, Homo sapiens
aagaaaaucuuggcauuuu

SEQ ID NO: 20675 - RNA, 20 nt, Homo sapiens
ggacagggagagaaaauacc

SEQ ID NO: 20676 - RNA, 20 nt, Homo sapiens
uccagaaauguauacuucca

SEQ ID NO: 20677 - RNA, 22 nt, Homo sapiens
uccaggggucaugcucuuccca

SEQ ID NO: 20678 - RNA, 20 nt, Homo sapiens
ugaagagacugaggugcaga

SEQ ID NO: 20679 - RNA, 22 nt, Homo sapiens
ucucuucacccuuccuggccuu

SEQ ID NO: 20680 - RNA, 28 nt, Homo sapiens
gccagggucaaucaggauccccauuuga

SEQ ID NO: 20681 - RNA, 20 nt, Homo sapiens
gcccauuucccauuauacau

SEQ ID NO: 20682 - RNA, 19 nt, Homo sapiens
uugaaauauuuuaucauua

SEQ ID NO: 20683 - RNA, 22 nt, Homo sapiens
uuucccauuauacauaacaaua

SEQ ID NO: 20684 - RNA, 21 nt, Homo sapiens
acccuuuaauccaacuuuuga

SEQ ID NO: 20685 - RNA, 23 nt, Homo sapiens
uguuucuuuuuuaacuaaugcua

SEQ ID NO: 20686 - RNA, 20 nt, Homo sapiens
uucuuuuuuaacuaaugcua

SEQ ID NO: 20687 - RNA, 18 nt, Homo sapiens
caaaugcuguuuaugaua

SEQ ID NO: 20688 - RNA, 17 nt, Homo sapiens
uuuaaauucucaucuua

SEQ ID NO: 20689 - RNA, 17 nt, Homo sapiens
agagaaaaaaaagaucc

SEQ ID NO: 20690 - RNA, 18 nt, Homo sapiens
augugauauaaaagcugu

SEQ ID NO: 20691 - RNA, 19 nt, Homo sapiens
ccacugaucauaccacugc

SEQ ID NO: 20692 - RNA, 19 nt, Homo sapiens
ccugggccauauugugaga

SEQ ID NO: 20693 - RNA, 20 nt, Homo sapiens
cgaggcugcugugagccgug

SEQ ID NO: 20694 - RNA, 20 nt, Homo sapiens
agcuccacaaaugugagcua

SEQ ID NO: 20695 - RNA, 18 nt, Homo sapiens
ggaggggaaucugugaac

SEQ ID NO: 20696 - RNA, 19 nt, Homo sapiens
ggauuaucaaugugaacug

SEQ ID NO: 20697 - RNA, 18 nt, Homo sapiens
uggguggaucacuugagg

SEQ ID NO: 20698 - RNA, 24 nt, Homo sapiens
cccguuguuggaggauuugaugag

SEQ ID NO: 20699 - RNA, 23 nt, Homo sapiens
cccugaugauggccuacacugug

SEQ ID NO: 20700 - RNA, 15 nt, Homo sapiens
uuucugauaggcagu

SEQ ID NO: 20701 - RNA, 17 nt, Homo sapiens
cauccagcagccaagac

SEQ ID NO: 20702 - RNA, 19 nt, Homo sapiens
ccauuacaaaauguaaugg

SEQ ID NO: 20703 - RNA, 19 nt, Homo sapiens
ccauuacaaaauguaaugg

SEQ ID NO: 20704 - RNA, 19 nt, Homo sapiens
uuuguccaguucucacuua

SEQ ID NO: 20705 - RNA, 17 nt, Homo sapiens
ucguuccucugcauauc

SEQ ID NO: 20706 - RNA, 23 nt, Homo sapiens
uuuaggaaauugcacauaccuuc

SEQ ID NO: 20707 - RNA, 23 nt, Homo sapiens
acuugggcuaagccgucuggguc

SEQ ID NO: 20708 - RNA, 27 nt, Homo sapiens
ccuccaggcuccacucaccagaccuca

SEQ ID NO: 20709 - RNA, 18 nt, Homo sapiens
ucuguuucacguucguug

SEQ ID NO: 20710 - RNA, 17 nt, Homo sapiens
aucuguuaccacaauua

SEQ ID NO: 20711 - RNA, 19 nt, Homo sapiens
ggguuacuuuaaaaaucug

SEQ ID NO: 20712 - RNA, 20 nt, Homo sapiens
ugcuuuuucuuuuacauaau

SEQ ID NO: 20713 - RNA, 22 nt, Homo sapiens
uuugaguagugagguuacuuuu

SEQ ID NO: 20714 - RNA, 20 nt, Homo sapiens
aagcgccuuuuccugcagcu

SEQ ID NO: 20715 - RNA, 22 nt, Homo sapiens
accagagagcagcccacgggca

SEQ ID NO: 20716 - RNA, 18 nt, Homo sapiens
accucggcugcuaggccc

SEQ ID NO: 20717 - RNA, 17 nt, Homo sapiens
ccacggccccacugucc

SEQ ID NO: 20718 - RNA, 20 nt, Homo sapiens
gcguaggggccguugcccgc

SEQ ID NO: 20719 - RNA, 20 nt, Homo sapiens
gggcagaugcuaggucaguu

SEQ ID NO: 20720 - RNA, 21 nt, Homo sapiens
guggcaaagggguaggcucua

SEQ ID NO: 20721 - RNA, 20 nt, Homo sapiens
uuucuuaguuaugcaucuca

SEQ ID NO: 20722 - RNA, 19 nt, Homo sapiens
agacccacuaauuugcaca

SEQ ID NO: 20723 - RNA, 18 nt, Homo sapiens
ggagcuuuuuaaaucuca

SEQ ID NO: 20724 - RNA, 18 nt, Homo sapiens
ugagcucuucauuagcuc

SEQ ID NO: 20725 - RNA, 21 nt, Homo sapiens
gcauaaaaauaaaauuucaua

SEQ ID NO: 20726 - RNA, 26 nt, Homo sapiens
acuugagcugggaaauccuuuggccu

SEQ ID NO: 20727 - RNA, 18 nt, Homo sapiens
aucagcucaccaguucaa

SEQ ID NO: 20728 - RNA, 24 nt, Homo sapiens
ccugggaguaauaaaguuacuuuu

SEQ ID NO: 20729 - RNA, 17 nt, Homo sapiens
uacaaugaagauuuacc

SEQ ID NO: 20730 - RNA, 20 nt, Homo sapiens
uccugggagacuccaacaaa

SEQ ID NO: 20731 - RNA, 21 nt, Homo sapiens
gcaggcguucccaugaugcca

SEQ ID NO: 20732 - RNA, 20 nt, Homo sapiens
acucaguaacacagugcagu

SEQ ID NO: 20733 - RNA, 20 nt, Homo sapiens
acucaguaacacagugcagu

SEQ ID NO: 20734 - RNA, 22 nt, Homo sapiens
caaccuucucaggacaagccca

SEQ ID NO: 20735 - RNA, 15 nt, Homo sapiens
ccguggaaccuguuu

SEQ ID NO: 20736 - RNA, 19 nt, Homo sapiens
cugcaaccucuaccuccca

SEQ ID NO: 20737 - RNA, 18 nt, Homo sapiens
cugcugggcugcuucuuu

SEQ ID NO: 20738 - RNA, 18 nt, Homo sapiens
gagcugguaaaaugugaa

SEQ ID NO: 20739 - RNA, 18 nt, Homo sapiens
gcuuguuccuggacuuca

SEQ ID NO: 20740 - RNA, 18 nt, Homo sapiens
ucuaccucccagguucaa

SEQ ID NO: 20741 - RNA, 18 nt, Homo sapiens
uguauuugaaaauucugc

SEQ ID NO: 20742 - RNA, 18 nt, Homo sapiens
uuugggcaggugagucau

SEQ ID NO: 20743 - RNA, 26 nt, Homo sapiens
cgggcggggcggggcgggccgggcca

SEQ ID NO: 20744 - RNA, 17 nt, Homo sapiens
caguggugucucucacc

SEQ ID NO: 20745 - RNA, 21 nt, Homo sapiens
cuugugcagcugcaaccacca

SEQ ID NO: 20746 - RNA, 22 nt, Homo sapiens
ugcacuaggcuuuuguuacugu

SEQ ID NO: 20747 - RNA, 20 nt, Homo sapiens
uugcuauuucuacauucucc

SEQ ID NO: 20748 - RNA, 20 nt, Homo sapiens
gugggaagggagccuucuca

SEQ ID NO: 20749 - RNA, 18 nt, Homo sapiens
aagaccugggauuuuguc

SEQ ID NO: 20750 - RNA, 17 nt, Homo sapiens
ugagccuucccguccgc

SEQ ID NO: 20751 - RNA, 21 nt, Homo sapiens
cauccucuuugcccccucagg

SEQ ID NO: 20752 - RNA, 20 nt, Homo sapiens
ggacaguaaugacggcugug

SEQ ID NO: 20753 - RNA, 19 nt, Homo sapiens
ccaccccuggucuguucug

SEQ ID NO: 20754 - RNA, 19 nt, Homo sapiens
gauggggcugcaagugcua

SEQ ID NO: 20755 - RNA, 22 nt, Homo sapiens
acaaauccuuuuaacaugcauu

SEQ ID NO: 20756 - RNA, 22 nt, Homo sapiens
cucccacauauacuaaaauucu

SEQ ID NO: 20757 - RNA, 18 nt, Homo sapiens
gauguccugaugugaaac

SEQ ID NO: 20758 - RNA, 22 nt, Homo sapiens
uaagggaagggcaaaaggcuca

SEQ ID NO: 20759 - RNA, 27 nt, Homo sapiens
ucauuagaagcuccuacccucaucuca

SEQ ID NO: 20760 - RNA, 19 nt, Homo sapiens
uguguuggcuuuuguucag

SEQ ID NO: 20761 - RNA, 21 nt, Homo sapiens
uguguuggcuuuuguucagaa

SEQ ID NO: 20762 - RNA, 23 nt, Homo sapiens
uauuuuuucaaguaaaauuuuca

SEQ ID NO: 20763 - RNA, 19 nt, Homo sapiens
guguuucgugucuaccaua

SEQ ID NO: 20764 - RNA, 18 nt, Homo sapiens
aauaagggcuugcuugcc

SEQ ID NO: 20765 - RNA, 16 nt, Homo sapiens
ccuuugucagaaguca

SEQ ID NO: 20766 - RNA, 18 nt, Homo sapiens
gcaaaccuaaauaccacc

SEQ ID NO: 20767 - RNA, 29 nt, Homo sapiens
gguaccucaaagcaacaguguauaugcaa

SEQ ID NO: 20768 - RNA, 18 nt, Homo sapiens
uggguggaucauuugagg

SEQ ID NO: 20769 - RNA, 20 nt, Homo sapiens
aaaguaaaaggaaacaguac

SEQ ID NO: 20770 - RNA, 18 nt, Homo sapiens
auaguuagccuugauuuu

SEQ ID NO: 20771 - RNA, 20 nt, Homo sapiens
augugaacucaaauauugca

SEQ ID NO: 20772 - RNA, 20 nt, Homo sapiens
augugaacucaacacuucca

SEQ ID NO: 20773 - RNA, 24 nt, Homo sapiens
ccucuuugauuuuuguuuggccuu

SEQ ID NO: 20774 - RNA, 17 nt, Homo sapiens
uauucagcuggauccaa

SEQ ID NO: 20775 - RNA, 21 nt, Homo sapiens
ccucaugucuguaacauguga

SEQ ID NO: 20776 - RNA, 17 nt, Homo sapiens
cucagagugcacugcag

SEQ ID NO: 20777 - RNA, 18 nt, Homo sapiens
cuuugauggccacacugu

SEQ ID NO: 20778 - RNA, 22 nt, Homo sapiens
cuuuguuggggagacuucugga

SEQ ID NO: 20779 - RNA, 16 nt, Homo sapiens
uauuagucuuucuaac

SEQ ID NO: 20780 - RNA, 22 nt, Homo sapiens
ucuagggucuauccuagugaua

SEQ ID NO: 20781 - RNA, 18 nt, Homo sapiens
aacuagagaggugcaaaa

SEQ ID NO: 20782 - RNA, 18 nt, Homo sapiens
cagcuucagcagcaacaa

SEQ ID NO: 20783 - RNA, 20 nt, Homo sapiens
cuuccaugugaacuuuaggc

SEQ ID NO: 20784 - RNA, 22 nt, Homo sapiens
gaagaaguggaguuuuuugguu

SEQ ID NO: 20785 - RNA, 24 nt, Homo sapiens
uuauuacauaucagguuuuccuga

SEQ ID NO: 20786 - RNA, 19 nt, Homo sapiens
gcccuuccccgcccucccu

SEQ ID NO: 20787 - RNA, 17 nt, Homo sapiens
uugcaaccucaagcuuc

SEQ ID NO: 20788 - RNA, 18 nt, Homo sapiens
ccuaauccccucacuuuu

SEQ ID NO: 20789 - RNA, 20 nt, Homo sapiens
cuguuuaacaauuuuuccuc

SEQ ID NO: 20790 - RNA, 22 nt, Homo sapiens
uaaggugaucacuggcucaguc

SEQ ID NO: 20791 - RNA, 20 nt, Homo sapiens
aguguucaaagaaguucuug

SEQ ID NO: 20792 - RNA, 18 nt, Homo sapiens
agaggugugacaggcucu

SEQ ID NO: 20793 - RNA, 19 nt, Homo sapiens
cuguggacacacaagguga

SEQ ID NO: 20794 - RNA, 19 nt, Homo sapiens
cuguggacacacaagguga

SEQ ID NO: 20795 - RNA, 20 nt, Homo sapiens
ucagcuuuccccuagcaugg

SEQ ID NO: 20796 - RNA, 18 nt, Homo sapiens
ugcccgugugccuguccc

SEQ ID NO: 20797 - RNA, 18 nt, Homo sapiens
uuccagaaacuucugcag

SEQ ID NO: 20798 - RNA, 20 nt, Homo sapiens
aaacagaaccagccaccuca

SEQ ID NO: 20799 - RNA, 20 nt, Homo sapiens
ccuuugccuccuagguucaa

SEQ ID NO: 20800 - RNA, 22 nt, Homo sapiens
ugcaauuguguggcagcuugcu

SEQ ID NO: 20801 - RNA, 19 nt, Homo sapiens
ugcacuccagcagaggcua

SEQ ID NO: 20802 - RNA, 22 nt, Homo sapiens
agacccccacccaguggccgcc

SEQ ID NO: 20803 - RNA, 20 nt, Homo sapiens
agugcgugagaaaccagcac

SEQ ID NO: 20804 - RNA, 21 nt, Homo sapiens
cagcuuccuugaucggacuca

SEQ ID NO: 20805 - RNA, 20 nt, Homo sapiens
ccagcacccccuuccgccgc

SEQ ID NO: 20806 - RNA, 18 nt, Homo sapiens
ccaguggccgccaggucc

SEQ ID NO: 20807 - RNA, 18 nt, Homo sapiens
gggcggggcugaccugcc

SEQ ID NO: 20808 - RNA, 19 nt, Homo sapiens
gggcgggggcgcucugcca

SEQ ID NO: 20809 - RNA, 21 nt, Homo sapiens
aaacuacagaaccacauccca

SEQ ID NO: 20810 - RNA, 22 nt, Homo sapiens
aucuuggcucacugcaaccucu

SEQ ID NO: 20811 - RNA, 21 nt, Homo sapiens
auggcacaugcuuccacucca

SEQ ID NO: 20812 - RNA, 20 nt, Homo sapiens
cacaccuggcuguuuucuuu

SEQ ID NO: 20813 - RNA, 21 nt, Homo sapiens
cagugcucugucagcagccug

SEQ ID NO: 20814 - RNA, 20 nt, Homo sapiens
ccucugccucccggguucaa

SEQ ID NO: 20815 - RNA, 22 nt, Homo sapiens
cuuugggaacaaacucuuccuu

SEQ ID NO: 20816 - RNA, 25 nt, Homo sapiens
ugcaaccuccgccuccuggauucca

SEQ ID NO: 20817 - RNA, 19 nt, Homo sapiens
aucucucacucacagugac

SEQ ID NO: 20818 - RNA, 20 nt, Homo sapiens
uuacuuucgcucucuaauca

SEQ ID NO: 20819 - RNA, 22 nt, Homo sapiens
auaccaauaaaaagaaaacccu

SEQ ID NO: 20820 - RNA, 17 nt, Homo sapiens
cuuaagacaacuugcac

SEQ ID NO: 20821 - RNA, 21 nt, Homo sapiens
aggucguguaagagccaugcg

SEQ ID NO: 20822 - RNA, 22 nt, Homo sapiens
uggugacacuuguaaacuguca

SEQ ID NO: 20823 - RNA, 20 nt, Homo sapiens
acggcggcggcgcgccggcc

SEQ ID NO: 20824 - RNA, 17 nt, Homo sapiens
cgcggagcuccggcugg

SEQ ID NO: 20825 - RNA, 16 nt, Homo sapiens
gaccggcgccgcggga

SEQ ID NO: 20826 - RNA, 19 nt, Homo sapiens
uaaaaacaaaacaaacaaa

SEQ ID NO: 20827 - RNA, 22 nt, Homo sapiens
aguuggggaggggucuguugug

SEQ ID NO: 20828 - RNA, 23 nt, Homo sapiens
cccgccucuaccccgccuccauu

SEQ ID NO: 20829 - RNA, 22 nt, Homo sapiens
agaauagaagauuggcucauca

SEQ ID NO: 20830 - RNA, 16 nt, Homo sapiens
agauucuauuuucaug

SEQ ID NO: 20831 - RNA, 15 nt, Homo sapiens
aguaagccagaguga

SEQ ID NO: 20832 - RNA, 21 nt, Homo sapiens
ugucucuguuuuauccagugg

SEQ ID NO: 20833 - RNA, 22 nt, Homo sapiens
ggaauuacuaauuugucauuaa

SEQ ID NO: 20834 - RNA, 21 nt, Homo sapiens
auggaagaaauaacaguaugu

SEQ ID NO: 20835 - RNA, 19 nt, Homo sapiens
auggucaugguagacugau

SEQ ID NO: 20836 - RNA, 21 nt, Homo sapiens
gguaaguggaaaaauaucaug

SEQ ID NO: 20837 - RNA, 19 nt, Homo sapiens
caguaagcaaaauuuucca

SEQ ID NO: 20838 - RNA, 22 nt, Homo sapiens
ugggcauuuaauauguaaagau

SEQ ID NO: 20839 - RNA, 19 nt, Homo sapiens
uuuacuuugauguaucaua

SEQ ID NO: 20840 - RNA, 21 nt, Homo sapiens
aaucuuacuaacaccuaugau

SEQ ID NO: 20841 - RNA, 18 nt, Homo sapiens
auggaaacaagccacuua

SEQ ID NO: 20842 - RNA, 18 nt, Homo sapiens
auuuuauuuaugguccag

SEQ ID NO: 20843 - RNA, 24 nt, Homo sapiens
cagaaugcuuugaaauucuaaugg

SEQ ID NO: 20844 - RNA, 20 nt, Homo sapiens
cccgacaccucaccuuucgc

SEQ ID NO: 20845 - RNA, 17 nt, Homo sapiens
ccucaccuuucgcuguu

SEQ ID NO: 20846 - RNA, 21 nt, Homo sapiens
cucuuucucucucucucucuc

SEQ ID NO: 20847 - RNA, 18 nt, Homo sapiens
uaaggauaaaacacguca

SEQ ID NO: 20848 - RNA, 22 nt, Homo sapiens
uaucggccaccugccaaucaca

SEQ ID NO: 20849 - RNA, 16 nt, Homo sapiens
ucucucucucuuuucu

SEQ ID NO: 20850 - RNA, 21 nt, Homo sapiens
aaucuuacuaacaccuaugau

SEQ ID NO: 20851 - RNA, 18 nt, Homo sapiens
auggaaacaagccacuua

SEQ ID NO: 20852 - RNA, 18 nt, Homo sapiens
auuuuauuuaugguccag

SEQ ID NO: 20853 - RNA, 24 nt, Homo sapiens
cagaaugcuuugaaauucuaaugg

SEQ ID NO: 20854 - RNA, 20 nt, Homo sapiens
cccgacaccucaccuuucgc

SEQ ID NO: 20855 - RNA, 17 nt, Homo sapiens
ccucaccuuucgcuguu

SEQ ID NO: 20856 - RNA, 21 nt, Homo sapiens
cucuuucucucucucucucuc

SEQ ID NO: 20857 - RNA, 18 nt, Homo sapiens
uaaggauaaaacacguca

SEQ ID NO: 20858 - RNA, 22 nt, Homo sapiens
uaucggccaccugccaaucaca

SEQ ID NO: 20859 - RNA, 16 nt, Homo sapiens
ucucucucucuuuucu

SEQ ID NO: 20860 - RNA, 21 nt, Homo sapiens
aaucuuacuaacaccuaugau

SEQ ID NO: 20861 - RNA, 18 nt, Homo sapiens
auggaaacaagccacuua

SEQ ID NO: 20862 - RNA, 18 nt, Homo sapiens
auuuuauuuaugguccag

SEQ ID NO: 20863 - RNA, 24 nt, Homo sapiens
cagaaugcuuugaaauucuaaugg

SEQ ID NO: 20864 - RNA, 20 nt, Homo sapiens
cccgacaccucaccuuucgc

SEQ ID NO: 20865 - RNA, 17 nt, Homo sapiens
ccucaccuuucgcuguu

SEQ ID NO: 20866 - RNA, 21 nt, Homo sapiens
cucuuucucucucucucucuc

SEQ ID NO: 20867 - RNA, 18 nt, Homo sapiens
uaaggauaaaacacguca

SEQ ID NO: 20868 - RNA, 22 nt, Homo sapiens
uaucggccaccugccaaucaca

SEQ ID NO: 20869 - RNA, 16 nt, Homo sapiens
ucucucucucuuuucu

SEQ ID NO: 20870 - RNA, 21 nt, Homo sapiens
aaucuuacuaacaccuaugau

SEQ ID NO: 20871 - RNA, 18 nt, Homo sapiens
auggaaacaagccacuua

SEQ ID NO: 20872 - RNA, 18 nt, Homo sapiens
auuuuauuuaugguccag

SEQ ID NO: 20873 - RNA, 24 nt, Homo sapiens
cagaaugcuuugaaauucuaaugg

SEQ ID NO: 20874 - RNA, 20 nt, Homo sapiens
cccgacaccucaccuuucgc

SEQ ID NO: 20875 - RNA, 17 nt, Homo sapiens
ccucaccuuucgcuguu

SEQ ID NO: 20876 - RNA, 21 nt, Homo sapiens
cucuuucucucucucucucuc

SEQ ID NO: 20877 - RNA, 18 nt, Homo sapiens
uaaggauaaaacacguca

SEQ ID NO: 20878 - RNA, 22 nt, Homo sapiens
uaucggccaccugccaaucaca

SEQ ID NO: 20879 - RNA, 16 nt, Homo sapiens
ucucucucucuuuucu

SEQ ID NO: 20880 - RNA, 21 nt, Homo sapiens
aaucuuacuaacaccuaugau

SEQ ID NO: 20881 - RNA, 18 nt, Homo sapiens
auggaaacaagccacuua

SEQ ID NO: 20882 - RNA, 18 nt, Homo sapiens
auuuuauuuaugguccag

SEQ ID NO: 20883 - RNA, 24 nt, Homo sapiens
cagaaugcuuugaaauucuaaugg

SEQ ID NO: 20884 - RNA, 20 nt, Homo sapiens
cccgacaccucaccuuucgc

SEQ ID NO: 20885 - RNA, 17 nt, Homo sapiens
ccucaccuuucgcuguu

SEQ ID NO: 20886 - RNA, 21 nt, Homo sapiens
cucuuucucucucucucucuc

SEQ ID NO: 20887 - RNA, 21 nt, Homo sapiens
cugaaacugaagaaucuggua

SEQ ID NO: 20888 - RNA, 18 nt, Homo sapiens
uaaggauaaaacacguca

SEQ ID NO: 20889 - RNA, 22 nt, Homo sapiens
uaucggccaccugccaaucaca

SEQ ID NO: 20890 - RNA, 16 nt, Homo sapiens
ucucucucucuuuucu

SEQ ID NO: 20891 - RNA, 21 nt, Homo sapiens
aaucuuacuaacaccuaugau

SEQ ID NO: 20892 - RNA, 18 nt, Homo sapiens
auggaaacaagccacuua

SEQ ID NO: 20893 - RNA, 18 nt, Homo sapiens
auuuuauuuaugguccag

SEQ ID NO: 20894 - RNA, 24 nt, Homo sapiens
cagaaugcuuugaaauucuaaugg

SEQ ID NO: 20895 - RNA, 20 nt, Homo sapiens
cccgacaccucaccuuucgc

SEQ ID NO: 20896 - RNA, 17 nt, Homo sapiens
ccucaccuuucgcuguu

SEQ ID NO: 20897 - RNA, 21 nt, Homo sapiens
cucuuucucucucucucucuc

SEQ ID NO: 20898 - RNA, 18 nt, Homo sapiens
uaaggauaaaacacguca

SEQ ID NO: 20899 - RNA, 22 nt, Homo sapiens
uaucggccaccugccaaucaca

SEQ ID NO: 20900 - RNA, 16 nt, Homo sapiens
ucucucucucuuuucu

SEQ ID NO: 20901 - RNA, 21 nt, Homo sapiens
aaucuuacuaacaccuaugau

SEQ ID NO: 20902 - RNA, 18 nt, Homo sapiens
auggaaacaagccacuua

SEQ ID NO: 20903 - RNA, 18 nt, Homo sapiens
auuuuauuuaugguccag

SEQ ID NO: 20904 - RNA, 24 nt, Homo sapiens
cagaaugcuuugaaauucuaaugg

SEQ ID NO: 20905 - RNA, 20 nt, Homo sapiens
cccgacaccucaccuuucgc

SEQ ID NO: 20906 - RNA, 17 nt, Homo sapiens
ccucaccuuucgcuguu

SEQ ID NO: 20907 - RNA, 21 nt, Homo sapiens
cucuuucucucucucucucuc

SEQ ID NO: 20908 - RNA, 18 nt, Homo sapiens
uaaggauaaaacacguca

SEQ ID NO: 20909 - RNA, 22 nt, Homo sapiens
uaucggccaccugccaaucaca

SEQ ID NO: 20910 - RNA, 16 nt, Homo sapiens
ucucucucucuuuucu

SEQ ID NO: 20911 - RNA, 21 nt, Homo sapiens
aaucuuacuaacaccuaugau

SEQ ID NO: 20912 - RNA, 18 nt, Homo sapiens
auggaaacaagccacuua

SEQ ID NO: 20913 - RNA, 18 nt, Homo sapiens
auuuuauuuaugguccag

SEQ ID NO: 20914 - RNA, 24 nt, Homo sapiens
cagaaugcuuugaaauucuaaugg

SEQ ID NO: 20915 - RNA, 20 nt, Homo sapiens
cccgacaccucaccuuucgc

SEQ ID NO: 20916 - RNA, 17 nt, Homo sapiens
ccucaccuuucgcuguu

SEQ ID NO: 20917 - RNA, 21 nt, Homo sapiens
cucuuucucucucucucucuc

SEQ ID NO: 20918 - RNA, 18 nt, Homo sapiens
uaaggauaaaacacguca

SEQ ID NO: 20919 - RNA, 22 nt, Homo sapiens
uaucggccaccugccaaucaca

SEQ ID NO: 20920 - RNA, 16 nt, Homo sapiens
ucucucucucuuuucu

SEQ ID NO: 20921 - RNA, 21 nt, Homo sapiens
aaucuuacuaacaccuaugau

SEQ ID NO: 20922 - RNA, 18 nt, Homo sapiens
auggaaacaagccacuua

SEQ ID NO: 20923 - RNA, 18 nt, Homo sapiens
auuuuauuuaugguccag

SEQ ID NO: 20924 - RNA, 24 nt, Homo sapiens
cagaaugcuuugaaauucuaaugg

SEQ ID NO: 20925 - RNA, 20 nt, Homo sapiens
cccgacaccucaccuuucgc

SEQ ID NO: 20926 - RNA, 17 nt, Homo sapiens
ccucaccuuucgcuguu

SEQ ID NO: 20927 - RNA, 21 nt, Homo sapiens
cucuuucucucucucucucuc

SEQ ID NO: 20928 - RNA, 18 nt, Homo sapiens
uaaggauaaaacacguca

SEQ ID NO: 20929 - RNA, 22 nt, Homo sapiens
uaucggccaccugccaaucaca

SEQ ID NO: 20930 - RNA, 16 nt, Homo sapiens
ucucucucucuuuucu

SEQ ID NO: 20931 - RNA, 21 nt, Homo sapiens
aaucuuacuaacaccuaugau

SEQ ID NO: 20932 - RNA, 18 nt, Homo sapiens
auggaaacaagccacuua

SEQ ID NO: 20933 - RNA, 18 nt, Homo sapiens
auuuuauuuaugguccag

SEQ ID NO: 20934 - RNA, 24 nt, Homo sapiens
cagaaugcuuugaaauucuaaugg

SEQ ID NO: 20935 - RNA, 20 nt, Homo sapiens
cccgacaccucaccuuucgc

SEQ ID NO: 20936 - RNA, 17 nt, Homo sapiens
ccucaccuuucgcuguu

SEQ ID NO: 20937 - RNA, 21 nt, Homo sapiens
cucuuucucucucucucucuc

SEQ ID NO: 20938 - RNA, 18 nt, Homo sapiens
uaaggauaaaacacguca

SEQ ID NO: 20939 - RNA, 22 nt, Homo sapiens
uaucggccaccugccaaucaca

SEQ ID NO: 20940 - RNA, 16 nt, Homo sapiens
ucucucucucuuuucu

SEQ ID NO: 20941 - RNA, 21 nt, Homo sapiens
aaucuuacuaacaccuaugau

SEQ ID NO: 20942 - RNA, 18 nt, Homo sapiens
auggaaacaagccacuua

SEQ ID NO: 20943 - RNA, 18 nt, Homo sapiens
auuuuauuuaugguccag

SEQ ID NO: 20944 - RNA, 24 nt, Homo sapiens
cagaaugcuuugaaauucuaaugg

SEQ ID NO: 20945 - RNA, 20 nt, Homo sapiens
cccgacaccucaccuuucgc

SEQ ID NO: 20946 - RNA, 17 nt, Homo sapiens
ccucaccuuucgcuguu

SEQ ID NO: 20947 - RNA, 21 nt, Homo sapiens
cucuuucucucucucucucuc

SEQ ID NO: 20948 - RNA, 18 nt, Homo sapiens
uaaggauaaaacacguca

SEQ ID NO: 20949 - RNA, 22 nt, Homo sapiens
uaucggccaccugccaaucaca

SEQ ID NO: 20950 - RNA, 16 nt, Homo sapiens
ucucucucucuuuucu

SEQ ID NO: 20951 - RNA, 21 nt, Homo sapiens
aaucuuacuaacaccuaugau

SEQ ID NO: 20952 - RNA, 18 nt, Homo sapiens
auggaaacaagccacuua

SEQ ID NO: 20953 - RNA, 18 nt, Homo sapiens
auuuuauuuaugguccag

SEQ ID NO: 20954 - RNA, 24 nt, Homo sapiens
cagaaugcuuugaaauucuaaugg

SEQ ID NO: 20955 - RNA, 20 nt, Homo sapiens
cccgacaccucaccuuucgc

SEQ ID NO: 20956 - RNA, 17 nt, Homo sapiens
ccucaccuuucgcuguu

SEQ ID NO: 20957 - RNA, 21 nt, Homo sapiens
cucuuucucucucucucucuc

SEQ ID NO: 20958 - RNA, 18 nt, Homo sapiens
uaaggauaaaacacguca

SEQ ID NO: 20959 - RNA, 22 nt, Homo sapiens
uaucggccaccugccaaucaca

SEQ ID NO: 20960 - RNA, 16 nt, Homo sapiens
ucucucucucuuuucu

SEQ ID NO: 20961 - RNA, 21 nt, Homo sapiens
aaucuuacuaacaccuaugau

SEQ ID NO: 20962 - RNA, 18 nt, Homo sapiens
auggaaacaagccacuua

SEQ ID NO: 20963 - RNA, 18 nt, Homo sapiens
auuuuauuuaugguccag

SEQ ID NO: 20964 - RNA, 24 nt, Homo sapiens
cagaaugcuuugaaauucuaaugg

SEQ ID NO: 20965 - RNA, 20 nt, Homo sapiens
cccgacaccucaccuuucgc

SEQ ID NO: 20966 - RNA, 17 nt, Homo sapiens
ccucaccuuucgcuguu

SEQ ID NO: 20967 - RNA, 21 nt, Homo sapiens
cucuuucucucucucucucuc

SEQ ID NO: 20968 - RNA, 18 nt, Homo sapiens
uaaggauaaaacacguca

SEQ ID NO: 20969 - RNA, 22 nt, Homo sapiens
uaucggccaccugccaaucaca

SEQ ID NO: 20970 - RNA, 16 nt, Homo sapiens
ucucucucucuuuucu

SEQ ID NO: 20971 - RNA, 21 nt, Homo sapiens
aaucuuacuaacaccuaugau

SEQ ID NO: 20972 - RNA, 18 nt, Homo sapiens
auggaaacaagccacuua

SEQ ID NO: 20973 - RNA, 18 nt, Homo sapiens
auuuuauuuaugguccag

SEQ ID NO: 20974 - RNA, 24 nt, Homo sapiens
cagaaugcuuugaaauucuaaugg

SEQ ID NO: 20975 - RNA, 20 nt, Homo sapiens
cccgacaccucaccuuucgc

SEQ ID NO: 20976 - RNA, 17 nt, Homo sapiens
ccucaccuuucgcuguu

SEQ ID NO: 20977 - RNA, 21 nt, Homo sapiens
cucuuucucucucucucucuc

SEQ ID NO: 20978 - RNA, 18 nt, Homo sapiens
uaaggauaaaacacguca

SEQ ID NO: 20979 - RNA, 22 nt, Homo sapiens
uaucggccaccugccaaucaca

SEQ ID NO: 20980 - RNA, 16 nt, Homo sapiens
ucucucucucuuuucu

SEQ ID NO: 20981 - RNA, 19 nt, Homo sapiens
cugaagccucaguccuuca

SEQ ID NO: 20982 - RNA, 19 nt, Homo sapiens
cugaagccucaguccuuca

SEQ ID NO: 20983 - RNA, 18 nt, Homo sapiens
ccgcggaauaucggcuua

SEQ ID NO: 20984 - RNA, 19 nt, Homo sapiens
cugaagccucaguccuuca

SEQ ID NO: 20985 - RNA, 19 nt, Homo sapiens
cugaagccucaguccuuca

SEQ ID NO: 20986 - RNA, 19 nt, Homo sapiens
cugaagccucaguccuuca

SEQ ID NO: 20987 - RNA, 19 nt, Homo sapiens
cugaagccucaguccuuca

SEQ ID NO: 20988 - RNA, 19 nt, Homo sapiens
cugaagccucaguccuuca

SEQ ID NO: 20989 - RNA, 19 nt, Homo sapiens
cugaagccucaguccuuca

SEQ ID NO: 20990 - RNA, 19 nt, Homo sapiens
cugaagccucaguccuuca

SEQ ID NO: 20991 - RNA, 19 nt, Homo sapiens
cugaagccucaguccuuca

SEQ ID NO: 20992 - RNA, 19 nt, Homo sapiens
cugaagccucaguccuuca

SEQ ID NO: 20993 - RNA, 19 nt, Homo sapiens
cugaagccucaguccuuca

SEQ ID NO: 20994 - RNA, 19 nt, Homo sapiens
cugaagccucaguccuuca

SEQ ID NO: 20995 - RNA, 19 nt, Homo sapiens
cugaagccucaguccuuca

SEQ ID NO: 20996 - RNA, 19 nt, Homo sapiens
cugaagccucaguccuuca

SEQ ID NO: 20997 - RNA, 19 nt, Homo sapiens
cugaagccucaguccuuca

SEQ ID NO: 20998 - RNA, 19 nt, Homo sapiens
cugaagccucaguccuuca

SEQ ID NO: 20999 - RNA, 19 nt, Homo sapiens
cugaagccucaguccuuca

SEQ ID NO: 21000 - RNA, 19 nt, Homo sapiens
ccagcccaccuccgccucc

SEQ ID NO: 21001 - RNA, 19 nt, Homo sapiens
ccagcccaccuccgccucc

SEQ ID NO: 21002 - RNA, 16 nt, Homo sapiens
uaacuaauaagugaca

SEQ ID NO: 21003 - RNA, 26 nt, Homo sapiens
uuuaugucaaacaauuaugcuuaaua

SEQ ID NO: 21004 - RNA, 23 nt, Homo sapiens
uuugagauauuuuaaauugcuuu

SEQ ID NO: 21005 - RNA, 20 nt, Homo sapiens
caucuuaaaaaaaaaucuca

SEQ ID NO: 21006 - RNA, 22 nt, Homo sapiens
ccugcuuuucugggucaauuuu

SEQ ID NO: 21007 - RNA, 16 nt, Homo sapiens
uaacuaauaagugaca

SEQ ID NO: 21008 - RNA, 26 nt, Homo sapiens
ucauagaugaucauuaaauuuuuaga

SEQ ID NO: 21009 - RNA, 26 nt, Homo sapiens
uuuaugucaaacaauuaugcuuaaua

SEQ ID NO: 21010 - RNA, 23 nt, Homo sapiens
uuugagauauuuuaaauugcuuu

SEQ ID NO: 21011 - RNA, 17 nt, Homo sapiens
gcaggcucggcucuguc

SEQ ID NO: 21012 - RNA, 19 nt, Homo sapiens
ggucugggcacugcagcag

SEQ ID NO: 21013 - RNA, 19 nt, Homo sapiens
aagcgauucucucacuuca

SEQ ID NO: 21014 - RNA, 18 nt, Homo sapiens
caguggugcaaucucacu

SEQ ID NO: 21015 - RNA, 23 nt, Homo sapiens
ucaugacuuuuuuauguguacca

SEQ ID NO: 21016 - RNA, 18 nt, Homo sapiens
uccgccuuccagguucaa

SEQ ID NO: 21017 - RNA, 19 nt, Homo sapiens
ugggugacgagugaaacug

SEQ ID NO: 21018 - RNA, 28 nt, Homo sapiens
uaaaacaugcuuaagaaaaaugcacuga

SEQ ID NO: 21019 - RNA, 18 nt, Homo sapiens
ucauaccaaggccucaua

SEQ ID NO: 21020 - RNA, 16 nt, Homo sapiens
ugaagauuucuggcuu

SEQ ID NO: 21021 - RNA, 22 nt, Homo sapiens
gccugggccguaucuccggcuc

SEQ ID NO: 21022 - RNA, 18 nt, Homo sapiens
ugcuguuguccaacuauu

SEQ ID NO: 21023 - RNA, 21 nt, Homo sapiens
aucuuggcucacugcaaccuc

SEQ ID NO: 21024 - RNA, 23 nt, Homo sapiens
auuuggauuuuacugguuggucc

SEQ ID NO: 21025 - RNA, 18 nt, Homo sapiens
caaacauuguaaaaugug

SEQ ID NO: 21026 - RNA, 18 nt, Homo sapiens
ccugcaaccuccaccucc

SEQ ID NO: 21027 - RNA, 21 nt, Homo sapiens
cgcccaccaccccaccuggcu

SEQ ID NO: 21028 - RNA, 19 nt, Homo sapiens
cugcaaccuccgccuccca

SEQ ID NO: 21029 - RNA, 17 nt, Homo sapiens
uccaccuccagguucaa

SEQ ID NO: 21030 - RNA, 20 nt, Homo sapiens
uggccaggcuggucuugaac

SEQ ID NO: 21031 - RNA, 17 nt, Homo sapiens
uacccuuaacccaugaa

SEQ ID NO: 21032 - RNA, 21 nt, Homo sapiens
aggccuugaagacaugauucc

SEQ ID NO: 21033 - RNA, 16 nt, Homo sapiens
uggagagguggaaaga

SEQ ID NO: 21034 - RNA, 21 nt, Homo sapiens
uugauaugacuaauucaggga

SEQ ID NO: 21035 - RNA, 16 nt, Homo sapiens
ccagaggcuuuuccag

SEQ ID NO: 21036 - RNA, 18 nt, Homo sapiens
uaucugcccuuugaaaua

SEQ ID NO: 21037 - RNA, 19 nt, Homo sapiens
aucugugaaauauacuaca

SEQ ID NO: 21038 - RNA, 17 nt, Homo sapiens
cagauuaaacucucagc

SEQ ID NO: 21039 - RNA, 19 nt, Homo sapiens
ccuaauaagauuuauuauc

SEQ ID NO: 21040 - RNA, 17 nt, Homo sapiens
gucaaucaaauaugcca

SEQ ID NO: 21041 - RNA, 19 nt, Homo sapiens
ucuggaugacaucugugaa

SEQ ID NO: 21042 - RNA, 19 nt, Homo sapiens
augguaccagccugucaca

SEQ ID NO: 21043 - RNA, 18 nt, Homo sapiens
ccuuguaaguucugggga

SEQ ID NO: 21044 - RNA, 19 nt, Homo sapiens
ugagacuugacugaggcug

SEQ ID NO: 21045 - RNA, 20 nt, Homo sapiens
auugugaccaaugaacuuua

SEQ ID NO: 21046 - RNA, 17 nt, Homo sapiens
uaaaaaauaguggugag

SEQ ID NO: 21047 - RNA, 18 nt, Homo sapiens
ugugaccaaugaacuuua

SEQ ID NO: 21048 - RNA, 20 nt, Homo sapiens
acuuguuuacauccaacaaa

SEQ ID NO: 21049 - RNA, 20 nt, Homo sapiens
gccuuagaacgccuuuccag

SEQ ID NO: 21050 - RNA, 23 nt, Homo sapiens
guucaaaaucaagugccuaggga

SEQ ID NO: 21051 - RNA, 17 nt, Homo sapiens
uccuuuucacccaugga

SEQ ID NO: 21052 - RNA, 18 nt, Homo sapiens
ugaaauagaaccauggaa

SEQ ID NO: 21053 - RNA, 23 nt, Homo sapiens
aaauuagugguuaagguuaucua

SEQ ID NO: 21054 - RNA, 20 nt, Homo sapiens
cacuuucacuguggauuugg

SEQ ID NO: 21055 - RNA, 19 nt, Homo sapiens
acuuuggucccuugacaua

SEQ ID NO: 21056 - RNA, 16 nt, Homo sapiens
cggguaacggcuccug

SEQ ID NO: 21057 - RNA, 17 nt, Homo sapiens
gcagacagacauccucu

SEQ ID NO: 21058 - RNA, 20 nt, Homo sapiens
agaaaagagcacaggcugca

SEQ ID NO: 21059 - RNA, 18 nt, Homo sapiens
aguauggguuuggccaua

SEQ ID NO: 21060 - RNA, 19 nt, Homo sapiens
gacguuugucugugcgauu

SEQ ID NO: 21061 - RNA, 25 nt, Homo sapiens
agccccgccaccaacuagggcgaga

SEQ ID NO: 21062 - RNA, 23 nt, Homo sapiens
cucccaagaccgugcuugcccaa

SEQ ID NO: 21063 - RNA, 18 nt, Homo sapiens
ggcccuggacacccagug

SEQ ID NO: 21064 - RNA, 19 nt, Homo sapiens
uguugggaaagucguugaa

SEQ ID NO: 21065 - RNA, 15 nt, Homo sapiens
cugaccaagcccggg

SEQ ID NO: 21066 - RNA, 19 nt, Homo sapiens
gauccugaagaucguguga

SEQ ID NO: 21067 - RNA, 24 nt, Homo sapiens
ucauuuucuuuguauaacuaugca

SEQ ID NO: 21068 - RNA, 25 nt, Homo sapiens
uccagcacgucguggccucuggucc

SEQ ID NO: 21069 - RNA, 19 nt, Homo sapiens
ggaacagaaacaagcacuu

SEQ ID NO: 21070 - RNA, 15 nt, Homo sapiens
ccugagcauguugaa

SEQ ID NO: 21071 - RNA, 21 nt, Homo sapiens
agcugacacugauagauugau

SEQ ID NO: 21072 - RNA, 24 nt, Homo sapiens
ucugaguaagggaggagcacuuuu

SEQ ID NO: 21073 - RNA, 18 nt, Homo sapiens
ucccuuugcaaaauguga

SEQ ID NO: 21074 - RNA, 19 nt, Homo sapiens
ugcggggugcgguuuguag

SEQ ID NO: 21075 - RNA, 21 nt, Homo sapiens
uggaaaguacuuuauccagaa

SEQ ID NO: 21076 - RNA, 18 nt, Homo sapiens
ugucaauuucggcuguga

SEQ ID NO: 21077 - RNA, 23 nt, Homo sapiens
caucaaccucaacugugugugca

SEQ ID NO: 21078 - RNA, 21 nt, Homo sapiens
cggcgguggcggagccggagc

SEQ ID NO: 21079 - RNA, 18 nt, Homo sapiens
gcauuaaucuugcaguuu

SEQ ID NO: 21080 - RNA, 22 nt, Homo sapiens
gcugcuucuguuuuuucauuaa

SEQ ID NO: 21081 - RNA, 19 nt, Homo sapiens
acccuucccacagacuccu

SEQ ID NO: 21082 - RNA, 20 nt, Homo sapiens
ccccuguccuguuucucacc

SEQ ID NO: 21083 - RNA, 18 nt, Homo sapiens
cugugauagcauguuuca

SEQ ID NO: 21084 - RNA, 24 nt, Homo sapiens
cuuccgucaaguugucuuauuuuu

SEQ ID NO: 21085 - RNA, 18 nt, Homo sapiens
ggaagagagcacacagau

SEQ ID NO: 21086 - RNA, 20 nt, Homo sapiens
ugacaucucuuucgucuccu

SEQ ID NO: 21087 - RNA, 18 nt, Homo sapiens
ugcccguuugccuguucc

SEQ ID NO: 21088 - RNA, 18 nt, Homo sapiens
ugcugagaaugucucuca

SEQ ID NO: 21089 - RNA, 21 nt, Homo sapiens
uggaugggcuccccacgacug

SEQ ID NO: 21090 - RNA, 23 nt, Homo sapiens
agccacacucagaggccucacug

SEQ ID NO: 21091 - RNA, 26 nt, Homo sapiens
ccaucgauugggggugguuuuuguca

SEQ ID NO: 21092 - RNA, 18 nt, Homo sapiens
cucccccuccucuccucu

SEQ ID NO: 21093 - RNA, 24 nt, Homo sapiens
cuuuuucacaagcgcuuuauuuuu

SEQ ID NO: 21094 - RNA, 16 nt, Homo sapiens
guucuggaaaaugcuc

SEQ ID NO: 21095 - RNA, 26 nt, Homo sapiens
acccugucuuaaagacccugaccuca

SEQ ID NO: 21096 - RNA, 17 nt, Homo sapiens
acgguguuagaacucuc

SEQ ID NO: 21097 - RNA, 19 nt, Homo sapiens
auggaggacaauccugaua

SEQ ID NO: 21098 - RNA, 18 nt, Homo sapiens
cacugacaauuugaugag

SEQ ID NO: 21099 - RNA, 21 nt, Homo sapiens
ccuaggcaggagcaaucacuu

SEQ ID NO: 21100 - RNA, 20 nt, Homo sapiens
cuccugccccuuuguuuuuu

SEQ ID NO: 21101 - RNA, 18 nt, Homo sapiens
cuuccuuauguuccugaa

SEQ ID NO: 21102 - RNA, 22 nt, Homo sapiens
gagccaagauugugccaccaca

SEQ ID NO: 21103 - RNA, 22 nt, Homo sapiens
gagccaagauugugccacugca

SEQ ID NO: 21104 - RNA, 24 nt, Homo sapiens
gccacguugaaguaaaaacaaaca

SEQ ID NO: 21105 - RNA, 24 nt, Homo sapiens
gcuuuuugguugcuguugaguuuu

SEQ ID NO: 21106 - RNA, 21 nt, Homo sapiens
ucauauagugggaucaugcaa

SEQ ID NO: 21107 - RNA, 22 nt, Homo sapiens
uguaucgucuucagacuccuca

SEQ ID NO: 21108 - RNA, 19 nt, Homo sapiens
acagagaaccacuacuuug

SEQ ID NO: 21109 - RNA, 22 nt, Homo sapiens
ugaaaccaaagcuagcauuuca

SEQ ID NO: 21110 - RNA, 23 nt, Homo sapiens
uggcccucacuuagcuugugaac

SEQ ID NO: 21111 - RNA, 22 nt, Homo sapiens
agucucacucugcugccuaggc

SEQ ID NO: 21112 - RNA, 17 nt, Homo sapiens
aaaauuuguaugcugua

SEQ ID NO: 21113 - RNA, 21 nt, Homo sapiens
aacuggauuggggugugcaca

SEQ ID NO: 21114 - RNA, 21 nt, Homo sapiens
augguucgugccuucauucca

SEQ ID NO: 21115 - RNA, 21 nt, Homo sapiens
uccaaacacuggaaagcucuc

SEQ ID NO: 21116 - RNA, 20 nt, Homo sapiens
ucuccaugugccuuagccuu

SEQ ID NO: 21117 - RNA, 24 nt, Homo sapiens
caacuuuccauuucucauggucaa

SEQ ID NO: 21118 - RNA, 21 nt, Homo sapiens
uaaauauguaaaaaauauuua

SEQ ID NO: 21119 - RNA, 27 nt, Homo sapiens
uuucuuucaguguggcugcuuuggcuu

SEQ ID NO: 21120 - RNA, 19 nt, Homo sapiens
gagggggcugggccuauca

SEQ ID NO: 21121 - RNA, 19 nt, Homo sapiens
gccacccccaccacgagug

SEQ ID NO: 21122 - RNA, 20 nt, Homo sapiens
uggccaggcuggucuugaac

SEQ ID NO: 21123 - RNA, 20 nt, Homo sapiens
cauuaacuugaacagggaua

SEQ ID NO: 21124 - RNA, 21 nt, Homo sapiens
uucuccagacaaacuuccuua

SEQ ID NO: 21125 - RNA, 21 nt, Homo sapiens
gaaaggauaaauaugccuuuc

SEQ ID NO: 21126 - RNA, 18 nt, Homo sapiens
aguuccuacugcacaagu

SEQ ID NO: 21127 - RNA, 20 nt, Homo sapiens
cguguaaaacacaguuccua

SEQ ID NO: 21128 - RNA, 19 nt, Homo sapiens
ucaguguuguuuuaauuuu

SEQ ID NO: 21129 - RNA, 20 nt, Homo sapiens
gggcugagccaucccgcgug

SEQ ID NO: 21130 - RNA, 18 nt, Homo sapiens
aaugcaaucuguauaaua

SEQ ID NO: 21131 - RNA, 16 nt, Homo sapiens
uugcauccaagcuucu

SEQ ID NO: 21132 - RNA, 17 nt, Homo sapiens
caaggcugggucuagcg

SEQ ID NO: 21133 - RNA, 25 nt, Homo sapiens
cauggaaagaaaauaauuaugaaug

SEQ ID NO: 21134 - RNA, 19 nt, Homo sapiens
gcaccauccucguacuguu

SEQ ID NO: 21135 - RNA, 31 nt, Homo sapiens
uaccugggcuguggugugugggucuuggccu

SEQ ID NO: 21136 - RNA, 19 nt, Homo sapiens
ucccaaccucaccauggaa

SEQ ID NO: 21137 - RNA, 25 nt, Homo sapiens
aaugguuggccccacgaagccacga

SEQ ID NO: 21138 - RNA, 23 nt, Homo sapiens
ccccgccccugagacccugcagc

SEQ ID NO: 21139 - RNA, 23 nt, Homo sapiens
cuggaagcaaagaggguugcuca

SEQ ID NO: 21140 - RNA, 19 nt, Homo sapiens
uauuuuuuacuuuucuaau

SEQ ID NO: 21141 - RNA, 18 nt, Homo sapiens
uucaagcggcaggacgca

SEQ ID NO: 21142 - RNA, 19 nt, Homo sapiens
cagcuaagccuucaucaua

SEQ ID NO: 21143 - RNA, 18 nt, Homo sapiens
gaacuaagagagcauugg

SEQ ID NO: 21144 - RNA, 17 nt, Homo sapiens
gcggcucucaacgugac

SEQ ID NO: 21145 - RNA, 16 nt, Homo sapiens
uacuggcucagacugu

SEQ ID NO: 21146 - RNA, 20 nt, Homo sapiens
ugggugggguuaugaaauug

SEQ ID NO: 21147 - RNA, 23 nt, Homo sapiens
uucaggaacaaccagagguauca

SEQ ID NO: 21148 - RNA, 25 nt, Homo sapiens
gccaaaguacuggacugccugguuc

SEQ ID NO: 21149 - RNA, 19 nt, Homo sapiens
aaccccccgaagccauuga

SEQ ID NO: 21150 - RNA, 18 nt, Homo sapiens
gguucuuugggcaacaga

SEQ ID NO: 21151 - RNA, 24 nt, Homo sapiens
guuugaacacuuuuguugugguuc

SEQ ID NO: 21152 - RNA, 26 nt, Homo sapiens
ucaccaaaacccccuuucccaucuug

SEQ ID NO: 21153 - RNA, 15 nt, Homo sapiens
uuucccaucuugcac

SEQ ID NO: 21154 - RNA, 22 nt, Homo sapiens
caaauauaugguaggacuguua

SEQ ID NO: 21155 - RNA, 22 nt, Homo sapiens
uaccuaaucucuuugugccuca

SEQ ID NO: 21156 - RNA, 20 nt, Homo sapiens
aaaauguaucuguguuacga

SEQ ID NO: 21157 - RNA, 22 nt, Homo sapiens
aauccaugauuuauacucagaa

SEQ ID NO: 21158 - RNA, 21 nt, Homo sapiens
aucugggccuaauguuggcuu

SEQ ID NO: 21159 - RNA, 19 nt, Homo sapiens
gcuuugugacaugaagcua

SEQ ID NO: 21160 - RNA, 20 nt, Homo sapiens
ucaucuauggacuugccaaa

SEQ ID NO: 21161 - RNA, 20 nt, Homo sapiens
acaauguuuucuugauuaca

SEQ ID NO: 21162 - RNA, 20 nt, Homo sapiens
auuaugugacugggacucca

SEQ ID NO: 21163 - RNA, 22 nt, Homo sapiens
caauguuuucuugauuacaucu

SEQ ID NO: 21164 - RNA, 19 nt, Homo sapiens
uccagaagauagacuucag

SEQ ID NO: 21165 - RNA, 24 nt, Homo sapiens
ucugcagcauucuugaauauuuuu

SEQ ID NO: 21166 - RNA, 18 nt, Homo sapiens
aaaacagacaaacaagaa

SEQ ID NO: 21167 - RNA, 27 nt, Homo sapiens
gucaagaugacugcucuauaucacuug

SEQ ID NO: 21168 - RNA, 18 nt, Homo sapiens
uaugcaaaagcugcugua

SEQ ID NO: 21169 - RNA, 17 nt, Homo sapiens
cucgucaaacaucugau

SEQ ID NO: 21170 - RNA, 22 nt, Homo sapiens
ugugguuuauuuugucaucaga

SEQ ID NO: 21171 - RNA, 21 nt, Homo sapiens
agugcuccgaagcugugugcu

SEQ ID NO: 21172 - RNA, 24 nt, Homo sapiens
auccuaccacucucaccccacuuu

SEQ ID NO: 21173 - RNA, 20 nt, Homo sapiens
gcccugccauuggcggcucu

SEQ ID NO: 21174 - RNA, 19 nt, Homo sapiens
uggcccaggcguggggcua

SEQ ID NO: 21175 - RNA, 19 nt, Homo sapiens
acaaaauauaacaaguuuu

SEQ ID NO: 21176 - RNA, 24 nt, Homo sapiens
caugaauuagcuagcauuagcaua

SEQ ID NO: 21177 - RNA, 20 nt, Homo sapiens
caccaccaaccaccuucuuc

SEQ ID NO: 21178 - RNA, 18 nt, Homo sapiens
caccaccacagccccucu

SEQ ID NO: 21179 - RNA, 22 nt, Homo sapiens
ccacccccugccccacugcuga

SEQ ID NO: 21180 - RNA, 18 nt, Homo sapiens
ccauuuauccaaaccacu

SEQ ID NO: 21181 - RNA, 16 nt, Homo sapiens
cccucaaccguucuca

SEQ ID NO: 21182 - RNA, 19 nt, Homo sapiens
ccuguauggagaccuugga

SEQ ID NO: 21183 - RNA, 19 nt, Homo sapiens
ccuuucccuccuucccuca

SEQ ID NO: 21184 - RNA, 20 nt, Homo sapiens
ggcagggaguucaggacaac

SEQ ID NO: 21185 - RNA, 24 nt, Homo sapiens
ugaccacaccuccguuuucuccgu

SEQ ID NO: 21186 - RNA, 18 nt, Homo sapiens
uuccagaaaugacuuuag

SEQ ID NO: 21187 - RNA, 18 nt, Homo sapiens
auuuaccacccuuccaga

SEQ ID NO: 21188 - RNA, 23 nt, Homo sapiens
ggagagcgcgcggcggcggcggc

SEQ ID NO: 21189 - RNA, 24 nt, Homo sapiens
ggccacucgcagcggcgcuggccg

SEQ ID NO: 21190 - RNA, 23 nt, Homo sapiens
gggacggccccgagcgcgcccuc

SEQ ID NO: 21191 - RNA, 18 nt, Homo sapiens
aaaaaggucaugaaacac

SEQ ID NO: 21192 - RNA, 22 nt, Homo sapiens
augguguucaggccacuauggc

SEQ ID NO: 21193 - RNA, 23 nt, Homo sapiens
caagcauggaucuccauauuuca

SEQ ID NO: 21194 - RNA, 18 nt, Homo sapiens
caauauagaaaaaaaaac

SEQ ID NO: 21195 - RNA, 19 nt, Homo sapiens
cucgaaaacucauguugaa

SEQ ID NO: 21196 - RNA, 20 nt, Homo sapiens
guauuuccacagagcaugca

SEQ ID NO: 21197 - RNA, 22 nt, Homo sapiens
uaaaacuucaaauaucucacca

SEQ ID NO: 21198 - RNA, 19 nt, Homo sapiens
uauugauacaaacugugac

SEQ ID NO: 21199 - RNA, 19 nt, Homo sapiens
agcuccucccaccccaaca

SEQ ID NO: 21200 - RNA, 20 nt, Homo sapiens
ccauggacauccccaacaac

SEQ ID NO: 21201 - RNA, 19 nt, Homo sapiens
cuccucgaugcccagugaa

SEQ ID NO: 21202 - RNA, 18 nt, Homo sapiens
gucaaagggcagcugaga

SEQ ID NO: 21203 - RNA, 18 nt, Homo sapiens
guccucccuccuugcugc

SEQ ID NO: 21204 - RNA, 21 nt, Homo sapiens
acaugcuuguaaucccagcua

SEQ ID NO: 21205 - RNA, 19 nt, Homo sapiens
cugcaaccuccgccuccca

SEQ ID NO: 21206 - RNA, 18 nt, Homo sapiens
uccgccucccagguucaa

SEQ ID NO: 21207 - RNA, 24 nt, Homo sapiens
uaucuguagaaaaccacagccuca

SEQ ID NO: 21208 - RNA, 17 nt, Homo sapiens
aacagcuaaguaccuag

SEQ ID NO: 21209 - RNA, 22 nt, Homo sapiens
ccucuuuguccagccuugauuu

SEQ ID NO: 21210 - RNA, 16 nt, Homo sapiens
gaccaacucaugaagu

SEQ ID NO: 21211 - RNA, 16 nt, Homo sapiens
uauuacccuguguugu

SEQ ID NO: 21212 - RNA, 22 nt, Homo sapiens
cucuaacacauaugcaguuuua

SEQ ID NO: 21213 - RNA, 22 nt, Homo sapiens
cuguaggacaguuuaucaguca

SEQ ID NO: 21214 - RNA, 26 nt, Homo sapiens
cagugagucaagaucucaccacugaa

SEQ ID NO: 21215 - RNA, 18 nt, Homo sapiens
ccgccgccuccccgcuga

SEQ ID NO: 21216 - RNA, 17 nt, Homo sapiens
cuaacagucuuguguga

SEQ ID NO: 21217 - RNA, 21 nt, Homo sapiens
gagagguguuauacagggcga

SEQ ID NO: 21218 - RNA, 18 nt, Homo sapiens
ucuucucaccgaacuuug

SEQ ID NO: 21219 - RNA, 22 nt, Homo sapiens
aaggcuggcugugcuggaguca

SEQ ID NO: 21220 - RNA, 18 nt, Homo sapiens
auaucuuugauccccuga

SEQ ID NO: 21221 - RNA, 24 nt, Homo sapiens
caucuuccuccucccgacaucgca

SEQ ID NO: 21222 - RNA, 17 nt, Homo sapiens
cccgugccgcccacagc

SEQ ID NO: 21223 - RNA, 22 nt, Homo sapiens
acccauaauugagauugccaua

SEQ ID NO: 21224 - RNA, 22 nt, Homo sapiens
gaacacuagcauaccugcauga

SEQ ID NO: 21225 - RNA, 21 nt, Homo sapiens
uggcucuagaaugucuaggaa

SEQ ID NO: 21226 - RNA, 22 nt, Homo sapiens
uuugaguaauuuugggcaagcu

SEQ ID NO: 21227 - RNA, 23 nt, Homo sapiens
cuuggguauuauagaucacuuuu

SEQ ID NO: 21228 - RNA, 20 nt, Homo sapiens
gcuucugugaggaccuuuug

SEQ ID NO: 21229 - RNA, 23 nt, Homo sapiens
uaucuccaacuuccuaaaggcuu

SEQ ID NO: 21230 - RNA, 20 nt, Homo sapiens
uuguuguaauuauggcacug

SEQ ID NO: 21231 - RNA, 21 nt, Homo sapiens
gccauacgugguugucugcuu

SEQ ID NO: 21232 - RNA, 19 nt, Homo sapiens
gggcgccacagcacccacc

SEQ ID NO: 21233 - RNA, 19 nt, Homo sapiens
aguagaggcaugaacacac

SEQ ID NO: 21234 - RNA, 21 nt, Homo sapiens
cacggaugcacagagauaugc

SEQ ID NO: 21235 - RNA, 17 nt, Homo sapiens
cccccaaacucuccccc

SEQ ID NO: 21236 - RNA, 19 nt, Homo sapiens
gagagagacagagacagag

SEQ ID NO: 21237 - RNA, 21 nt, Homo sapiens
gauaugcacacacauggauga

SEQ ID NO: 21238 - RNA, 18 nt, Homo sapiens
gcugagccuccuuaccuc

SEQ ID NO: 21239 - RNA, 25 nt, Homo sapiens
ggcugcgucuccuccgcacaccugu

SEQ ID NO: 21240 - RNA, 19 nt, Homo sapiens
ugaacacacauggaugcac

SEQ ID NO: 21241 - RNA, 20 nt, Homo sapiens
cagcucugugagucuggcca

SEQ ID NO: 21242 - RNA, 22 nt, Homo sapiens
caccccaccauccaguuuugcc

SEQ ID NO: 21243 - RNA, 20 nt, Homo sapiens
cuugggcaaucuauacuuuu

SEQ ID NO: 21244 - RNA, 16 nt, Homo sapiens
gcucugggaaggaggc

SEQ ID NO: 21245 - RNA, 23 nt, Homo sapiens
uccaguuuugcccagaugugcua

SEQ ID NO: 21246 - RNA, 24 nt, Homo sapiens
ucccccagcucuauccaucugcca

SEQ ID NO: 21247 - RNA, 25 nt, Homo sapiens
accugcaugcacacacaccaccuca

SEQ ID NO: 21248 - RNA, 23 nt, Homo sapiens
ccccucacuaucagagacugggc

SEQ ID NO: 21249 - RNA, 16 nt, Homo sapiens
aaguggacuuggccau

SEQ ID NO: 21250 - RNA, 18 nt, Homo sapiens
cuacagagacaauuccuc

SEQ ID NO: 21251 - RNA, 20 nt, Homo sapiens
uccauauccuaaugauucaa

SEQ ID NO: 21252 - RNA, 20 nt, Homo sapiens
cccugcuagagcagccgcgc

SEQ ID NO: 21253 - RNA, 17 nt, Homo sapiens
uggguauaaacuguuga

SEQ ID NO: 21254 - RNA, 22 nt, Homo sapiens
caggacaacccaacagcaccag

SEQ ID NO: 21255 - RNA, 20 nt, Homo sapiens
gccugccaggcagacgcugc

SEQ ID NO: 21256 - RNA, 20 nt, Homo sapiens
ccauggauacgcuugugauc

SEQ ID NO: 21257 - RNA, 22 nt, Homo sapiens
guuucuccauuaauaguaacuc

SEQ ID NO: 21258 - RNA, 18 nt, Homo sapiens
cuuccccaccccuuacca

SEQ ID NO: 21259 - RNA, 16 nt, Homo sapiens
guccaucaugugucca

SEQ ID NO: 21260 - RNA, 20 nt, Homo sapiens
cgggagggagggcauuggca

SEQ ID NO: 21261 - RNA, 21 nt, Homo sapiens
cccucuguucuccagcaaaca

SEQ ID NO: 21262 - RNA, 21 nt, Homo sapiens
ccuuuuuauuucuguggcuuu

SEQ ID NO: 21263 - RNA, 18 nt, Homo sapiens
cuaucuuccccuccaccu

SEQ ID NO: 21264 - RNA, 21 nt, Homo sapiens
uccaaaaaacucaggaaucaa

SEQ ID NO: 21265 - RNA, 23 nt, Homo sapiens
acagacugcucuccaaucccuga

SEQ ID NO: 21266 - RNA, 17 nt, Homo sapiens
ccauauuuauucacuga

SEQ ID NO: 21267 - RNA, 26 nt, Homo sapiens
cccggaccuguacccccuccccccaa

SEQ ID NO: 21268 - RNA, 24 nt, Homo sapiens
ccuucuggcuccagcuucccucca

SEQ ID NO: 21269 - RNA, 17 nt, Homo sapiens
gacacccccaccuuccc

SEQ ID NO: 21270 - RNA, 24 nt, Homo sapiens
gugccucugccuuaucccuggugg

SEQ ID NO: 21271 - RNA, 21 nt, Homo sapiens
uguguuguaauuggucccucc

SEQ ID NO: 21272 - RNA, 24 nt, Homo sapiens
uuuuuucauaaauguuauaauuuu

SEQ ID NO: 21273 - RNA, 20 nt, Homo sapiens
acagcugcaacgugggguga

SEQ ID NO: 21274 - RNA, 17 nt, Homo sapiens
caccaccuugaacaccu

SEQ ID NO: 21275 - RNA, 20 nt, Homo sapiens
ccuuucggggauccgaggga

SEQ ID NO: 21276 - RNA, 24 nt, Homo sapiens
gccgccuuucggggauccgaggga

SEQ ID NO: 21277 - RNA, 21 nt, Homo sapiens
ggggauccgagggacuguggc

SEQ ID NO: 21278 - RNA, 21 nt, Homo sapiens
ucacacggguauccagagcaa

SEQ ID NO: 21279 - RNA, 24 nt, Homo sapiens
ugagugggccccagagcccagcug

SEQ ID NO: 21280 - RNA, 18 nt, Homo sapiens
agucaaccagcaguauua

SEQ ID NO: 21281 - RNA, 20 nt, Homo sapiens
agagcuggcauaucugguca

SEQ ID NO: 21282 - RNA, 20 nt, Homo sapiens
agagugagcaaccagcugga

SEQ ID NO: 21283 - RNA, 19 nt, Homo sapiens
auaucuggucagaacugca

SEQ ID NO: 21284 - RNA, 20 nt, Homo sapiens
gcgcccagggaggagucagu

SEQ ID NO: 21285 - RNA, 20 nt, Homo sapiens
agagcuggcauaucugguca

SEQ ID NO: 21286 - RNA, 20 nt, Homo sapiens
agagugagcaaccagcugga

SEQ ID NO: 21287 - RNA, 19 nt, Homo sapiens
auaucuggucagaacugca

SEQ ID NO: 21288 - RNA, 20 nt, Homo sapiens
gcgcccagggaggagucagu

SEQ ID NO: 21289 - RNA, 18 nt, Homo sapiens
auucccaacugaguguua

SEQ ID NO: 21290 - RNA, 18 nt, Homo sapiens
auucccaacugaguguua

SEQ ID NO: 21291 - RNA, 18 nt, Homo sapiens
ccccaggcuaugccauca

SEQ ID NO: 21292 - RNA, 23 nt, Homo sapiens
gccucccucgcucccugcuccuc

SEQ ID NO: 21293 - RNA, 20 nt, Homo sapiens
gcgcaacggcuccuuugcca

SEQ ID NO: 21294 - RNA, 22 nt, Homo sapiens
guucuggccccugucauccuca

SEQ ID NO: 21295 - RNA, 21 nt, Homo sapiens
ugcacucuucaggaaaacgug

SEQ ID NO: 21296 - RNA, 17 nt, Homo sapiens
ccacauccucuucccca

SEQ ID NO: 21297 - RNA, 19 nt, Homo sapiens
ggcaggaacuaaaaccuca

SEQ ID NO: 21298 - RNA, 23 nt, Homo sapiens
uucuggugagguggguuugggag

SEQ ID NO: 21299 - RNA, 21 nt, Homo sapiens
aaacuucuuacaaaugaccag

SEQ ID NO: 21300 - RNA, 19 nt, Homo sapiens
accccagcccccagccuca

SEQ ID NO: 21301 - RNA, 20 nt, Homo sapiens
cucaagcaacagagcugcag

SEQ ID NO: 21302 - RNA, 24 nt, Homo sapiens
gugccuggcuuugcuguggauucu

SEQ ID NO: 21303 - RNA, 19 nt, Homo sapiens
aagcagaacauuccaucca

SEQ ID NO: 21304 - RNA, 19 nt, Homo sapiens
augcagaagacuuaccuua

SEQ ID NO: 21305 - RNA, 25 nt, Homo sapiens
ccacuauucauaaaguauuaaccaa

SEQ ID NO: 21306 - RNA, 19 nt, Homo sapiens
ccaggaucugacaaugagc

SEQ ID NO: 21307 - RNA, 16 nt, Homo sapiens
ccuggacuaucaguaa

SEQ ID NO: 21308 - RNA, 17 nt, Homo sapiens
ccugguggauuuguggg

SEQ ID NO: 21309 - RNA, 18 nt, Homo sapiens
gccaucacaccacgagga

SEQ ID NO: 21310 - RNA, 20 nt, Homo sapiens
gggugcaccagggccuuguu

SEQ ID NO: 21311 - RNA, 18 nt, Homo sapiens
guuucucucacccaggug

SEQ ID NO: 21312 - RNA, 19 nt, Homo sapiens
ccaauggggcggagccuga

SEQ ID NO: 21313 - RNA, 21 nt, Homo sapiens
gcccuggccccgucucaggau

SEQ ID NO: 21314 - RNA, 19 nt, Homo sapiens
ucaguccugacgcuugcca

SEQ ID NO: 21315 - RNA, 21 nt, Homo sapiens
cccuucuguuguagacuggac

SEQ ID NO: 21316 - RNA, 18 nt, Homo sapiens
ccuggcaaggccugguga

SEQ ID NO: 21317 - RNA, 23 nt, Homo sapiens
gcuugagcuacugugcccggccc

SEQ ID NO: 21318 - RNA, 18 nt, Homo sapiens
guugcugccauugcugcu

SEQ ID NO: 21319 - RNA, 23 nt, Homo sapiens
uggagugcaguagcgcgaucuca

SEQ ID NO: 21320 - RNA, 22 nt, Homo sapiens
uuguuaaugucagagugacacu

SEQ ID NO: 21321 - RNA, 20 nt, Homo sapiens
ugaagaggcauuucagagug

SEQ ID NO: 21322 - RNA, 21 nt, Homo sapiens
uggauugacuguuguuccuuc

SEQ ID NO: 21323 - RNA, 18 nt, Homo sapiens
uuacagacacagaccugc

SEQ ID NO: 21324 - RNA, 20 nt, Homo sapiens
agcauuuugcugcuaccuua

SEQ ID NO: 21325 - RNA, 20 nt, Homo sapiens
ggacagggagagaaaauacc

SEQ ID NO: 21326 - RNA, 23 nt, Homo sapiens
uuuuggucugugaugcuuggucu

SEQ ID NO: 21327 - RNA, 18 nt, Homo sapiens
agcauucgguucuucugu

SEQ ID NO: 21328 - RNA, 20 nt, Homo sapiens
cuguuggaaauuccagggua

SEQ ID NO: 21329 - RNA, 16 nt, Homo sapiens
ggcccgcccgccccuc

SEQ ID NO: 21330 - RNA, 16 nt, Homo sapiens
gguucuucugucaauc

SEQ ID NO: 21331 - RNA, 18 nt, Homo sapiens
cuccugcuguaguccuuu

SEQ ID NO: 21332 - RNA, 19 nt, Homo sapiens
gccugcugagagagggucg

SEQ ID NO: 21333 - RNA, 20 nt, Homo sapiens
ucuccagccgaagcugcagg

SEQ ID NO: 21334 - RNA, 22 nt, Homo sapiens
ugccuuggccucggcgggcuuu

SEQ ID NO: 21335 - RNA, 19 nt, Homo sapiens
cuggcgggcuccuuugaua

SEQ ID NO: 21336 - RNA, 22 nt, Homo sapiens
gccuucuucugcugccugguuu

SEQ ID NO: 21337 - RNA, 17 nt, Homo sapiens
aagucaucaaguaaaca

SEQ ID NO: 21338 - RNA, 20 nt, Homo sapiens
aggaaagagaguuacaccuu

SEQ ID NO: 21339 - RNA, 23 nt, Homo sapiens
caccacagcaucugccccugcua

SEQ ID NO: 21340 - RNA, 21 nt, Homo sapiens
guagcuuuaaugauuuuuguu

SEQ ID NO: 21341 - RNA, 23 nt, Homo sapiens
guucagcauguuugcacuuguua

SEQ ID NO: 21342 - RNA, 22 nt, Homo sapiens
acguauucccauugcagguguu

SEQ ID NO: 21343 - RNA, 22 nt, Homo sapiens
cucaacaucaaaugcucugaug

SEQ ID NO: 21344 - RNA, 20 nt, Homo sapiens
aaagaaugacuguuuugguu

SEQ ID NO: 21345 - RNA, 21 nt, Homo sapiens
agccaaggagcagcauauagu

SEQ ID NO: 21346 - RNA, 24 nt, Homo sapiens
agccccacaauguuaaauucugua

SEQ ID NO: 21347 - RNA, 20 nt, Homo sapiens
cccacaauguuaaauucugu

SEQ ID NO: 21348 - RNA, 18 nt, Homo sapiens
gacacuuaauaugaaauu

SEQ ID NO: 21349 - RNA, 18 nt, Homo sapiens
ucuggaaaaagacuccga

SEQ ID NO: 21350 - RNA, 18 nt, Homo sapiens
acauuuagauacuucaua

SEQ ID NO: 21351 - RNA, 22 nt, Homo sapiens
agaagcugcugugaggagcuca

SEQ ID NO: 21352 - RNA, 25 nt, Homo sapiens
cuucaguguuaguuuucuuaauuuu

SEQ ID NO: 21353 - RNA, 25 nt, Homo sapiens
ucuguagcuuuuccagguuuuuuuu

SEQ ID NO: 21354 - RNA, 20 nt, Homo sapiens
augucauuguaaugauuuca

SEQ ID NO: 21355 - RNA, 20 nt, Homo sapiens
cauuuuuaucaaauguguga

SEQ ID NO: 21356 - RNA, 19 nt, Homo sapiens
ccggcgucugcugccauga

SEQ ID NO: 21357 - RNA, 21 nt, Homo sapiens
cuguagaagggggacaugcca

SEQ ID NO: 21358 - RNA, 20 nt, Homo sapiens
gccauuuagggggacgcugc

SEQ ID NO: 21359 - RNA, 22 nt, Homo sapiens
gccugagcugucugucucguuu

SEQ ID NO: 21360 - RNA, 20 nt, Homo sapiens
gugugaacgauacuuggcua

SEQ ID NO: 21361 - RNA, 18 nt, Homo sapiens
uacaaagaaauuucccuc

SEQ ID NO: 21362 - RNA, 16 nt, Homo sapiens
cuuguucuaccuauca

SEQ ID NO: 21363 - RNA, 26 nt, Homo sapiens
uaaaugagaucauuaacgugaaacua

SEQ ID NO: 21364 - RNA, 21 nt, Homo sapiens
ccuagcgacugacaacaggcu

SEQ ID NO: 21365 - RNA, 18 nt, Homo sapiens
gcguggagagccuucgcg

SEQ ID NO: 21366 - RNA, 19 nt, Homo sapiens
uuuuugccuagcgacugac

SEQ ID NO: 21367 - RNA, 17 nt, Homo sapiens
uucaguugaauaacuug

SEQ ID NO: 21368 - RNA, 18 nt, Homo sapiens
cacaaaaauggucuuucu

SEQ ID NO: 21369 - RNA, 18 nt, Homo sapiens
ccugcaaccuccaccucc

SEQ ID NO: 21370 - RNA, 21 nt, Homo sapiens
cgacagaaagaagucucuucu

SEQ ID NO: 21371 - RNA, 20 nt, Homo sapiens
gcacaaugcaucccauccca

SEQ ID NO: 21372 - RNA, 21 nt, Homo sapiens
guucuuuguaaauaaaacagg

SEQ ID NO: 21373 - RNA, 18 nt, Homo sapiens
uacaaccugauggcauua

SEQ ID NO: 21374 - RNA, 17 nt, Homo sapiens
ucaagugauucuugugc

SEQ ID NO: 21375 - RNA, 18 nt, Homo sapiens
uccaccuccuggguucaa

SEQ ID NO: 21376 - RNA, 20 nt, Homo sapiens
ucuaggagucucuugaugag

SEQ ID NO: 21377 - RNA, 18 nt, Homo sapiens
gugggcaaaagaagaucu

SEQ ID NO: 21378 - RNA, 18 nt, Homo sapiens
ucuguccggaguugugua

SEQ ID NO: 21379 - RNA, 20 nt, Homo sapiens
aaaacaaccaagacaaagaa

SEQ ID NO: 21380 - RNA, 18 nt, Homo sapiens
accauguaauaaaugaac

SEQ ID NO: 21381 - RNA, 22 nt, Homo sapiens
agagcugcagccagcucugccc

SEQ ID NO: 21382 - RNA, 26 nt, Homo sapiens
cgaaccagaagcacugagauuaaccu

SEQ ID NO: 21383 - RNA, 21 nt, Homo sapiens
uaaauggauuuaggaagacug

SEQ ID NO: 21384 - RNA, 16 nt, Homo sapiens
aacccaagacugccug

SEQ ID NO: 21385 - RNA, 18 nt, Homo sapiens
uuuccacuauccuaacug

SEQ ID NO: 21386 - RNA, 22 nt, Homo sapiens
aagaaauugcaaggacuuuuuu

SEQ ID NO: 21387 - RNA, 20 nt, Homo sapiens
aggucccaggucuucccucu

SEQ ID NO: 21388 - RNA, 19 nt, Homo sapiens
ccaugcuaagucuaacacu

SEQ ID NO: 21389 - RNA, 21 nt, Homo sapiens
ccccacccucugcccuucagc

SEQ ID NO: 21390 - RNA, 19 nt, Homo sapiens
cuugacagcccaggucccu

SEQ ID NO: 21391 - RNA, 18 nt, Homo sapiens
ggacuugccugccuccuc

SEQ ID NO: 21392 - RNA, 20 nt, Homo sapiens
uugauauuugcacagggaua

SEQ ID NO: 21393 - RNA, 19 nt, Homo sapiens
aagaaaaaaaggacagaca

SEQ ID NO: 21394 - RNA, 18 nt, Homo sapiens
acauuguauauauaucac

SEQ ID NO: 21395 - RNA, 23 nt, Homo sapiens
acuugccgcggacugccugggcu

SEQ ID NO: 21396 - RNA, 16 nt, Homo sapiens
ccccaagccucauuca

SEQ ID NO: 21397 - RNA, 15 nt, Homo sapiens
uccuggaucuuccca

SEQ ID NO: 21398 - RNA, 18 nt, Homo sapiens
ccaaaaggucacauucag

SEQ ID NO: 21399 - RNA, 23 nt, Homo sapiens
ccuuuuugugccuuucuugaccu

SEQ ID NO: 21400 - RNA, 19 nt, Homo sapiens
ucaccuaugccugaaagca

SEQ ID NO: 21401 - RNA, 18 nt, Homo sapiens
acaugugaugucuggucu

SEQ ID NO: 21402 - RNA, 21 nt, Homo sapiens
agcaguugagcaaacaccaac

SEQ ID NO: 21403 - RNA, 22 nt, Homo sapiens
aggcugggcgcaucccaagaca

SEQ ID NO: 21404 - RNA, 21 nt, Homo sapiens
aguuuugaaguucuagccacu

SEQ ID NO: 21405 - RNA, 21 nt, Homo sapiens
caagcuaagagagcuugcaaa

SEQ ID NO: 21406 - RNA, 19 nt, Homo sapiens
gcucgaugacuugucucug

SEQ ID NO: 21407 - RNA, 21 nt, Homo sapiens
gggcuuucucuagccuuguca

SEQ ID NO: 21408 - RNA, 16 nt, Homo sapiens
uuucccaaaaaugaaa

SEQ ID NO: 21409 - RNA, 19 nt, Homo sapiens
aaaaaauuacccaggcacu

SEQ ID NO: 21410 - RNA, 18 nt, Homo sapiens
aaauaccauguuugaaga

SEQ ID NO: 21411 - RNA, 25 nt, Homo sapiens
aauaaccaaagcaaauguuuccuuc

SEQ ID NO: 21412 - RNA, 17 nt, Homo sapiens
cacacauuaaauucagu

SEQ ID NO: 21413 - RNA, 21 nt, Homo sapiens
cuuacauauuguuuuggcuuu

SEQ ID NO: 21414 - RNA, 22 nt, Homo sapiens
gagccaagaucgcgccacugca

SEQ ID NO: 21415 - RNA, 19 nt, Homo sapiens
gcgccuacgggcugcggug

SEQ ID NO: 21416 - RNA, 22 nt, Homo sapiens
gcuuuccaagggaggucuagga

SEQ ID NO: 21417 - RNA, 23 nt, Homo sapiens
uccaguuucagaucaugcugcca

SEQ ID NO: 21418 - RNA, 18 nt, Homo sapiens
ucugauuccaggcacucu

SEQ ID NO: 21419 - RNA, 20 nt, Homo sapiens
ugggauauuuaugcucaguu

SEQ ID NO: 21420 - RNA, 21 nt, Homo sapiens
uggggcagcccucagacuuca

SEQ ID NO: 21421 - RNA, 23 nt, Homo sapiens
ugucuuuuauacaauuuuuagcu

SEQ ID NO: 21422 - RNA, 17 nt, Homo sapiens
auggguucucaacugua

SEQ ID NO: 21423 - RNA, 19 nt, Homo sapiens
cauugaucaucccuucuca

SEQ ID NO: 21424 - RNA, 20 nt, Homo sapiens
ccauugaucaucccuucuca

SEQ ID NO: 21425 - RNA, 20 nt, Homo sapiens
cugcuguacccagaaaucua

SEQ ID NO: 21426 - RNA, 19 nt, Homo sapiens
cuugcucccaaguccuuuu

SEQ ID NO: 21427 - RNA, 22 nt, Homo sapiens
ucuggguucuuccuuuugguuc

SEQ ID NO: 21428 - RNA, 18 nt, Homo sapiens
ugcaaaacuccaggcuuc

SEQ ID NO: 21429 - RNA, 18 nt, Homo sapiens
ugggugcagcaggagcug

SEQ ID NO: 21430 - RNA, 20 nt, Homo sapiens
cugauaccacgaaccaguga

SEQ ID NO: 21431 - RNA, 21 nt, Homo sapiens
aucaauauguaaauaugugau

SEQ ID NO: 21432 - RNA, 21 nt, Homo sapiens
augaaguuguuuguauacaua

SEQ ID NO: 21433 - RNA, 21 nt, Homo sapiens
ugugucaagaaaucuuggcaa

SEQ ID NO: 21434 - RNA, 19 nt, Homo sapiens
uuccagagcacgucuccag

SEQ ID NO: 21435 - RNA, 20 nt, Homo sapiens
ucuugauuggagcuuccggu

SEQ ID NO: 21436 - RNA, 20 nt, Homo sapiens
aggcagcaggcaccaagcug

SEQ ID NO: 21437 - RNA, 20 nt, Homo sapiens
aaaguggcucugacuuuccc

SEQ ID NO: 21438 - RNA, 21 nt, Homo sapiens
accauucccauucguucuauu

SEQ ID NO: 21439 - RNA, 17 nt, Homo sapiens
accugggacguuggccg

SEQ ID NO: 21440 - RNA, 21 nt, Homo sapiens
acuccauuuugaucuguacua

SEQ ID NO: 21441 - RNA, 22 nt, Homo sapiens
caagaucaugccacuccacucc

SEQ ID NO: 21442 - RNA, 22 nt, Homo sapiens
cagggccaccugggaucaguca

SEQ ID NO: 21443 - RNA, 18 nt, Homo sapiens
cauuucucaagaauccuc

SEQ ID NO: 21444 - RNA, 20 nt, Homo sapiens
ccauucguucuauucugaga

SEQ ID NO: 21445 - RNA, 22 nt, Homo sapiens
gagccaagaucaugccacucca

SEQ ID NO: 21446 - RNA, 20 nt, Homo sapiens
ggcacacucaauggcaaaca

SEQ ID NO: 21447 - RNA, 17 nt, Homo sapiens
ggcuucccagccgcuca

SEQ ID NO: 21448 - RNA, 23 nt, Homo sapiens
uggaaugucucgguguaaagcug

SEQ ID NO: 21449 - RNA, 18 nt, Homo sapiens
uggguggaucacuugagg

SEQ ID NO: 21450 - RNA, 16 nt, Homo sapiens
cccaagaacuacucca

SEQ ID NO: 21451 - RNA, 23 nt, Homo sapiens
cucguaccaccccuguuacccca

SEQ ID NO: 21452 - RNA, 22 nt, Homo sapiens
cuggucaaugcauccuacacca

SEQ ID NO: 21453 - RNA, 16 nt, Homo sapiens
gaggauggucaggugg

SEQ ID NO: 21454 - RNA, 18 nt, Homo sapiens
guggaucaucucuagcaa

SEQ ID NO: 21455 - RNA, 24 nt, Homo sapiens
uuugugggaaucuguuccucacca

SEQ ID NO: 21456 - RNA, 17 nt, Homo sapiens
gacuuguuaccaccgca

SEQ ID NO: 21457 - RNA, 20 nt, Homo sapiens
acuauucuuggaguccuuug

SEQ ID NO: 21458 - RNA, 21 nt, Homo sapiens
auggacgccauaaauucugaa

SEQ ID NO: 21459 - RNA, 19 nt, Homo sapiens
cccacccuggcccacucca

SEQ ID NO: 21460 - RNA, 20 nt, Homo sapiens
ggcccagggaguucugcuca

SEQ ID NO: 21461 - RNA, 19 nt, Homo sapiens
uauuucugaccuuuuucca

SEQ ID NO: 21462 - RNA, 17 nt, Homo sapiens
ucacuuuguuagcguug

SEQ ID NO: 21463 - RNA, 20 nt, Homo sapiens
ugcgaucacugacuucucua

SEQ ID NO: 21464 - RNA, 20 nt, Homo sapiens
uggaugggaguguggggcug

SEQ ID NO: 21465 - RNA, 25 nt, Homo sapiens
uuuugaggaagagggaaagugacaa

SEQ ID NO: 21466 - RNA, 22 nt, Homo sapiens
caggcuauguauuaucuccuuu

SEQ ID NO: 21467 - RNA, 21 nt, Homo sapiens
gugaaaguuuggucagucuca

SEQ ID NO: 21468 - RNA, 22 nt, Homo sapiens
uauuaacaguuaaucccauaac

SEQ ID NO: 21469 - RNA, 20 nt, Homo sapiens
ugacccuggcuugugcuagu

SEQ ID NO: 21470 - RNA, 23 nt, Homo sapiens
ugagucuuuaggccaguaugcua

SEQ ID NO: 21471 - RNA, 24 nt, Homo sapiens
aacagagcagccgggaagcuccaa

SEQ ID NO: 21472 - RNA, 24 nt, Homo sapiens
accgcucaacuacauggaaacuga

SEQ ID NO: 21473 - RNA, 21 nt, Homo sapiens
auguugagaauccacauauga

SEQ ID NO: 21474 - RNA, 21 nt, Homo sapiens
ccuaauauuuguaacuacaca

SEQ ID NO: 21475 - RNA, 24 nt, Homo sapiens
cugcaugaacuaaugagcaaaaua

SEQ ID NO: 21476 - RNA, 17 nt, Homo sapiens
cuuuuucauuccccuuu

SEQ ID NO: 21477 - RNA, 22 nt, Homo sapiens
cuuuuucauuccccuuuaccuu

SEQ ID NO: 21478 - RNA, 18 nt, Homo sapiens
gaccaucgagacuaggaa

SEQ ID NO: 21479 - RNA, 15 nt, Homo sapiens
gguggauauacauca

SEQ ID NO: 21480 - RNA, 16 nt, Homo sapiens
uccagaucaucuccca

SEQ ID NO: 21481 - RNA, 23 nt, Homo sapiens
ugagaucaaacugcaagguggca

SEQ ID NO: 21482 - RNA, 21 nt, Homo sapiens
ccaggcaccccucuuuuuacu

SEQ ID NO: 21483 - RNA, 19 nt, Homo sapiens
cccagccccgcccucccca

SEQ ID NO: 21484 - RNA, 20 nt, Homo sapiens
cccccaaccucuggcuccca

SEQ ID NO: 21485 - RNA, 20 nt, Homo sapiens
uaaggucgugauaaaguguu

SEQ ID NO: 21486 - RNA, 19 nt, Homo sapiens
uuagaaccaccgccccucu

SEQ ID NO: 21487 - RNA, 22 nt, Homo sapiens
uuuuuacucaaaggcacugacu

SEQ ID NO: 21488 - RNA, 20 nt, Homo sapiens
aaaauaacacuacaguuucc

SEQ ID NO: 21489 - RNA, 18 nt, Homo sapiens
aauaggcaaaaggaaaca

SEQ ID NO: 21490 - RNA, 16 nt, Homo sapiens
ccaacaccucuugaca

SEQ ID NO: 21491 - RNA, 18 nt, Homo sapiens
ccgcaccccucucccuuu

SEQ ID NO: 21492 - RNA, 21 nt, Homo sapiens
uugguaguguuggcgcuccug

SEQ ID NO: 21493 - RNA, 20 nt, Homo sapiens
accacacacuugcacacccc

SEQ ID NO: 21494 - RNA, 20 nt, Homo sapiens
aaugaagccagcucuuccuc

SEQ ID NO: 21495 - RNA, 18 nt, Homo sapiens
acucuaaaacuaauuugu

SEQ ID NO: 21496 - RNA, 18 nt, Homo sapiens
cacagaugcugguccuca

SEQ ID NO: 21497 - RNA, 19 nt, Homo sapiens
ggagaaggggcauuuugug

SEQ ID NO: 21498 - RNA, 20 nt, Homo sapiens
uauucugcacauucauucca

SEQ ID NO: 21499 - RNA, 23 nt, Homo sapiens
ucaaaaaugaagccagcucuucc

SEQ ID NO: 21500 - RNA, 24 nt, Homo sapiens
uuuuauggcaguuguuuuaaguuu

SEQ ID NO: 21501 - RNA, 21 nt, Homo sapiens
gcuucacacugcucugccucu

SEQ ID NO: 21502 - RNA, 19 nt, Homo sapiens
gaaaagguggugauugcca

SEQ ID NO: 21503 - RNA, 19 nt, Homo sapiens
gauucagccaagaacagcu

SEQ ID NO: 21504 - RNA, 21 nt, Homo sapiens
auguggagcaguguacaguga

SEQ ID NO: 21505 - RNA, 19 nt, Homo sapiens
acaaaacagagcaagaguu

SEQ ID NO: 21506 - RNA, 18 nt, Homo sapiens
uguguuggcacaugccug

SEQ ID NO: 21507 - RNA, 19 nt, Homo sapiens
aaucgccuccauuugagaa

SEQ ID NO: 21508 - RNA, 19 nt, Homo sapiens
acucaucuuaagcccgagc

SEQ ID NO: 21509 - RNA, 16 nt, Homo sapiens
aucuuaagcccgagca

SEQ ID NO: 21510 - RNA, 15 nt, Homo sapiens
caaccaaaaaugucu

SEQ ID NO: 21511 - RNA, 19 nt, Homo sapiens
gcuccugccugcucugaga

SEQ ID NO: 21512 - RNA, 21 nt, Homo sapiens
ggaaacauccuguuuuauuau

SEQ ID NO: 21513 - RNA, 17 nt, Homo sapiens
ggcugaagagucugcuu

SEQ ID NO: 21514 - RNA, 19 nt, Homo sapiens
guugcucuaaaauaccuca

SEQ ID NO: 21515 - RNA, 25 nt, Homo sapiens
uaaaugggguaggugggugagauua

SEQ ID NO: 21516 - RNA, 17 nt, Homo sapiens
ucccugcccuucuccuc

SEQ ID NO: 21517 - RNA, 20 nt, Homo sapiens
uuuuggcuguuagaccugug

SEQ ID NO: 21518 - RNA, 21 nt, Homo sapiens
aaaagaaacaaaaucuugcca

SEQ ID NO: 21519 - RNA, 17 nt, Homo sapiens
aacacugggaccacugu

SEQ ID NO: 21520 - RNA, 20 nt, Homo sapiens
aagaauucagcaauguuauc

SEQ ID NO: 21521 - RNA, 22 nt, Homo sapiens
acagccucaucauuccacuuuu

SEQ ID NO: 21522 - RNA, 16 nt, Homo sapiens
auccuuauuugccuuu

SEQ ID NO: 21523 - RNA, 21 nt, Homo sapiens
ccuaaauuuaaaagcagucca

SEQ ID NO: 21524 - RNA, 21 nt, Homo sapiens
ccucccccaaaggcgcuuucc

SEQ ID NO: 21525 - RNA, 18 nt, Homo sapiens
ccuuugucucuggaauca

SEQ ID NO: 21526 - RNA, 19 nt, Homo sapiens
cguggcucuguuuugucag

SEQ ID NO: 21527 - RNA, 21 nt, Homo sapiens
cuaaaauuuggacucuugucu

SEQ ID NO: 21528 - RNA, 19 nt, Homo sapiens
cucuacucucucugccccu

SEQ ID NO: 21529 - RNA, 20 nt, Homo sapiens
gauaccauguucuaugccuu

SEQ ID NO: 21530 - RNA, 20 nt, Homo sapiens
ggaaacagcuuggcuguggu

SEQ ID NO: 21531 - RNA, 19 nt, Homo sapiens
gggacacagggccaagcuu

SEQ ID NO: 21532 - RNA, 19 nt, Homo sapiens
gguaaagaagaaacugcac

SEQ ID NO: 21533 - RNA, 20 nt, Homo sapiens
gugugccuguaucauuuggc

SEQ ID NO: 21534 - RNA, 16 nt, Homo sapiens
uccagaaagaauucag

SEQ ID NO: 21535 - RNA, 22 nt, Homo sapiens
ucccauucuaaaaguguggaca

SEQ ID NO: 21536 - RNA, 19 nt, Homo sapiens
ugaaguuguaagaguuguc

SEQ ID NO: 21537 - RNA, 20 nt, Homo sapiens
uggccaggcuggucuugaac

SEQ ID NO: 21538 - RNA, 21 nt, Homo sapiens
uuugagauauaaagacccuga

SEQ ID NO: 21539 - RNA, 17 nt, Homo sapiens
uuuucacuaugcauuca

SEQ ID NO: 21540 - RNA, 20 nt, Homo sapiens
acagcgagggcccagcuccu

SEQ ID NO: 21541 - RNA, 18 nt, Homo sapiens
ggcacucaagcugggcca

SEQ ID NO: 21542 - RNA, 22 nt, Homo sapiens
aucguuuguuuaugaaaugcca

SEQ ID NO: 21543 - RNA, 19 nt, Homo sapiens
ccuggcagggaccugagag

SEQ ID NO: 21544 - RNA, 19 nt, Homo sapiens
guaggugguucgugcugug

SEQ ID NO: 21545 - RNA, 16 nt, Homo sapiens
guccuccaccaugcac

SEQ ID NO: 21546 - RNA, 17 nt, Homo sapiens
gugagcacacccgugug

SEQ ID NO: 21547 - RNA, 18 nt, Homo sapiens
guguuugauuggcuuucg

SEQ ID NO: 21548 - RNA, 20 nt, Homo sapiens
cacagcaagacuccgucuaa

SEQ ID NO: 21549 - RNA, 19 nt, Homo sapiens
ccuaggugcugccuggccc

SEQ ID NO: 21550 - RNA, 27 nt, Homo sapiens
cggcgcgcgcacaccccagugcugcug

SEQ ID NO: 21551 - RNA, 19 nt, Homo sapiens
cucucccucuucaggucuc

SEQ ID NO: 21552 - RNA, 20 nt, Homo sapiens
cucucccucuucaggucuca

SEQ ID NO: 21553 - RNA, 19 nt, Homo sapiens
gccaccucccucucccucu

SEQ ID NO: 21554 - RNA, 19 nt, Homo sapiens
ggccccugugucauaguca

SEQ ID NO: 21555 - RNA, 17 nt, Homo sapiens
ugaucugcuccagauga

SEQ ID NO: 21556 - RNA, 21 nt, Homo sapiens
ugcacauuucccaggacugcc

SEQ ID NO: 21557 - RNA, 20 nt, Homo sapiens
cuaaagguucccucuccacc

SEQ ID NO: 21558 - RNA, 21 nt, Homo sapiens
accugugggagcgccuggccc

SEQ ID NO: 21559 - RNA, 22 nt, Homo sapiens
cccagcacagccaccugccaga

SEQ ID NO: 21560 - RNA, 18 nt, Homo sapiens
cccuccccgucccugucc

SEQ ID NO: 21561 - RNA, 21 nt, Homo sapiens
ccucaucauccacccgcugcc

SEQ ID NO: 21562 - RNA, 25 nt, Homo sapiens
ccucugggcagccugcuuuggccuu

SEQ ID NO: 21563 - RNA, 19 nt, Homo sapiens
cuccagccccuuugccucu

SEQ ID NO: 21564 - RNA, 17 nt, Homo sapiens
gacagggagggggaccu

SEQ ID NO: 21565 - RNA, 19 nt, Homo sapiens
gccacugccaagcuuccug

SEQ ID NO: 21566 - RNA, 18 nt, Homo sapiens
ggagcauagaagccacau

SEQ ID NO: 21567 - RNA, 22 nt, Homo sapiens
ucugccucugggcagccugcuu

SEQ ID NO: 21568 - RNA, 24 nt, Homo sapiens
ugagugggcccugcccggggagcu

SEQ ID NO: 21569 - RNA, 17 nt, Homo sapiens
uccccaaccacauuuga

SEQ ID NO: 21570 - RNA, 18 nt, Homo sapiens
uugucuuucagaguuguu

SEQ ID NO: 21571 - RNA, 22 nt, Homo sapiens
auuugcaucaugccgacuggag

SEQ ID NO: 21572 - RNA, 25 nt, Homo sapiens
cuucuuccacguccuccuccuccuc

SEQ ID NO: 21573 - RNA, 17 nt, Homo sapiens
uguuugcagccacugcu

SEQ ID NO: 21574 - RNA, 17 nt, Homo sapiens
aagugauagugacccag

SEQ ID NO: 21575 - RNA, 21 nt, Homo sapiens
ccccuccccacucccugaucc

SEQ ID NO: 21576 - RNA, 20 nt, Homo sapiens
gcucgaaggggggcuuucgu

SEQ ID NO: 21577 - RNA, 24 nt, Homo sapiens
gcuucuagagcucucucugccccu

SEQ ID NO: 21578 - RNA, 18 nt, Homo sapiens
ggacccaucaggacccca

SEQ ID NO: 21579 - RNA, 22 nt, Homo sapiens
uaaguaauagugacccuuucac

SEQ ID NO: 21580 - RNA, 18 nt, Homo sapiens
ggcuaaagccgcagguga

SEQ ID NO: 21581 - RNA, 20 nt, Homo sapiens
uccugaguugaggcuugcgg

SEQ ID NO: 21582 - RNA, 22 nt, Homo sapiens
ccuacaaaugauuucagaucau

SEQ ID NO: 21583 - RNA, 23 nt, Homo sapiens
uaaauggauuuuuaagugaaauu

SEQ ID NO: 21584 - RNA, 22 nt, Homo sapiens
ccuacaaaugauuucagaucau

SEQ ID NO: 21585 - RNA, 23 nt, Homo sapiens
uaaauggauuuuuaagugaaauu

SEQ ID NO: 21586 - RNA, 18 nt, Homo sapiens
aacggggaguagcaguag

SEQ ID NO: 21587 - RNA, 22 nt, Homo sapiens
ccuacaaaugauuucagaucau

SEQ ID NO: 21588 - RNA, 23 nt, Homo sapiens
uaaauggauuuuuaagugaaauu

SEQ ID NO: 21589 - RNA, 22 nt, Homo sapiens
ccuacaaaugauuucagaucau

SEQ ID NO: 21590 - RNA, 21 nt, Homo sapiens
ccugaggcagguaaauggggc

SEQ ID NO: 21591 - RNA, 23 nt, Homo sapiens
uaaauggauuuuuaagugaaauu

SEQ ID NO: 21592 - RNA, 21 nt, Homo sapiens
uaagaaccuucuauucacauc

SEQ ID NO: 21593 - RNA, 19 nt, Homo sapiens
aaacacuuauuucugugaa

SEQ ID NO: 21594 - RNA, 18 nt, Homo sapiens
acaaaaguuaagaagcca

SEQ ID NO: 21595 - RNA, 16 nt, Homo sapiens
acacuuauuucuguga

SEQ ID NO: 21596 - RNA, 22 nt, Homo sapiens
cucaucacuauuuacuaaagca

SEQ ID NO: 21597 - RNA, 22 nt, Homo sapiens
ucauuuccauucaagucaucca

SEQ ID NO: 21598 - RNA, 20 nt, Homo sapiens
cuauacccuuuagcaaaaua

SEQ ID NO: 21599 - RNA, 25 nt, Homo sapiens
cugucuacuaagagacaucauucca

SEQ ID NO: 21600 - RNA, 23 nt, Homo sapiens
gaugagagaagggagagaauaaa

SEQ ID NO: 21601 - RNA, 16 nt, Homo sapiens
gucucuccauauuuag

SEQ ID NO: 21602 - RNA, 16 nt, Homo sapiens
aacuugggguccauca

SEQ ID NO: 21603 - RNA, 20 nt, Homo sapiens
agaaaagaaaagcaaccaca

SEQ ID NO: 21604 - RNA, 19 nt, Homo sapiens
aguauuguacaaccaacac

SEQ ID NO: 21605 - RNA, 17 nt, Homo sapiens
caccugaggccaccagg

SEQ ID NO: 21606 - RNA, 19 nt, Homo sapiens
caucugcuucccccaaggc

SEQ ID NO: 21607 - RNA, 18 nt, Homo sapiens
ccagcugaccacuggccc

SEQ ID NO: 21608 - RNA, 18 nt, Homo sapiens
gcagucuucaaucgauca

SEQ ID NO: 21609 - RNA, 19 nt, Homo sapiens
ggcggguggaucacuugaa

SEQ ID NO: 21610 - RNA, 18 nt, Homo sapiens
guggucuuuucaaauguc

SEQ ID NO: 21611 - RNA, 19 nt, Homo sapiens
ugccuucccuuccaucucu

SEQ ID NO: 21612 - RNA, 21 nt, Homo sapiens
uucagguuaaaaaaaaaguuu

SEQ ID NO: 21613 - RNA, 22 nt, Homo sapiens
uucuuuggguccccugaugcca

SEQ ID NO: 21614 - RNA, 20 nt, Homo sapiens
uugcccagcugaccacuggc

SEQ ID NO: 21615 - RNA, 21 nt, Homo sapiens
acauugggaauauaagacaau

SEQ ID NO: 21616 - RNA, 18 nt, Homo sapiens
agugaauuacccagagug

SEQ ID NO: 21617 - RNA, 17 nt, Homo sapiens
ucuacacagguugccaa

SEQ ID NO: 21618 - RNA, 19 nt, Homo sapiens
ugucaaacaagagagauga

SEQ ID NO: 21619 - RNA, 19 nt, Homo sapiens
aacccaguaaacauauaca

SEQ ID NO: 21620 - RNA, 20 nt, Homo sapiens
aauaggaguucauccugaaa

SEQ ID NO: 21621 - RNA, 20 nt, Homo sapiens
caccuuuguaucucauuuga

SEQ ID NO: 21622 - RNA, 20 nt, Homo sapiens
uuuguuggcauaaaauaacc

SEQ ID NO: 21623 - RNA, 27 nt, Homo sapiens
gccuggauugucugauuuuaggucacu

SEQ ID NO: 21624 - RNA, 22 nt, Homo sapiens
aaaauaagaagaugcacuuucu

SEQ ID NO: 21625 - RNA, 19 nt, Homo sapiens
auaacuccagagaagcagc

SEQ ID NO: 21626 - RNA, 24 nt, Homo sapiens
cauagucacagacaaaagcauaca

SEQ ID NO: 21627 - RNA, 23 nt, Homo sapiens
ccaaaaaaaaaauuaacauugua

SEQ ID NO: 21628 - RNA, 18 nt, Homo sapiens
gcagcuucagacuguuuu

SEQ ID NO: 21629 - RNA, 19 nt, Homo sapiens
ggaacaguuuccuuuuuua

SEQ ID NO: 21630 - RNA, 22 nt, Homo sapiens
augugaaaccacagauauuuca

SEQ ID NO: 21631 - RNA, 18 nt, Homo sapiens
gggaaacaggcugaccac

SEQ ID NO: 21632 - RNA, 22 nt, Homo sapiens
cccuuccagggccucugcucca

SEQ ID NO: 21633 - RNA, 19 nt, Homo sapiens
uuccagggccucugcucca

SEQ ID NO: 21634 - RNA, 24 nt, Homo sapiens
acaccacugggaggguuguguagg

SEQ ID NO: 21635 - RNA, 22 nt, Homo sapiens
augccagaauuuggagauuuga

SEQ ID NO: 21636 - RNA, 18 nt, Homo sapiens
caccacuacccuuguaaa

SEQ ID NO: 21637 - RNA, 28 nt, Homo sapiens
ccaaagcucugaguuccauuuuacagcu

SEQ ID NO: 21638 - RNA, 16 nt, Homo sapiens
ccuaccaauuuccucc

SEQ ID NO: 21639 - RNA, 24 nt, Homo sapiens
gagauauagcaacuaacgacgcua

SEQ ID NO: 21640 - RNA, 24 nt, Homo sapiens
gcuccccuguccucuucaaucccu

SEQ ID NO: 21641 - RNA, 18 nt, Homo sapiens
gcucugaguuccauuuua

SEQ ID NO: 21642 - RNA, 24 nt, Homo sapiens
gcuucuccagcuccccuguccucu

SEQ ID NO: 21643 - RNA, 21 nt, Homo sapiens
acucucaggguuggcaacccu

SEQ ID NO: 21644 - RNA, 20 nt, Homo sapiens
ccgcagggaugccuugccuu

SEQ ID NO: 21645 - RNA, 21 nt, Homo sapiens
gcccacucacuugccauucca

SEQ ID NO: 21646 - RNA, 22 nt, Homo sapiens
ugcccagggacccccaucccgg

SEQ ID NO: 21647 - RNA, 24 nt, Homo sapiens
acagcaaacagauuuuauuaccua

SEQ ID NO: 21648 - RNA, 17 nt, Homo sapiens
cauuuuuaucagggccc

SEQ ID NO: 21649 - RNA, 22 nt, Homo sapiens
cuggaauuacaggcaccugcca

SEQ ID NO: 21650 - RNA, 23 nt, Homo sapiens
cuguaaguuccuccucugccccu

SEQ ID NO: 21651 - RNA, 22 nt, Homo sapiens
gggauggcgccagggcgguggc

SEQ ID NO: 21652 - RNA, 17 nt, Homo sapiens
ucaagugauucuccugc

SEQ ID NO: 21653 - RNA, 18 nt, Homo sapiens
uccgccuccuggguucaa

SEQ ID NO: 21654 - RNA, 19 nt, Homo sapiens
gacccccugggccagguga

SEQ ID NO: 21655 - RNA, 23 nt, Homo sapiens
gcaacucuggugaaaccuuuuca

SEQ ID NO: 21656 - RNA, 24 nt, Homo sapiens
ggacagaaaaggggcagacacacc

SEQ ID NO: 21657 - RNA, 19 nt, Homo sapiens
uucuccccauagcacgagg

SEQ ID NO: 21658 - RNA, 20 nt, Homo sapiens
gcgaggccaagagagacccc

SEQ ID NO: 21659 - RNA, 18 nt, Homo sapiens
cuuuuggacuuuguauua

SEQ ID NO: 21660 - RNA, 20 nt, Homo sapiens
ggccacaugcaaccauguga

SEQ ID NO: 21661 - RNA, 18 nt, Homo sapiens
guuuugguaaaucucuua

SEQ ID NO: 21662 - RNA, 21 nt, Homo sapiens
uuucucaguuguuuuugcuuu

SEQ ID NO: 21663 - RNA, 20 nt, Homo sapiens
ucuacugauguuuauuagag

SEQ ID NO: 21664 - RNA, 21 nt, Homo sapiens
gaaacacagaagcaauuuuaa

SEQ ID NO: 21665 - RNA, 18 nt, Homo sapiens
aacaguccacguguucuc

SEQ ID NO: 21666 - RNA, 22 nt, Homo sapiens
aauuggcacacucucuuccaca

SEQ ID NO: 21667 - RNA, 26 nt, Homo sapiens
ugaguguauacccaguaaugggauug

SEQ ID NO: 21668 - RNA, 16 nt, Homo sapiens
agcuaugaucauccca

SEQ ID NO: 21669 - RNA, 24 nt, Homo sapiens
aggcaccugccaacuacuugcuuu

SEQ ID NO: 21670 - RNA, 20 nt, Homo sapiens
caccgcaucaccaccccuuc

SEQ ID NO: 21671 - RNA, 18 nt, Homo sapiens
cacuaaagcuaaccauuc

SEQ ID NO: 21672 - RNA, 15 nt, Homo sapiens
ccccugcauaugaca

SEQ ID NO: 21673 - RNA, 20 nt, Homo sapiens
gaaguucugcaaaccucccc

SEQ ID NO: 21674 - RNA, 18 nt, Homo sapiens
ucuuuaggacauuagucc

SEQ ID NO: 21675 - RNA, 21 nt, Homo sapiens
ccacgucuccccugcacccca

SEQ ID NO: 21676 - RNA, 16 nt, Homo sapiens
ugagcccaguacaaca

SEQ ID NO: 21677 - RNA, 25 nt, Homo sapiens
aaggagacuccacccugggguccca

SEQ ID NO: 21678 - RNA, 20 nt, Homo sapiens
acaucacccucacgcugcgg

SEQ ID NO: 21679 - RNA, 18 nt, Homo sapiens
ugcagauuucuugcugcu

SEQ ID NO: 21680 - RNA, 18 nt, Homo sapiens
uccaacucccagguucaa

SEQ ID NO: 21681 - RNA, 20 nt, Homo sapiens
ugacuguuccacauguagua

SEQ ID NO: 21682 - RNA, 21 nt, Homo sapiens
cuuuuuuguugucuuuugacc

SEQ ID NO: 21683 - RNA, 22 nt, Homo sapiens
ugaaccuugagucccccugcuu

SEQ ID NO: 21684 - RNA, 20 nt, Homo sapiens
ugcacuuuaaagugagauua

SEQ ID NO: 21685 - RNA, 17 nt, Homo sapiens
uugcaucccacuccccu

SEQ ID NO: 21686 - RNA, 22 nt, Homo sapiens
accauuguaauaaaagcuguua

SEQ ID NO: 21687 - RNA, 18 nt, Homo sapiens
uuuguuugaacuuucugg

SEQ ID NO: 21688 - RNA, 21 nt, Homo sapiens
auacacuaaauucacaucacc

SEQ ID NO: 21689 - RNA, 22 nt, Homo sapiens
aucuuggcucacugcaaccucu

SEQ ID NO: 21690 - RNA, 21 nt, Homo sapiens
ccauacuauauuaaacacauu

SEQ ID NO: 21691 - RNA, 22 nt, Homo sapiens
ccucuucaugacccugagucuu

SEQ ID NO: 21692 - RNA, 22 nt, Homo sapiens
gcuucucagaccggcaacauca

SEQ ID NO: 21693 - RNA, 19 nt, Homo sapiens
guaacauuuauuuacauaa

SEQ ID NO: 21694 - RNA, 18 nt, Homo sapiens
uccugaccucaugaucca

SEQ ID NO: 21695 - RNA, 20 nt, Homo sapiens
agaaagaguuaacugugcug

SEQ ID NO: 21696 - RNA, 21 nt, Homo sapiens
cagcccacacucugccaccuc

SEQ ID NO: 21697 - RNA, 22 nt, Homo sapiens
cccaucaugggaggcuuuugga

SEQ ID NO: 21698 - RNA, 20 nt, Homo sapiens
cggcccagaaaccagagcca

SEQ ID NO: 21699 - RNA, 19 nt, Homo sapiens
gcccaaggcagcgaggcuu

SEQ ID NO: 21700 - RNA, 23 nt, Homo sapiens
ucugucucauagcacaugugaca

SEQ ID NO: 21701 - RNA, 20 nt, Homo sapiens
uggacaacagccacaagggg

SEQ ID NO: 21702 - RNA, 22 nt, Homo sapiens
agagcaaaggaaaaacacauca

SEQ ID NO: 21703 - RNA, 18 nt, Homo sapiens
uagguggaucacuugagg

SEQ ID NO: 21704 - RNA, 17 nt, Homo sapiens
uguuuauggaugucuca

SEQ ID NO: 21705 - RNA, 21 nt, Homo sapiens
agaacaaaggcagcuacguca

SEQ ID NO: 21706 - RNA, 20 nt, Homo sapiens
cggagcggccgaagcucagc

SEQ ID NO: 21707 - RNA, 18 nt, Homo sapiens
cggggugcugaucugccu

SEQ ID NO: 21708 - RNA, 17 nt, Homo sapiens
gagaacauuuaagccac

SEQ ID NO: 21709 - RNA, 20 nt, Homo sapiens
gagauaucugaaaccaggua

SEQ ID NO: 21710 - RNA, 20 nt, Homo sapiens
gcagccaguugugguuuaca

SEQ ID NO: 21711 - RNA, 24 nt, Homo sapiens
guaagauuuuaaacauuuguaaua

SEQ ID NO: 21712 - RNA, 18 nt, Homo sapiens
uaugaacuguuuuauauc

SEQ ID NO: 21713 - RNA, 19 nt, Homo sapiens
ugcuaccucuauaucauuc

SEQ ID NO: 21714 - RNA, 21 nt, Homo sapiens
ugggggguuuuuguuuuuuua

SEQ ID NO: 21715 - RNA, 17 nt, Homo sapiens
gagaacauuuaagccac

SEQ ID NO: 21716 - RNA, 20 nt, Homo sapiens
gagauaucugaaaccaggua

SEQ ID NO: 21717 - RNA, 20 nt, Homo sapiens
gcagccaguugugguuuaca

SEQ ID NO: 21718 - RNA, 24 nt, Homo sapiens
guaagauuuuaaacauuuguaaua

SEQ ID NO: 21719 - RNA, 18 nt, Homo sapiens
uaugaacuguuuuauauc

SEQ ID NO: 21720 - RNA, 19 nt, Homo sapiens
ugcuaccucuauaucauuc

SEQ ID NO: 21721 - RNA, 21 nt, Homo sapiens
ugggggguuuuuguuuuuuua

SEQ ID NO: 21722 - RNA, 19 nt, Homo sapiens
auuaagacauuuuuccuga

SEQ ID NO: 21723 - RNA, 24 nt, Homo sapiens
cacuccauacucaaauaugcuuca

SEQ ID NO: 21724 - RNA, 20 nt, Homo sapiens
cugauagauaaucccauugc

SEQ ID NO: 21725 - RNA, 26 nt, Homo sapiens
uauuauuuggguauuuggagauaaua

SEQ ID NO: 21726 - RNA, 23 nt, Homo sapiens
uuuucaugcucagaauuucaggu

SEQ ID NO: 21727 - RNA, 18 nt, Homo sapiens
aacaauaaauacuaugca

SEQ ID NO: 21728 - RNA, 17 nt, Homo sapiens
aaugcugcagucugcac

SEQ ID NO: 21729 - RNA, 23 nt, Homo sapiens
cccuccccaacccacauaccucc

SEQ ID NO: 21730 - RNA, 24 nt, Homo sapiens
cccuccccaacccacauaccucca

SEQ ID NO: 21731 - RNA, 22 nt, Homo sapiens
cccuggccgcggggccugugag

SEQ ID NO: 21732 - RNA, 21 nt, Homo sapiens
accaagagagcaaaccagaga

SEQ ID NO: 21733 - RNA, 21 nt, Homo sapiens
accaagagagcaaaccagaga

SEQ ID NO: 21734 - RNA, 21 nt, Homo sapiens
accaagagagcaaaccagaga

SEQ ID NO: 21735 - RNA, 18 nt, Homo sapiens
augagguuuuucauaccu

SEQ ID NO: 21736 - RNA, 18 nt, Homo sapiens
ccuugcccuuccaacaaa

SEQ ID NO: 21737 - RNA, 22 nt, Homo sapiens
ccuuugcccuugccuugcccuu

SEQ ID NO: 21738 - RNA, 26 nt, Homo sapiens
cuaugcaaaugcaugcaaauacucca

SEQ ID NO: 21739 - RNA, 19 nt, Homo sapiens
ggcccuugagaagcugaua

SEQ ID NO: 21740 - RNA, 21 nt, Homo sapiens
uuuugggguggggucugggga

SEQ ID NO: 21741 - RNA, 24 nt, Homo sapiens
acaggguucccggucaguccggcu

SEQ ID NO: 21742 - RNA, 23 nt, Homo sapiens
accaggcccacccucgucucugc

SEQ ID NO: 21743 - RNA, 20 nt, Homo sapiens
augugggugaugguggauga

SEQ ID NO: 21744 - RNA, 17 nt, Homo sapiens
ccagcaccaggcccacc

SEQ ID NO: 21745 - RNA, 24 nt, Homo sapiens
ccccaccgugugcccccugccagc

SEQ ID NO: 21746 - RNA, 18 nt, Homo sapiens
cgccagguccagcaccca

SEQ ID NO: 21747 - RNA, 21 nt, Homo sapiens
gcccccccuccccauagccag

SEQ ID NO: 21748 - RNA, 19 nt, Homo sapiens
gccuggggccuccacguca

SEQ ID NO: 21749 - RNA, 21 nt, Homo sapiens
uccacggcccaggucuccuca

SEQ ID NO: 21750 - RNA, 23 nt, Homo sapiens
ucugccugggugagcccaccccg

SEQ ID NO: 21751 - RNA, 22 nt, Homo sapiens
cccgcgucacccaccugccaga

SEQ ID NO: 21752 - RNA, 22 nt, Homo sapiens
uugccugagaccccuccucucu

SEQ ID NO: 21753 - RNA, 20 nt, Homo sapiens
acuuauauuuaaaacuugcc

SEQ ID NO: 21754 - RNA, 21 nt, Homo sapiens
cccuggugguggauccuggaa

SEQ ID NO: 21755 - RNA, 17 nt, Homo sapiens
cuggggcaggucacuuu

SEQ ID NO: 21756 - RNA, 21 nt, Homo sapiens
aacagauuuacaucccagaca

SEQ ID NO: 21757 - RNA, 19 nt, Homo sapiens
accaggcagccacugugca

SEQ ID NO: 21758 - RNA, 18 nt, Homo sapiens
agcuauugcuccaugaca

SEQ ID NO: 21759 - RNA, 21 nt, Homo sapiens
auuugaacccaggucucgucu

SEQ ID NO: 21760 - RNA, 21 nt, Homo sapiens
cugauaaaacagauugugaua

SEQ ID NO: 21761 - RNA, 21 nt, Homo sapiens
gacacagaguauuuuaaaaga

SEQ ID NO: 21762 - RNA, 17 nt, Homo sapiens
ucaagugauucuucugc

SEQ ID NO: 21763 - RNA, 20 nt, Homo sapiens
ucuuuuuggacuuuaaucuu

SEQ ID NO: 21764 - RNA, 20 nt, Homo sapiens
uggccaggcuggucuugaac

SEQ ID NO: 21765 - RNA, 19 nt, Homo sapiens
accaggcagccacugugca

SEQ ID NO: 21766 - RNA, 18 nt, Homo sapiens
agcuauugcuccaugaca

SEQ ID NO: 21767 - RNA, 23 nt, Homo sapiens
auuacaaguaauucuuuuccuga

SEQ ID NO: 21768 - RNA, 21 nt, Homo sapiens
auuugaacccaggucucgucu

SEQ ID NO: 21769 - RNA, 21 nt, Homo sapiens
ccaggcaggcauuuuuacagc

SEQ ID NO: 21770 - RNA, 21 nt, Homo sapiens
gacacagaguauuuuaaaaga

SEQ ID NO: 21771 - RNA, 17 nt, Homo sapiens
ucaagugauucuucugc

SEQ ID NO: 21772 - RNA, 20 nt, Homo sapiens
ucuuuuuggacuuuaaucuu

SEQ ID NO: 21773 - RNA, 20 nt, Homo sapiens
uggccaggcuggucuugaac

SEQ ID NO: 21774 - RNA, 23 nt, Homo sapiens
auuacaaguaauucuuuuccuga

SEQ ID NO: 21775 - RNA, 21 nt, Homo sapiens
ccaggcaggcauuuuuacagc

SEQ ID NO: 21776 - RNA, 17 nt, Homo sapiens
gggcaguuaguccuucc

SEQ ID NO: 21777 - RNA, 23 nt, Homo sapiens
ucuggaaucuggauuuuauucca

SEQ ID NO: 21778 - RNA, 17 nt, Homo sapiens
gggcaguuaguccuucc

SEQ ID NO: 21779 - RNA, 23 nt, Homo sapiens
ucuggaaucuggauuuuauucca

SEQ ID NO: 21780 - RNA, 18 nt, Homo sapiens
acguaaaugcagaaguua

SEQ ID NO: 21781 - RNA, 25 nt, Homo sapiens
acagacgagugccuccuuuacguua

SEQ ID NO: 21782 - RNA, 18 nt, Homo sapiens
acguaaaugcagaaguua

SEQ ID NO: 21783 - RNA, 18 nt, Homo sapiens
auccuuucccuuacccac

SEQ ID NO: 21784 - RNA, 21 nt, Homo sapiens
gcaggugccucucagaggcca

SEQ ID NO: 21785 - RNA, 19 nt, Homo sapiens
ggcaggcaggugccucuca

SEQ ID NO: 21786 - RNA, 23 nt, Homo sapiens
gguacugagcagccacuaccccu

SEQ ID NO: 21787 - RNA, 21 nt, Homo sapiens
gugaccaccaacauucugugu

SEQ ID NO: 21788 - RNA, 18 nt, Homo sapiens
ugguguuuggcucuuaua

SEQ ID NO: 21789 - RNA, 18 nt, Homo sapiens
uucccuuacccaccuuca

SEQ ID NO: 21790 - RNA, 20 nt, Homo sapiens
cagccacagccagagggccc

SEQ ID NO: 21791 - RNA, 23 nt, Homo sapiens
ccagaauggccccacucuguucc

SEQ ID NO: 21792 - RNA, 23 nt, Homo sapiens
ccuuccacaggagguccugugag

SEQ ID NO: 21793 - RNA, 22 nt, Homo sapiens
gaucccaaaaggauuuuggugg

SEQ ID NO: 21794 - RNA, 20 nt, Homo sapiens
gcauuaaaugaagccuuacc

SEQ ID NO: 21795 - RNA, 21 nt, Homo sapiens
ucucgcugucucccucugugc

SEQ ID NO: 21796 - RNA, 18 nt, Homo sapiens
uuaucacuuuuaagcaua

SEQ ID NO: 21797 - RNA, 17 nt, Homo sapiens
cccaggcguggaagcau

SEQ ID NO: 21798 - RNA, 21 nt, Homo sapiens
uguccccuccaggugaagcug

SEQ ID NO: 21799 - RNA, 23 nt, Homo sapiens
aaagauuuucaaacaagcauaca

SEQ ID NO: 21800 - RNA, 17 nt, Homo sapiens
ccugucauauuaccaac

SEQ ID NO: 21801 - RNA, 20 nt, Homo sapiens
gcuacagggaauauuuugua

SEQ ID NO: 21802 - RNA, 24 nt, Homo sapiens
guguuuugguuuggggggaauuuu

SEQ ID NO: 21803 - RNA, 21 nt, Homo sapiens
uccugucuugaagauuuugag

SEQ ID NO: 21804 - RNA, 20 nt, Homo sapiens
uguacauagucuguacaaua

SEQ ID NO: 21805 - RNA, 20 nt, Homo sapiens
agucucacucuguugcccag

SEQ ID NO: 21806 - RNA, 18 nt, Homo sapiens
caccauucuccugccuca

SEQ ID NO: 21807 - RNA, 18 nt, Homo sapiens
ugacuagaaagaaacagg

SEQ ID NO: 21808 - RNA, 22 nt, Homo sapiens
cagcuguuucaaacaggugcca

SEQ ID NO: 21809 - RNA, 21 nt, Homo sapiens
aaauuuggaccguuauuuaua

SEQ ID NO: 21810 - RNA, 20 nt, Homo sapiens
acuuaguaaaauaauaggua

SEQ ID NO: 21811 - RNA, 23 nt, Homo sapiens
gcucuuggacacauuuuguauua

SEQ ID NO: 21812 - RNA, 18 nt, Homo sapiens
ggacagggugaaaaugcu

SEQ ID NO: 21813 - RNA, 23 nt, Homo sapiens
agcaugguaacgauggugucaca

SEQ ID NO: 21814 - RNA, 20 nt, Homo sapiens
agucucacucugucgcccag

SEQ ID NO: 21815 - RNA, 20 nt, Homo sapiens
aucuauuuuucucccaugau

SEQ ID NO: 21816 - RNA, 19 nt, Homo sapiens
ccucugccuccagguucaa

SEQ ID NO: 21817 - RNA, 19 nt, Homo sapiens
ggucuaaauguguauguca

SEQ ID NO: 21818 - RNA, 20 nt, Homo sapiens
uggccaggcuggucuugaac

SEQ ID NO: 21819 - RNA, 20 nt, Homo sapiens
uuaaacaguuuuguaaaaua

SEQ ID NO: 21820 - RNA, 20 nt, Homo sapiens
ugugacucuagcaugagacu

SEQ ID NO: 21821 - RNA, 23 nt, Homo sapiens
aacaaaaaauuuuaccugugcaa

SEQ ID NO: 21822 - RNA, 20 nt, Homo sapiens
acagagaagaaaauaacuug

SEQ ID NO: 21823 - RNA, 19 nt, Homo sapiens
uguguugggggguacuuuu

SEQ ID NO: 21824 - RNA, 18 nt, Homo sapiens
uguuuuuuaacaauauua

SEQ ID NO: 21825 - RNA, 21 nt, Homo sapiens
agaugccucagugcuacacca

SEQ ID NO: 21826 - RNA, 18 nt, Homo sapiens
caccagggucgcuccauc

SEQ ID NO: 21827 - RNA, 19 nt, Homo sapiens
gccucagugcuacaccaca

SEQ ID NO: 21828 - RNA, 18 nt, Homo sapiens
cagaaccccauaggcaag

SEQ ID NO: 21829 - RNA, 22 nt, Homo sapiens
cccccccccacuucacccccua

SEQ ID NO: 21830 - RNA, 20 nt, Homo sapiens
gacaucuguaucuccugugg

SEQ ID NO: 21831 - RNA, 24 nt, Homo sapiens
ugagaaaagaauuggguucuguca

SEQ ID NO: 21832 - RNA, 23 nt, Homo sapiens
caggaaugucacacacgaugaaa

SEQ ID NO: 21833 - RNA, 21 nt, Homo sapiens
uccuaaagugucaacguuuuu

SEQ ID NO: 21834 - RNA, 19 nt, Homo sapiens
acuuaauaaaguaauaauc

SEQ ID NO: 21835 - RNA, 22 nt, Homo sapiens
uggauggauaaaaauggaauua

SEQ ID NO: 21836 - RNA, 20 nt, Homo sapiens
uuuuucugacaguauagugu

SEQ ID NO: 21837 - RNA, 20 nt, Homo sapiens
aagcagccaccuuggaccau

SEQ ID NO: 21838 - RNA, 17 nt, Homo sapiens
agaaaccccagccauga

SEQ ID NO: 21839 - RNA, 19 nt, Homo sapiens
uguucuagacaucugucua

SEQ ID NO: 21840 - RNA, 19 nt, Homo sapiens
uugggauuuuguuugguuu

SEQ ID NO: 21841 - RNA, 19 nt, Homo sapiens
acaggaggaaauagacuua

SEQ ID NO: 21842 - RNA, 21 nt, Homo sapiens
acccuuucuucuccccauuuu

SEQ ID NO: 21843 - RNA, 22 nt, Homo sapiens
ccccauuuucauacucuuccca

SEQ ID NO: 21844 - RNA, 21 nt, Homo sapiens
ccuuucuucuccccauuuuca

SEQ ID NO: 21845 - RNA, 19 nt, Homo sapiens
ccuuuucuccccacuccuc

SEQ ID NO: 21846 - RNA, 18 nt, Homo sapiens
cugggagccaggccaccu

SEQ ID NO: 21847 - RNA, 20 nt, Homo sapiens
gagaugcccaaguuugucag

SEQ ID NO: 21848 - RNA, 27 nt, Homo sapiens
ucaaagaaggacgaauagcacccuacc

SEQ ID NO: 21849 - RNA, 22 nt, Homo sapiens
uggacaauuuggguggcagugu

SEQ ID NO: 21850 - RNA, 20 nt, Homo sapiens
auggugaaaccccaugucua

SEQ ID NO: 21851 - RNA, 21 nt, Homo sapiens
uuauuuugacuugcacugcca

SEQ ID NO: 21852 - RNA, 23 nt, Homo sapiens
aucugggcccagauugucugguu

SEQ ID NO: 21853 - RNA, 17 nt, Homo sapiens
cccauggcuccucgcca

SEQ ID NO: 21854 - RNA, 17 nt, Homo sapiens
cuggguacaguaccucc

SEQ ID NO: 21855 - RNA, 16 nt, Homo sapiens
gacgcgcuuuguccuu

SEQ ID NO: 21856 - RNA, 18 nt, Homo sapiens
gaugaaacagacauccca

SEQ ID NO: 21857 - RNA, 22 nt, Homo sapiens
cacacuuaaauuacguuccucc

SEQ ID NO: 21858 - RNA, 19 nt, Homo sapiens
uuaaaaauuauaaagaugu

SEQ ID NO: 21859 - RNA, 20 nt, Homo sapiens
aucuuagaauaaagaacgag

SEQ ID NO: 21860 - RNA, 18 nt, Homo sapiens
caaacuaacuaacugugu

SEQ ID NO: 21861 - RNA, 18 nt, Homo sapiens
gcaaaccuucuaccuccu

SEQ ID NO: 21862 - RNA, 21 nt, Homo sapiens
uaaauaaugcuggaauacuca

SEQ ID NO: 21863 - RNA, 17 nt, Homo sapiens
uuuugaugcaggucugc

SEQ ID NO: 21864 - RNA, 20 nt, Homo sapiens
gcgcggcgcgagcggccggg

SEQ ID NO: 21865 - RNA, 20 nt, Homo sapiens
aagugccgacaccucccuca

SEQ ID NO: 21866 - RNA, 25 nt, Homo sapiens
auacccuauguuauugugcucccug

SEQ ID NO: 21867 - RNA, 19 nt, Homo sapiens
cgcggagcccggcuaggga

SEQ ID NO: 21868 - RNA, 21 nt, Homo sapiens
gacauuuauuucuccuuugga

SEQ ID NO: 21869 - RNA, 19 nt, Homo sapiens
uuauaguggaaggaugguc

SEQ ID NO: 21870 - RNA, 20 nt, Homo sapiens
uugugcucccuggauuccug

SEQ ID NO: 21871 - RNA, 21 nt, Homo sapiens
cacaccaggcgacaggcacca

SEQ ID NO: 21872 - RNA, 24 nt, Homo sapiens
ccacccauggagacuggaaccuca

SEQ ID NO: 21873 - RNA, 17 nt, Homo sapiens
ccagcaucugucuuuuc

SEQ ID NO: 21874 - RNA, 21 nt, Homo sapiens
cccagugcccaugguuccuca

SEQ ID NO: 21875 - RNA, 21 nt, Homo sapiens
ccccuccccacuccagaggcc

SEQ ID NO: 21876 - RNA, 23 nt, Homo sapiens
ccuccucucuggcagggaucuca

SEQ ID NO: 21877 - RNA, 20 nt, Homo sapiens
cgcgcggcacggagccaggc

SEQ ID NO: 21878 - RNA, 25 nt, Homo sapiens
gcgcggagcccgguggcggcgagga

SEQ ID NO: 21879 - RNA, 17 nt, Homo sapiens
aaagagacaagcacaca

SEQ ID NO: 21880 - RNA, 21 nt, Homo sapiens
ccagcccccaccccgcccccc

SEQ ID NO: 21881 - RNA, 21 nt, Homo sapiens
aaaugucaagaagaacaucca

SEQ ID NO: 21882 - RNA, 18 nt, Homo sapiens
auguuuaacggugccaac

SEQ ID NO: 21883 - RNA, 19 nt, Homo sapiens
cgaggacagucuugaaaua

SEQ ID NO: 21884 - RNA, 19 nt, Homo sapiens
gccguucugugcuuuuccg

SEQ ID NO: 21885 - RNA, 22 nt, Homo sapiens
cucuggagcugggauuugggag

SEQ ID NO: 21886 - RNA, 23 nt, Homo sapiens
auaguggauccuggauggaacug

SEQ ID NO: 21887 - RNA, 20 nt, Homo sapiens
cagguggauacagaacuucc

SEQ ID NO: 21888 - RNA, 21 nt, Homo sapiens
gauaguuguauacaaaugagc

SEQ ID NO: 21889 - RNA, 18 nt, Homo sapiens
ugaaauagcuuuacagug

SEQ ID NO: 21890 - RNA, 17 nt, Homo sapiens
cacaauaauucccaacu

SEQ ID NO: 21891 - RNA, 22 nt, Homo sapiens
guaaaaugugaccguuugacau

SEQ ID NO: 21892 - RNA, 20 nt, Homo sapiens
guaugccacaggugaacuuu

SEQ ID NO: 21893 - RNA, 18 nt, Homo sapiens
uaaaggacuaaauuuguu

SEQ ID NO: 21894 - RNA, 18 nt, Homo sapiens
uaaaucucuuuacuaugu

SEQ ID NO: 21895 - RNA, 19 nt, Homo sapiens
uagcggggacaaaaaauca

SEQ ID NO: 21896 - RNA, 22 nt, Homo sapiens
uucuacuucuuguuccaagaug

SEQ ID NO: 21897 - RNA, 17 nt, Homo sapiens
acuguucuaacaaucua

SEQ ID NO: 21898 - RNA, 21 nt, Homo sapiens
cucagauguguucuuguagga

SEQ ID NO: 21899 - RNA, 18 nt, Homo sapiens
ucuuguaggaagaucugu

SEQ ID NO: 21900 - RNA, 15 nt, Homo sapiens
uuugcuguugcacaa

SEQ ID NO: 21901 - RNA, 24 nt, Homo sapiens
aagauugguaaauaaauacauuga

SEQ ID NO: 21902 - RNA, 21 nt, Homo sapiens
aaguuuacauuucaauuucua

SEQ ID NO: 21903 - RNA, 21 nt, Homo sapiens
acacaaaacucaggaauuggu

SEQ ID NO: 21904 - RNA, 22 nt, Homo sapiens
caagguguuuauaggcuuguca

SEQ ID NO: 21905 - RNA, 24 nt, Homo sapiens
cagugcuuguacuaggcuuaguua

SEQ ID NO: 21906 - RNA, 17 nt, Homo sapiens
cguguaauaaguugagu

SEQ ID NO: 21907 - RNA, 17 nt, Homo sapiens
cuaaaagcaugcaucua

SEQ ID NO: 21908 - RNA, 25 nt, Homo sapiens
gcugauaauuuauguuuuuucauua

SEQ ID NO: 21909 - RNA, 18 nt, Homo sapiens
uaaucguuuaugccauga

SEQ ID NO: 21910 - RNA, 16 nt, Homo sapiens
uucaagcacuaccacu

SEQ ID NO: 21911 - RNA, 24 nt, Homo sapiens
aucuggguuauugguguuuguucc

SEQ ID NO: 21912 - RNA, 22 nt, Homo sapiens
cuauuauuacuuuguaguagaa

SEQ ID NO: 21913 - RNA, 16 nt, Homo sapiens
aaaucucugcaaguga

SEQ ID NO: 21914 - RNA, 17 nt, Homo sapiens
gccucgacuccuggccc

SEQ ID NO: 21915 - RNA, 25 nt, Homo sapiens
ggggaugcgccgcggcggcggcggc

SEQ ID NO: 21916 - RNA, 27 nt, Homo sapiens
guggguuguauaaggguagcuuuuguu

SEQ ID NO: 21917 - RNA, 16 nt, Homo sapiens
uggacuauauaacuua

SEQ ID NO: 21918 - RNA, 21 nt, Homo sapiens
cuguccucccccaccugcuga

SEQ ID NO: 21919 - RNA, 19 nt, Homo sapiens
gccgccuccggagcuucgg

SEQ ID NO: 21920 - RNA, 18 nt, Homo sapiens
ucaaagcugcauaucuca

SEQ ID NO: 21921 - RNA, 21 nt, Homo sapiens
acuucauccucuccuaccugg

SEQ ID NO: 21922 - RNA, 19 nt, Homo sapiens
ccaaggccccccucccucu

SEQ ID NO: 21923 - RNA, 23 nt, Homo sapiens
ucauugguuccucuuucuguucc

SEQ ID NO: 21924 - RNA, 19 nt, Homo sapiens
ucuccuaccuggcucuuuu

SEQ ID NO: 21925 - RNA, 18 nt, Homo sapiens
uuucuguucccccauuga

SEQ ID NO: 21926 - RNA, 20 nt, Homo sapiens
uuucuguucccccauugacu

SEQ ID NO: 21927 - RNA, 24 nt, Homo sapiens
uagauuugacuucaacuccguaaa

SEQ ID NO: 21928 - RNA, 23 nt, Homo sapiens
cucaaaaguauuguggcaccuca

SEQ ID NO: 21929 - RNA, 24 nt, Homo sapiens
cuuuuaaacugcaguuuuaacuuu

SEQ ID NO: 21930 - RNA, 23 nt, Homo sapiens
gauuuguguuaagugacugagaa

SEQ ID NO: 21931 - RNA, 23 nt, Homo sapiens
ugaaguuguaagaaaagcuucca

SEQ ID NO: 21932 - RNA, 20 nt, Homo sapiens
aaagucccugacaugaagcu

SEQ ID NO: 21933 - RNA, 19 nt, Homo sapiens
ccagaacauccagagucug

SEQ ID NO: 21934 - RNA, 22 nt, Homo sapiens
ccucgcuguugugugugugaua

SEQ ID NO: 21935 - RNA, 21 nt, Homo sapiens
cuaauuccacccucugccccu

SEQ ID NO: 21936 - RNA, 17 nt, Homo sapiens
cugagaugaaacucccu

SEQ ID NO: 21937 - RNA, 22 nt, Homo sapiens
gagaaguggccgaagaggcuca

SEQ ID NO: 21938 - RNA, 19 nt, Homo sapiens
gauccccgagguggagcug

SEQ ID NO: 21939 - RNA, 20 nt, Homo sapiens
gccucaguuuccccaucucu

SEQ ID NO: 21940 - RNA, 23 nt, Homo sapiens
gccucccacugucccaccgccuc

SEQ ID NO: 21941 - RNA, 20 nt, Homo sapiens
ggucucagcccccaaggcug

SEQ ID NO: 21942 - RNA, 15 nt, Homo sapiens
ugagaugaagcuucc

SEQ ID NO: 21943 - RNA, 20 nt, Homo sapiens
accguugggcugcuugguuc

SEQ ID NO: 21944 - RNA, 20 nt, Homo sapiens
agccucccaaaauucuggga

SEQ ID NO: 21945 - RNA, 20 nt, Homo sapiens
augcucaccaccaccaauaa

SEQ ID NO: 21946 - RNA, 19 nt, Homo sapiens
ggcuaacaacucaaucuca

SEQ ID NO: 21947 - RNA, 16 nt, Homo sapiens
ggcugcuugguucuga

SEQ ID NO: 21948 - RNA, 21 nt, Homo sapiens
uaccacugauugcaauuuugc

SEQ ID NO: 21949 - RNA, 22 nt, Homo sapiens
ccuuuugcaucuccuugacuuu

SEQ ID NO: 21950 - RNA, 20 nt, Homo sapiens
ggaaccuugaaaacuaccug

SEQ ID NO: 21951 - RNA, 20 nt, Homo sapiens
ccagcaccagugcccuucuc

SEQ ID NO: 21952 - RNA, 26 nt, Homo sapiens
gcucugaaggucaaaagccucauuuu

SEQ ID NO: 21953 - RNA, 21 nt, Homo sapiens
ucucuaacaacgugacuaccu

SEQ ID NO: 21954 - RNA, 19 nt, Homo sapiens
ucugcauccuucucuaaca

SEQ ID NO: 21955 - RNA, 19 nt, Homo sapiens
ucugggaagugccugguuu

SEQ ID NO: 21956 - RNA, 21 nt, Homo sapiens
uggagcuuccuaaguugcuuu

SEQ ID NO: 21957 - RNA, 24 nt, Homo sapiens
uucuccugcucccagauacucuuu

SEQ ID NO: 21958 - RNA, 18 nt, Homo sapiens
acgugccacucaauacaa

SEQ ID NO: 21959 - RNA, 18 nt, Homo sapiens
acguaaaugcagaaguua

SEQ ID NO: 21960 - RNA, 23 nt, Homo sapiens
gguacugagcagccacuaccccu

SEQ ID NO: 21961 - RNA, 21 nt, Homo sapiens
gugaccaccaacauucugugu

SEQ ID NO: 21962 - RNA, 18 nt, Homo sapiens
ugguguuuggcucuuaua

SEQ ID NO: 21963 - RNA, 19 nt, Homo sapiens
aauccauugaucagaagaa

SEQ ID NO: 21964 - RNA, 19 nt, Homo sapiens
accagaaaccacacauuca

SEQ ID NO: 21965 - RNA, 22 nt, Homo sapiens
augcucagaugaacaacauauu

SEQ ID NO: 21966 - RNA, 21 nt, Homo sapiens
cagaagaacuucaccugcaga

SEQ ID NO: 21967 - RNA, 20 nt, Homo sapiens
gaagcuaccuggauauuucc

SEQ ID NO: 21968 - RNA, 18 nt, Homo sapiens
ggcugagaaucuuugcca

SEQ ID NO: 21969 - RNA, 19 nt, Homo sapiens
uaauagauguuacuuuuga

SEQ ID NO: 21970 - RNA, 18 nt, Homo sapiens
ucuccaggaaucugugag

SEQ ID NO: 21971 - RNA, 21 nt, Homo sapiens
auauuuuuacauauauuccca

SEQ ID NO: 21972 - RNA, 23 nt, Homo sapiens
gcccauggacaaucuccaccuca

SEQ ID NO: 21973 - RNA, 19 nt, Homo sapiens
caugccagcacuugaacug

SEQ ID NO: 21974 - RNA, 21 nt, Homo sapiens
ccuaccgagaggauuaugcaa

SEQ ID NO: 21975 - RNA, 19 nt, Homo sapiens
ccuccagacccugcuaacc

SEQ ID NO: 21976 - RNA, 23 nt, Homo sapiens
gcuuggaucaugcucgucugccc

SEQ ID NO: 21977 - RNA, 17 nt, Homo sapiens
ggcuguucccucuccaa

SEQ ID NO: 21978 - RNA, 21 nt, Homo sapiens
ucaggaggugggaggccgugg

SEQ ID NO: 21979 - RNA, 22 nt, Homo sapiens
ugaguggacucugugcucacug

SEQ ID NO: 21980 - RNA, 22 nt, Homo sapiens
aaaccauacacuggaugaccua

SEQ ID NO: 21981 - RNA, 20 nt, Homo sapiens
agaaaagaaaaccacccaca

SEQ ID NO: 21982 - RNA, 21 nt, Homo sapiens
ccuagucgauuauuuaagcau

SEQ ID NO: 21983 - RNA, 23 nt, Homo sapiens
uguugauaaggcacugccucuua

SEQ ID NO: 21984 - RNA, 20 nt, Homo sapiens
uuccacacauuaauggcaug

SEQ ID NO: 21985 - RNA, 19 nt, Homo sapiens
acgugcuuuccuauucuca

SEQ ID NO: 21986 - RNA, 23 nt, Homo sapiens
aggacugggcgucuccaagccca

SEQ ID NO: 21987 - RNA, 22 nt, Homo sapiens
auuucagaaaauaaaaauuuca

SEQ ID NO: 21988 - RNA, 18 nt, Homo sapiens
auuuguguugcugcugua

SEQ ID NO: 21989 - RNA, 24 nt, Homo sapiens
caagagacccgcaagaaacuugca

SEQ ID NO: 21990 - RNA, 21 nt, Homo sapiens
cacccuacucaccgcucuccu

SEQ ID NO: 21991 - RNA, 18 nt, Homo sapiens
cccaccuucgcuggaaca

SEQ ID NO: 21992 - RNA, 19 nt, Homo sapiens
cuugauggccggccucgaa

SEQ ID NO: 21993 - RNA, 19 nt, Homo sapiens
gagugggccggggaggcug

SEQ ID NO: 21994 - RNA, 16 nt, Homo sapiens
gcggcuacacauucca

SEQ ID NO: 21995 - RNA, 18 nt, Homo sapiens
ggggucauggguuuuguu

SEQ ID NO: 21996 - RNA, 19 nt, Homo sapiens
ugucuauuuccugcacuuc

SEQ ID NO: 21997 - RNA, 18 nt, Homo sapiens
acagggagagcagcagcc

SEQ ID NO: 21998 - RNA, 19 nt, Homo sapiens
ucugagccgcgagggcgcc

SEQ ID NO: 21999 - RNA, 18 nt, Homo sapiens
ugcggcugcuccggaccu

SEQ ID NO: 22000 - RNA, 21 nt, Homo sapiens
uuucaagucauguuguguuug

SEQ ID NO: 22001 - RNA, 19 nt, Homo sapiens
aaaacuaaccaaccucaac

SEQ ID NO: 22002 - RNA, 19 nt, Homo sapiens
aaguauugucaguuaccuc

SEQ ID NO: 22003 - RNA, 19 nt, Homo sapiens
guagcagucacugacagua

SEQ ID NO: 22004 - RNA, 21 nt, Homo sapiens
caagcacagagccuggcccca

SEQ ID NO: 22005 - RNA, 21 nt, Homo sapiens
caggacgaaaaagaggcauac

SEQ ID NO: 22006 - RNA, 24 nt, Homo sapiens
ccauccucccuccaccucaagacc

SEQ ID NO: 22007 - RNA, 19 nt, Homo sapiens
ccauugcucuuagucccaa

SEQ ID NO: 22008 - RNA, 24 nt, Homo sapiens
gcuucucuccuugccccccgcccu

SEQ ID NO: 22009 - RNA, 25 nt, Homo sapiens
guggcagaugucuucccugggcugc

SEQ ID NO: 22010 - RNA, 18 nt, Homo sapiens
ucucuuugugguuucuug

SEQ ID NO: 22011 - RNA, 22 nt, Homo sapiens
ccuccccccggccacccuuccc

SEQ ID NO: 22012 - RNA, 20 nt, Homo sapiens
gcguccuccccccggccacc

SEQ ID NO: 22013 - RNA, 18 nt, Homo sapiens
ugguguagaaugauucca

SEQ ID NO: 22014 - RNA, 21 nt, Homo sapiens
gcaucaaaugaaaacuucaua

SEQ ID NO: 22015 - RNA, 18 nt, Homo sapiens
uaaaaaugcagaagcuau

SEQ ID NO: 22016 - RNA, 21 nt, Homo sapiens
gucccaccgcugccccuacug

SEQ ID NO: 22017 - RNA, 16 nt, Homo sapiens
gagaccagcgugguca

SEQ ID NO: 22018 - RNA, 21 nt, Homo sapiens
gauuguuccaguuucuuuuga

SEQ ID NO: 22019 - RNA, 21 nt, Homo sapiens
ccuuccccuucccuuccuucc

SEQ ID NO: 22020 - RNA, 17 nt, Homo sapiens
ucaauagcuuaaacuca

SEQ ID NO: 22021 - RNA, 18 nt, Homo sapiens
ugcuuguugcaauguggu

SEQ ID NO: 22022 - RNA, 24 nt, Homo sapiens
acaaagaagaaagcagcacuguca

SEQ ID NO: 22023 - RNA, 16 nt, Homo sapiens
acauuuaacuaccugu

SEQ ID NO: 22024 - RNA, 18 nt, Homo sapiens
acuauacuaagaacauau

SEQ ID NO: 22025 - RNA, 21 nt, Homo sapiens
cagccacaagacauccacaua

SEQ ID NO: 22026 - RNA, 21 nt, Homo sapiens
cauguacuuuuaaagcaggga

SEQ ID NO: 22027 - RNA, 23 nt, Homo sapiens
cuucaaacauguugcuuugcuuu

SEQ ID NO: 22028 - RNA, 20 nt, Homo sapiens
cuuuguacauuuaauugaua

SEQ ID NO: 22029 - RNA, 17 nt, Homo sapiens
gguuuggauguugcagc

SEQ ID NO: 22030 - RNA, 23 nt, Homo sapiens
guaaaggauauuuuugcucuguu

SEQ ID NO: 22031 - RNA, 20 nt, Homo sapiens
gucaaaagacuauaaaugcu

SEQ ID NO: 22032 - RNA, 19 nt, Homo sapiens
ucaaaaaugcaaaauguga

SEQ ID NO: 22033 - RNA, 23 nt, Homo sapiens
acacagugggucgcaggaucuga

SEQ ID NO: 22034 - RNA, 19 nt, Homo sapiens
agggugacucaagucaaca

SEQ ID NO: 22035 - RNA, 21 nt, Homo sapiens
ggacagggagagcaagagguc

SEQ ID NO: 22036 - RNA, 22 nt, Homo sapiens
aucuuggcucacugcaaucucu

SEQ ID NO: 22037 - RNA, 22 nt, Homo sapiens
uagaaauacaauugauguugaa

SEQ ID NO: 22038 - RNA, 23 nt, Homo sapiens
ucuuuuugagauuuguuuuggcu

SEQ ID NO: 22039 - RNA, 21 nt, Homo sapiens
ugggcaccuugauugagauug

SEQ ID NO: 22040 - RNA, 21 nt, Homo sapiens
uguaucuguaaucacagcauu

SEQ ID NO: 22041 - RNA, 22 nt, Homo sapiens
uuucccaucccaagaucacaau

SEQ ID NO: 22042 - RNA, 18 nt, Homo sapiens
uaaacaaucucuacaugu

SEQ ID NO: 22043 - RNA, 17 nt, Homo sapiens
cagaaggagcguggccc

SEQ ID NO: 22044 - RNA, 17 nt, Homo sapiens
cccagccaacacccuga

SEQ ID NO: 22045 - RNA, 20 nt, Homo sapiens
gcccacugaaagccugguga

SEQ ID NO: 22046 - RNA, 18 nt, Homo sapiens
ccagagcucucuauucug

SEQ ID NO: 22047 - RNA, 20 nt, Homo sapiens
cauccucgagcaacugcugu

SEQ ID NO: 22048 - RNA, 24 nt, Homo sapiens
ccacccucugccacccaguccucc

SEQ ID NO: 22049 - RNA, 21 nt, Homo sapiens
ucaccgaagccacuuucuaca

SEQ ID NO: 22050 - RNA, 20 nt, Homo sapiens
uggacaacugcauggagcug

SEQ ID NO: 22051 - RNA, 21 nt, Homo sapiens
uggagcucuuggcuggggcug

SEQ ID NO: 22052 - RNA, 25 nt, Homo sapiens
uuccccacacaugccuauuucugaa

SEQ ID NO: 22053 - RNA, 19 nt, Homo sapiens
aguuacuuguguucauuga

SEQ ID NO: 22054 - RNA, 20 nt, Homo sapiens
augcaauuugacuuggcaua

SEQ ID NO: 22055 - RNA, 17 nt, Homo sapiens
cauaauacccuuuucca

SEQ ID NO: 22056 - RNA, 21 nt, Homo sapiens
caugcacucuucauguaauca

SEQ ID NO: 22057 - RNA, 20 nt, Homo sapiens
ccacagaaaucucucaccca

SEQ ID NO: 22058 - RNA, 19 nt, Homo sapiens
ccaucagcaacaucauucc

SEQ ID NO: 22059 - RNA, 16 nt, Homo sapiens
gccaucagcaacauca

SEQ ID NO: 22060 - RNA, 18 nt, Homo sapiens
guccagcacuacaacuua

SEQ ID NO: 22061 - RNA, 17 nt, Homo sapiens
guucagguguauaggga

SEQ ID NO: 22062 - RNA, 20 nt, Homo sapiens
uaaagcuaccauguuaauac

SEQ ID NO: 22063 - RNA, 17 nt, Homo sapiens
uugucaaauacagcauu

SEQ ID NO: 22064 - RNA, 20 nt, Homo sapiens
uuuuaccauauggaauaggg

SEQ ID NO: 22065 - RNA, 20 nt, Homo sapiens
accaaccauaugaaguaggc

SEQ ID NO: 22066 - RNA, 18 nt, Homo sapiens
aucugcaucuccagauga

SEQ ID NO: 22067 - RNA, 16 nt, Homo sapiens
cacauuuucggacguc

SEQ ID NO: 22068 - RNA, 20 nt, Homo sapiens
cagguaucacugcacuuuaa

SEQ ID NO: 22069 - RNA, 18 nt, Homo sapiens
cuagcacuuacugagcac

SEQ ID NO: 22070 - RNA, 21 nt, Homo sapiens
ugccaggaaucagugacauuc

SEQ ID NO: 22071 - RNA, 19 nt, Homo sapiens
ccuugguugucuuaauuuu

SEQ ID NO: 22072 - RNA, 15 nt, Homo sapiens
ucccuaccuuuucca

SEQ ID NO: 22073 - RNA, 18 nt, Homo sapiens
uugucuggcugcuggcca

SEQ ID NO: 22074 - RNA, 22 nt, Homo sapiens
ggacacccgaggccuccuggga

SEQ ID NO: 22075 - RNA, 26 nt, Homo sapiens
aaauuuguucuuugauauuggaauua

SEQ ID NO: 22076 - RNA, 22 nt, Homo sapiens
aggguagaaguaagacauauca

SEQ ID NO: 22077 - RNA, 17 nt, Homo sapiens
cccgcggggacgccgcc

SEQ ID NO: 22078 - RNA, 21 nt, Homo sapiens
aaaauaucucuaaaauaggua

SEQ ID NO: 22079 - RNA, 19 nt, Homo sapiens
accgucuguguuugagcaa

SEQ ID NO: 22080 - RNA, 18 nt, Homo sapiens
acucuucuucauuagcuu

SEQ ID NO: 22081 - RNA, 19 nt, Homo sapiens
aggagaaaaucauguugaa

SEQ ID NO: 22082 - RNA, 18 nt, Homo sapiens
augauacuuaaccaguua

SEQ ID NO: 22083 - RNA, 21 nt, Homo sapiens
uagcauacuuaaaauaucucu

SEQ ID NO: 22084 - RNA, 19 nt, Homo sapiens
ugcuauuucacuugagcaa

SEQ ID NO: 22085 - RNA, 22 nt, Homo sapiens
acucuaaaacucugguauuaua

SEQ ID NO: 22086 - RNA, 21 nt, Homo sapiens
aagagaggcccaggcuacugg

SEQ ID NO: 22087 - RNA, 20 nt, Homo sapiens
cagacuccccagggcuucaa

SEQ ID NO: 22088 - RNA, 21 nt, Homo sapiens
cccugcugcggagaccgcgga

SEQ ID NO: 22089 - RNA, 23 nt, Homo sapiens
ccugagggcacccgguugcugcu

SEQ ID NO: 22090 - RNA, 19 nt, Homo sapiens
cugacuuucuuuuuugaua

SEQ ID NO: 22091 - RNA, 19 nt, Homo sapiens
uauuuguaaaaugacaauc

SEQ ID NO: 22092 - RNA, 19 nt, Homo sapiens
aagguccuaaaucucccca

SEQ ID NO: 22093 - RNA, 17 nt, Homo sapiens
ccuccugcccucaggag

SEQ ID NO: 22094 - RNA, 20 nt, Homo sapiens
gcccccacgggugccccccc

SEQ ID NO: 22095 - RNA, 19 nt, Homo sapiens
uggaauccggcgugggcug

SEQ ID NO: 22096 - RNA, 18 nt, Homo sapiens
aguuccacaaucucuucu

SEQ ID NO: 22097 - RNA, 22 nt, Homo sapiens
uugggguuuugaauguuugcuu

SEQ ID NO: 22098 - RNA, 22 nt, Homo sapiens
aacaguucagugcauuguuguu

SEQ ID NO: 22099 - RNA, 15 nt, Homo sapiens
aguuaguucucaucu

SEQ ID NO: 22100 - RNA, 20 nt, Homo sapiens
cguuucaucaauuugaagaa

SEQ ID NO: 22101 - RNA, 18 nt, Homo sapiens
ggaagauggaauacauca

SEQ ID NO: 22102 - RNA, 17 nt, Homo sapiens
guauuacuuaagauugu

SEQ ID NO: 22103 - RNA, 22 nt, Homo sapiens
uuauacauauuaccuuguuaua

SEQ ID NO: 22104 - RNA, 21 nt, Homo sapiens
aagucaagacugcauguugaa

SEQ ID NO: 22105 - RNA, 19 nt, Homo sapiens
gcgccugggaugccgggga

SEQ ID NO: 22106 - RNA, 18 nt, Homo sapiens
gucccagguacccggugg

SEQ ID NO: 22107 - RNA, 18 nt, Homo sapiens
ugcggcugcuccgggcug

SEQ ID NO: 22108 - RNA, 17 nt, Homo sapiens
agcucucuucuuacuca

SEQ ID NO: 22109 - RNA, 21 nt, Homo sapiens
cuuaggauauuugagucacuu

SEQ ID NO: 22110 - RNA, 21 nt, Homo sapiens
ucucugcaaugcuucuguagc

SEQ ID NO: 22111 - RNA, 19 nt, Homo sapiens
aucuuagcuucuuuaauca

SEQ ID NO: 22112 - RNA, 21 nt, Homo sapiens
ccucuuuagggcuuugguuuu

SEQ ID NO: 22113 - RNA, 25 nt, Homo sapiens
gagacuggaaugcgucagccugaga

SEQ ID NO: 22114 - RNA, 20 nt, Homo sapiens
uauuacauacaugcuuugaa

SEQ ID NO: 22115 - RNA, 16 nt, Homo sapiens
ugccaucgcugugaug

SEQ ID NO: 22116 - RNA, 20 nt, Homo sapiens
ggagcuuccauccugguucu

SEQ ID NO: 22117 - RNA, 19 nt, Homo sapiens
guucuuccaaagugcccgg

SEQ ID NO: 22118 - RNA, 22 nt, Homo sapiens
caaggaaagagagaaaacaaca

SEQ ID NO: 22119 - RNA, 20 nt, Homo sapiens
cagagugaaagcguaagguu

SEQ ID NO: 22120 - RNA, 23 nt, Homo sapiens
ugcaucuggcgaucagacucuga

SEQ ID NO: 22121 - RNA, 18 nt, Homo sapiens
acuuaccaaaacauauca

SEQ ID NO: 22122 - RNA, 22 nt, Homo sapiens
aguccaucuuucaagcacuuua

SEQ ID NO: 22123 - RNA, 21 nt, Homo sapiens
gcagcaaugcaaauuaugaca

SEQ ID NO: 22124 - RNA, 16 nt, Homo sapiens
gcuacuugaaggcuga

SEQ ID NO: 22125 - RNA, 17 nt, Homo sapiens
guauacccucuauuaca

SEQ ID NO: 22126 - RNA, 24 nt, Homo sapiens
uguuugaugggaaagaccacuaca

SEQ ID NO: 22127 - RNA, 20 nt, Homo sapiens
caugaaguauuguuuccuuu

SEQ ID NO: 22128 - RNA, 16 nt, Homo sapiens
aggucaacauugacca

SEQ ID NO: 22129 - RNA, 19 nt, Homo sapiens
cauuggaggagugguuuaa

SEQ ID NO: 22130 - RNA, 24 nt, Homo sapiens
ccuagaaguucuugauucauuuuu

SEQ ID NO: 22131 - RNA, 17 nt, Homo sapiens
ucacugauauauguaga

SEQ ID NO: 22132 - RNA, 21 nt, Homo sapiens
uggggucuccuggguucagcg

SEQ ID NO: 22133 - RNA, 19 nt, Homo sapiens
cacuucugauuuuccuuca

SEQ ID NO: 22134 - RNA, 25 nt, Homo sapiens
ccaaaauauaguuguuguugauuuu

SEQ ID NO: 22135 - RNA, 19 nt, Homo sapiens
cuguuuuguuuucaucuca

SEQ ID NO: 22136 - RNA, 19 nt, Homo sapiens
cuuuggccugcaguuugua

SEQ ID NO: 22137 - RNA, 18 nt, Homo sapiens
uguugggaucuguuugga

SEQ ID NO: 22138 - RNA, 23 nt, Homo sapiens
cagagaugacaaacuggcauccu

SEQ ID NO: 22139 - RNA, 22 nt, Homo sapiens
uaucccugugccaaaggcucca

SEQ ID NO: 22140 - RNA, 23 nt, Homo sapiens
cccgaagaauguaacaagaagca

SEQ ID NO: 22141 - RNA, 23 nt, Homo sapiens
gacagcagccccgccccggccuc

SEQ ID NO: 22142 - RNA, 19 nt, Homo sapiens
gauucaaauuguauuuaca

SEQ ID NO: 22143 - RNA, 21 nt, Homo sapiens
uuuaggcauuagagucauuuu

SEQ ID NO: 22144 - RNA, 16 nt, Homo sapiens
ccacacagcugccuca

SEQ ID NO: 22145 - RNA, 23 nt, Homo sapiens
cgugccuggaaccaccucgucca

SEQ ID NO: 22146 - RNA, 18 nt, Homo sapiens
cugcccaugccugcccca

SEQ ID NO: 22147 - RNA, 24 nt, Homo sapiens
gcuccuccacccagugcuucugcc

SEQ ID NO: 22148 - RNA, 19 nt, Homo sapiens
ggauuaugaacaaaccuca

SEQ ID NO: 22149 - RNA, 19 nt, Homo sapiens
agccagggcagggguggcu

SEQ ID NO: 22150 - RNA, 24 nt, Homo sapiens
uagaaagagcucaguguugggcug

SEQ ID NO: 22151 - RNA, 20 nt, Homo sapiens
ucaaugugaagagcuuagaa

SEQ ID NO: 22152 - RNA, 24 nt, Homo sapiens
aauggagaccucccuaccaaguga

SEQ ID NO: 22153 - RNA, 21 nt, Homo sapiens
agugucuggaguuucauucca

SEQ ID NO: 22154 - RNA, 18 nt, Homo sapiens
ccagaacccaucccaaua

SEQ ID NO: 22155 - RNA, 24 nt, Homo sapiens
cugagcuuacacuaauuggucaga

SEQ ID NO: 22156 - RNA, 18 nt, Homo sapiens
ucagaaaggcauugugaa

SEQ ID NO: 22157 - RNA, 18 nt, Homo sapiens
ugacuagaaacaucaagg

SEQ ID NO: 22158 - RNA, 23 nt, Homo sapiens
accuggguugcagaacugagccu

SEQ ID NO: 22159 - RNA, 19 nt, Homo sapiens
agugaaagguaaaaucuca

SEQ ID NO: 22160 - RNA, 20 nt, Homo sapiens
auugccuuccauguuguuua

SEQ ID NO: 22161 - RNA, 17 nt, Homo sapiens
cauugaccucagcagca

SEQ ID NO: 22162 - RNA, 20 nt, Homo sapiens
ucauuugcagaaguuaguaa

SEQ ID NO: 22163 - RNA, 20 nt, Homo sapiens
cacucuuacccaagacucug

SEQ ID NO: 22164 - RNA, 18 nt, Homo sapiens
caugcagccaugcaggga

SEQ ID NO: 22165 - RNA, 18 nt, Homo sapiens
ccugaacugccucugcuu

SEQ ID NO: 22166 - RNA, 16 nt, Homo sapiens
cugcuuugggugcggu

SEQ ID NO: 22167 - RNA, 18 nt, Homo sapiens
gcccuuuccguggcuucu

SEQ ID NO: 22168 - RNA, 19 nt, Homo sapiens
uuuagggcacacuguuaua

SEQ ID NO: 22169 - RNA, 23 nt, Homo sapiens
cucuccggggagcuaaccaggga

SEQ ID NO: 22170 - RNA, 18 nt, Homo sapiens
ccugccccccucgucuca

SEQ ID NO: 22171 - RNA, 19 nt, Homo sapiens
gacccccgcccccaccucc

SEQ ID NO: 22172 - RNA, 20 nt, Homo sapiens
aggccccacagugcagcuuc

SEQ ID NO: 22173 - RNA, 16 nt, Homo sapiens
ccuuugggggaucugu

SEQ ID NO: 22174 - RNA, 19 nt, Homo sapiens
gcaaugaccucagacuucu

SEQ ID NO: 22175 - RNA, 22 nt, Homo sapiens
cuccguccagaaaugccucuca

SEQ ID NO: 22176 - RNA, 21 nt, Homo sapiens
uacgacuucauuuggcuucga

SEQ ID NO: 22177 - RNA, 19 nt, Homo sapiens
ucucuuuauagcugugacu

SEQ ID NO: 22178 - RNA, 22 nt, Homo sapiens
ugaagucuucacaucuaccacu

SEQ ID NO: 22179 - RNA, 23 nt, Homo sapiens
acaaaagauuaaucuuuaaacca

SEQ ID NO: 22180 - RNA, 22 nt, Homo sapiens
acccaugcacacucaugcacac

SEQ ID NO: 22181 - RNA, 25 nt, Homo sapiens
cuacccagguauuacacaagccaaa

SEQ ID NO: 22182 - RNA, 18 nt, Homo sapiens
cuuaaugcacagugcauu

SEQ ID NO: 22183 - RNA, 24 nt, Homo sapiens
gaaagaaguuuuaugcgugugaca

SEQ ID NO: 22184 - RNA, 22 nt, Homo sapiens
gggcggggcguguagccagcca

SEQ ID NO: 22185 - RNA, 21 nt, Homo sapiens
ugcagggucgggcuugcggug

SEQ ID NO: 22186 - RNA, 20 nt, Homo sapiens
agcaccaggaaaaucaacag

SEQ ID NO: 22187 - RNA, 16 nt, Homo sapiens
ucugcgcauugaugaa

SEQ ID NO: 22188 - RNA, 21 nt, Homo sapiens
accugaauuggucuuugguuu

SEQ ID NO: 22189 - RNA, 18 nt, Homo sapiens
cauagcugaccaagcugc

SEQ ID NO: 22190 - RNA, 22 nt, Homo sapiens
gauuuugucauuuuuuacauca

SEQ ID NO: 22191 - RNA, 21 nt, Homo sapiens
ggggagccgcggcggcguggc

SEQ ID NO: 22192 - RNA, 24 nt, Homo sapiens
ugacaaaaauauggugucauaaua

SEQ ID NO: 22193 - RNA, 19 nt, Homo sapiens
cacagccuugaugaucuca

SEQ ID NO: 22194 - RNA, 19 nt, Homo sapiens
ggauuuauuaaugugggau

SEQ ID NO: 22195 - RNA, 24 nt, Homo sapiens
cuucacgugguuguaaacagcaga

SEQ ID NO: 22196 - RNA, 21 nt, Homo sapiens
gggauggcugcucagcugcug

SEQ ID NO: 22197 - RNA, 22 nt, Homo sapiens
guaacaaaagaccuuagacugg

SEQ ID NO: 22198 - RNA, 21 nt, Homo sapiens
ucccugcagugcacgcuggca

SEQ ID NO: 22199 - RNA, 23 nt, Homo sapiens
ggaggagggggccgcagucggga

SEQ ID NO: 22200 - RNA, 16 nt, Homo sapiens
guccuuuugaaacauc

SEQ ID NO: 22201 - RNA, 21 nt, Homo sapiens
cuccaucccuccuucugccuc

SEQ ID NO: 22202 - RNA, 23 nt, Homo sapiens
ccuuaguugcuggcuuugaccuu

SEQ ID NO: 22203 - RNA, 16 nt, Homo sapiens
aauauggaucaucucu

SEQ ID NO: 22204 - RNA, 22 nt, Homo sapiens
cucgauuaaaaauguuaagcua

SEQ ID NO: 22205 - RNA, 17 nt, Homo sapiens
ucaagugauucuccugc

SEQ ID NO: 22206 - RNA, 21 nt, Homo sapiens
ugaugauucacaccuguacua

SEQ ID NO: 22207 - RNA, 19 nt, Homo sapiens
uguacuguauguagucaug

SEQ ID NO: 22208 - RNA, 20 nt, Homo sapiens
aaucccuccuccucugcucu

SEQ ID NO: 22209 - RNA, 19 nt, Homo sapiens
cccaucucacccucucuca

SEQ ID NO: 22210 - RNA, 18 nt, Homo sapiens
ccccggcgcccucccuca

SEQ ID NO: 22211 - RNA, 18 nt, Homo sapiens
gacccacagagcacccuc

SEQ ID NO: 22212 - RNA, 25 nt, Homo sapiens
ggaggagggggccacgugugagaga

SEQ ID NO: 22213 - RNA, 19 nt, Homo sapiens
ccccagggagagcugacca

SEQ ID NO: 22214 - RNA, 22 nt, Homo sapiens
cccccuuuccugcccuccccca

SEQ ID NO: 22215 - RNA, 21 nt, Homo sapiens
gccccagccccgcgcaggcca

SEQ ID NO: 22216 - RNA, 20 nt, Homo sapiens
aaacuacagaagcuugguga

SEQ ID NO: 22217 - RNA, 18 nt, Homo sapiens
aaagaaugaacugcuccu

SEQ ID NO: 22218 - RNA, 23 nt, Homo sapiens
ugagugcguuuuguccuucacgu

SEQ ID NO: 22219 - RNA, 18 nt, Homo sapiens
ugcuguuugaacuguuga

SEQ ID NO: 22220 - RNA, 21 nt, Homo sapiens
cuauucaauuucugaguaaua

SEQ ID NO: 22221 - RNA, 17 nt, Homo sapiens
cuccuaucauuuucuga

SEQ ID NO: 22222 - RNA, 26 nt, Homo sapiens
ucuguauugacaagacuguuguuuuu

SEQ ID NO: 22223 - RNA, 20 nt, Homo sapiens
ugaauaguguguuuauugua

SEQ ID NO: 22224 - RNA, 23 nt, Homo sapiens
ugcuauucuuuuugcuuaaauac

SEQ ID NO: 22225 - RNA, 18 nt, Homo sapiens
guugaaggaagcuucucu

SEQ ID NO: 22226 - RNA, 21 nt, Homo sapiens
aagaaaggagaaagccauugg

SEQ ID NO: 22227 - RNA, 21 nt, Homo sapiens
aaggccagauuuuaccuacca

SEQ ID NO: 22228 - RNA, 19 nt, Homo sapiens
caucgaucguaucacugcu

SEQ ID NO: 22229 - RNA, 25 nt, Homo sapiens
cuggggcuuuuucugauuuauuuuu

SEQ ID NO: 22230 - RNA, 24 nt, Homo sapiens
cuuuguacauauacguaauuuaua

SEQ ID NO: 22231 - RNA, 17 nt, Homo sapiens
uccuuuaggacaugaga

SEQ ID NO: 22232 - RNA, 18 nt, Homo sapiens
ucuggggcuuuuucugau

SEQ ID NO: 22233 - RNA, 21 nt, Homo sapiens
cccgcccucaccccagccauc

SEQ ID NO: 22234 - RNA, 17 nt, Homo sapiens
aacugccugacguugca

SEQ ID NO: 22235 - RNA, 20 nt, Homo sapiens
cugccucuucugucauuguu

SEQ ID NO: 22236 - RNA, 20 nt, Homo sapiens
cgcgcggcgccccgcggagc

SEQ ID NO: 22237 - RNA, 22 nt, Homo sapiens
ccuccccccggcccucccuucc

SEQ ID NO: 22238 - RNA, 18 nt, Homo sapiens
ggaggcggcggcggcggc

SEQ ID NO: 22239 - RNA, 21 nt, Homo sapiens
acauuuacaggaggccccgga

SEQ ID NO: 22240 - RNA, 21 nt, Homo sapiens
ccccacccaccuccugcggcu

SEQ ID NO: 22241 - RNA, 21 nt, Homo sapiens
cuggaccaucgcugccugcca

SEQ ID NO: 22242 - RNA, 21 nt, Homo sapiens
augccuccggugcaacagcug

SEQ ID NO: 22243 - RNA, 19 nt, Homo sapiens
acucuucauggaaagcaac

SEQ ID NO: 22244 - RNA, 15 nt, Homo sapiens
cagguuuagaagcuu

SEQ ID NO: 22245 - RNA, 20 nt, Homo sapiens
ccagggcucacccagauuca

SEQ ID NO: 22246 - RNA, 21 nt, Homo sapiens
ccccaccgugccgcugcagcu

SEQ ID NO: 22247 - RNA, 18 nt, Homo sapiens
gagcgaugcuggugguca

SEQ ID NO: 22248 - RNA, 24 nt, Homo sapiens
auauuuucagagaaaguuaccuaa

SEQ ID NO: 22249 - RNA, 21 nt, Homo sapiens
ccacccccaugaccaccacca

SEQ ID NO: 22250 - RNA, 24 nt, Homo sapiens
ccuaacuauuaagaucacugugua

SEQ ID NO: 22251 - RNA, 23 nt, Homo sapiens
gguucuuggaggguaugucagug

SEQ ID NO: 22252 - RNA, 24 nt, Homo sapiens
uauaaauugggauuuaagacugua

SEQ ID NO: 22253 - RNA, 26 nt, Homo sapiens
ucugcaacauucacaccauugcuucc

SEQ ID NO: 22254 - RNA, 19 nt, Homo sapiens
auauauuauuauuugauug

SEQ ID NO: 22255 - RNA, 21 nt, Homo sapiens
gcagcugcuucgcagcgcaac

SEQ ID NO: 22256 - RNA, 24 nt, Homo sapiens
ucagagguggcguaaaucuggcca

SEQ ID NO: 22257 - RNA, 19 nt, Homo sapiens
aggcacuugccaccacgcc

SEQ ID NO: 22258 - RNA, 20 nt, Homo sapiens
ccucugccuccuggguucaa

SEQ ID NO: 22259 - RNA, 18 nt, Homo sapiens
ccuggaacuccuuggcuc

SEQ ID NO: 22260 - RNA, 23 nt, Homo sapiens
ccugggugucaauaauuauuuuu

SEQ ID NO: 22261 - RNA, 20 nt, Homo sapiens
gccaccacaccuggauaauu

SEQ ID NO: 22262 - RNA, 17 nt, Homo sapiens
ucaagcgauucuugugc

SEQ ID NO: 22263 - RNA, 20 nt, Homo sapiens
uccagauuuuauauuccuaa

SEQ ID NO: 22264 - RNA, 25 nt, Homo sapiens
uccagauuuuauauuccuaauccca

SEQ ID NO: 22265 - RNA, 22 nt, Homo sapiens
uuucuauguuccaugcauaaua

SEQ ID NO: 22266 - RNA, 18 nt, Homo sapiens
uuugucccuagcaccuuu

SEQ ID NO: 22267 - RNA, 17 nt, Homo sapiens
acauuccuguaauccca

SEQ ID NO: 22268 - RNA, 20 nt, Homo sapiens
acucaucuuucagaaguuug

SEQ ID NO: 22269 - RNA, 20 nt, Homo sapiens
gauuagagauuucacugaua

SEQ ID NO: 22270 - RNA, 20 nt, Homo sapiens
gcgcccagcggacaccggca

SEQ ID NO: 22271 - RNA, 18 nt, Homo sapiens
gcucgccauuguguuugc

SEQ ID NO: 22272 - RNA, 20 nt, Homo sapiens
cuggccucguccgcggccca

SEQ ID NO: 22273 - RNA, 22 nt, Homo sapiens
cacuuccacacuauuuauuugg

SEQ ID NO: 22274 - RNA, 19 nt, Homo sapiens
cugggcggcgcuucggcuc

SEQ ID NO: 22275 - RNA, 19 nt, Homo sapiens
gcacugaaguauuacauaa

SEQ ID NO: 22276 - RNA, 19 nt, Homo sapiens
gggacgggcccggugcggc

SEQ ID NO: 22277 - RNA, 25 nt, Homo sapiens
uuuccagaaugucuguuucucacua

SEQ ID NO: 22278 - RNA, 17 nt, Homo sapiens
aaguaacugaaccauuc

SEQ ID NO: 22279 - RNA, 19 nt, Homo sapiens
auuauuaucuauuaucuca

SEQ ID NO: 22280 - RNA, 20 nt, Homo sapiens
guuuguuauuuauccuagug

SEQ ID NO: 22281 - RNA, 18 nt, Homo sapiens
uggguggaucaccugagg

SEQ ID NO: 22282 - RNA, 20 nt, Homo sapiens
uucccaaguguaagacucug

SEQ ID NO: 22283 - RNA, 19 nt, Homo sapiens
ccuguuagaagucugugag

SEQ ID NO: 22284 - RNA, 19 nt, Homo sapiens
ccuguuagaagucugugag

SEQ ID NO: 22285 - RNA, 20 nt, Homo sapiens
ccuguuagaagucugugagc

SEQ ID NO: 22286 - RNA, 21 nt, Homo sapiens
guguguguuuuucauuugauu

SEQ ID NO: 22287 - RNA, 23 nt, Homo sapiens
ugaagagaauccugauaugaaac

SEQ ID NO: 22288 - RNA, 19 nt, Homo sapiens
accaagacaugaaaagcug

SEQ ID NO: 22289 - RNA, 20 nt, Homo sapiens
accagcuuccucaccaggca

SEQ ID NO: 22290 - RNA, 18 nt, Homo sapiens
accccuugccucuguggc

SEQ ID NO: 22291 - RNA, 20 nt, Homo sapiens
augucauuuuauuccccucc

SEQ ID NO: 22292 - RNA, 18 nt, Homo sapiens
cccccagacauacuuuca

SEQ ID NO: 22293 - RNA, 21 nt, Homo sapiens
ggcagcugggcccacuucaua

SEQ ID NO: 22294 - RNA, 23 nt, Homo sapiens
ucccccugaccugggcacaggca

SEQ ID NO: 22295 - RNA, 24 nt, Homo sapiens
cccuucccccccuuuuuaaaugua

SEQ ID NO: 22296 - RNA, 21 nt, Homo sapiens
ccuuccccuuuuccccuuucc

SEQ ID NO: 22297 - RNA, 20 nt, Homo sapiens
ggauccuggccaugagguug

SEQ ID NO: 22298 - RNA, 19 nt, Homo sapiens
ggccagguuacuuaagcac

SEQ ID NO: 22299 - RNA, 21 nt, Homo sapiens
uccccuuuuccccuuuccccu

SEQ ID NO: 22300 - RNA, 17 nt, Homo sapiens
uuuuuggguacagcugu

SEQ ID NO: 22301 - RNA, 16 nt, Homo sapiens
cggcuucacccuucgu

SEQ ID NO: 22302 - RNA, 21 nt, Homo sapiens
cucuucuguccccuccccucu

SEQ ID NO: 22303 - RNA, 20 nt, Homo sapiens
gcccauuugggggcuucuaa

SEQ ID NO: 22304 - RNA, 21 nt, Homo sapiens
gcuuguaaggcccucugguuu

SEQ ID NO: 22305 - RNA, 20 nt, Homo sapiens
gggggagacggggugauugc

SEQ ID NO: 22306 - RNA, 22 nt, Homo sapiens
uuuugaacaaugaggguuugug

SEQ ID NO: 22307 - RNA, 18 nt, Homo sapiens
uuuuucauguuuugcuuu

SEQ ID NO: 22308 - RNA, 25 nt, Homo sapiens
accuggauauucugacuccuggccc

SEQ ID NO: 22309 - RNA, 22 nt, Homo sapiens
cuuauuuucagcuuuacagaca

SEQ ID NO: 22310 - RNA, 22 nt, Homo sapiens
gagccaagauugugccacugca

SEQ ID NO: 22311 - RNA, 17 nt, Homo sapiens
gccugggcaauaagcaa

SEQ ID NO: 22312 - RNA, 16 nt, Homo sapiens
uugaaacuggaaggca

SEQ ID NO: 22313 - RNA, 21 nt, Homo sapiens
caaauaaagacugauucuuua

SEQ ID NO: 22314 - RNA, 19 nt, Homo sapiens
gugcagaauugauaccaga

SEQ ID NO: 22315 - RNA, 24 nt, Homo sapiens
uuagguaggagugaugccacuuua

SEQ ID NO: 22316 - RNA, 18 nt, Homo sapiens
agaaaacaaaacuggcaa

SEQ ID NO: 22317 - RNA, 19 nt, Homo sapiens
auguacuuaugguaagcua

SEQ ID NO: 22318 - RNA, 21 nt, Homo sapiens
cagaguuggggcauugaggaa

SEQ ID NO: 22319 - RNA, 21 nt, Homo sapiens
cucuuucucucccuccuccuc

SEQ ID NO: 22320 - RNA, 22 nt, Homo sapiens
gaauucagugaauauucauuaa

SEQ ID NO: 22321 - RNA, 19 nt, Homo sapiens
ggaaugagccugcuguggc

SEQ ID NO: 22322 - RNA, 19 nt, Homo sapiens
cggacccacucucugccuu

SEQ ID NO: 22323 - RNA, 17 nt, Homo sapiens
acuguuuacaugugaua

SEQ ID NO: 22324 - RNA, 20 nt, Homo sapiens
agcaaguuuccuaagguaca

SEQ ID NO: 22325 - RNA, 17 nt, Homo sapiens
acuguuuacaugugaua

SEQ ID NO: 22326 - RNA, 20 nt, Homo sapiens
agcaaguuuccuaagguaca

SEQ ID NO: 22327 - RNA, 25 nt, Homo sapiens
cugcaucuuuaccuauauccauuua

SEQ ID NO: 22328 - RNA, 21 nt, Homo sapiens
acagcagcacgauuugugaca

SEQ ID NO: 22329 - RNA, 18 nt, Homo sapiens
caaacaccauguaaccug

SEQ ID NO: 22330 - RNA, 18 nt, Homo sapiens
caccccagcuccucacuc

SEQ ID NO: 22331 - RNA, 20 nt, Homo sapiens
cgcugaccacucccuccucc

SEQ ID NO: 22332 - RNA, 22 nt, Homo sapiens
gcuucugucucccccugccccu

SEQ ID NO: 22333 - RNA, 21 nt, Homo sapiens
uccugccagaaggccucugag

SEQ ID NO: 22334 - RNA, 24 nt, Homo sapiens
uucugucucccccugccccuucga

SEQ ID NO: 22335 - RNA, 19 nt, Homo sapiens
aagugagcaucugggcauu

SEQ ID NO: 22336 - RNA, 19 nt, Homo sapiens
cagcagccgccugcccuga

SEQ ID NO: 22337 - RNA, 21 nt, Homo sapiens
ccuaaacugacuggacggcug

SEQ ID NO: 22338 - RNA, 21 nt, Homo sapiens
cuuuuucauuuccuuaaguuu

SEQ ID NO: 22339 - RNA, 19 nt, Homo sapiens
gugguuugacucuccuuag

SEQ ID NO: 22340 - RNA, 19 nt, Homo sapiens
aagugagcaucugggcauu

SEQ ID NO: 22341 - RNA, 19 nt, Homo sapiens
cagcagccgccugcccuga

SEQ ID NO: 22342 - RNA, 21 nt, Homo sapiens
ccuaaacugacuggacggcug

SEQ ID NO: 22343 - RNA, 21 nt, Homo sapiens
cuuuuucauuuccuuaaguuu

SEQ ID NO: 22344 - RNA, 19 nt, Homo sapiens
gugguuugacucuccuuag

SEQ ID NO: 22345 - RNA, 20 nt, Homo sapiens
agcuuucagaaggaguucuc

SEQ ID NO: 22346 - RNA, 17 nt, Homo sapiens
ucaaccuuucuaccuua

SEQ ID NO: 22347 - RNA, 21 nt, Homo sapiens
ucuuguuccagcuaggcaaug

SEQ ID NO: 22348 - RNA, 19 nt, Homo sapiens
ugguguuuuucacaaagua

SEQ ID NO: 22349 - RNA, 17 nt, Homo sapiens
gcaggccaaguggcauc

SEQ ID NO: 22350 - RNA, 17 nt, Homo sapiens
uauuaggagauaucuau

SEQ ID NO: 22351 - RNA, 22 nt, Homo sapiens
gugucuugguuacccauuauuc

SEQ ID NO: 22352 - RNA, 19 nt, Homo sapiens
auuauccccagcugccaga

SEQ ID NO: 22353 - RNA, 24 nt, Homo sapiens
gccaccccucuucaguuccgguga

SEQ ID NO: 22354 - RNA, 23 nt, Homo sapiens
cccaagagauauuuauuaaacac

SEQ ID NO: 22355 - RNA, 19 nt, Homo sapiens
ggaugggccuuugagccug

SEQ ID NO: 22356 - RNA, 22 nt, Homo sapiens
aaaugucuguugaauuucugaa

SEQ ID NO: 22357 - RNA, 20 nt, Homo sapiens
ccaucuagcccuguccucca

SEQ ID NO: 22358 - RNA, 24 nt, Homo sapiens
acacagugaugccucacacccuga

SEQ ID NO: 22359 - RNA, 21 nt, Homo sapiens
accacacacagugaugccuca

SEQ ID NO: 22360 - RNA, 22 nt, Homo sapiens
ccuggcacacuggaccucacca

SEQ ID NO: 22361 - RNA, 24 nt, Homo sapiens
cuuugaccacacacagugaugccu

SEQ ID NO: 22362 - RNA, 20 nt, Homo sapiens
gcaaugcacugacugggcca

SEQ ID NO: 22363 - RNA, 16 nt, Homo sapiens
agaggaacccagugga

SEQ ID NO: 22364 - RNA, 22 nt, Homo sapiens
cagacucugcuuggguuugguu

SEQ ID NO: 22365 - RNA, 21 nt, Homo sapiens
ccaucugcuggucaggaaguc

SEQ ID NO: 22366 - RNA, 27 nt, Homo sapiens
ccugcagccucaguuuugaauucuuuu

SEQ ID NO: 22367 - RNA, 19 nt, Homo sapiens
cuguacuccagcccggguu

SEQ ID NO: 22368 - RNA, 22 nt, Homo sapiens
uuucuuuugcuguuuuguuuuu

SEQ ID NO: 22369 - RNA, 20 nt, Homo sapiens
agaaagcagcuuuuccaaga

SEQ ID NO: 22370 - RNA, 21 nt, Homo sapiens
agacgcaauuuggccuugcca

SEQ ID NO: 22371 - RNA, 24 nt, Homo sapiens
gaucagccaucuugaaccaaagca

SEQ ID NO: 22372 - RNA, 20 nt, Homo sapiens
ucuaccuucuacuuccgaga

SEQ ID NO: 22373 - RNA, 18 nt, Homo sapiens
uuggauaucuaaaagucu

SEQ ID NO: 22374 - RNA, 19 nt, Homo sapiens
accuccggcccuuugguuu

SEQ ID NO: 22375 - RNA, 20 nt, Homo sapiens
cuuuucccuccaccaugaag

SEQ ID NO: 22376 - RNA, 17 nt, Homo sapiens
agagccuucucaucucu

SEQ ID NO: 22377 - RNA, 22 nt, Homo sapiens
caacgacuguaacagguuacau

SEQ ID NO: 22378 - RNA, 21 nt, Homo sapiens
ccuccaaccacgggcuguuua

SEQ ID NO: 22379 - RNA, 18 nt, Homo sapiens
gcacaccucucccaucca

SEQ ID NO: 22380 - RNA, 20 nt, Homo sapiens
guuaagacaccaaaaacucc

SEQ ID NO: 22381 - RNA, 20 nt, Homo sapiens
ugagccaucucaugacccca

SEQ ID NO: 22382 - RNA, 19 nt, Homo sapiens
ugagguuuuucugccagug

SEQ ID NO: 22383 - RNA, 21 nt, Homo sapiens
uuucugaucauuugcagcugu

SEQ ID NO: 22384 - RNA, 21 nt, Homo sapiens
gccgccccuugggcuaaaagg

SEQ ID NO: 22385 - RNA, 21 nt, Homo sapiens
uuauaaauguaugucuucauu

SEQ ID NO: 22386 - RNA, 22 nt, Homo sapiens
aguacaaaaaaguuuaagauug

SEQ ID NO: 22387 - RNA, 21 nt, Homo sapiens
aguccuaaagugaagaagcca

SEQ ID NO: 22388 - RNA, 21 nt, Homo sapiens
aucuuuaucauuaaacaugaa

SEQ ID NO: 22389 - RNA, 20 nt, Homo sapiens
caaaaucuucacugaauauc

SEQ ID NO: 22390 - RNA, 21 nt, Homo sapiens
caacaccuccugauaguagua

SEQ ID NO: 22391 - RNA, 20 nt, Homo sapiens
cauugcauucaaaaucuuca

SEQ ID NO: 22392 - RNA, 19 nt, Homo sapiens
gcaucaaaauacaacuuca

SEQ ID NO: 22393 - RNA, 19 nt, Homo sapiens
gcauguaauauucugagca

SEQ ID NO: 22394 - RNA, 21 nt, Homo sapiens
uggagacuacaauuccuggca

SEQ ID NO: 22395 - RNA, 18 nt, Homo sapiens
uguuugcaaaggcaaugc

SEQ ID NO: 22396 - RNA, 18 nt, Homo sapiens
acugaagaaauguugaca

SEQ ID NO: 22397 - RNA, 18 nt, Homo sapiens
ggaagucuuccagaauac

SEQ ID NO: 22398 - RNA, 27 nt, Homo sapiens
cccaggaaugaaaauuaagauuuugac

SEQ ID NO: 22399 - RNA, 21 nt, Homo sapiens
ccugucagcuguuucuuacca

SEQ ID NO: 22400 - RNA, 22 nt, Homo sapiens
ugacaaaauaagaacuacccug

SEQ ID NO: 22401 - RNA, 24 nt, Homo sapiens
cugagguuuccugcagaccaugcc

SEQ ID NO: 22402 - RNA, 21 nt, Homo sapiens
cuguacucagaauggguucag

SEQ ID NO: 22403 - RNA, 20 nt, Homo sapiens
gccacgugaacauccggcga

SEQ ID NO: 22404 - RNA, 21 nt, Homo sapiens
guugcuuggucauagagccau

SEQ ID NO: 22405 - RNA, 16 nt, Homo sapiens
acagggaccugccacc

SEQ ID NO: 22406 - RNA, 21 nt, Homo sapiens
ccacggccccgcucugccccu

SEQ ID NO: 22407 - RNA, 19 nt, Homo sapiens
aucaaacccuuuccugcgc

SEQ ID NO: 22408 - RNA, 24 nt, Homo sapiens
caguugaauuuauggaaucuacca

SEQ ID NO: 22409 - RNA, 24 nt, Homo sapiens
ccagaguuuuuauguagcagggaa

SEQ ID NO: 22410 - RNA, 19 nt, Homo sapiens
ggugcaaaagcagaaaaua

SEQ ID NO: 22411 - RNA, 21 nt, Homo sapiens
aaccaaggacugagcacccuc

SEQ ID NO: 22412 - RNA, 19 nt, Homo sapiens
agcacccucuggauucuga

SEQ ID NO: 22413 - RNA, 19 nt, Homo sapiens
cgccaguccugcuaccucc

SEQ ID NO: 22414 - RNA, 18 nt, Homo sapiens
ucaucccaucauuuucca

SEQ ID NO: 22415 - RNA, 21 nt, Homo sapiens
aaccaaggacugagcacccuc

SEQ ID NO: 22416 - RNA, 19 nt, Homo sapiens
agcacccucuggauucuga

SEQ ID NO: 22417 - RNA, 19 nt, Homo sapiens
cgccaguccugcuaccucc

SEQ ID NO: 22418 - RNA, 18 nt, Homo sapiens
ucaucccaucauuuucca

SEQ ID NO: 22419 - RNA, 19 nt, Homo sapiens
aaguguccccccugagcuc

SEQ ID NO: 22420 - RNA, 19 nt, Homo sapiens
ccucuucuaguuaccacgg

SEQ ID NO: 22421 - RNA, 19 nt, Homo sapiens
cuccccacaaaaucaggga

SEQ ID NO: 22422 - RNA, 19 nt, Homo sapiens
cugcagcuccucugccuuu

SEQ ID NO: 22423 - RNA, 20 nt, Homo sapiens
gcugccuccucagcagccuc

SEQ ID NO: 22424 - RNA, 24 nt, Homo sapiens
uaacgcuccccaacagcuaccccu

SEQ ID NO: 22425 - RNA, 17 nt, Homo sapiens
ucacaaucaucuucucc

SEQ ID NO: 22426 - RNA, 16 nt, Homo sapiens
ucacgcucagcacaca

SEQ ID NO: 22427 - RNA, 17 nt, Homo sapiens
aggaucaaguccuaguu

SEQ ID NO: 22428 - RNA, 24 nt, Homo sapiens
caccaccaaaacugcuccuccucc

SEQ ID NO: 22429 - RNA, 22 nt, Homo sapiens
cccucucucacuccccacaucc

SEQ ID NO: 22430 - RNA, 22 nt, Homo sapiens
gcgcgauuucccgccgagcccg

SEQ ID NO: 22431 - RNA, 19 nt, Homo sapiens
ggugaaucaucccggcaga

SEQ ID NO: 22432 - RNA, 19 nt, Homo sapiens
guccuaguuguucagcaug

SEQ ID NO: 22433 - RNA, 18 nt, Homo sapiens
uuuuauacugacacaaga

SEQ ID NO: 22434 - RNA, 22 nt, Homo sapiens
aucucucagcccagcgagaugc

SEQ ID NO: 22435 - RNA, 23 nt, Homo sapiens
gagaacuuccaacaagccucaaa

SEQ ID NO: 22436 - RNA, 23 nt, Homo sapiens
gcacaggcccgcccucugccucc

SEQ ID NO: 22437 - RNA, 18 nt, Homo sapiens
uuauuacaagaucuuucc

SEQ ID NO: 22438 - RNA, 23 nt, Homo sapiens
aaggaagggguuggauugcaaua

SEQ ID NO: 22439 - RNA, 22 nt, Homo sapiens
agauucuagaucagaugcucca

SEQ ID NO: 22440 - RNA, 19 nt, Homo sapiens
auguugcccccgugagcca

SEQ ID NO: 22441 - RNA, 21 nt, Homo sapiens
caacccuccaccugguacucc

SEQ ID NO: 22442 - RNA, 18 nt, Homo sapiens
caagacucuagaguccaa

SEQ ID NO: 22443 - RNA, 19 nt, Homo sapiens
cuccccugccgcugugcca

SEQ ID NO: 22444 - RNA, 17 nt, Homo sapiens
cucccucucaggaucca

SEQ ID NO: 22445 - RNA, 24 nt, Homo sapiens
gggacagcccggcccugcccccuc

SEQ ID NO: 22446 - RNA, 19 nt, Homo sapiens
uagcaucaccaucuguaaa

SEQ ID NO: 22447 - RNA, 17 nt, Homo sapiens
cuauauuuucuuuuuca

SEQ ID NO: 22448 - RNA, 18 nt, Homo sapiens
aaugcugccuugacacac

SEQ ID NO: 22449 - RNA, 21 nt, Homo sapiens
cagacaccaccccccacccca

SEQ ID NO: 22450 - RNA, 19 nt, Homo sapiens
gccucuguccccgccucag

SEQ ID NO: 22451 - RNA, 22 nt, Homo sapiens
ugccuggacacacacacacaca

SEQ ID NO: 22452 - RNA, 21 nt, Homo sapiens
acauugccauacauuaacucu

SEQ ID NO: 22453 - RNA, 21 nt, Homo sapiens
gucuuauuucugguuuuuaga

SEQ ID NO: 22454 - RNA, 17 nt, Homo sapiens
gggauuggugauugaca

SEQ ID NO: 22455 - RNA, 18 nt, Homo sapiens
ccugcugagagaggccca

SEQ ID NO: 22456 - RNA, 18 nt, Homo sapiens
acuugcaaaaucaguuuu

SEQ ID NO: 22457 - RNA, 21 nt, Homo sapiens
agaacacauacacaacaacau

SEQ ID NO: 22458 - RNA, 21 nt, Homo sapiens
agcuggggaagcugccgccca

SEQ ID NO: 22459 - RNA, 23 nt, Homo sapiens
cucugguaggugagggccugagg

SEQ ID NO: 22460 - RNA, 21 nt, Homo sapiens
gggccccccgcccccuccucu

SEQ ID NO: 22461 - RNA, 24 nt, Homo sapiens
gugccuuggccacgggaggcugcu

SEQ ID NO: 22462 - RNA, 16 nt, Homo sapiens
uugauggugguugaaa

SEQ ID NO: 22463 - RNA, 21 nt, Homo sapiens
aaggcaccugucucccuucug

SEQ ID NO: 22464 - RNA, 24 nt, Homo sapiens
cuucuucauggcuuguuuacucuu

SEQ ID NO: 22465 - RNA, 15 nt, Homo sapiens
gcacaggaucugcaa

SEQ ID NO: 22466 - RNA, 21 nt, Homo sapiens
augucuagcggcgaacacuuc

SEQ ID NO: 22467 - RNA, 22 nt, Homo sapiens
ggacuaauccaucgaugacugg

SEQ ID NO: 22468 - RNA, 19 nt, Homo sapiens
ucgaugacuggaaaagagg

SEQ ID NO: 22469 - RNA, 18 nt, Homo sapiens
caucuggcuccugcuguc

SEQ ID NO: 22470 - RNA, 19 nt, Homo sapiens
ccuggagaccaucuggcuc

SEQ ID NO: 22471 - RNA, 19 nt, Homo sapiens
gcgucuuggcuauaaggau

SEQ ID NO: 22472 - RNA, 22 nt, Homo sapiens
gcuuggguugcuucccuguccc

SEQ ID NO: 22473 - RNA, 21 nt, Homo sapiens
auagaaaauaaacuuugccca

SEQ ID NO: 22474 - RNA, 21 nt, Homo sapiens
ccaagaugaaacauuuaccca

SEQ ID NO: 22475 - RNA, 20 nt, Homo sapiens
ccauccuccuccuucauacc

SEQ ID NO: 22476 - RNA, 19 nt, Homo sapiens
cccacaaaauguaaaccca

SEQ ID NO: 22477 - RNA, 18 nt, Homo sapiens
uucuccaucagcaaccag

SEQ ID NO: 22478 - RNA, 22 nt, Homo sapiens
uuucuccaucagcaaccaggga

SEQ ID NO: 22479 - RNA, 17 nt, Homo sapiens
acugaaauauaaucaga

SEQ ID NO: 22480 - RNA, 23 nt, Homo sapiens
auucaagugaagccauuugugug

SEQ ID NO: 22481 - RNA, 23 nt, Homo sapiens
ccucccaauccaaaacguaacug

SEQ ID NO: 22482 - RNA, 17 nt, Homo sapiens
ccaucccgggcacucca

SEQ ID NO: 22483 - RNA, 16 nt, Homo sapiens
cugggguuucaauuga

SEQ ID NO: 22484 - RNA, 23 nt, Homo sapiens
uuuugauagaagggaagaccugc

SEQ ID NO: 22485 - RNA, 18 nt, Homo sapiens
uguuauuuaggauuucug

SEQ ID NO: 22486 - RNA, 24 nt, Homo sapiens
cuacaaauuaauguugguugucaa

SEQ ID NO: 22487 - RNA, 19 nt, Homo sapiens
guggauggagagacauuug

SEQ ID NO: 22488 - RNA, 21 nt, Homo sapiens
uaaggaccuaaaagcacuuua

SEQ ID NO: 22489 - RNA, 17 nt, Homo sapiens
uacaugggaagagugcu

SEQ ID NO: 22490 - RNA, 18 nt, Homo sapiens
uaggacaccccaaguggu

SEQ ID NO: 22491 - RNA, 19 nt, Homo sapiens
uuaggaaccuguuucuuac

SEQ ID NO: 22492 - RNA, 18 nt, Homo sapiens
acuugaaagacugcaaua

SEQ ID NO: 22493 - RNA, 21 nt, Homo sapiens
gacugcaauagaaaacuccca

SEQ ID NO: 22494 - RNA, 18 nt, Homo sapiens
gcuaugggaaggcugcaa

SEQ ID NO: 22495 - RNA, 20 nt, Homo sapiens
gcuucucucuuggcccugcu

SEQ ID NO: 22496 - RNA, 16 nt, Homo sapiens
ugcuuugccuugcugc

SEQ ID NO: 22497 - RNA, 19 nt, Homo sapiens
uguagcuauuaaucugugg

SEQ ID NO: 22498 - RNA, 17 nt, Homo sapiens
gccuuagcacuaccacu

SEQ ID NO: 22499 - RNA, 24 nt, Homo sapiens
gccaggcgggcugcaggcaccuca

SEQ ID NO: 22500 - RNA, 19 nt, Homo sapiens
gccugcccuccccagagca

SEQ ID NO: 22501 - RNA, 21 nt, Homo sapiens
gagacuugcaguuagacucaa

SEQ ID NO: 22502 - RNA, 18 nt, Homo sapiens
auaauauguagccaguuu

SEQ ID NO: 22503 - RNA, 18 nt, Homo sapiens
cgcaaugugaacagguca

SEQ ID NO: 22504 - RNA, 19 nt, Homo sapiens
gaugaaauaaacacaacuc

SEQ ID NO: 22505 - RNA, 25 nt, Homo sapiens
ggagucccucccguccaccuccucu

SEQ ID NO: 22506 - RNA, 20 nt, Homo sapiens
ggcccuguuccagcaauaag

SEQ ID NO: 22507 - RNA, 19 nt, Homo sapiens
ugaacaucugggaauccug

SEQ ID NO: 22508 - RNA, 20 nt, Homo sapiens
accuucuagaccacaugaua

SEQ ID NO: 22509 - RNA, 18 nt, Homo sapiens
caucuuucgucugcacua

SEQ ID NO: 22510 - RNA, 20 nt, Homo sapiens
gaggggggggcagcaagaga

SEQ ID NO: 22511 - RNA, 19 nt, Homo sapiens
ucccucuccuuuggucaga

SEQ ID NO: 22512 - RNA, 20 nt, Homo sapiens
accuucuagaccacaugaua

SEQ ID NO: 22513 - RNA, 18 nt, Homo sapiens
caucuuucgucugcacua

SEQ ID NO: 22514 - RNA, 20 nt, Homo sapiens
gaggggggggcagcaagaga

SEQ ID NO: 22515 - RNA, 19 nt, Homo sapiens
ucccucuccuuuggucaga

SEQ ID NO: 22516 - RNA, 19 nt, Homo sapiens
aaggaacccggugugcaca

SEQ ID NO: 22517 - RNA, 20 nt, Homo sapiens
acaucuaacucaacugugaa

SEQ ID NO: 22518 - RNA, 21 nt, Homo sapiens
accacaggcccuuccccuucc

SEQ ID NO: 22519 - RNA, 23 nt, Homo sapiens
agaaguuuuaaacagggcuuuca

SEQ ID NO: 22520 - RNA, 20 nt, Homo sapiens
augacacuuccuugcuuugg

SEQ ID NO: 22521 - RNA, 19 nt, Homo sapiens
caccuuuugaagcagcaac

SEQ ID NO: 22522 - RNA, 21 nt, Homo sapiens
ccuuggugguugaacuuggag

SEQ ID NO: 22523 - RNA, 18 nt, Homo sapiens
ccuuuuugcaccgucacc

SEQ ID NO: 22524 - RNA, 20 nt, Homo sapiens
cucuagccuggggggcuugu

SEQ ID NO: 22525 - RNA, 18 nt, Homo sapiens
gguccucagcccugccac

SEQ ID NO: 22526 - RNA, 18 nt, Homo sapiens
uagauuguaaccccucca

SEQ ID NO: 22527 - RNA, 20 nt, Homo sapiens
accuucuagaccacaugaua

SEQ ID NO: 22528 - RNA, 18 nt, Homo sapiens
caucuuucgucugcacua

SEQ ID NO: 22529 - RNA, 20 nt, Homo sapiens
ccuucccuucauccccuucc

SEQ ID NO: 22530 - RNA, 19 nt, Homo sapiens
cuuggcagauggccuuuaa

SEQ ID NO: 22531 - RNA, 20 nt, Homo sapiens
gaggggggggcagcaagaga

SEQ ID NO: 22532 - RNA, 22 nt, Homo sapiens
uacagagugcagggcagagcuu

SEQ ID NO: 22533 - RNA, 19 nt, Homo sapiens
ucccucuccuuuggucaga

SEQ ID NO: 22534 - RNA, 21 nt, Homo sapiens
gaaaacauuacgucgacgggg

SEQ ID NO: 22535 - RNA, 20 nt, Homo sapiens
uagcguuucuacuggugcca

SEQ ID NO: 22536 - RNA, 18 nt, Homo sapiens
ggcggcggcagcuguagc

SEQ ID NO: 22537 - RNA, 23 nt, Homo sapiens
aaaucuuaagagaauccacauaa

SEQ ID NO: 22538 - RNA, 18 nt, Homo sapiens
agcccgcgccccgagccc

SEQ ID NO: 22539 - RNA, 20 nt, Homo sapiens
caguagccgccucugccgcc

SEQ ID NO: 22540 - RNA, 17 nt, Homo sapiens
ggagcuucccgaaccuc

SEQ ID NO: 22541 - RNA, 15 nt, Homo sapiens
uaaucauauauaugc

SEQ ID NO: 22542 - RNA, 23 nt, Homo sapiens
agcuguauaggaacaaucacaca

SEQ ID NO: 22543 - RNA, 18 nt, Homo sapiens
cuuuuucucccuuccuca

SEQ ID NO: 22544 - RNA, 22 nt, Homo sapiens
uggauccauaaaugugaaacug

SEQ ID NO: 22545 - RNA, 19 nt, Homo sapiens
cagcacaaggaauuucccu

SEQ ID NO: 22546 - RNA, 16 nt, Homo sapiens
aucaccuucugcuccu

SEQ ID NO: 22547 - RNA, 19 nt, Homo sapiens
caaaaaccuugcuuccuua

SEQ ID NO: 22548 - RNA, 20 nt, Homo sapiens
cacauggccaucugcuccuc

SEQ ID NO: 22549 - RNA, 23 nt, Homo sapiens
ccugaggcggcugcuugaaccuu

SEQ ID NO: 22550 - RNA, 24 nt, Homo sapiens
ccuuccgugguuaauuucuuccca

SEQ ID NO: 22551 - RNA, 25 nt, Homo sapiens
cuuuaacaaaaaccuugcuuccuua

SEQ ID NO: 22552 - RNA, 21 nt, Homo sapiens
gcuucucugccuacguccccu

SEQ ID NO: 22553 - RNA, 23 nt, Homo sapiens
ucuugggaccugggaagguuugc

SEQ ID NO: 22554 - RNA, 22 nt, Homo sapiens
uugcuguucucuguaucgugau

SEQ ID NO: 22555 - RNA, 21 nt, Homo sapiens
gaaggauccuucaccagcccc

SEQ ID NO: 22556 - RNA, 17 nt, Homo sapiens
guauaaagauucccucu

SEQ ID NO: 22557 - RNA, 22 nt, Homo sapiens
ucagguaaugggagucucucca

SEQ ID NO: 22558 - RNA, 21 nt, Homo sapiens
aaugugauaaguucuuaugcc

SEQ ID NO: 22559 - RNA, 16 nt, Homo sapiens
cauccacauuguuuua

SEQ ID NO: 22560 - RNA, 25 nt, Homo sapiens
uuuuuucacaaauuugucuugccuu

SEQ ID NO: 22561 - RNA, 20 nt, Homo sapiens
cauaugaaaaacaucacuua

SEQ ID NO: 22562 - RNA, 16 nt, Homo sapiens
ccacccuagugugaaa

SEQ ID NO: 22563 - RNA, 21 nt, Homo sapiens
uaaucuuuuccuccuucccuc

SEQ ID NO: 22564 - RNA, 20 nt, Homo sapiens
uaucucucauucucaccuca

SEQ ID NO: 22565 - RNA, 18 nt, Homo sapiens
uuauaugccagaggcacc

SEQ ID NO: 22566 - RNA, 21 nt, Homo sapiens
uucugggguaguaccugugga

SEQ ID NO: 22567 - RNA, 19 nt, Homo sapiens
ucaggugcaguggcccuac

SEQ ID NO: 22568 - RNA, 20 nt, Homo sapiens
agauucuucuggacaaaagu

SEQ ID NO: 22569 - RNA, 19 nt, Homo sapiens
ccagugccucccaggaguc

SEQ ID NO: 22570 - RNA, 21 nt, Homo sapiens
uucuggacaaaagucacauau

SEQ ID NO: 22571 - RNA, 19 nt, Homo sapiens
cauuuaaaauaucucaaug

SEQ ID NO: 22572 - RNA, 22 nt, Homo sapiens
cccagcgggcuaccugaaccaa

SEQ ID NO: 22573 - RNA, 23 nt, Homo sapiens
ucuauuuuagguaccguuucaca

SEQ ID NO: 22574 - RNA, 18 nt, Homo sapiens
uuuagguaccguuucaca

SEQ ID NO: 22575 - RNA, 22 nt, Homo sapiens
ccucuucauacuauuaaauuuu

SEQ ID NO: 22576 - RNA, 19 nt, Homo sapiens
guaaaauaucuaacaggug

SEQ ID NO: 22577 - RNA, 17 nt, Homo sapiens
ucaagugauucuccugc

SEQ ID NO: 22578 - RNA, 21 nt, Homo sapiens
aauaggugaaaauccugaaau

SEQ ID NO: 22579 - RNA, 22 nt, Homo sapiens
acuuggauuuuuaguucgguuu

SEQ ID NO: 22580 - RNA, 23 nt, Homo sapiens
agccuagcaccccacuuuccaca

SEQ ID NO: 22581 - RNA, 23 nt, Homo sapiens
auccugcuuuugaaauacauauu

SEQ ID NO: 22582 - RNA, 17 nt, Homo sapiens
cgaguggcgcccguaug

SEQ ID NO: 22583 - RNA, 16 nt, Homo sapiens
cucuuucacuugauug

SEQ ID NO: 22584 - RNA, 23 nt, Homo sapiens
cugcgccucggcguccccgagga

SEQ ID NO: 22585 - RNA, 18 nt, Homo sapiens
gcaagcaccacauguguu

SEQ ID NO: 22586 - RNA, 16 nt, Homo sapiens
gguagaauaauaguac

SEQ ID NO: 22587 - RNA, 18 nt, Homo sapiens
ucucccuuuuuuauauca

SEQ ID NO: 22588 - RNA, 19 nt, Homo sapiens
ugaagucucucuauaacau

SEQ ID NO: 22589 - RNA, 18 nt, Homo sapiens
gguuccaagucuucuucc

SEQ ID NO: 22590 - RNA, 19 nt, Homo sapiens
gugagacuguagugucagg

SEQ ID NO: 22591 - RNA, 19 nt, Homo sapiens
ucccagguugguuccaagu

SEQ ID NO: 22592 - RNA, 22 nt, Homo sapiens
cauuuuuaccagggcuugggga

SEQ ID NO: 22593 - RNA, 19 nt, Homo sapiens
uugccuuguuucauuaauc

SEQ ID NO: 22594 - RNA, 19 nt, Homo sapiens
ccaaagcauugaaagccga

SEQ ID NO: 22595 - RNA, 18 nt, Homo sapiens
uggaauaaugaugugaua

SEQ ID NO: 22596 - RNA, 22 nt, Homo sapiens
acggguugguuucaccuccuca

SEQ ID NO: 22597 - RNA, 21 nt, Homo sapiens
ccaagaauggaagcuugugag

SEQ ID NO: 22598 - RNA, 17 nt, Homo sapiens
ccaucucccagguucaa

SEQ ID NO: 22599 - RNA, 19 nt, Homo sapiens
ccuccuuagcaggugccgu

SEQ ID NO: 22600 - RNA, 23 nt, Homo sapiens
gcccuuacugugauuccuggcuu

SEQ ID NO: 22601 - RNA, 20 nt, Homo sapiens
ucugcuuuucacacugggug

SEQ ID NO: 22602 - RNA, 22 nt, Homo sapiens
cacuucaccccaucccauacca

SEQ ID NO: 22603 - RNA, 20 nt, Homo sapiens
ccuuccuugccccaucuucc

SEQ ID NO: 22604 - RNA, 20 nt, Homo sapiens
gccguuucagggguucuggg

SEQ ID NO: 22605 - RNA, 21 nt, Homo sapiens
uaagcuagggacacucaagug

SEQ ID NO: 22606 - RNA, 20 nt, Homo sapiens
cuugguauaaaaucacuuuu

SEQ ID NO: 22607 - RNA, 20 nt, Homo sapiens
uggucaggcuggucuugaac

SEQ ID NO: 22608 - RNA, 18 nt, Homo sapiens
uucaagugauucucaugc

SEQ ID NO: 22609 - RNA, 19 nt, Homo sapiens
agaaaagugacugcuccag

SEQ ID NO: 22610 - RNA, 21 nt, Homo sapiens
ggacauuugguucagaacgag

SEQ ID NO: 22611 - RNA, 24 nt, Homo sapiens
aaaaacauaguauuagugauacuc

SEQ ID NO: 22612 - RNA, 17 nt, Homo sapiens
agcgcuccauccccacu

SEQ ID NO: 22613 - RNA, 20 nt, Homo sapiens
gacugguaccucuuaaucag

SEQ ID NO: 22614 - RNA, 21 nt, Homo sapiens
gguaauuguugaugaacagca

SEQ ID NO: 22615 - RNA, 18 nt, Homo sapiens
gggacaccaaggaucucc

SEQ ID NO: 22616 - RNA, 20 nt, Homo sapiens
aaugaagacaggaauuuugu

SEQ ID NO: 22617 - RNA, 21 nt, Homo sapiens
agucuuucuucagcucacuug

SEQ ID NO: 22618 - RNA, 21 nt, Homo sapiens
auuugaguucucgucuguccc

SEQ ID NO: 22619 - RNA, 17 nt, Homo sapiens
uccagaaauuccugcag

SEQ ID NO: 22620 - RNA, 21 nt, Homo sapiens
gggcaauccaccacuuccucu

SEQ ID NO: 22621 - RNA, 19 nt, Homo sapiens
uccuucugcuucugugacg

SEQ ID NO: 22622 - RNA, 18 nt, Homo sapiens
uucuccugccucagccuu

SEQ ID NO: 22623 - RNA, 20 nt, Homo sapiens
caccugccagcgggcucggc

SEQ ID NO: 22624 - RNA, 20 nt, Homo sapiens
cuccaugucagacacacgag

SEQ ID NO: 22625 - RNA, 17 nt, Homo sapiens
guguggccgucagggug

SEQ ID NO: 22626 - RNA, 18 nt, Homo sapiens
ugcagcgcccgccugcca

SEQ ID NO: 22627 - RNA, 21 nt, Homo sapiens
aucugugggacugucugggcc

SEQ ID NO: 22628 - RNA, 22 nt, Homo sapiens
ccuggguaagacugaaagcauu

SEQ ID NO: 22629 - RNA, 20 nt, Homo sapiens
cuuuaaggcuuuuuaauuuu

SEQ ID NO: 22630 - RNA, 22 nt, Homo sapiens
gacugugcaaagggcuuagcua

SEQ ID NO: 22631 - RNA, 25 nt, Homo sapiens
uaagugcuuguucuagcauaaauua

SEQ ID NO: 22632 - RNA, 19 nt, Homo sapiens
ugccuacuucaccaucucu

SEQ ID NO: 22633 - RNA, 19 nt, Homo sapiens
guccgccucccagguucaa

SEQ ID NO: 22634 - RNA, 18 nt, Homo sapiens
uucaagcgauucucaugc

SEQ ID NO: 22635 - RNA, 23 nt, Homo sapiens
gccugggcgccuccgccgggcuc

SEQ ID NO: 22636 - RNA, 18 nt, Homo sapiens
ccaguuauucuccaucuc

SEQ ID NO: 22637 - RNA, 22 nt, Homo sapiens
ccuugaagucuggacucuuaaa

SEQ ID NO: 22638 - RNA, 18 nt, Homo sapiens
gugcacuuuauuucuauu

SEQ ID NO: 22639 - RNA, 19 nt, Homo sapiens
cacauguccaugcauucca

SEQ ID NO: 22640 - RNA, 24 nt, Homo sapiens
ggcccacaugcaccucagguucaa

SEQ ID NO: 22641 - RNA, 17 nt, Homo sapiens
cuauugagcuugcaggg

SEQ ID NO: 22642 - RNA, 18 nt, Homo sapiens
agauguuauuuuauguca

SEQ ID NO: 22643 - RNA, 22 nt, Homo sapiens
ccauguguuuguauccauguuu

SEQ ID NO: 22644 - RNA, 19 nt, Homo sapiens
ccauugauucuccuacauu

SEQ ID NO: 22645 - RNA, 18 nt, Homo sapiens
aaauaguggcauugcaug

SEQ ID NO: 22646 - RNA, 22 nt, Homo sapiens
agccaccacacccagccaguga

SEQ ID NO: 22647 - RNA, 21 nt, Homo sapiens
gggcccuuacccagacagaca

SEQ ID NO: 22648 - RNA, 21 nt, Homo sapiens
aaaccuuuagucgaagcuucu

SEQ ID NO: 22649 - RNA, 22 nt, Homo sapiens
aauguggggaaagcuucaauca

SEQ ID NO: 22650 - RNA, 19 nt, Homo sapiens
acgcuacacacccacauga

SEQ ID NO: 22651 - RNA, 18 nt, Homo sapiens
acuggugaacguucaccu

SEQ ID NO: 22652 - RNA, 18 nt, Homo sapiens
ggccacacacuccugcuu

SEQ ID NO: 22653 - RNA, 18 nt, Homo sapiens
ucacaccuagaacacugu

SEQ ID NO: 22654 - RNA, 18 nt, Homo sapiens
cccugcccacccucccuc

SEQ ID NO: 22655 - RNA, 22 nt, Homo sapiens
ugggugggcaccugagagauua

SEQ ID NO: 22656 - RNA, 19 nt, Homo sapiens
uuccuugccacuggucuca

SEQ ID NO: 22657 - RNA, 17 nt, Homo sapiens
aaaaacaaacaaacaaa

SEQ ID NO: 22658 - RNA, 18 nt, Homo sapiens
cuacaccucccuggaggc

SEQ ID NO: 22659 - RNA, 22 nt, Homo sapiens
uccugaaauuugccaucugaca

SEQ ID NO: 22660 - RNA, 18 nt, Homo sapiens
uguccuuugcaccacuga

SEQ ID NO: 22661 - RNA, 24 nt, Homo sapiens
auuugaaagcaggcagccuggcuc

SEQ ID NO: 22662 - RNA, 19 nt, Homo sapiens
acucaucauggaaacaaca

SEQ ID NO: 22663 - RNA, 19 nt, Homo sapiens
caccaccuccacuuccaga

SEQ ID NO: 22664 - RNA, 22 nt, Homo sapiens
uauuuguaaaaacaauuuuugg

SEQ ID NO: 22665 - RNA, 17 nt, Homo sapiens
uccuacucaucauggaa

SEQ ID NO: 22666 - RNA, 16 nt, Homo sapiens
cccuguuugacuaagu

SEQ ID NO: 22667 - RNA, 18 nt, Homo sapiens
guggucaagagaguucuc

SEQ ID NO: 22668 - RNA, 18 nt, Homo sapiens
aaugucaaugaacaagca

SEQ ID NO: 22669 - RNA, 19 nt, Homo sapiens
cuggggaccagcuuggcuc

SEQ ID NO: 22670 - RNA, 22 nt, Homo sapiens
ggacgcguccgacggcggccgg

SEQ ID NO: 22671 - RNA, 21 nt, Homo sapiens
ggccggacgcugagguggucg

SEQ ID NO: 22672 - RNA, 21 nt, Homo sapiens
agacuugaaggugucaugccc

SEQ ID NO: 22673 - RNA, 19 nt, Homo sapiens
caugcccggugugugcagg

SEQ ID NO: 22674 - RNA, 21 nt, Homo sapiens
ccacacagugagaacuguagc

SEQ ID NO: 22675 - RNA, 21 nt, Homo sapiens
cuccccuccaccccugccucu

SEQ ID NO: 22676 - RNA, 19 nt, Homo sapiens
cuccuccaccccugccucu

SEQ ID NO: 22677 - RNA, 19 nt, Homo sapiens
cuccuccaccccugccucu

SEQ ID NO: 22678 - RNA, 17 nt, Homo sapiens
gagagccccgccuccuc

SEQ ID NO: 22679 - RNA, 22 nt, Homo sapiens
gccucuccuccaccccugccuc

SEQ ID NO: 22680 - RNA, 21 nt, Homo sapiens
accucaaugaucgucuguuuc

SEQ ID NO: 22681 - RNA, 15 nt, Homo sapiens
ucaauaauucaccag

SEQ ID NO: 22682 - RNA, 18 nt, Homo sapiens
uggguggaucaccugagg

SEQ ID NO: 22683 - RNA, 28 nt, Homo sapiens
uuuucaagucauuaagaguguuuguuua

SEQ ID NO: 22684 - RNA, 17 nt, Homo sapiens
aggauuaagaauuuugu

SEQ ID NO: 22685 - RNA, 19 nt, Homo sapiens
auguaaaucuauuguauua

SEQ ID NO: 22686 - RNA, 24 nt, Homo sapiens
caguaccaaucuugaguuucuuuu

SEQ ID NO: 22687 - RNA, 19 nt, Homo sapiens
ugcgacccucucggcccgg

SEQ ID NO: 22688 - RNA, 20 nt, Homo sapiens
ugcucggggugaaccauucu

SEQ ID NO: 22689 - RNA, 20 nt, Homo sapiens
uugaguuucuuuuucugucc

SEQ ID NO: 22690 - RNA, 21 nt, Homo sapiens
uuucuggucuacuuugacuuu

SEQ ID NO: 22691 - RNA, 20 nt, Homo sapiens
caagaauagguccuuggcca

SEQ ID NO: 22692 - RNA, 22 nt, Homo sapiens
cauguuuguuucgaaugucuga

SEQ ID NO: 22693 - RNA, 23 nt, Homo sapiens
guaugcccaugucuaucauaccu

SEQ ID NO: 22694 - RNA, 21 nt, Homo sapiens
uugcaaucauugcagcuucuu

SEQ ID NO: 22695 - RNA, 17 nt, Homo sapiens
uuuuccaucuccauccu

SEQ ID NO: 22696 - RNA, 18 nt, Homo sapiens
gaaaacaauguauuugaa

SEQ ID NO: 22697 - RNA, 22 nt, Homo sapiens
acaaaggauuugcauuacguca

SEQ ID NO: 22698 - RNA, 17 nt, Homo sapiens
gagauuuauaugcugua

SEQ ID NO: 22699 - RNA, 23 nt, Homo sapiens
uaaguuuuuggaucugcuacuga

SEQ ID NO: 22700 - RNA, 20 nt, Homo sapiens
uccugcucuccggaccccca

SEQ ID NO: 22701 - RNA, 20 nt, Homo sapiens
uaggaaauuguaucagccuc

SEQ ID NO: 22702 - RNA, 21 nt, Homo sapiens
uaggaaauuguaucagccucc

SEQ ID NO: 22703 - RNA, 25 nt, Homo sapiens
cagagcucuugggagcagaaccuua

SEQ ID NO: 22704 - RNA, 22 nt, Homo sapiens
cccagaagaacucucucaaaga

SEQ ID NO: 22705 - RNA, 16 nt, Homo sapiens
gggaggggaauugcca

SEQ ID NO: 22706 - RNA, 19 nt, Homo sapiens
ucuucuaaaugcugauuca

SEQ ID NO: 22707 - RNA, 20 nt, Homo sapiens
ugguuaaaaaaaacagauua

SEQ ID NO: 22708 - RNA, 23 nt, Homo sapiens
gcuucuccucuggcaucuguuag

SEQ ID NO: 22709 - RNA, 19 nt, Homo sapiens
aaauguaauaaaauuuaug

SEQ ID NO: 22710 - RNA, 21 nt, Homo sapiens
acgagguuccccucccaccuc

SEQ ID NO: 22711 - RNA, 16 nt, Homo sapiens
agcuauuucuuccccc

SEQ ID NO: 22712 - RNA, 18 nt, Homo sapiens
aacucuaugguaggauca

SEQ ID NO: 22713 - RNA, 21 nt, Homo sapiens
caaagcccaacaaugaucuca

SEQ ID NO: 22714 - RNA, 19 nt, Homo sapiens
acuuuguuuuacugucuua

SEQ ID NO: 22715 - RNA, 17 nt, Homo sapiens
cuccagcugggaucaca

SEQ ID NO: 22716 - RNA, 22 nt, Homo sapiens
cuggccucugcugauccuccca

SEQ ID NO: 22717 - RNA, 17 nt, Homo sapiens
gaccccuuaccacugcu

SEQ ID NO: 22718 - RNA, 19 nt, Homo sapiens
uccucccaggcuuccgugu

SEQ ID NO: 22719 - RNA, 19 nt, Homo sapiens
ucugguugaugccugugaa

SEQ ID NO: 22720 - RNA, 18 nt, Homo sapiens
ugguugaugccugugaac

SEQ ID NO: 22721 - RNA, 22 nt, Homo sapiens
agaaauauaucucuaucucucu

SEQ ID NO: 22722 - RNA, 19 nt, Homo sapiens
cucuccuuccuuccaccug

SEQ ID NO: 22723 - RNA, 18 nt, Homo sapiens
guugggcugcggugcugc

SEQ ID NO: 22724 - RNA, 18 nt, Homo sapiens
ucuagaaucuggcacuuu

SEQ ID NO: 22725 - RNA, 18 nt, Homo sapiens
ugggucuagaaucuggca

SEQ ID NO: 22726 - RNA, 21 nt, Homo sapiens
uguugguauucagcugugaug

SEQ ID NO: 22727 - RNA, 21 nt, Homo sapiens
uucuccugcuccuuguuuucc

SEQ ID NO: 22728 - RNA, 22 nt, Homo sapiens
agugcacaguggccccaucaua

SEQ ID NO: 22729 - RNA, 22 nt, Homo sapiens
auacuucuguuuccaucugcug

SEQ ID NO: 22730 - RNA, 20 nt, Homo sapiens
caaacacccacauaccuggc

SEQ ID NO: 22731 - RNA, 19 nt, Homo sapiens
gccugcucccucacccagg

SEQ ID NO: 22732 - RNA, 20 nt, Homo sapiens
uucugccucuuaagccugcu

SEQ ID NO: 22733 - RNA, 21 nt, Homo sapiens
aaugugauaaguucuuaugcc

SEQ ID NO: 22734 - RNA, 16 nt, Homo sapiens
cauccacauuguuuua

SEQ ID NO: 22735 - RNA, 25 nt, Homo sapiens
uuuuuucacaaauuugucuugccuu

SEQ ID NO: 22736 - RNA, 18 nt, Homo sapiens
aggugcugacaaagauga

SEQ ID NO: 22737 - RNA, 24 nt, Homo sapiens
cccaagguuuccaagauaaaacca

SEQ ID NO: 22738 - RNA, 24 nt, Homo sapiens
gccucagaccugacugccugguuc

SEQ ID NO: 22739 - RNA, 21 nt, Homo sapiens
uaucugccuuagacaaaggcu

SEQ ID NO: 22740 - RNA, 18 nt, Homo sapiens
aaacacagugagccggga

SEQ ID NO: 22741 - RNA, 23 nt, Homo sapiens
ccucccccuguaauaccuccucc

SEQ ID NO: 22742 - RNA, 20 nt, Homo sapiens
uccucccccuguaauaccuc

SEQ ID NO: 22743 - RNA, 18 nt, Homo sapiens
uuccugugacacucugaa

SEQ ID NO: 22744 - RNA, 17 nt, Homo sapiens
agagaggugugccaggu

SEQ ID NO: 22745 - RNA, 18 nt, Homo sapiens
ucagaugcucgccuguac

SEQ ID NO: 22746 - RNA, 22 nt, Homo sapiens
cagucucgcgggauuucccccu

SEQ ID NO: 22747 - RNA, 17 nt, Homo sapiens
accacccccaugcacac

SEQ ID NO: 22748 - RNA, 21 nt, Homo sapiens
cgcaggccugagcagcgggga

SEQ ID NO: 22749 - RNA, 24 nt, Homo sapiens
ccagagauugcccaaggacuggac

SEQ ID NO: 22750 - RNA, 23 nt, Homo sapiens
cccgccccccaccaccccacucc

SEQ ID NO: 22751 - RNA, 22 nt, Homo sapiens
ugcggcccguggcaugagguug

SEQ ID NO: 22752 - RNA, 19 nt, Homo sapiens
acccccagaccugcuccua

SEQ ID NO: 22753 - RNA, 20 nt, Homo sapiens
acccuaaaaaaccugccugu

SEQ ID NO: 22754 - RNA, 18 nt, Homo sapiens
ccuggugacagucugugg

SEQ ID NO: 22755 - RNA, 16 nt, Homo sapiens
ccuuaccagucgugca

SEQ ID NO: 22756 - RNA, 19 nt, Homo sapiens
gcaggagcccuccuacccg

SEQ ID NO: 22757 - RNA, 21 nt, Homo sapiens
cccuccccggcucuccuccca

SEQ ID NO: 22758 - RNA, 20 nt, Homo sapiens
gccagcagggguucuggaga

SEQ ID NO: 22759 - RNA, 19 nt, Homo sapiens
ccggacgacagauauuaca

SEQ ID NO: 22760 - RNA, 20 nt, Homo sapiens
gggccaggcugggccagguc

SEQ ID NO: 22761 - RNA, 19 nt, Homo sapiens
ccucaguccauccuuggua

SEQ ID NO: 22762 - RNA, 19 nt, Homo sapiens
ucucguaauucacaacccu

SEQ ID NO: 22763 - RNA, 19 nt, Homo sapiens
aaggaacccggugugcaca

SEQ ID NO: 22764 - RNA, 20 nt, Homo sapiens
acaucuaacucaacugugaa

SEQ ID NO: 22765 - RNA, 21 nt, Homo sapiens
accacaggcccuuccccuucc

SEQ ID NO: 22766 - RNA, 23 nt, Homo sapiens
agaaguuuuaaacagggcuuuca

SEQ ID NO: 22767 - RNA, 20 nt, Homo sapiens
augacacuuccuugcuuugg

SEQ ID NO: 22768 - RNA, 19 nt, Homo sapiens
caccuuuugaagcagcaac

SEQ ID NO: 22769 - RNA, 21 nt, Homo sapiens
ccuuggugguugaacuuggag

SEQ ID NO: 22770 - RNA, 18 nt, Homo sapiens
ccuuuuugcaccgucacc

SEQ ID NO: 22771 - RNA, 20 nt, Homo sapiens
cucuagccuggggggcuugu

SEQ ID NO: 22772 - RNA, 18 nt, Homo sapiens
gguccucagcccugccac

SEQ ID NO: 22773 - RNA, 18 nt, Homo sapiens
uagauuguaaccccucca

SEQ ID NO: 22774 - RNA, 21 nt, Homo sapiens
cacuauaaaacuauuaacaua

SEQ ID NO: 22775 - RNA, 19 nt, Homo sapiens
cugcaagcuccgccuccca

SEQ ID NO: 22776 - RNA, 24 nt, Homo sapiens
uucuccugccucagccaaaccuuu

SEQ ID NO: 22777 - RNA, 21 nt, Homo sapiens
uuguagacagguagcaaaaua

SEQ ID NO: 22778 - RNA, 23 nt, Homo sapiens
gacugaaaaacuguugguucauc

SEQ ID NO: 22779 - RNA, 16 nt, Homo sapiens
gagguucuuucccaca

SEQ ID NO: 22780 - RNA, 18 nt, Homo sapiens
guagugggaaagauacau

SEQ ID NO: 22781 - RNA, 20 nt, Homo sapiens
uaacagucugcaucaucauc

SEQ ID NO: 22782 - RNA, 22 nt, Homo sapiens
uagguggaaagagaaaugaugu

SEQ ID NO: 22783 - RNA, 19 nt, Homo sapiens
cuggauacacuuuuccaca

SEQ ID NO: 22784 - RNA, 19 nt, Homo sapiens
ugaagcaauuuggauuuaa

SEQ ID NO: 22785 - RNA, 21 nt, Homo sapiens
aggauuuccacaucuugguga

SEQ ID NO: 22786 - RNA, 23 nt, Homo sapiens
gccacuccugggggcugugggga

SEQ ID NO: 22787 - RNA, 20 nt, Homo sapiens
gugcaacaaagauuccauac

SEQ ID NO: 22788 - RNA, 21 nt, Homo sapiens
uagguggauucugauucacug

SEQ ID NO: 22789 - RNA, 20 nt, Homo sapiens
aaagugcccccucccguuca

SEQ ID NO: 22790 - RNA, 22 nt, Homo sapiens
aaggucauaaccucaccagcca

SEQ ID NO: 22791 - RNA, 18 nt, Homo sapiens
agaaggggacacagaucc

SEQ ID NO: 22792 - RNA, 21 nt, Homo sapiens
cccacaagaccaagcaucaca

SEQ ID NO: 22793 - RNA, 21 nt, Homo sapiens
gcaaaggucauaaccucacca

SEQ ID NO: 22794 - RNA, 27 nt, Homo sapiens
gcgccggcagcggccgcgguggguucu

SEQ ID NO: 22795 - RNA, 22 nt, Homo sapiens
acagcgcauucuucuguagaca

SEQ ID NO: 22796 - RNA, 20 nt, Homo sapiens
uaggaaguaucauguaauca

SEQ ID NO: 22797 - RNA, 19 nt, Homo sapiens
agaagcccagccccaagga

SEQ ID NO: 22798 - RNA, 21 nt, Homo sapiens
ccagccccagcacagacccaa

SEQ ID NO: 22799 - RNA, 23 nt, Homo sapiens
ccccgaggccuucgucguccuca

SEQ ID NO: 22800 - RNA, 21 nt, Homo sapiens
cucuaucccuccucugccucu

SEQ ID NO: 22801 - RNA, 18 nt, Homo sapiens
uuccccuacccuaagcug

SEQ ID NO: 22802 - RNA, 21 nt, Homo sapiens
auuugaacacacuguacaaua

SEQ ID NO: 22803 - RNA, 21 nt, Homo sapiens
uggaagagauucacgauuuca

SEQ ID NO: 22804 - RNA, 21 nt, Homo sapiens
aagguucaagugauucuccug

SEQ ID NO: 22805 - RNA, 23 nt, Homo sapiens
ccagcggaaggagcugugccccg

SEQ ID NO: 22806 - RNA, 18 nt, Homo sapiens
cccaaguguccagccucu

SEQ ID NO: 22807 - RNA, 20 nt, Homo sapiens
cccacucagcacucugccag

SEQ ID NO: 22808 - RNA, 21 nt, Homo sapiens
ccccacucagcacucugccag

SEQ ID NO: 22809 - RNA, 18 nt, Homo sapiens
cuucuccuccucccccuc

SEQ ID NO: 22810 - RNA, 18 nt, Homo sapiens
cuugggcugaccugaccc

SEQ ID NO: 22811 - RNA, 18 nt, Homo sapiens
gggauggacggcuucggc

SEQ ID NO: 22812 - RNA, 17 nt, Homo sapiens
ucaagugauucuccugc

SEQ ID NO: 22813 - RNA, 18 nt, Homo sapiens
uuuuggugaaggaucugc

SEQ ID NO: 22814 - RNA, 21 nt, Homo sapiens
gacggcggcggcggcgacggc

SEQ ID NO: 22815 - RNA, 19 nt, Homo sapiens
gauggcggcggugacugug

SEQ ID NO: 22816 - RNA, 19 nt, Homo sapiens
uuuccacaagaggaaaugu

SEQ ID NO: 22817 - RNA, 21 nt, Homo sapiens
ccaccggacagagaacuuucc

SEQ ID NO: 22818 - RNA, 17 nt, Homo sapiens
guccccgcugcugccac

SEQ ID NO: 22819 - RNA, 16 nt, Homo sapiens
aaccuuuuccguugcu

SEQ ID NO: 22820 - RNA, 19 nt, Homo sapiens
acugguggggaccugggac

SEQ ID NO: 22821 - RNA, 20 nt, Homo sapiens
cccagacccggaaccagccc

SEQ ID NO: 22822 - RNA, 19 nt, Homo sapiens
gccccgccccgccuggcca

SEQ ID NO: 22823 - RNA, 20 nt, Homo sapiens
caagaagacaacuugagcca

SEQ ID NO: 22824 - RNA, 22 nt, Homo sapiens
cagaaaaaaaaaugccugguca

SEQ ID NO: 22825 - RNA, 20 nt, Homo sapiens
ccaccgccacccagcaguca

SEQ ID NO: 22826 - RNA, 18 nt, Homo sapiens
cgcgcggcgcggggcgcg

SEQ ID NO: 22827 - RNA, 19 nt, Homo sapiens
gccacccagcagucagaga

SEQ ID NO: 22828 - RNA, 16 nt, Homo sapiens
aauaacugcaguuuau

SEQ ID NO: 22829 - RNA, 21 nt, Homo sapiens
cacuaauuuuucacugugcca

SEQ ID NO: 22830 - RNA, 21 nt, Homo sapiens
cucugauuuggacuucgcuuu

SEQ ID NO: 22831 - RNA, 19 nt, Homo sapiens
cuucaagagggucugugag

SEQ ID NO: 22832 - RNA, 22 nt, Homo sapiens
gagccaagaucauacuacugca

SEQ ID NO: 22833 - RNA, 19 nt, Homo sapiens
gggcagggggacuucacca

SEQ ID NO: 22834 - RNA, 17 nt, Homo sapiens
uauggccccacaagcuc

SEQ ID NO: 22835 - RNA, 17 nt, Homo sapiens
ugaagauacagauccua

SEQ ID NO: 22836 - RNA, 19 nt, Homo sapiens
ugauuuggacuucgcuuug

SEQ ID NO: 22837 - RNA, 18 nt, Homo sapiens
ugguauaaagcugugaac

SEQ ID NO: 22838 - RNA, 26 nt, Homo sapiens
uucuuaacaauuaugugcagugugug

SEQ ID NO: 22839 - RNA, 21 nt, Homo sapiens
aaacaaaauggugccacuuug

SEQ ID NO: 22840 - RNA, 20 nt, Homo sapiens
uuguggaucagacucuacac

SEQ ID NO: 22841 - RNA, 19 nt, Homo sapiens
cugcugggcaguggcguuc

SEQ ID NO: 22842 - RNA, 18 nt, Homo sapiens
cugggcgggggcgcgcga

SEQ ID NO: 22843 - RNA, 22 nt, Homo sapiens
ggagaugcugucgggccgcggc

SEQ ID NO: 22844 - RNA, 17 nt, Homo sapiens
gugagaagaaaccagaa

SEQ ID NO: 22845 - RNA, 20 nt, Homo sapiens
acuguaacauuccaacaucu

SEQ ID NO: 22846 - RNA, 26 nt, Homo sapiens
aguccauccuucaaaugaccacucca

SEQ ID NO: 22847 - RNA, 20 nt, Homo sapiens
gugguuuuagacacgcuuuc

SEQ ID NO: 22848 - RNA, 20 nt, Homo sapiens
uaagauucuuugaucccgac

SEQ ID NO: 22849 - RNA, 20 nt, Homo sapiens
cagaaaggugaccaagacag

SEQ ID NO: 22850 - RNA, 25 nt, Homo sapiens
cucuucagcuuugcagugguuugug

SEQ ID NO: 22851 - RNA, 16 nt, Homo sapiens
gaaggugaccaagaca

SEQ ID NO: 22852 - RNA, 20 nt, Homo sapiens
gugugaacacugcuuggcug

SEQ ID NO: 22853 - RNA, 19 nt, Homo sapiens
uccccaggagaccacgcug

SEQ ID NO: 22854 - RNA, 20 nt, Homo sapiens
uggugcccugacagggacug

SEQ ID NO: 22855 - RNA, 21 nt, Homo sapiens
ccuaaguagagagccauugcu

SEQ ID NO: 22856 - RNA, 16 nt, Homo sapiens
ugggauggcucugcuu

SEQ ID NO: 22857 - RNA, 18 nt, Homo sapiens
gcuucagaaauccaugga

SEQ ID NO: 22858 - RNA, 17 nt, Homo sapiens
ugcagguccagcuucuu

SEQ ID NO: 22859 - RNA, 16 nt, Homo sapiens
uugcaaaaccuuuucu

SEQ ID NO: 22860 - RNA, 21 nt, Homo sapiens
acggagaaaguuuacgccgac

SEQ ID NO: 22861 - RNA, 18 nt, Homo sapiens
auuuuguuaaaaaucaaa

SEQ ID NO: 22862 - RNA, 19 nt, Homo sapiens
ggccgagucagaucacuau

SEQ ID NO: 22863 - RNA, 19 nt, Homo sapiens
agguugagcgcauugagaa

SEQ ID NO: 22864 - RNA, 23 nt, Homo sapiens
caaacacgaauggggauaucugu

SEQ ID NO: 22865 - RNA, 16 nt, Homo sapiens
cuggagcuguuuggcc

SEQ ID NO: 22866 - RNA, 22 nt, Homo sapiens
ggauggcagcgggaccggcggc

SEQ ID NO: 22867 - RNA, 20 nt, Homo sapiens
cacaccggugacgccgacgg

SEQ ID NO: 22868 - RNA, 24 nt, Homo sapiens
cgaaagccugcucaccagccgcca

SEQ ID NO: 22869 - RNA, 22 nt, Homo sapiens
gagcgccuccaggccagcaucu

SEQ ID NO: 22870 - RNA, 19 nt, Homo sapiens
guuuaaucaaaaugcaaug

SEQ ID NO: 22871 - RNA, 18 nt, Homo sapiens
cauccacugaaacauccu

SEQ ID NO: 22872 - RNA, 23 nt, Homo sapiens
ccauccucucaagccccaggacc

SEQ ID NO: 22873 - RNA, 17 nt, Homo sapiens
ucugucucaggccagau

SEQ ID NO: 22874 - RNA, 18 nt, Homo sapiens
ugcuauguaugacucuga

SEQ ID NO: 22875 - RNA, 22 nt, Homo sapiens
caaauuaaagaaggaugucuua

SEQ ID NO: 22876 - RNA, 18 nt, Homo sapiens
ccugcaaccuccaccucc

SEQ ID NO: 22877 - RNA, 19 nt, Homo sapiens
cugcaaccuccaccuccca

SEQ ID NO: 22878 - RNA, 21 nt, Homo sapiens
gcccugguacuugcugucaua

SEQ ID NO: 22879 - RNA, 18 nt, Homo sapiens
uccaccucccagguucaa

SEQ ID NO: 22880 - RNA, 18 nt, Homo sapiens
aaaaccuugaucugugaa

SEQ ID NO: 22881 - RNA, 16 nt, Homo sapiens
cccagccccgcgcagc

SEQ ID NO: 22882 - RNA, 22 nt, Homo sapiens
acagcuggagucaaacaacuua

SEQ ID NO: 22883 - RNA, 18 nt, Homo sapiens
gaaggcggcggcggcggc

SEQ ID NO: 22884 - RNA, 17 nt, Homo sapiens
ggggucacggcgccuga

SEQ ID NO: 22885 - RNA, 20 nt, Homo sapiens
ucgagcguguguuuuuuuaa

SEQ ID NO: 22886 - RNA, 22 nt, Homo sapiens
accacaauccuccuccuccucu

SEQ ID NO: 22887 - RNA, 18 nt, Homo sapiens
caauccuccuccuccucu

SEQ ID NO: 22888 - RNA, 18 nt, Homo sapiens
caauccuccuccuccucu

SEQ ID NO: 22889 - RNA, 17 nt, Homo sapiens
uccagagauggccccag

SEQ ID NO: 22890 - RNA, 18 nt, Homo sapiens
uguggacgucuuuggaau

SEQ ID NO: 22891 - RNA, 22 nt, Homo sapiens
ccuucccaucuauugccuucca

SEQ ID NO: 22892 - RNA, 19 nt, Homo sapiens
uccagcuuuaacucaguug

SEQ ID NO: 22893 - RNA, 19 nt, Homo sapiens
aggaggguccugauugcca

SEQ ID NO: 22894 - RNA, 16 nt, Homo sapiens
cacccaucccugcaaa

SEQ ID NO: 22895 - RNA, 19 nt, Homo sapiens
cccacagucuugcagguca

SEQ ID NO: 22896 - RNA, 22 nt, Homo sapiens
ccucaucauccuucucaucgcu

SEQ ID NO: 22897 - RNA, 18 nt, Homo sapiens
cucuccuugcacaucugg

SEQ ID NO: 22898 - RNA, 25 nt, Homo sapiens
uugucaaugcuucucuuguggcacu

SEQ ID NO: 22899 - RNA, 22 nt, Homo sapiens
caacggcuccaccagggucacc

SEQ ID NO: 22900 - RNA, 22 nt, Homo sapiens
ccgaguguccagccccaccucc

SEQ ID NO: 22901 - RNA, 17 nt, Homo sapiens
gaucugccuuuauccac

SEQ ID NO: 22902 - RNA, 18 nt, Homo sapiens
gccccuguccugggaguc

SEQ ID NO: 22903 - RNA, 20 nt, Homo sapiens
ggcauguggcucagcagcaa

SEQ ID NO: 22904 - RNA, 18 nt, Homo sapiens
cauuugacuguucaauga

SEQ ID NO: 22905 - RNA, 21 nt, Homo sapiens
cuuucacaaaacgaaaugcua

SEQ ID NO: 22906 - RNA, 21 nt, Homo sapiens
ucuugauaucucgaacuuuca

SEQ ID NO: 22907 - RNA, 19 nt, Homo sapiens
uguccaacaugguaauuca

SEQ ID NO: 22908 - RNA, 18 nt, Homo sapiens
ucgcacgccuuccugcca

SEQ ID NO: 22909 - RNA, 20 nt, Homo sapiens
caaaguuauagcacuguucc

SEQ ID NO: 22910 - RNA, 23 nt, Homo sapiens
ugagccaggcauccauuuccaca

SEQ ID NO: 22911 - RNA, 20 nt, Homo sapiens
agaagaaauauuuuucaccu

SEQ ID NO: 22912 - RNA, 19 nt, Homo sapiens
agggggucccccacccucu

SEQ ID NO: 22913 - RNA, 20 nt, Homo sapiens
caagacaucacccucuccuc

SEQ ID NO: 22914 - RNA, 18 nt, Homo sapiens
ccuguccucuucccaguu

SEQ ID NO: 22915 - RNA, 20 nt, Homo sapiens
cggaaggcggcuggugcaca

SEQ ID NO: 22916 - RNA, 21 nt, Homo sapiens
cucccccgcccugcuggccuc

SEQ ID NO: 22917 - RNA, 16 nt, Homo sapiens
ggcuaauucuaagcac

SEQ ID NO: 22918 - RNA, 21 nt, Homo sapiens
uccucucucccccuuguuauu

SEQ ID NO: 22919 - RNA, 20 nt, Homo sapiens
gguucuaaaagcugucuaca

SEQ ID NO: 22920 - RNA, 23 nt, Homo sapiens
guaaacuagucuuaagcgcuuuu

SEQ ID NO: 22921 - RNA, 21 nt, Homo sapiens
ccuugguggcugcccugugga

SEQ ID NO: 22922 - RNA, 18 nt, Homo sapiens
gacaauuccuccugucag

SEQ ID NO: 22923 - RNA, 22 nt, Homo sapiens
gacgggguuucaccaugcuggc

SEQ ID NO: 22924 - RNA, 21 nt, Homo sapiens
uaauccaugaaggccaucuug

SEQ ID NO: 22925 - RNA, 17 nt, Homo sapiens
ugaaaagcuguuggccu

SEQ ID NO: 22926 - RNA, 17 nt, Homo sapiens
uguaucucacacuauga

SEQ ID NO: 22927 - RNA, 23 nt, Homo sapiens
aauggucaaaucucuccaccucu

SEQ ID NO: 22928 - RNA, 19 nt, Homo sapiens
ugcuguuagaauauguuga

SEQ ID NO: 22929 - RNA, 18 nt, Homo sapiens
uuuuuagagaucaaugag

SEQ ID NO: 22930 - RNA, 19 nt, Homo sapiens
auugugaaggaggccccuc

SEQ ID NO: 22931 - RNA, 20 nt, Homo sapiens
cagaccugcccguccccuca

SEQ ID NO: 22932 - RNA, 19 nt, Homo sapiens
ccuguugguacuguuccag

SEQ ID NO: 22933 - RNA, 22 nt, Homo sapiens
ccuuccccaguuguucccuuca

SEQ ID NO: 22934 - RNA, 20 nt, Homo sapiens
cuugaacaguuucagguuau

SEQ ID NO: 22935 - RNA, 25 nt, Homo sapiens
aaaagacuccuucucccaaagaaga

SEQ ID NO: 22936 - RNA, 22 nt, Homo sapiens
gaaaacaucuacaagcccccca

SEQ ID NO: 22937 - RNA, 17 nt, Homo sapiens
aacuagaauguucaaaa

SEQ ID NO: 22938 - RNA, 21 nt, Homo sapiens
caccucagagauuuuucuuca

SEQ ID NO: 22939 - RNA, 18 nt, Homo sapiens
cucagagauuuuucuuca

SEQ ID NO: 22940 - RNA, 19 nt, Homo sapiens
uacuacuaguagcaaaaua

SEQ ID NO: 22941 - RNA, 17 nt, Homo sapiens
ucacuuagggauguaau

SEQ ID NO: 22942 - RNA, 20 nt, Homo sapiens
uuucugaucacgaacaauag

SEQ ID NO: 22943 - RNA, 19 nt, Homo sapiens
cacugccccccaugccuca

SEQ ID NO: 22944 - RNA, 20 nt, Homo sapiens
cugagccgacgcccuugccc

SEQ ID NO: 22945 - RNA, 20 nt, Homo sapiens
gugugccccguccucgauug

SEQ ID NO: 22946 - RNA, 21 nt, Homo sapiens
cgcccccgugccgcccgccgc

SEQ ID NO: 22947 - RNA, 21 nt, Homo sapiens
aucgcacagaacaccacccuc

SEQ ID NO: 22948 - RNA, 21 nt, Homo sapiens
cacgaaaucacaaacucuuca

SEQ ID NO: 22949 - RNA, 21 nt, Homo sapiens
cagaagggugaaggcuguaga

SEQ ID NO: 22950 - RNA, 18 nt, Homo sapiens
gcugugguguuucuuguu

SEQ ID NO: 22951 - RNA, 17 nt, Homo sapiens
ggagcgucauacacaca

SEQ ID NO: 22952 - RNA, 16 nt, Homo sapiens
ugccgugacugugaug

SEQ ID NO: 22953 - RNA, 21 nt, Homo sapiens
uucaguggaguucagguucca

SEQ ID NO: 22954 - RNA, 22 nt, Homo sapiens
accaacccaucaacaucaagcc

SEQ ID NO: 22955 - RNA, 16 nt, Homo sapiens
accucugcucauucca

SEQ ID NO: 22956 - RNA, 21 nt, Homo sapiens
cacuugaagcaugguguuuca

SEQ ID NO: 22957 - RNA, 15 nt, Homo sapiens
ccuguucaugaggua

SEQ ID NO: 22958 - RNA, 19 nt, Homo sapiens
cucaaaaaugacaacacuu

SEQ ID NO: 22959 - RNA, 18 nt, Homo sapiens
gguuuuggcuugugauca

SEQ ID NO: 22960 - RNA, 19 nt, Homo sapiens
aguggguguugugugugug

SEQ ID NO: 22961 - RNA, 19 nt, Homo sapiens
ccagcccgaaauucccucc

SEQ ID NO: 22962 - RNA, 18 nt, Homo sapiens
cuuuuuggguagaagaag

SEQ ID NO: 22963 - RNA, 23 nt, Homo sapiens
gccauguuaaaagucacugugca

SEQ ID NO: 22964 - RNA, 18 nt, Homo sapiens
ugaaucaaguguauuuca

SEQ ID NO: 22965 - RNA, 20 nt, Homo sapiens
ugaggaaccaaaggaagcaa

SEQ ID NO: 22966 - RNA, 19 nt, Homo sapiens
uugaaucuguucgugguca

SEQ ID NO: 22967 - RNA, 20 nt, Homo sapiens
uuuaugauaauuugccauug

SEQ ID NO: 22968 - RNA, 18 nt, Homo sapiens
acugcggcauguugacca

SEQ ID NO: 22969 - RNA, 18 nt, Homo sapiens
ccagaccccagacccuca

SEQ ID NO: 22970 - RNA, 22 nt, Homo sapiens
ucugccucucccacauuccucc

SEQ ID NO: 22971 - RNA, 20 nt, Homo sapiens
ugccucucccacauuccucc

SEQ ID NO: 22972 - RNA, 18 nt, Homo sapiens
ugggauggggcuucugcu

SEQ ID NO: 22973 - RNA, 16 nt, Homo sapiens
cugccuguugcucuga

SEQ ID NO: 22974 - RNA, 20 nt, Homo sapiens
ucaaacauccagggaagcca

SEQ ID NO: 22975 - RNA, 18 nt, Homo sapiens
ccaggcaccuaccgcugc

SEQ ID NO: 22976 - RNA, 28 nt, Homo sapiens
agcauccuucggaccucaccacgcgaaa

SEQ ID NO: 22977 - RNA, 22 nt, Homo sapiens
caccuuuuggaaaugcccauug

SEQ ID NO: 22978 - RNA, 18 nt, Homo sapiens
cccacaaccuccgccucc

SEQ ID NO: 22979 - RNA, 22 nt, Homo sapiens
cuuauugaacuuauuuugcaca

SEQ ID NO: 22980 - RNA, 16 nt, Homo sapiens
gaacaugcgaagccac

SEQ ID NO: 22981 - RNA, 30 nt, Homo sapiens
gcuucuguagguacuagcugccuugauuuu

SEQ ID NO: 22982 - RNA, 18 nt, Homo sapiens
guuaacuagaaaauguga

SEQ ID NO: 22983 - RNA, 18 nt, Homo sapiens
uccgccuccuggguucaa

SEQ ID NO: 22984 - RNA, 20 nt, Homo sapiens
uggucaggcuggucuugaac

SEQ ID NO: 22985 - RNA, 23 nt, Homo sapiens
ugucaguuucaauuaugaaacug

SEQ ID NO: 22986 - RNA, 21 nt, Homo sapiens
aagucagucacagaccacugc

SEQ ID NO: 22987 - RNA, 19 nt, Homo sapiens
gccaccgcacccggccuga

SEQ ID NO: 22988 - RNA, 19 nt, Homo sapiens
uccuggaaccaagcaucca

SEQ ID NO: 22989 - RNA, 21 nt, Homo sapiens
acauaucaacacagguuuuua

SEQ ID NO: 22990 - RNA, 19 nt, Homo sapiens
accauggaauuauaugaaa

SEQ ID NO: 22991 - RNA, 21 nt, Homo sapiens
accuaagauggccgccggccc

SEQ ID NO: 22992 - RNA, 18 nt, Homo sapiens
cuuuuaagaaaacaugga

SEQ ID NO: 22993 - RNA, 22 nt, Homo sapiens
aacuggcuggcaccagcuucau

SEQ ID NO: 22994 - RNA, 20 nt, Homo sapiens
agaacacaagucacauuuca

SEQ ID NO: 22995 - RNA, 24 nt, Homo sapiens
uguacagcucauacuuuccugcug

SEQ ID NO: 22996 - RNA, 19 nt, Homo sapiens
aagcagucagccuucucuc

SEQ ID NO: 22997 - RNA, 18 nt, Homo sapiens
ccaauagucccugcuccu

SEQ ID NO: 22998 - RNA, 21 nt, Homo sapiens
gccugcugagaagcguggugc

SEQ ID NO: 22999 - RNA, 22 nt, Homo sapiens
aaggcuggguacucagcagcca

SEQ ID NO: 23000 - RNA, 20 nt, Homo sapiens
cucugcaguggggguugugg

SEQ ID NO: 23001 - RNA, 21 nt, Homo sapiens
uccaagcaccgggaagaccuc

SEQ ID NO: 23002 - RNA, 21 nt, Homo sapiens
ucugcuggguguaacugcucu

SEQ ID NO: 23003 - RNA, 16 nt, Homo sapiens
ccgcggagccccggga

SEQ ID NO: 23004 - RNA, 21 nt, Homo sapiens
gugggcagccucacuuggcug

SEQ ID NO: 23005 - RNA, 18 nt, Homo sapiens
acuaguagagacugagaa

SEQ ID NO: 23006 - RNA, 18 nt, Homo sapiens
gggcauuacugagagaua

SEQ ID NO: 23007 - RNA, 20 nt, Homo sapiens
ucuugguggcgggcgccugu

SEQ ID NO: 23008 - RNA, 18 nt, Homo sapiens
uggguggaucaccugagg

SEQ ID NO: 23009 - RNA, 18 nt, Homo sapiens
cuugaaaccaggcacuuu

SEQ ID NO: 23010 - RNA, 21 nt, Homo sapiens
cccgggccgccccgcauccca

SEQ ID NO: 23011 - RNA, 23 nt, Homo sapiens
ugcccagcugcugcccuccccag

SEQ ID NO: 23012 - RNA, 21 nt, Homo sapiens
caggugaaagggcagcuuuaa

SEQ ID NO: 23013 - RNA, 22 nt, Homo sapiens
gagccaagauugcgccacugca

SEQ ID NO: 23014 - RNA, 19 nt, Homo sapiens
uuagugauuucacguuuaa

SEQ ID NO: 23015 - RNA, 23 nt, Homo sapiens
aagcaagcgagggacuucacucu

SEQ ID NO: 23016 - RNA, 18 nt, Homo sapiens
acuguggcuguuggguuu

SEQ ID NO: 23017 - RNA, 20 nt, Homo sapiens
cccucccugucagcacagca

SEQ ID NO: 23018 - RNA, 18 nt, Homo sapiens
ccgugugucuugucugug

SEQ ID NO: 23019 - RNA, 19 nt, Homo sapiens
cuggcugggcuuccggugu

SEQ ID NO: 23020 - RNA, 18 nt, Homo sapiens
gcuuugaucccuuggucu

SEQ ID NO: 23021 - RNA, 18 nt, Homo sapiens
uccagaacuuuguucuag

SEQ ID NO: 23022 - RNA, 19 nt, Homo sapiens
uccggcuuggcuguuccag

SEQ ID NO: 23023 - RNA, 23 nt, Homo sapiens
uggggucauagauuguccaguca

SEQ ID NO: 23024 - RNA, 19 nt, Homo sapiens
uuuguucuagauuccuuaa

SEQ ID NO: 23025 - RNA, 17 nt, Homo sapiens
aacugagcuuguuauug

SEQ ID NO: 23026 - RNA, 15 nt, Homo sapiens
acagaauggcuccuc

SEQ ID NO: 23027 - RNA, 22 nt, Homo sapiens
aucugcauaacucagcagucaa

SEQ ID NO: 23028 - RNA, 18 nt, Homo sapiens
caggguucccugggccca

SEQ ID NO: 23029 - RNA, 21 nt, Homo sapiens
cuuguacagaaccagaauccu

SEQ ID NO: 23030 - RNA, 18 nt, Homo sapiens
cuuuaacccaagaaccca

SEQ ID NO: 23031 - RNA, 24 nt, Homo sapiens
aaacauucacuuuguuuaagcuua

SEQ ID NO: 23032 - RNA, 23 nt, Homo sapiens
aacauucacuuuguuuaagcuua

SEQ ID NO: 23033 - RNA, 20 nt, Homo sapiens
caguaaugaaauaaaaaaua

SEQ ID NO: 23034 - RNA, 19 nt, Homo sapiens
acagcgcacacccagaccc

SEQ ID NO: 23035 - RNA, 17 nt, Homo sapiens
caaacccucgccccaca

SEQ ID NO: 23036 - RNA, 23 nt, Homo sapiens
cccgccacagccuacacgcaucc

SEQ ID NO: 23037 - RNA, 18 nt, Homo sapiens
gcucugaucucccaucca

SEQ ID NO: 23038 - RNA, 16 nt, Homo sapiens
guucaagagcaaccug

SEQ ID NO: 23039 - RNA, 18 nt, Homo sapiens
uuuuuauuuccacaaccu

SEQ ID NO: 23040 - RNA, 19 nt, Homo sapiens
accaguggcagcuggugac

SEQ ID NO: 23041 - RNA, 19 nt, Homo sapiens
caguggcagcuggugacug

SEQ ID NO: 23042 - RNA, 20 nt, Homo sapiens
gaggcccucucugccuuucc

SEQ ID NO: 23043 - RNA, 19 nt, Homo sapiens
ugugaauagucauuugacu

SEQ ID NO: 23044 - RNA, 24 nt, Homo sapiens
uuuuucugucaggaaaacaauguu

SEQ ID NO: 23045 - RNA, 21 nt, Homo sapiens
acauaccuguuguuuaucagc

SEQ ID NO: 23046 - RNA, 22 nt, Homo sapiens
cuguuguuuaucagccauugua

SEQ ID NO: 23047 - RNA, 24 nt, Homo sapiens
cuugaaaaauuucagaacauuuuu

SEQ ID NO: 23048 - RNA, 23 nt, Homo sapiens
cagccugggcaacagacauccug

SEQ ID NO: 23049 - RNA, 18 nt, Homo sapiens
cuugauucacccaacaaa

SEQ ID NO: 23050 - RNA, 19 nt, Homo sapiens
gugguuuuugccauuuuua

SEQ ID NO: 23051 - RNA, 22 nt, Homo sapiens
gcccuagggauuauagccagga

SEQ ID NO: 23052 - RNA, 19 nt, Homo sapiens
aaugcaguuaccagaccca

SEQ ID NO: 23053 - RNA, 17 nt, Homo sapiens
cagagacaaacucuuug

SEQ ID NO: 23054 - RNA, 17 nt, Homo sapiens
cuccugcuuuuacuuuu

SEQ ID NO: 23055 - RNA, 23 nt, Homo sapiens
cuucugcaaagcguaucaucuca

SEQ ID NO: 23056 - RNA, 18 nt, Homo sapiens
cuugagaguguuugugaa

SEQ ID NO: 23057 - RNA, 22 nt, Homo sapiens
gcuuggagugcuuguguggucc

SEQ ID NO: 23058 - RNA, 19 nt, Homo sapiens
uguuggaauccucuuugaa

SEQ ID NO: 23059 - RNA, 19 nt, Homo sapiens
uuaaaguuagaagcuagca

SEQ ID NO: 23060 - RNA, 17 nt, Homo sapiens
ccuucagaaacugugag

SEQ ID NO: 23061 - RNA, 18 nt, Homo sapiens
gaaaaaaaaguguaacaa

SEQ ID NO: 23062 - RNA, 21 nt, Homo sapiens
gaaugagaaaagccuucuucc

SEQ ID NO: 23063 - RNA, 28 nt, Homo sapiens
uaggauaucccucaccuguuccugauga

SEQ ID NO: 23064 - RNA, 18 nt, Homo sapiens
ucuuugguguuuuuuuaa

SEQ ID NO: 23065 - RNA, 19 nt, Homo sapiens
cugggagaagaauaaauca

SEQ ID NO: 23066 - RNA, 17 nt, Homo sapiens
aaacauuugggaaacca

SEQ ID NO: 23067 - RNA, 22 nt, Homo sapiens
accaaaaccauuauuguuuuaa

SEQ ID NO: 23068 - RNA, 20 nt, Homo sapiens
ucugcauaguuuugaugaag

SEQ ID NO: 23069 - RNA, 19 nt, Homo sapiens
uuauuguuuuaaagaauga

SEQ ID NO: 23070 - RNA, 20 nt, Homo sapiens
cauguaccaggucagugcag

SEQ ID NO: 23071 - RNA, 21 nt, Homo sapiens
aaacagaaacccaacuacccc

SEQ ID NO: 23072 - RNA, 18 nt, Homo sapiens
acccagucccaugccaga

SEQ ID NO: 23073 - RNA, 22 nt, Homo sapiens
caaagcugaaacgcucugagca

SEQ ID NO: 23074 - RNA, 21 nt, Homo sapiens
cauuuuauucacaugcuccca

SEQ ID NO: 23075 - RNA, 23 nt, Homo sapiens
ccucuuugucugccuuuaauuuu

SEQ ID NO: 23076 - RNA, 20 nt, Homo sapiens
gcaggugggucaaugcucuc

SEQ ID NO: 23077 - RNA, 17 nt, Homo sapiens
gucaucucuucucugga

SEQ ID NO: 23078 - RNA, 20 nt, Homo sapiens
uguucauaagagaggacuga

SEQ ID NO: 23079 - RNA, 17 nt, Homo sapiens
gucaucucuucucugga

SEQ ID NO: 23080 - RNA, 19 nt, Homo sapiens
ucucaggucagaggcacgg

SEQ ID NO: 23081 - RNA, 18 nt, Homo sapiens
acccagucccaugccaga

SEQ ID NO: 23082 - RNA, 17 nt, Homo sapiens
gucaucucuucucugga

SEQ ID NO: 23083 - RNA, 25 nt, Homo sapiens
ccugguaacauuucauauugcuuuu

SEQ ID NO: 23084 - RNA, 21 nt, Homo sapiens
uaagugggaucuguggaucug

SEQ ID NO: 23085 - RNA, 25 nt, Homo sapiens
ccugguaacauuucauauugcuuuu

SEQ ID NO: 23086 - RNA, 19 nt, Homo sapiens
cuuaacgguccucuggucu

SEQ ID NO: 23087 - RNA, 22 nt, Homo sapiens
aucuuggcucacugcaaccucu

SEQ ID NO: 23088 - RNA, 19 nt, Homo sapiens
auuccaaagaugguucaga

SEQ ID NO: 23089 - RNA, 20 nt, Homo sapiens
cagcgagguacaccaggugg

SEQ ID NO: 23090 - RNA, 20 nt, Homo sapiens
ccucugccucccagguucaa

SEQ ID NO: 23091 - RNA, 19 nt, Homo sapiens
cugcaaccucugccuccca

SEQ ID NO: 23092 - RNA, 18 nt, Homo sapiens
gacugccaccacacccag

SEQ ID NO: 23093 - RNA, 19 nt, Homo sapiens
gugugaagcguuguuuggc

SEQ ID NO: 23094 - RNA, 23 nt, Homo sapiens
ucuuuuuaugaccuguuugccuu

SEQ ID NO: 23095 - RNA, 21 nt, Homo sapiens
ccucagguucaaccugugaua

SEQ ID NO: 23096 - RNA, 23 nt, Homo sapiens
cuucaaguuauuuuaaugcucuu

SEQ ID NO: 23097 - RNA, 22 nt, Homo sapiens
gguagaaguuuucuacucagcu

SEQ ID NO: 23098 - RNA, 16 nt, Homo sapiens
ugcgucuguccacuug

SEQ ID NO: 23099 - RNA, 18 nt, Homo sapiens
gugccucaggacugcacc

SEQ ID NO: 23100 - RNA, 25 nt, Homo sapiens
ccaggccuuaaucacccccauuccg

SEQ ID NO: 23101 - RNA, 18 nt, Homo sapiens
cccggccuuaugcacugc

SEQ ID NO: 23102 - RNA, 21 nt, Homo sapiens
cgggcaccgcccaccgagcca

SEQ ID NO: 23103 - RNA, 23 nt, Homo sapiens
aggccgccgcacugccucccgca

SEQ ID NO: 23104 - RNA, 21 nt, Homo sapiens
cuccgcagacccgcgcccgcu

SEQ ID NO: 23105 - RNA, 20 nt, Homo sapiens
gcagcucggccccgcgcugc

SEQ ID NO: 23106 - RNA, 23 nt, Homo sapiens
aaacuaaagccugcaagcgccac

SEQ ID NO: 23107 - RNA, 17 nt, Homo sapiens
auaaaguuggauguucu

SEQ ID NO: 23108 - RNA, 21 nt, Homo sapiens
augaggggaaugcagugucag

SEQ ID NO: 23109 - RNA, 20 nt, Homo sapiens
auuagcuguucuucuacauc

SEQ ID NO: 23110 - RNA, 16 nt, Homo sapiens
caucucaaaauaauua

SEQ ID NO: 23111 - RNA, 19 nt, Homo sapiens
cuucagacuuaauacagca

SEQ ID NO: 23112 - RNA, 17 nt, Homo sapiens
cuuuugacuuaacguca

SEQ ID NO: 23113 - RNA, 22 nt, Homo sapiens
aaaaucauccuugacaugaaac

SEQ ID NO: 23114 - RNA, 18 nt, Homo sapiens
cccacuaaugguaucacu

SEQ ID NO: 23115 - RNA, 18 nt, Homo sapiens
uccuguauccggcacugc

SEQ ID NO: 23116 - RNA, 21 nt, Homo sapiens
caggacaccagcuggguccag

SEQ ID NO: 23117 - RNA, 21 nt, Homo sapiens
cccgcagcagccccggcccca

SEQ ID NO: 23118 - RNA, 17 nt, Homo sapiens
ccgcccaccgccacuau

SEQ ID NO: 23119 - RNA, 20 nt, Homo sapiens
auguugucaaaguuucugaa

SEQ ID NO: 23120 - RNA, 18 nt, Homo sapiens
cauauaguaacaugcagu

SEQ ID NO: 23121 - RNA, 18 nt, Homo sapiens
cuacaaggaacagcuagu

SEQ ID NO: 23122 - RNA, 17 nt, Homo sapiens
gugagugugcauguugu

SEQ ID NO: 23123 - RNA, 19 nt, Homo sapiens
guguaguuuuuauacuaca

SEQ ID NO: 23124 - RNA, 22 nt, Homo sapiens
caccaaccgggacaaaacuuca

SEQ ID NO: 23125 - RNA, 18 nt, Homo sapiens
ggaaaggggacagaguga

SEQ ID NO: 23126 - RNA, 19 nt, Homo sapiens
acgaaccauucgcauaugg

SEQ ID NO: 23127 - RNA, 26 nt, Homo sapiens
ggaacugcuagaacgaaccauucgca

SEQ ID NO: 23128 - RNA, 19 nt, Homo sapiens
cacaguaccacugccacca

SEQ ID NO: 23129 - RNA, 20 nt, Homo sapiens
caugcugcucacuuauguca

SEQ ID NO: 23130 - RNA, 19 nt, Homo sapiens
ggguucaagaaaaaacugc

SEQ ID NO: 23131 - RNA, 30 nt, Homo sapiens
uaaaguagugguuucuucauuguuuccuca

SEQ ID NO: 23132 - RNA, 22 nt, Homo sapiens
ucuauggauguguuuuguguga

SEQ ID NO: 23133 - RNA, 26 nt, Homo sapiens
uaaauguugauuuuaauauggagcua

SEQ ID NO: 23134 - RNA, 18 nt, Homo sapiens
agugauuuaucacuuuca

SEQ ID NO: 23135 - RNA, 19 nt, Homo sapiens
cagaauguuuauuaccuca

SEQ ID NO: 23136 - RNA, 21 nt, Homo sapiens
cugcagcagauuucuuugaua

SEQ ID NO: 23137 - RNA, 15 nt, Homo sapiens
guuguuauuucacug

SEQ ID NO: 23138 - RNA, 20 nt, Homo sapiens
guuuauuaccucauaagugc

SEQ ID NO: 23139 - RNA, 21 nt, Homo sapiens
ucuguguacucgaauugcuuu

SEQ ID NO: 23140 - RNA, 23 nt, Homo sapiens
aggaauauaaaaaccaccacccu

SEQ ID NO: 23141 - RNA, 22 nt, Homo sapiens
aguuuugcaccacggcaagaaa

SEQ ID NO: 23142 - RNA, 25 nt, Homo sapiens
caaaccuuuccaacuucucacguca

SEQ ID NO: 23143 - RNA, 23 nt, Homo sapiens
gcaccaccaccaccaccccuacu

SEQ ID NO: 23144 - RNA, 20 nt, Homo sapiens
ugcaaaccuuuccaacuucu

SEQ ID NO: 23145 - RNA, 22 nt, Homo sapiens
uuaaaaauaagcugggcguggu

SEQ ID NO: 23146 - RNA, 22 nt, Homo sapiens
auugaugcaauuugauauuuuu

SEQ ID NO: 23147 - RNA, 22 nt, Homo sapiens
caugcugggugaugaaagauua

SEQ ID NO: 23148 - RNA, 22 nt, Homo sapiens
cuuaagcuaccagauugcuuuu

SEQ ID NO: 23149 - RNA, 23 nt, Homo sapiens
uuccccugagggaaucgcuuuuu

SEQ ID NO: 23150 - RNA, 24 nt, Homo sapiens
uuugaaaaauguauuuuaucauua

SEQ ID NO: 23151 - RNA, 16 nt, Homo sapiens
gcgguccucccggcca

SEQ ID NO: 23152 - RNA, 23 nt, Homo sapiens
auugcauuuuacgcaaacuuuga

SEQ ID NO: 23153 - RNA, 23 nt, Homo sapiens
aaauugccaucuacaguauuaca

SEQ ID NO: 23154 - RNA, 20 nt, Homo sapiens
aguaagugggaaagugagcg

SEQ ID NO: 23155 - RNA, 23 nt, Homo sapiens
uagaaguggcugucauacgugaa

SEQ ID NO: 23156 - RNA, 21 nt, Homo sapiens
caaaacuuagagugauuugga

SEQ ID NO: 23157 - RNA, 23 nt, Homo sapiens
aauaucauaaaaggagcugguga

SEQ ID NO: 23158 - RNA, 18 nt, Homo sapiens
accugccacuuggcauua

SEQ ID NO: 23159 - RNA, 17 nt, Homo sapiens
caagcacaagcauugug

SEQ ID NO: 23160 - RNA, 23 nt, Homo sapiens
ccuuccccugcguuuccucucca

SEQ ID NO: 23161 - RNA, 25 nt, Homo sapiens
cucgguacaaccuuugagaaaaaga

SEQ ID NO: 23162 - RNA, 18 nt, Homo sapiens
cuugaaaauguugcagua

SEQ ID NO: 23163 - RNA, 20 nt, Homo sapiens
gaaacuaacaaagccacauu

SEQ ID NO: 23164 - RNA, 18 nt, Homo sapiens
gaugucaguaacauucca

SEQ ID NO: 23165 - RNA, 17 nt, Homo sapiens
gcaaaacaaaaacaauu

SEQ ID NO: 23166 - RNA, 20 nt, Homo sapiens
ggacauuuaacuugaucucc

SEQ ID NO: 23167 - RNA, 20 nt, Homo sapiens
ggaggugcggcggcggcggc

SEQ ID NO: 23168 - RNA, 22 nt, Homo sapiens
ggccgguuuccgcacugccaca

SEQ ID NO: 23169 - RNA, 20 nt, Homo sapiens
uagaggauaugaaaugccau

SEQ ID NO: 23170 - RNA, 20 nt, Homo sapiens
uucuguucgaugcacucuuu

SEQ ID NO: 23171 - RNA, 22 nt, Homo sapiens
uuuuuguuagugaauuuggaaa

SEQ ID NO: 23172 - RNA, 19 nt, Homo sapiens
uuuuuuuuuuccuaucuca

SEQ ID NO: 23173 - RNA, 24 nt, Homo sapiens
accagcacuuacaagcacugugaa

SEQ ID NO: 23174 - RNA, 20 nt, Homo sapiens
agaaaacaauuuuuauuugg

SEQ ID NO: 23175 - RNA, 19 nt, Homo sapiens
aguuguaaacucucuugcc

SEQ ID NO: 23176 - RNA, 16 nt, Homo sapiens
caaaaacaagcuucuu

SEQ ID NO: 23177 - RNA, 19 nt, Homo sapiens
gucugaguuaaaugcacuu

SEQ ID NO: 23178 - RNA, 21 nt, Homo sapiens
uaccaacuuagucaucaagcc

SEQ ID NO: 23179 - RNA, 20 nt, Homo sapiens
ugccaguaccaacugggaug

SEQ ID NO: 23180 - RNA, 19 nt, Homo sapiens
cugaaaugauuuuucuucc

SEQ ID NO: 23181 - RNA, 23 nt, Homo sapiens
agcaagcagguucaaauacagua

SEQ ID NO: 23182 - RNA, 18 nt, Homo sapiens
cagcuggcaggcauucau

SEQ ID NO: 23183 - RNA, 20 nt, Homo sapiens
caguuacauagucuacaaua

SEQ ID NO: 23184 - RNA, 23 nt, Homo sapiens
cuggguucaagcaauucuucuga

SEQ ID NO: 23185 - RNA, 19 nt, Homo sapiens
ucaggcauaaucccuaaua

SEQ ID NO: 23186 - RNA, 18 nt, Homo sapiens
uccgccuccuggguucaa

SEQ ID NO: 23187 - RNA, 19 nt, Homo sapiens
uuccagagagacauucaca

SEQ ID NO: 23188 - RNA, 24 nt, Homo sapiens
ggagccggcgacggcggcaguggc

SEQ ID NO: 23189 - RNA, 21 nt, Homo sapiens
caaucuugaggacucccggug

SEQ ID NO: 23190 - RNA, 22 nt, Homo sapiens
cccugggugguggaccugugga

SEQ ID NO: 23191 - RNA, 22 nt, Homo sapiens
gagccaagaucucgccacugca

SEQ ID NO: 23192 - RNA, 21 nt, Homo sapiens
gccucucuagggcccugguga

SEQ ID NO: 23193 - RNA, 21 nt, Homo sapiens
uacuggugguugagucaggac

SEQ ID NO: 23194 - RNA, 19 nt, Homo sapiens
ucucuacucccagguccag

SEQ ID NO: 23195 - RNA, 19 nt, Homo sapiens
ugggccccacaagcugcca

SEQ ID NO: 23196 - RNA, 22 nt, Homo sapiens
aucuuggcucacugcaaccucu

SEQ ID NO: 23197 - RNA, 20 nt, Homo sapiens
ccucugccucccagguucaa

SEQ ID NO: 23198 - RNA, 19 nt, Homo sapiens
cugcaaccucugccuccca

SEQ ID NO: 23199 - RNA, 18 nt, Homo sapiens
gaaaaagccuaggacauu

SEQ ID NO: 23200 - RNA, 21 nt, Homo sapiens
uaaaaacguguaagauguggu

SEQ ID NO: 23201 - RNA, 21 nt, Homo sapiens
uccagauccagacccucuuau

SEQ ID NO: 23202 - RNA, 17 nt, Homo sapiens
uucucuucaacaguuca

SEQ ID NO: 23203 - RNA, 23 nt, Homo sapiens
aaaaaaacaauacagcuauccaa

SEQ ID NO: 23204 - RNA, 23 nt, Homo sapiens
aguggcucuuaaaaacacccuca

SEQ ID NO: 23205 - RNA, 17 nt, Homo sapiens
aaacuguccugguuaug

SEQ ID NO: 23206 - RNA, 19 nt, Homo sapiens
cugcaagcuccgccuccca

SEQ ID NO: 23207 - RNA, 19 nt, Homo sapiens
ggcagagucaagacgaacu

SEQ ID NO: 23208 - RNA, 17 nt, Homo sapiens
ucauuuucuuuuuauac

SEQ ID NO: 23209 - RNA, 20 nt, Homo sapiens
caccgccacacucgagccca

SEQ ID NO: 23210 - RNA, 20 nt, Homo sapiens
agaaagaguuaacugugcug

SEQ ID NO: 23211 - RNA, 21 nt, Homo sapiens
cagcccacacucugccaccuc

SEQ ID NO: 23212 - RNA, 22 nt, Homo sapiens
cccaucaugggaggcuuuugga

SEQ ID NO: 23213 - RNA, 20 nt, Homo sapiens
cggcccagaaaccagagcca

SEQ ID NO: 23214 - RNA, 19 nt, Homo sapiens
gcccaaggcagcgaggcuu

SEQ ID NO: 23215 - RNA, 23 nt, Homo sapiens
ucugucucauagcacaugugaca

SEQ ID NO: 23216 - RNA, 20 nt, Homo sapiens
uggacaacagccacaagggg

SEQ ID NO: 23217 - RNA, 23 nt, Homo sapiens
gcaggagcagcccgcaccggaca

SEQ ID NO: 23218 - RNA, 17 nt, Homo sapiens
acaaacaguguacacuc

SEQ ID NO: 23219 - RNA, 23 nt, Homo sapiens
acauaaaaugugaaagccuguaa

SEQ ID NO: 23220 - RNA, 17 nt, Homo sapiens
ccacgugagugagauga

SEQ ID NO: 23221 - RNA, 19 nt, Homo sapiens
cugugcaucaaagggaugu

SEQ ID NO: 23222 - RNA, 19 nt, Homo sapiens
gggcugccagagguucuga

SEQ ID NO: 23223 - RNA, 20 nt, Homo sapiens
ugcagaauguaaacagcaga

SEQ ID NO: 23224 - RNA, 21 nt, Homo sapiens
uguaauguucaugucauaacu

SEQ ID NO: 23225 - RNA, 19 nt, Homo sapiens
ccagcccuuguucuguucc

SEQ ID NO: 23226 - RNA, 22 nt, Homo sapiens
aucuugguuugaucaaaucuuu

SEQ ID NO: 23227 - RNA, 18 nt, Homo sapiens
uccaccucacagguucaa

SEQ ID NO: 23228 - RNA, 19 nt, Homo sapiens
uucaagcgauucucguggc

SEQ ID NO: 23229 - RNA, 19 nt, Homo sapiens
aaacuccugaccucaggug

SEQ ID NO: 23230 - RNA, 19 nt, Homo sapiens
aagcaauucuccugccuca

SEQ ID NO: 23231 - RNA, 18 nt, Homo sapiens
ccugcaaccuccaccucc

SEQ ID NO: 23232 - RNA, 18 nt, Homo sapiens
uccaccuccuagguucaa

SEQ ID NO: 23233 - RNA, 21 nt, Homo sapiens
acacccacucacuuugcaaua

SEQ ID NO: 23234 - RNA, 26 nt, Homo sapiens
agccaccauguaaccccucucaccug

SEQ ID NO: 23235 - RNA, 19 nt, Homo sapiens
gagccuucgcaacucgcga

SEQ ID NO: 23236 - RNA, 21 nt, Homo sapiens
ggaucuucaagucccaucaua

SEQ ID NO: 23237 - RNA, 19 nt, Homo sapiens
uagaaaauugaaacacaga

SEQ ID NO: 23238 - RNA, 19 nt, Homo sapiens
ucagauccuuugaaaagag

SEQ ID NO: 23239 - RNA, 19 nt, Homo sapiens
gagccuucgcaacucgcga

SEQ ID NO: 23240 - RNA, 21 nt, Homo sapiens
acacccacucacuuugcaaua

SEQ ID NO: 23241 - RNA, 26 nt, Homo sapiens
agccaccauguaaccccucucaccug

SEQ ID NO: 23242 - RNA, 19 nt, Homo sapiens
gagccuucgcaacucgcga

SEQ ID NO: 23243 - RNA, 21 nt, Homo sapiens
ggaucuucaagucccaucaua

SEQ ID NO: 23244 - RNA, 19 nt, Homo sapiens
uagaaaauugaaacacaga

SEQ ID NO: 23245 - RNA, 19 nt, Homo sapiens
ucagauccuuugaaaagag

SEQ ID NO: 23246 - RNA, 19 nt, Homo sapiens
gagccuucgcaacucgcga

SEQ ID NO: 23247 - RNA, 19 nt, Homo sapiens
gagccuucgcaacucgcga

SEQ ID NO: 23248 - RNA, 19 nt, Homo sapiens
gagccuucgcaacucgcga

SEQ ID NO: 23249 - RNA, 19 nt, Homo sapiens
gagccuucgcaacucgcga

SEQ ID NO: 23250 - RNA, 18 nt, Homo sapiens
agguaaaaaguuaacagg

SEQ ID NO: 23251 - RNA, 20 nt, Homo sapiens
caccaccgcgcgcccccgcu

SEQ ID NO: 23252 - RNA, 21 nt, Homo sapiens
caccaccgcgcgcccccgcuc

SEQ ID NO: 23253 - RNA, 22 nt, Homo sapiens
ccuuucauuuugcuuuaaguuu

SEQ ID NO: 23254 - RNA, 18 nt, Homo sapiens
guguaugugaguauucuc

SEQ ID NO: 23255 - RNA, 19 nt, Homo sapiens
ugcugcuucuauuauugcc

SEQ ID NO: 23256 - RNA, 19 nt, Homo sapiens
agucucacucugucaccag

SEQ ID NO: 23257 - RNA, 18 nt, Homo sapiens
ccaaauaggucacauuca

SEQ ID NO: 23258 - RNA, 20 nt, Homo sapiens
ccucugccuccuggguucaa

SEQ ID NO: 23259 - RNA, 18 nt, Homo sapiens
uccgccucccggguucaa

SEQ ID NO: 23260 - RNA, 23 nt, Homo sapiens
ucugaaaugaggucuccuggccc

SEQ ID NO: 23261 - RNA, 20 nt, Homo sapiens
gugaguaggggguuuauguu

SEQ ID NO: 23262 - RNA, 19 nt, Homo sapiens
aacaagaggcccaaucuca

SEQ ID NO: 23263 - RNA, 19 nt, Homo sapiens
aagcccccacagcuggcca

SEQ ID NO: 23264 - RNA, 25 nt, Homo sapiens
ccgggguacaagaggcccaaucuca

SEQ ID NO: 23265 - RNA, 19 nt, Homo sapiens
cgucccuugugacaacacc

SEQ ID NO: 23266 - RNA, 20 nt, Homo sapiens
ggcuugaagcagggcuccau

SEQ ID NO: 23267 - RNA, 19 nt, Homo sapiens
ccaaggaugcuguucucag

SEQ ID NO: 23268 - RNA, 24 nt, Homo sapiens
cccugccuuugcagggccugugga

SEQ ID NO: 23269 - RNA, 19 nt, Homo sapiens
gcacgugccauggcuaugu

SEQ ID NO: 23270 - RNA, 20 nt, Homo sapiens
ucaugugaagugcuugcaaa

SEQ ID NO: 23271 - RNA, 19 nt, Homo sapiens
ccucgggcgccagccccac

SEQ ID NO: 23272 - RNA, 19 nt, Homo sapiens
cucccaucagccaucuggu

SEQ ID NO: 23273 - RNA, 22 nt, Homo sapiens
gaucucuaagcugcaaaaacug

SEQ ID NO: 23274 - RNA, 23 nt, Homo sapiens
uuuggguggagcagagucgcuuu

SEQ ID NO: 23275 - RNA, 19 nt, Homo sapiens
gcuucaacuauugcccuuu

SEQ ID NO: 23276 - RNA, 20 nt, Homo sapiens
gggauaaacuagauauagca

SEQ ID NO: 23277 - RNA, 18 nt, Homo sapiens
ggccccuuccgcaaucuc

SEQ ID NO: 23278 - RNA, 22 nt, Homo sapiens
aaacuguaaugaaacuacauug

SEQ ID NO: 23279 - RNA, 22 nt, Homo sapiens
ccuguaccucuucucugcccuc

SEQ ID NO: 23280 - RNA, 22 nt, Homo sapiens
gagccaagaucacgacacugca

SEQ ID NO: 23281 - RNA, 19 nt, Homo sapiens
ggcugccccguuuuuacua

SEQ ID NO: 23282 - RNA, 22 nt, Homo sapiens
aucugaacacagaaggugugaa

SEQ ID NO: 23283 - RNA, 18 nt, Homo sapiens
ccucgucugggcaccuca

SEQ ID NO: 23284 - RNA, 18 nt, Homo sapiens
gacccugggcacagggga

SEQ ID NO: 23285 - RNA, 18 nt, Homo sapiens
gccuuauuacgcuuuuca

SEQ ID NO: 23286 - RNA, 22 nt, Homo sapiens
gcuucccgcagccgccuggccc

SEQ ID NO: 23287 - RNA, 21 nt, Homo sapiens
acacccacucacuuugcaaua

SEQ ID NO: 23288 - RNA, 26 nt, Homo sapiens
agccaccauguaaccccucucaccug

SEQ ID NO: 23289 - RNA, 19 nt, Homo sapiens
gagccuucgcaacucgcga

SEQ ID NO: 23290 - RNA, 21 nt, Homo sapiens
ggaucuucaagucccaucaua

SEQ ID NO: 23291 - RNA, 19 nt, Homo sapiens
uagaaaauugaaacacaga

SEQ ID NO: 23292 - RNA, 19 nt, Homo sapiens
ucagauccuuugaaaagag

SEQ ID NO: 23293 - RNA, 21 nt, Homo sapiens
acacccacucacuuugcaaua

SEQ ID NO: 23294 - RNA, 26 nt, Homo sapiens
agccaccauguaaccccucucaccug

SEQ ID NO: 23295 - RNA, 19 nt, Homo sapiens
gagccuucgcaacucgcga

SEQ ID NO: 23296 - RNA, 21 nt, Homo sapiens
ggaucuucaagucccaucaua

SEQ ID NO: 23297 - RNA, 19 nt, Homo sapiens
uagaaaauugaaacacaga

SEQ ID NO: 23298 - RNA, 19 nt, Homo sapiens
ucagauccuuugaaaagag

SEQ ID NO: 23299 - RNA, 21 nt, Homo sapiens
acacccacucacuuugcaaua

SEQ ID NO: 23300 - RNA, 26 nt, Homo sapiens
agccaccauguaaccccucucaccug

SEQ ID NO: 23301 - RNA, 19 nt, Homo sapiens
gagccuucgcaacucgcga

SEQ ID NO: 23302 - RNA, 21 nt, Homo sapiens
ggaucuucaagucccaucaua

SEQ ID NO: 23303 - RNA, 19 nt, Homo sapiens
uagaaaauugaaacacaga

SEQ ID NO: 23304 - RNA, 19 nt, Homo sapiens
ucagauccuuugaaaagag

SEQ ID NO: 23305 - RNA, 16 nt, Homo sapiens
aaggacuuuggaccau

SEQ ID NO: 23306 - RNA, 18 nt, Homo sapiens
aggguggaguauguauca

SEQ ID NO: 23307 - RNA, 25 nt, Homo sapiens
cuuuggaccauaggggaucuuugga

SEQ ID NO: 23308 - RNA, 21 nt, Homo sapiens
gaagaauacaagaucccgucc

SEQ ID NO: 23309 - RNA, 22 nt, Homo sapiens
ugggucuucccaguugagacug

SEQ ID NO: 23310 - RNA, 16 nt, Homo sapiens
aaggacuuuggaccau

SEQ ID NO: 23311 - RNA, 18 nt, Homo sapiens
aggguggaguauguauca

SEQ ID NO: 23312 - RNA, 25 nt, Homo sapiens
cuuuggaccauaggggaucuuugga

SEQ ID NO: 23313 - RNA, 21 nt, Homo sapiens
gaagaauacaagaucccgucc

SEQ ID NO: 23314 - RNA, 22 nt, Homo sapiens
ugggucuucccaguugagacug

SEQ ID NO: 23315 - RNA, 18 nt, Homo sapiens
acccaggccgggcugcca

SEQ ID NO: 23316 - RNA, 19 nt, Homo sapiens
gagccuuccucuucccgca

SEQ ID NO: 23317 - RNA, 20 nt, Homo sapiens
ggagaggcggcggcggcggc

SEQ ID NO: 23318 - RNA, 20 nt, Homo sapiens
uuccucuucccgcagcacgc

SEQ ID NO: 23319 - RNA, 24 nt, Homo sapiens
cccgggcagccgccuucugagccc

SEQ ID NO: 23320 - RNA, 19 nt, Homo sapiens
aucccuuagccccgcggcg

SEQ ID NO: 23321 - RNA, 19 nt, Homo sapiens
ccgcgcugacaucacaacc

SEQ ID NO: 23322 - RNA, 20 nt, Homo sapiens
gccuccgagggcugcaggga

SEQ ID NO: 23323 - RNA, 18 nt, Homo sapiens
gucagaaguagaaucaua

SEQ ID NO: 23324 - RNA, 22 nt, Homo sapiens
cucuuuguccccucaguuuaug

SEQ ID NO: 23325 - RNA, 22 nt, Homo sapiens
ggcugcguuuccuccgcuauca

SEQ ID NO: 23326 - RNA, 20 nt, Homo sapiens
uccugugcucaccucccuga

SEQ ID NO: 23327 - RNA, 20 nt, Homo sapiens
gcggguggaucacuagguca

SEQ ID NO: 23328 - RNA, 15 nt, Homo sapiens
cuaucaaggcuaaac

SEQ ID NO: 23329 - RNA, 17 nt, Homo sapiens
gacuccggccucuagaa

SEQ ID NO: 23330 - RNA, 18 nt, Homo sapiens
gccuuccuuuuuuaucca

SEQ ID NO: 23331 - RNA, 17 nt, Homo sapiens
uacauauugucuccuuu

SEQ ID NO: 23332 - RNA, 19 nt, Homo sapiens
uucagcggugacugcccag

SEQ ID NO: 23333 - RNA, 19 nt, Homo sapiens
uucagcggugacugcccag

SEQ ID NO: 23334 - RNA, 23 nt, Homo sapiens
auccccggcggcggcgcggggcg

SEQ ID NO: 23335 - RNA, 19 nt, Homo sapiens
cugcugggcacccuggcuc

SEQ ID NO: 23336 - RNA, 23 nt, Homo sapiens
gucccaggucgcuggccggcucu

SEQ ID NO: 23337 - RNA, 25 nt, Homo sapiens
uaguuagagguuauaaauugcucua

SEQ ID NO: 23338 - RNA, 26 nt, Homo sapiens
uuuguuuucucccuuaacccucugaa

SEQ ID NO: 23339 - RNA, 19 nt, Homo sapiens
cccuggcuuagucuggaua

SEQ ID NO: 23340 - RNA, 18 nt, Homo sapiens
cucugugccccugccucu

SEQ ID NO: 23341 - RNA, 22 nt, Homo sapiens
gacacuccucccuccccaguga

SEQ ID NO: 23342 - RNA, 18 nt, Homo sapiens
gguggcuccgugcagcua

SEQ ID NO: 23343 - RNA, 18 nt, Homo sapiens
cccacgcucagcuccgac

SEQ ID NO: 23344 - RNA, 24 nt, Homo sapiens
gguaccuuuacaggagcaccuaga

SEQ ID NO: 23345 - RNA, 20 nt, Homo sapiens
ugucucugauggguauuugc

SEQ ID NO: 23346 - RNA, 24 nt, Homo sapiens
aucccagagcuucccaggaucccu

SEQ ID NO: 23347 - RNA, 18 nt, Homo sapiens
ccugccagggggcugcgg

SEQ ID NO: 23348 - RNA, 24 nt, Homo sapiens
aucccagagcuucccaggaucccu

SEQ ID NO: 23349 - RNA, 18 nt, Homo sapiens
ccugccagggggcugcgg

SEQ ID NO: 23350 - RNA, 24 nt, Homo sapiens
aucccagagcuucccaggaucccu

SEQ ID NO: 23351 - RNA, 18 nt, Homo sapiens
ccugccagggggcugcgg

SEQ ID NO: 23352 - RNA, 24 nt, Homo sapiens
aucccagagcuucccaggaucccu

SEQ ID NO: 23353 - RNA, 18 nt, Homo sapiens
ccugccagggggcugcgg

SEQ ID NO: 23354 - RNA, 19 nt, Homo sapiens
gggcagcaggaacuuugcc

SEQ ID NO: 23355 - RNA, 20 nt, Homo sapiens
ucagcaggaggcugccggaa

SEQ ID NO: 23356 - RNA, 21 nt, Homo sapiens
ucugccauacgcgggcgcugc

SEQ ID NO: 23357 - RNA, 17 nt, Homo sapiens
ugaaagaccugaaacuc

SEQ ID NO: 23358 - RNA, 17 nt, Homo sapiens
ugaaagaccugaaacuc

SEQ ID NO: 23359 - RNA, 17 nt, Homo sapiens
uucugucuuccuucauu

SEQ ID NO: 23360 - RNA, 20 nt, Homo sapiens
cauugucccugaaugcucca

SEQ ID NO: 23361 - RNA, 19 nt, Homo sapiens
cgcacgguacccgugcugc

SEQ ID NO: 23362 - RNA, 21 nt, Homo sapiens
gcacaagccacggcggacucu

SEQ ID NO: 23363 - RNA, 19 nt, Homo sapiens
gcuugaaaagccgcggaac

SEQ ID NO: 23364 - RNA, 17 nt, Homo sapiens
ucacucccagacauuca

SEQ ID NO: 23365 - RNA, 20 nt, Homo sapiens
cauugucccugaaugcucca

SEQ ID NO: 23366 - RNA, 21 nt, Homo sapiens
gcacaagccacggcggacucu

SEQ ID NO: 23367 - RNA, 19 nt, Homo sapiens
gcuugaaaagccgcggaac

SEQ ID NO: 23368 - RNA, 17 nt, Homo sapiens
ucacucccagacauuca

SEQ ID NO: 23369 - RNA, 18 nt, Homo sapiens
cccucucccuccaccucc

SEQ ID NO: 23370 - RNA, 21 nt, Homo sapiens
ccucccugccacaggcacugc

SEQ ID NO: 23371 - RNA, 19 nt, Homo sapiens
cgcacgguacccgugcugc

SEQ ID NO: 23372 - RNA, 18 nt, Homo sapiens
cuguuuugccuucaccca

SEQ ID NO: 23373 - RNA, 21 nt, Homo sapiens
gcacaagccacggcggacucu

SEQ ID NO: 23374 - RNA, 22 nt, Homo sapiens
gcuacuuuugcuguuuuauuuu

SEQ ID NO: 23375 - RNA, 19 nt, Homo sapiens
gcuugaaaagccgcggaac

SEQ ID NO: 23376 - RNA, 19 nt, Homo sapiens
cgcacgguacccgugcugc

SEQ ID NO: 23377 - RNA, 21 nt, Homo sapiens
gcacaagccacggcggacucu

SEQ ID NO: 23378 - RNA, 19 nt, Homo sapiens
gcuugaaaagccgcggaac

SEQ ID NO: 23379 - RNA, 18 nt, Homo sapiens
ccccgacuccgcacccca

SEQ ID NO: 23380 - RNA, 17 nt, Homo sapiens
cuccuucagccaccugg

SEQ ID NO: 23381 - RNA, 24 nt, Homo sapiens
guggaaaccgccugggaauuccgg

SEQ ID NO: 23382 - RNA, 19 nt, Homo sapiens
ucaaacauucaugauggau

SEQ ID NO: 23383 - RNA, 19 nt, Homo sapiens
ucuucaauuuuuuaagcaa

SEQ ID NO: 23384 - RNA, 19 nt, Homo sapiens
ugccuaugcugacauucca

SEQ ID NO: 23385 - RNA, 17 nt, Homo sapiens
ugggacugcauucugaa

SEQ ID NO: 23386 - RNA, 19 nt, Homo sapiens
uguggauguuaccuugcuu

SEQ ID NO: 23387 - RNA, 25 nt, Homo sapiens
auaucccaccaucaccucaaaccca

SEQ ID NO: 23388 - RNA, 18 nt, Homo sapiens
uuugcuuacagugcauca

SEQ ID NO: 23389 - RNA, 23 nt, Homo sapiens
accagacagacagauacugugaa

SEQ ID NO: 23390 - RNA, 18 nt, Homo sapiens
caaagucaccuuucucuc

SEQ ID NO: 23391 - RNA, 21 nt, Homo sapiens
caccaccugggaagcccuucu

SEQ ID NO: 23392 - RNA, 24 nt, Homo sapiens
gaaacagagcacaggcugucugca

SEQ ID NO: 23393 - RNA, 21 nt, Homo sapiens
gcacguguagaguuuuuguca

SEQ ID NO: 23394 - RNA, 25 nt, Homo sapiens
gcgcucugcuguugccggugagucu

SEQ ID NO: 23395 - RNA, 18 nt, Homo sapiens
gguuccgcccacuucuuc

SEQ ID NO: 23396 - RNA, 23 nt, Homo sapiens
gucugcaccacauacauggacac

SEQ ID NO: 23397 - RNA, 23 nt, Homo sapiens
gugaacccugaggaguggaguca

SEQ ID NO: 23398 - RNA, 23 nt, Homo sapiens
gugaacccugaggaguggaguca

SEQ ID NO: 23399 - RNA, 20 nt, Homo sapiens
ucuguagaaaacguuaauuu

SEQ ID NO: 23400 - RNA, 18 nt, Homo sapiens
ugguuauuacaagagauu

SEQ ID NO: 23401 - RNA, 21 nt, Homo sapiens
ucauccugauggaacuauuca

SEQ ID NO: 23402 - RNA, 18 nt, Homo sapiens
uccugauggaacuauuca

SEQ ID NO: 23403 - RNA, 21 nt, Homo sapiens
accaccugagcccacugggca

SEQ ID NO: 23404 - RNA, 20 nt, Homo sapiens
cccugcaggcaggucugugg

SEQ ID NO: 23405 - RNA, 20 nt, Homo sapiens
gcacgagggggcggcuggga

SEQ ID NO: 23406 - RNA, 21 nt, Homo sapiens
uuuugucagcuguuuagccuu

SEQ ID NO: 23407 - RNA, 21 nt, Homo sapiens
ccaucucuggaggucucagga

SEQ ID NO: 23408 - RNA, 21 nt, Homo sapiens
cccuggucaagaaucugugag

SEQ ID NO: 23409 - RNA, 20 nt, Homo sapiens
ccuggucaagaaucugugag

SEQ ID NO: 23410 - RNA, 20 nt, Homo sapiens
uaauuguuuaggguaucaua

SEQ ID NO: 23411 - RNA, 18 nt, Homo sapiens
aaugaagaaugauguuau

SEQ ID NO: 23412 - RNA, 22 nt, Homo sapiens
gcggcccgaggccgugcgcgag

SEQ ID NO: 23413 - RNA, 16 nt, Homo sapiens
uuaaggacuuuccacu

SEQ ID NO: 23414 - RNA, 18 nt, Homo sapiens
acugcaacuuccaccucc

SEQ ID NO: 23415 - RNA, 19 nt, Homo sapiens
agacagcaucuugcuccuc

SEQ ID NO: 23416 - RNA, 18 nt, Homo sapiens
ccacccaccucugccucc

SEQ ID NO: 23417 - RNA, 25 nt, Homo sapiens
cuggaauuacaggcaccugccacua

SEQ ID NO: 23418 - RNA, 20 nt, Homo sapiens
cuuuuuuauucuuugaccuu

SEQ ID NO: 23419 - RNA, 21 nt, Homo sapiens
gggcaacacuaugccugguua

SEQ ID NO: 23420 - RNA, 17 nt, Homo sapiens
ucagauggcugugacua

SEQ ID NO: 23421 - RNA, 25 nt, Homo sapiens
ugcccaccccccugucccccgagcu

SEQ ID NO: 23422 - RNA, 20 nt, Homo sapiens
accugccaccagccauggca

SEQ ID NO: 23423 - RNA, 16 nt, Homo sapiens
acagauuaagcauuga

SEQ ID NO: 23424 - RNA, 20 nt, Homo sapiens
ccacugagccacucucugaa

SEQ ID NO: 23425 - RNA, 19 nt, Homo sapiens
cccgcccguaccugcacuu

SEQ ID NO: 23426 - RNA, 25 nt, Homo sapiens
guccguugcaguuucaccaaaugua

SEQ ID NO: 23427 - RNA, 23 nt, Homo sapiens
ugaaagaacagauuaagcauuga

SEQ ID NO: 23428 - RNA, 20 nt, Homo sapiens
cccugggccugggucugcgg

SEQ ID NO: 23429 - RNA, 19 nt, Homo sapiens
cucccccagccacucccca

SEQ ID NO: 23430 - RNA, 18 nt, Homo sapiens
cuuugccaucucugcucc

SEQ ID NO: 23431 - RNA, 22 nt, Homo sapiens
gaggccaucuggagagcccaga

SEQ ID NO: 23432 - RNA, 28 nt, Homo sapiens
gcaguucucccgugagagggccuucgcg

SEQ ID NO: 23433 - RNA, 20 nt, Homo sapiens
gccgcccucucaguuucggg

SEQ ID NO: 23434 - RNA, 26 nt, Homo sapiens
uccugcuucacaaaauggccaccgca

SEQ ID NO: 23435 - RNA, 23 nt, Homo sapiens
acagccugcucccagugcugugu

SEQ ID NO: 23436 - RNA, 20 nt, Homo sapiens
cauccccacccuguguacac

SEQ ID NO: 23437 - RNA, 16 nt, Homo sapiens
ccacacucccuccucu

SEQ ID NO: 23438 - RNA, 16 nt, Homo sapiens
ccccugggauggcuca

SEQ ID NO: 23439 - RNA, 19 nt, Homo sapiens
cugguuauuucuccucucu

SEQ ID NO: 23440 - RNA, 21 nt, Homo sapiens
ggaggaggcugggguggaacc

SEQ ID NO: 23441 - RNA, 21 nt, Homo sapiens
uccuuaugcgcacucucaaca

SEQ ID NO: 23442 - RNA, 18 nt, Homo sapiens
uggcucgggguggagcua

SEQ ID NO: 23443 - RNA, 25 nt, Homo sapiens
uggggcuugagcuggagcucgguua

SEQ ID NO: 23444 - RNA, 19 nt, Homo sapiens
aaguaugaaaaugauuuau

SEQ ID NO: 23445 - RNA, 21 nt, Homo sapiens
caccuagaaccucccuccuuu

SEQ ID NO: 23446 - RNA, 17 nt, Homo sapiens
ccucuccuuccaacaaa

SEQ ID NO: 23447 - RNA, 19 nt, Homo sapiens
gugaauggggaagggaguc

SEQ ID NO: 23448 - RNA, 23 nt, Homo sapiens
ugaagguaucuuagguggagcua

SEQ ID NO: 23449 - RNA, 22 nt, Homo sapiens
uauuucaucuucuuccuuuccc

SEQ ID NO: 23450 - RNA, 24 nt, Homo sapiens
uucuacugggcauaauuauaucuu

SEQ ID NO: 23451 - RNA, 18 nt, Homo sapiens
cgauccuccccuggacuc

SEQ ID NO: 23452 - RNA, 21 nt, Homo sapiens
caaaagggccaucucugcccu

SEQ ID NO: 23453 - RNA, 18 nt, Homo sapiens
ccgagucccuuuauguca

SEQ ID NO: 23454 - RNA, 17 nt, Homo sapiens
gccccaggccacuguca

SEQ ID NO: 23455 - RNA, 22 nt, Homo sapiens
ggaaagcugcaauaaagccaca

SEQ ID NO: 23456 - RNA, 19 nt, Homo sapiens
ggccgggugcgguggcuca

SEQ ID NO: 23457 - RNA, 17 nt, Homo sapiens
acaagaaaacauuuaca

SEQ ID NO: 23458 - RNA, 16 nt, Homo sapiens
gcccaccaggcuucuu

SEQ ID NO: 23459 - RNA, 22 nt, Homo sapiens
ggguccacacggcggcugcugc

SEQ ID NO: 23460 - RNA, 21 nt, Homo sapiens
gcacgugucuggucacaucca

SEQ ID NO: 23461 - RNA, 20 nt, Homo sapiens
ggcuucugugguugcuccca

SEQ ID NO: 23462 - RNA, 20 nt, Homo sapiens
uucugaaauaaagcaucucc

SEQ ID NO: 23463 - RNA, 20 nt, Homo sapiens
ccugacuuuucuuugugaga

SEQ ID NO: 23464 - RNA, 20 nt, Homo sapiens
cucuugaggcucuggagucc

SEQ ID NO: 23465 - RNA, 21 nt, Homo sapiens
acuuuccugugccuuuugcau

SEQ ID NO: 23466 - RNA, 18 nt, Homo sapiens
ggucucaagauggaacug

SEQ ID NO: 23467 - RNA, 21 nt, Homo sapiens
aagagaggcucucaaacuuug

SEQ ID NO: 23468 - RNA, 24 nt, Homo sapiens
accuggacucggcgcgccuagcuc

SEQ ID NO: 23469 - RNA, 21 nt, Homo sapiens
gcggagccuuggagcugagcc

SEQ ID NO: 23470 - RNA, 20 nt, Homo sapiens
aagagagguagaauggugcu

SEQ ID NO: 23471 - RNA, 23 nt, Homo sapiens
uaggugggaagguggcaugggau

SEQ ID NO: 23472 - RNA, 24 nt, Homo sapiens
uguaggaaaauauaguugugggug

SEQ ID NO: 23473 - RNA, 18 nt, Homo sapiens
gucauaaguccuuuguga

SEQ ID NO: 23474 - RNA, 23 nt, Homo sapiens
guuuuggaaucugccuuauaccu

SEQ ID NO: 23475 - RNA, 25 nt, Homo sapiens
acacccugggggcagcucucugcca

SEQ ID NO: 23476 - RNA, 20 nt, Homo sapiens
cgagaccggccuugucugcu

SEQ ID NO: 23477 - RNA, 21 nt, Homo sapiens
cuuccacagagcucguuugca

SEQ ID NO: 23478 - RNA, 19 nt, Homo sapiens
guccaggagcagcagagga

SEQ ID NO: 23479 - RNA, 21 nt, Homo sapiens
acagggagggcugauaccucc

SEQ ID NO: 23480 - RNA, 23 nt, Homo sapiens
cucuggugugugaaggucggugg

SEQ ID NO: 23481 - RNA, 21 nt, Homo sapiens
agagggugagagccaccauca

SEQ ID NO: 23482 - RNA, 17 nt, Homo sapiens
auccacacagggcuuuu

SEQ ID NO: 23483 - RNA, 21 nt, Homo sapiens
cauuaccacauccacacaggg

SEQ ID NO: 23484 - RNA, 17 nt, Homo sapiens
gugacuaaaagccccug

SEQ ID NO: 23485 - RNA, 21 nt, Homo sapiens
acaauguuggcacaagacuca

SEQ ID NO: 23486 - RNA, 19 nt, Homo sapiens
cucagccggucauguugaa

SEQ ID NO: 23487 - RNA, 19 nt, Homo sapiens
cugcaacauauucaucauc

SEQ ID NO: 23488 - RNA, 18 nt, Homo sapiens
agcaugaauguuaaccca

SEQ ID NO: 23489 - RNA, 17 nt, Homo sapiens
gcggggugggggcugcc

SEQ ID NO: 23490 - RNA, 22 nt, Homo sapiens
acccaccaccacacccagcuca

SEQ ID NO: 23491 - RNA, 20 nt, Homo sapiens
ccucugccucccggguucaa

SEQ ID NO: 23492 - RNA, 24 nt, Homo sapiens
ggagccggcgacggcggcaguggc

SEQ ID NO: 23493 - RNA, 18 nt, Homo sapiens
uggagugauguggagcua

SEQ ID NO: 23494 - RNA, 20 nt, Homo sapiens
uuccacacagcgccuguaga

SEQ ID NO: 23495 - RNA, 25 nt, Homo sapiens
uaaaagccagaagcaucuuguaaua

SEQ ID NO: 23496 - RNA, 23 nt, Homo sapiens
ucugccuuccuucugcuuuuugg

SEQ ID NO: 23497 - RNA, 21 nt, Homo sapiens
aaacacagcugauuucagugg

SEQ ID NO: 23498 - RNA, 22 nt, Homo sapiens
guuccuuacaauaucuuucuca

SEQ ID NO: 23499 - RNA, 21 nt, Homo sapiens
gccaccucgggaaagaguuua

SEQ ID NO: 23500 - RNA, 21 nt, Homo sapiens
uuucacucacuauuucacuuu

SEQ ID NO: 23501 - RNA, 18 nt, Homo sapiens
aucccagcuaacguggca

SEQ ID NO: 23502 - RNA, 17 nt, Homo sapiens
aucuucccaaugaggaa

SEQ ID NO: 23503 - RNA, 23 nt, Homo sapiens
ccaagacuugaguuggcaacuca

SEQ ID NO: 23504 - RNA, 20 nt, Homo sapiens
cguggguggcucuccuuuug

SEQ ID NO: 23505 - RNA, 19 nt, Homo sapiens
gccugacccaggccggcca

SEQ ID NO: 23506 - RNA, 22 nt, Homo sapiens
ggccuggucugaucucauuuua

SEQ ID NO: 23507 - RNA, 20 nt, Homo sapiens
aucaagcaggaaccccugga

SEQ ID NO: 23508 - RNA, 19 nt, Homo sapiens
augcacccccaggcuucaa

SEQ ID NO: 23509 - RNA, 23 nt, Homo sapiens
gaugcagcccuaacugcaaaagu

SEQ ID NO: 23510 - RNA, 20 nt, Homo sapiens
ggggucacugggccuggcca

SEQ ID NO: 23511 - RNA, 24 nt, Homo sapiens
gugguucuguagggaccuuuguca

SEQ ID NO: 23512 - RNA, 16 nt, Homo sapiens
aaaccacaucucuacu

SEQ ID NO: 23513 - RNA, 24 nt, Homo sapiens
agccuggccaacauggcaaaacca

SEQ ID NO: 23514 - RNA, 19 nt, Homo sapiens
caacauucacuauguuugc

SEQ ID NO: 23515 - RNA, 18 nt, Homo sapiens
ccaggcuccuauugaagg

SEQ ID NO: 23516 - RNA, 19 nt, Homo sapiens
cugagaagcaacuugcauu

SEQ ID NO: 23517 - RNA, 22 nt, Homo sapiens
gaaccaagauugcaccacugca

SEQ ID NO: 23518 - RNA, 20 nt, Homo sapiens
uaaauaucuauuuauuauua

SEQ ID NO: 23519 - RNA, 18 nt, Homo sapiens
augggacggcuccucuga

SEQ ID NO: 23520 - RNA, 17 nt, Homo sapiens
caaccuucccuagcccc

SEQ ID NO: 23521 - RNA, 25 nt, Homo sapiens
cccgaagagggcucggaggaugagc

SEQ ID NO: 23522 - RNA, 22 nt, Homo sapiens
ccucuuugugguugccuucacu

SEQ ID NO: 23523 - RNA, 24 nt, Homo sapiens
cuuccugggcccucauugcugcuu

SEQ ID NO: 23524 - RNA, 19 nt, Homo sapiens
uccuggucagcugcgugga

SEQ ID NO: 23525 - RNA, 19 nt, Homo sapiens
ucucuccgcuucuugcaca

SEQ ID NO: 23526 - RNA, 19 nt, Homo sapiens
ugggcuugccacagcccca

SEQ ID NO: 23527 - RNA, 25 nt, Homo sapiens
ccugacaccuggcuguuuugauguu

SEQ ID NO: 23528 - RNA, 17 nt, Homo sapiens
guuucuaauuggaaugc

SEQ ID NO: 23529 - RNA, 20 nt, Homo sapiens
uuuuuuuguggcuucacuug

SEQ ID NO: 23530 - RNA, 18 nt, Homo sapiens
acgugugcagcucagcca

SEQ ID NO: 23531 - RNA, 18 nt, Homo sapiens
ucccaaaugaugcuccag

SEQ ID NO: 23532 - RNA, 25 nt, Homo sapiens
auaauagacaaaagaaaauggcaca

SEQ ID NO: 23533 - RNA, 18 nt, Homo sapiens
auccugcuucaagucagc

SEQ ID NO: 23534 - RNA, 21 nt, Homo sapiens
gcagaaacuaaagccuuuuua

SEQ ID NO: 23535 - RNA, 21 nt, Homo sapiens
ccucugcugcugccuuggcuu

SEQ ID NO: 23536 - RNA, 20 nt, Homo sapiens
cuccacaccccacugccucu

SEQ ID NO: 23537 - RNA, 19 nt, Homo sapiens
gaagccccagagaaucuaa

SEQ ID NO: 23538 - RNA, 21 nt, Homo sapiens
gacuggcaggugacucccuca

SEQ ID NO: 23539 - RNA, 19 nt, Homo sapiens
gauucagcucccaucccuc

SEQ ID NO: 23540 - RNA, 21 nt, Homo sapiens
agucucacucuguugcccagc

SEQ ID NO: 23541 - RNA, 22 nt, Homo sapiens
ccauggccgccugcacagccag

SEQ ID NO: 23542 - RNA, 17 nt, Homo sapiens
cuguuuugcuuuguuuu

SEQ ID NO: 23543 - RNA, 19 nt, Homo sapiens
gcagucacccgcgaguuuu

SEQ ID NO: 23544 - RNA, 26 nt, Homo sapiens
gugucuucaugguugccguggguuuu

SEQ ID NO: 23545 - RNA, 22 nt, Homo sapiens
uccuacccuuguugccauccca

SEQ ID NO: 23546 - RNA, 22 nt, Homo sapiens
accauaggggaaaguuugggga

SEQ ID NO: 23547 - RNA, 18 nt, Homo sapiens
auuauauugaaaguaaau

SEQ ID NO: 23548 - RNA, 18 nt, Homo sapiens
caguuaggagucauggau

SEQ ID NO: 23549 - RNA, 23 nt, Homo sapiens
cuuggguuucugagucugcuuuu

SEQ ID NO: 23550 - RNA, 18 nt, Homo sapiens
augaaaggaggguucuga

SEQ ID NO: 23551 - RNA, 18 nt, Homo sapiens
gaggaauggagauugcca

SEQ ID NO: 23552 - RNA, 19 nt, Homo sapiens
ccagggucagcuguuccag

SEQ ID NO: 23553 - RNA, 20 nt, Homo sapiens
aucagaagcucaccaaagca

SEQ ID NO: 23554 - RNA, 17 nt, Homo sapiens
auugcccucaacagcca

SEQ ID NO: 23555 - RNA, 15 nt, Homo sapiens
ggccuccuucccaca

SEQ ID NO: 23556 - RNA, 18 nt, Homo sapiens
gccacuuguaacugcaca

SEQ ID NO: 23557 - RNA, 18 nt, Homo sapiens
ggcuucugugugccuguu

SEQ ID NO: 23558 - RNA, 20 nt, Homo sapiens
auuccccccagugcugcugc

SEQ ID NO: 23559 - RNA, 17 nt, Homo sapiens
caggccuccaccucccc

SEQ ID NO: 23560 - RNA, 21 nt, Homo sapiens
ccagagcagagcuggagcuga

SEQ ID NO: 23561 - RNA, 18 nt, Homo sapiens
uugcgaccgcuugagccc

SEQ ID NO: 23562 - RNA, 19 nt, Homo sapiens
cucacagcaacuccauuaa

SEQ ID NO: 23563 - RNA, 15 nt, Homo sapiens
ggccccaagcugaca

SEQ ID NO: 23564 - RNA, 18 nt, Homo sapiens
ucacgccguagccuguua

SEQ ID NO: 23565 - RNA, 21 nt, Homo sapiens
uggcccuaucagccugugaac

SEQ ID NO: 23566 - RNA, 17 nt, Homo sapiens
accagagacaaaucaga

SEQ ID NO: 23567 - RNA, 19 nt, Homo sapiens
cccugccauagccuugaug

SEQ ID NO: 23568 - RNA, 19 nt, Homo sapiens
cgcauccugcaccugccac

SEQ ID NO: 23569 - RNA, 23 nt, Homo sapiens
cugggcacaagccaccugccaaa

SEQ ID NO: 23570 - RNA, 16 nt, Homo sapiens
aagaaauuagauccca

SEQ ID NO: 23571 - RNA, 19 nt, Homo sapiens
aaguagaaucacauguaac

SEQ ID NO: 23572 - RNA, 18 nt, Homo sapiens
uucaaaaucauuuggaga

SEQ ID NO: 23573 - RNA, 20 nt, Homo sapiens
cgcgccgcccgugcccgcgc

SEQ ID NO: 23574 - RNA, 23 nt, Homo sapiens
cgcgcgccacaccccagcgcgcu

SEQ ID NO: 23575 - RNA, 19 nt, Homo sapiens
ugccugcugcucuucucgg

SEQ ID NO: 23576 - RNA, 19 nt, Homo sapiens
cucuucaaacugugacuuu

SEQ ID NO: 23577 - RNA, 18 nt, Homo sapiens
gccaagauggagaugcca

SEQ ID NO: 23578 - RNA, 20 nt, Homo sapiens
acaauguggggucggagcuu

SEQ ID NO: 23579 - RNA, 23 nt, Homo sapiens
acggccauagcuguggacucucu

SEQ ID NO: 23580 - RNA, 18 nt, Homo sapiens
aguauugcccccguguug

SEQ ID NO: 23581 - RNA, 16 nt, Homo sapiens
ccagcccacccaccuu

SEQ ID NO: 23582 - RNA, 20 nt, Homo sapiens
ccagcuaaauacccugccug

SEQ ID NO: 23583 - RNA, 22 nt, Homo sapiens
cccauggcuuccaucugagcca

SEQ ID NO: 23584 - RNA, 19 nt, Homo sapiens
cugggccggggcugggcuu

SEQ ID NO: 23585 - RNA, 17 nt, Homo sapiens
ggacggggcgcccgcgc

SEQ ID NO: 23586 - RNA, 18 nt, Homo sapiens
ucccugccacaaccugca

SEQ ID NO: 23587 - RNA, 26 nt, Homo sapiens
ucucuggcacaguuugccuuggccuu

SEQ ID NO: 23588 - RNA, 22 nt, Homo sapiens
uggucccgggaauucugugaac

SEQ ID NO: 23589 - RNA, 16 nt, Homo sapiens
caaggaggggacuuuc

SEQ ID NO: 23590 - RNA, 22 nt, Homo sapiens
uuucuaauaaaugauugcugua

SEQ ID NO: 23591 - RNA, 23 nt, Homo sapiens
agaccagccucggcaacaugcca

SEQ ID NO: 23592 - RNA, 20 nt, Homo sapiens
cgcccagggccuguguucca

SEQ ID NO: 23593 - RNA, 18 nt, Homo sapiens
gcagugaccaccuccccu

SEQ ID NO: 23594 - RNA, 18 nt, Homo sapiens
ggggcagaaccccucuua

SEQ ID NO: 23595 - RNA, 18 nt, Homo sapiens
ccagaggaagccugugua

SEQ ID NO: 23596 - RNA, 22 nt, Homo sapiens
ccagacccuggggcagccccuc

SEQ ID NO: 23597 - RNA, 21 nt, Homo sapiens
ccccgcuccgccccccgccgc

SEQ ID NO: 23598 - RNA, 21 nt, Homo sapiens
cccuucauggcuugccuccug

SEQ ID NO: 23599 - RNA, 21 nt, Homo sapiens
gcccugguccagcagggacug

SEQ ID NO: 23600 - RNA, 17 nt, Homo sapiens
uacagaugugaccuauc

SEQ ID NO: 23601 - RNA, 16 nt, Homo sapiens
uccccaucuucuugca

SEQ ID NO: 23602 - RNA, 21 nt, Homo sapiens
uuugacaugggaaaggaguug

SEQ ID NO: 23603 - RNA, 21 nt, Homo sapiens
gcccuugcggccuccuggccc

SEQ ID NO: 23604 - RNA, 16 nt, Homo sapiens
uccagaagcugcccag

SEQ ID NO: 23605 - RNA, 18 nt, Homo sapiens
uggguggaucgccugagg

SEQ ID NO: 23606 - RNA, 18 nt, Homo sapiens
gucgccggagcugcaaug

SEQ ID NO: 23607 - RNA, 22 nt, Homo sapiens
aggccacacccacuccaggaca

SEQ ID NO: 23608 - RNA, 22 nt, Homo sapiens
gcagccauagaggagagcuuuc

SEQ ID NO: 23609 - RNA, 23 nt, Homo sapiens
guagguuucucucuguaauaaca

SEQ ID NO: 23610 - RNA, 21 nt, Homo sapiens
ucuuggcucccugccaucagc

SEQ ID NO: 23611 - RNA, 21 nt, Homo sapiens
aguccaugagugugcacuuca

SEQ ID NO: 23612 - RNA, 19 nt, Homo sapiens
aggaaaugucuugacuccc

SEQ ID NO: 23613 - RNA, 19 nt, Homo sapiens
ccagauccagagaucccca

SEQ ID NO: 23614 - RNA, 21 nt, Homo sapiens
cucugugggcagggcuugugg

SEQ ID NO: 23615 - RNA, 18 nt, Homo sapiens
uccagagcagaggaaucu

SEQ ID NO: 23616 - RNA, 23 nt, Homo sapiens
uggacacucaggcacagaguggc

SEQ ID NO: 23617 - RNA, 21 nt, Homo sapiens
ugugggcagggcuugugggug

SEQ ID NO: 23618 - RNA, 17 nt, Homo sapiens
uuccagagaugcacucc

SEQ ID NO: 23619 - RNA, 19 nt, Homo sapiens
ggaacucugggggcccuga

SEQ ID NO: 23620 - RNA, 18 nt, Homo sapiens
uaguccugaaauauuuuu

SEQ ID NO: 23621 - RNA, 22 nt, Homo sapiens
uuacagcugaguuagaagauga

SEQ ID NO: 23622 - RNA, 24 nt, Homo sapiens
cccgggcaggcccccagcacccca

SEQ ID NO: 23623 - RNA, 17 nt, Homo sapiens
cuaaaaauaucugugaa

SEQ ID NO: 23624 - RNA, 19 nt, Homo sapiens
cuuuuccuccucugcgucu

SEQ ID NO: 23625 - RNA, 23 nt, Homo sapiens
gcccaggccaccggccggguucu

SEQ ID NO: 23626 - RNA, 22 nt, Homo sapiens
gccugaauccuugccugugucu

SEQ ID NO: 23627 - RNA, 19 nt, Homo sapiens
aagcaagaacaaucaggac

SEQ ID NO: 23628 - RNA, 20 nt, Homo sapiens
aucaggaaacuuacuggaga

SEQ ID NO: 23629 - RNA, 18 nt, Homo sapiens
caagaacaaucaggacca

SEQ ID NO: 23630 - RNA, 20 nt, Homo sapiens
cuguggccucacucucugaa

SEQ ID NO: 23631 - RNA, 17 nt, Homo sapiens
gaccaaaugugagacug

SEQ ID NO: 23632 - RNA, 20 nt, Homo sapiens
ggaacccuaaguauagaccu

SEQ ID NO: 23633 - RNA, 19 nt, Homo sapiens
gguagcuaauguccgaaga

SEQ ID NO: 23634 - RNA, 20 nt, Homo sapiens
gugacucucugagaaccagc

SEQ ID NO: 23635 - RNA, 23 nt, Homo sapiens
ucaaccuaaaaugcuggauccca

SEQ ID NO: 23636 - RNA, 22 nt, Homo sapiens
ugcugcucaucaggaaacuuac

SEQ ID NO: 23637 - RNA, 16 nt, Homo sapiens
ugguucuuacacaucu

SEQ ID NO: 23638 - RNA, 23 nt, Homo sapiens
agaagaaaaacuuggaggacuca

SEQ ID NO: 23639 - RNA, 22 nt, Homo sapiens
aucuuauauaaaauuuaacuca

SEQ ID NO: 23640 - RNA, 16 nt, Homo sapiens
aaacacugaagauguc

SEQ ID NO: 23641 - RNA, 20 nt, Homo sapiens
agauccacccacaccuaagu

SEQ ID NO: 23642 - RNA, 18 nt, Homo sapiens
uucuccugcuguuuccuu

SEQ ID NO: 23643 - RNA, 20 nt, Homo sapiens
uucugaaaccagagaucugu

SEQ ID NO: 23644 - RNA, 23 nt, Homo sapiens
cucuuucccucucccugucccuc

SEQ ID NO: 23645 - RNA, 24 nt, Homo sapiens
guggacauuuggcaggaguuuuga

SEQ ID NO: 23646 - RNA, 21 nt, Homo sapiens
guugggucaagauccugguuc

SEQ ID NO: 23647 - RNA, 17 nt, Homo sapiens
uuuguugauuuuggugu

SEQ ID NO: 23648 - RNA, 22 nt, Homo sapiens
cccagaucugagcauucuaggc

SEQ ID NO: 23649 - RNA, 19 nt, Homo sapiens
gucaaauaggaaacaucac

SEQ ID NO: 23650 - RNA, 20 nt, Homo sapiens
gugcugugaugcccaugaca

SEQ ID NO: 23651 - RNA, 17 nt, Homo sapiens
uuugguaugguucucag

SEQ ID NO: 23652 - RNA, 20 nt, Homo sapiens
acugacuuccugaacuccca

SEQ ID NO: 23653 - RNA, 22 nt, Homo sapiens
cucuugaagaacugacuuccug

SEQ ID NO: 23654 - RNA, 23 nt, Homo sapiens
ucaugcagauaguauacacauca

SEQ ID NO: 23655 - RNA, 18 nt, Homo sapiens
gugcacacuaccuuccca

SEQ ID NO: 23656 - RNA, 17 nt, Homo sapiens
ucacuuguaccccacua

SEQ ID NO: 23657 - RNA, 18 nt, Homo sapiens
cuccccaccuugcugccu

SEQ ID NO: 23658 - RNA, 20 nt, Homo sapiens
uccagaauuuggagucucca

SEQ ID NO: 23659 - RNA, 22 nt, Homo sapiens
uaaauacuuuagcaaaaacauu

SEQ ID NO: 23660 - RNA, 17 nt, Homo sapiens
uuugcaaacugauguua

SEQ ID NO: 23661 - RNA, 21 nt, Homo sapiens
aaacauuuuaaaacuuaccuu

SEQ ID NO: 23662 - RNA, 26 nt, Homo sapiens
aaucucaaacuccagcacuggaauua

SEQ ID NO: 23663 - RNA, 20 nt, Homo sapiens
acaaaaacauuuuaaaacuu

SEQ ID NO: 23664 - RNA, 16 nt, Homo sapiens
gagcuacaaaauuuca

SEQ ID NO: 23665 - RNA, 16 nt, Homo sapiens
ugccauucuccugccu

SEQ ID NO: 23666 - RNA, 21 nt, Homo sapiens
aagaauuuuaccauucaguua

SEQ ID NO: 23667 - RNA, 18 nt, Homo sapiens
agaacuaaccaguaccuc

SEQ ID NO: 23668 - RNA, 19 nt, Homo sapiens
uuauagauguacauaccuc

SEQ ID NO: 23669 - RNA, 18 nt, Homo sapiens
uucaguugaucuucuuca

SEQ ID NO: 23670 - RNA, 21 nt, Homo sapiens
aagaauuuuaccauucaguua

SEQ ID NO: 23671 - RNA, 18 nt, Homo sapiens
agaacuaaccaguaccuc

SEQ ID NO: 23672 - RNA, 19 nt, Homo sapiens
uuauagauguacauaccuc

SEQ ID NO: 23673 - RNA, 18 nt, Homo sapiens
uucaguugaucuucuuca

SEQ ID NO: 23674 - RNA, 21 nt, Homo sapiens
aagaauuuuaccauucaguua

SEQ ID NO: 23675 - RNA, 18 nt, Homo sapiens
agaacuaaccaguaccuc

SEQ ID NO: 23676 - RNA, 19 nt, Homo sapiens
uuauagauguacauaccuc

SEQ ID NO: 23677 - RNA, 18 nt, Homo sapiens
uucaguugaucuucuuca

SEQ ID NO: 23678 - RNA, 19 nt, Homo sapiens
aaacuccugaccucaggug

SEQ ID NO: 23679 - RNA, 19 nt, Homo sapiens
cacuuucacaaauauuugg

SEQ ID NO: 23680 - RNA, 20 nt, Homo sapiens
ccucugccucccggguucaa

SEQ ID NO: 23681 - RNA, 23 nt, Homo sapiens
gacuuagaagccgccugaucaua

SEQ ID NO: 23682 - RNA, 23 nt, Homo sapiens
uaaagccuacaagugugaaauua

SEQ ID NO: 23683 - RNA, 17 nt, Homo sapiens
ucaagugauucuccugc

SEQ ID NO: 23684 - RNA, 19 nt, Homo sapiens
uugcaaagggccaaauuuc

SEQ ID NO: 23685 - RNA, 19 nt, Homo sapiens
aaacagcugcauggcacau

SEQ ID NO: 23686 - RNA, 21 nt, Homo sapiens
agggcagagcacauggccccc

SEQ ID NO: 23687 - RNA, 23 nt, Homo sapiens
ccagucaagcagaaaaacaggca

SEQ ID NO: 23688 - RNA, 19 nt, Homo sapiens
ggacucccagcuggagcug

SEQ ID NO: 23689 - RNA, 15 nt, Homo sapiens
uccucagaaccauuc

SEQ ID NO: 23690 - RNA, 18 nt, Homo sapiens
uuuggcacaacuugcgag

SEQ ID NO: 23691 - RNA, 23 nt, Homo sapiens
aaaucuuaggcuaccacauucua

SEQ ID NO: 23692 - RNA, 19 nt, Homo sapiens
acacccuagaacacuccua

SEQ ID NO: 23693 - RNA, 18 nt, Homo sapiens
augcuuaacagaucauua

SEQ ID NO: 23694 - RNA, 19 nt, Homo sapiens
cuguauuggacagcacugc

SEQ ID NO: 23695 - RNA, 24 nt, Homo sapiens
uccaauucaagccucucaacucaa

SEQ ID NO: 23696 - RNA, 20 nt, Homo sapiens
ccagcugccagcccagcucc

SEQ ID NO: 23697 - RNA, 17 nt, Homo sapiens
acacaggaccaguuugc

SEQ ID NO: 23698 - RNA, 20 nt, Homo sapiens
ccgaguccacucacagccag

SEQ ID NO: 23699 - RNA, 19 nt, Homo sapiens
cucaguaguggcugccagu

SEQ ID NO: 23700 - RNA, 20 nt, Homo sapiens
gggcggggauggcucggcca

SEQ ID NO: 23701 - RNA, 19 nt, Homo sapiens
ggggauggcucggccacug

SEQ ID NO: 23702 - RNA, 18 nt, Homo sapiens
caaacauuuuauucucaa

SEQ ID NO: 23703 - RNA, 21 nt, Homo sapiens
cgaggcugcagugugcuguga

SEQ ID NO: 23704 - RNA, 22 nt, Homo sapiens
cucugcgguguaaacagccgcg

SEQ ID NO: 23705 - RNA, 20 nt, Homo sapiens
cuugaagaaacaaaggcugg

SEQ ID NO: 23706 - RNA, 20 nt, Homo sapiens
acaccagcagccacaaccuc

SEQ ID NO: 23707 - RNA, 19 nt, Homo sapiens
cccagaaccacuccuccag

SEQ ID NO: 23708 - RNA, 24 nt, Homo sapiens
cuccagucaugcucuugucccuca

SEQ ID NO: 23709 - RNA, 19 nt, Homo sapiens
cuggccaagcugaugaccu

SEQ ID NO: 23710 - RNA, 21 nt, Homo sapiens
gcuguugucacacccaaaggg

SEQ ID NO: 23711 - RNA, 18 nt, Homo sapiens
gggaauagaaccuuucaa

SEQ ID NO: 23712 - RNA, 18 nt, Homo sapiens
uaacaaaagucuuugaua

SEQ ID NO: 23713 - RNA, 17 nt, Homo sapiens
ucaagaauaaauggugu

SEQ ID NO: 23714 - RNA, 18 nt, Homo sapiens
uccaggccaaguccaaca

SEQ ID NO: 23715 - RNA, 19 nt, Homo sapiens
ugaccagcuccuccaguca

SEQ ID NO: 23716 - RNA, 20 nt, Homo sapiens
ugagccuuccucuggaccca

SEQ ID NO: 23717 - RNA, 18 nt, Homo sapiens
gaccaccgcuugugugug

SEQ ID NO: 23718 - RNA, 23 nt, Homo sapiens
gucacugccaacuuggugacuca

SEQ ID NO: 23719 - RNA, 17 nt, Homo sapiens
cugucucccgucacccc

SEQ ID NO: 23720 - RNA, 20 nt, Homo sapiens
ucucuagaacagggauucca

SEQ ID NO: 23721 - RNA, 20 nt, Homo sapiens
aggacaucaggcccauccca

SEQ ID NO: 23722 - RNA, 21 nt, Homo sapiens
ccaucccaccacacucacuca

SEQ ID NO: 23723 - RNA, 19 nt, Homo sapiens
uuuucacugggaccuugca

SEQ ID NO: 23724 - RNA, 23 nt, Homo sapiens
uuuugguggaagugggccuugaa

SEQ ID NO: 23725 - RNA, 21 nt, Homo sapiens
uucugauggugugcaugugag

SEQ ID NO: 23726 - RNA, 19 nt, Homo sapiens
agaaaauauucaugcaugc

SEQ ID NO: 23727 - RNA, 21 nt, Homo sapiens
ugguguccuagcaggagacua

SEQ ID NO: 23728 - RNA, 20 nt, Homo sapiens
ugucuucugagcacaguauu

SEQ ID NO: 23729 - RNA, 25 nt, Homo sapiens
uucaagugguauuuaaaagcuuuaa

SEQ ID NO: 23730 - RNA, 21 nt, Homo sapiens
uucugaauagcauuugcugua

SEQ ID NO: 23731 - RNA, 18 nt, Homo sapiens
uuggcaucaccggugcac

SEQ ID NO: 23732 - RNA, 18 nt, Homo sapiens
uucugauuuuucauugcu

SEQ ID NO: 23733 - RNA, 16 nt, Homo sapiens
gagccuuuucucccca

SEQ ID NO: 23734 - RNA, 21 nt, Homo sapiens
gcucucaaggagaugcugcca

SEQ ID NO: 23735 - RNA, 18 nt, Homo sapiens
cggcucccgagucgccca

SEQ ID NO: 23736 - RNA, 19 nt, Homo sapiens
ucuuuucaugguuuauaac

SEQ ID NO: 23737 - RNA, 23 nt, Homo sapiens
ugauauauguaauauaccagagc

SEQ ID NO: 23738 - RNA, 19 nt, Homo sapiens
acucuucauggaaagcaac

SEQ ID NO: 23739 - RNA, 18 nt, Homo sapiens
cccaucuucauuauaaua

SEQ ID NO: 23740 - RNA, 24 nt, Homo sapiens
cccccaauccccccagauccugug

SEQ ID NO: 23741 - RNA, 25 nt, Homo sapiens
gccccgaacuguggucgccaggccc

SEQ ID NO: 23742 - RNA, 19 nt, Homo sapiens
ggccgggugcgguggcuca

SEQ ID NO: 23743 - RNA, 18 nt, Homo sapiens
ucucuacuaaaaaugcaa

SEQ ID NO: 23744 - RNA, 23 nt, Homo sapiens
uggagcccaugcugccuacagca

SEQ ID NO: 23745 - RNA, 18 nt, Homo sapiens
agaacuucaucuccaucu

SEQ ID NO: 23746 - RNA, 22 nt, Homo sapiens
ugcugcucaucagcugcccgcu

SEQ ID NO: 23747 - RNA, 22 nt, Homo sapiens
ggacuuaauugauugguauauu

SEQ ID NO: 23748 - RNA, 20 nt, Homo sapiens
agucucacucugucgcccag

SEQ ID NO: 23749 - RNA, 19 nt, Homo sapiens
ccccuuacccugcuguugu

SEQ ID NO: 23750 - RNA, 21 nt, Homo sapiens
gccuggggcugugcuuggcuu

SEQ ID NO: 23751 - RNA, 19 nt, Homo sapiens
guuggcuugugguuccucc

SEQ ID NO: 23752 - RNA, 21 nt, Homo sapiens
ucccuuagcccccccuccucu

SEQ ID NO: 23753 - RNA, 23 nt, Homo sapiens
acccugagcauaugcccucuugg

SEQ ID NO: 23754 - RNA, 18 nt, Homo sapiens
augccucaucacuuaagc

SEQ ID NO: 23755 - RNA, 17 nt, Homo sapiens
cagauggggcuguuuuc

SEQ ID NO: 23756 - RNA, 16 nt, Homo sapiens
ucuucuguuccugugu

SEQ ID NO: 23757 - RNA, 17 nt, Homo sapiens
ccuggacugaaaguauc

SEQ ID NO: 23758 - RNA, 19 nt, Homo sapiens
ugcuguuaauuguauguac

SEQ ID NO: 23759 - RNA, 21 nt, Homo sapiens
cagaacuuggauuucuuaaau

SEQ ID NO: 23760 - RNA, 19 nt, Homo sapiens
guguuggcgggauucugaa

SEQ ID NO: 23761 - RNA, 18 nt, Homo sapiens
ggaaugaaauuugauaaa

SEQ ID NO: 23762 - RNA, 19 nt, Homo sapiens
ggauaaaguugaggaucac

SEQ ID NO: 23763 - RNA, 17 nt, Homo sapiens
aaugagauucugacgug

SEQ ID NO: 23764 - RNA, 16 nt, Homo sapiens
aggauggagugcauca

SEQ ID NO: 23765 - RNA, 20 nt, Homo sapiens
caccaaaauagugcucgagu

SEQ ID NO: 23766 - RNA, 22 nt, Homo sapiens
ccaguggugacaugaccacucc

SEQ ID NO: 23767 - RNA, 19 nt, Homo sapiens
gauggcucaugucacaggc

SEQ ID NO: 23768 - RNA, 21 nt, Homo sapiens
gugcagcucacuaccaacagc

SEQ ID NO: 23769 - RNA, 21 nt, Homo sapiens
gugcagcucacuaccaacagc

SEQ ID NO: 23770 - RNA, 23 nt, Homo sapiens
uguccagguuucuccugagcuca

SEQ ID NO: 23771 - RNA, 19 nt, Homo sapiens
ccgccgccggcccucggug

SEQ ID NO: 23772 - RNA, 21 nt, Homo sapiens
cccaaaacaggacugugguga

SEQ ID NO: 23773 - RNA, 20 nt, Homo sapiens
gaauucucuacgauggccau

SEQ ID NO: 23774 - RNA, 17 nt, Homo sapiens
gaggcauuccugcucau

SEQ ID NO: 23775 - RNA, 22 nt, Homo sapiens
acuugaggccauugaagcugca

SEQ ID NO: 23776 - RNA, 18 nt, Homo sapiens
caugaauaaggugccagg

SEQ ID NO: 23777 - RNA, 21 nt, Homo sapiens
cauggauaucauguauccuuc

SEQ ID NO: 23778 - RNA, 23 nt, Homo sapiens
gcccagaggaggguaagacucug

SEQ ID NO: 23779 - RNA, 22 nt, Homo sapiens
uggggacuguuuuacucugaua

SEQ ID NO: 23780 - RNA, 22 nt, Homo sapiens
gauauucauauuauauacauca

SEQ ID NO: 23781 - RNA, 18 nt, Homo sapiens
acuuccaaaaggugcugg

SEQ ID NO: 23782 - RNA, 19 nt, Homo sapiens
augccacguacucagagua

SEQ ID NO: 23783 - RNA, 17 nt, Homo sapiens
cagaccaauucugugac

SEQ ID NO: 23784 - RNA, 23 nt, Homo sapiens
cuuaaguaauucuauaggauuuu

SEQ ID NO: 23785 - RNA, 19 nt, Homo sapiens
gaguaggccuccauacuuc

SEQ ID NO: 23786 - RNA, 18 nt, Homo sapiens
ucuuuuucaguugucuuu

SEQ ID NO: 23787 - RNA, 24 nt, Homo sapiens
ugaguggaugcagacaugagagua

SEQ ID NO: 23788 - RNA, 22 nt, Homo sapiens
aguaaguguuaguguguuagug

SEQ ID NO: 23789 - RNA, 20 nt, Homo sapiens
uccccuuuuccucuuauccc

SEQ ID NO: 23790 - RNA, 19 nt, Homo sapiens
agacucugccaccguguca

SEQ ID NO: 23791 - RNA, 19 nt, Homo sapiens
cccagaaagaggcguccca

SEQ ID NO: 23792 - RNA, 18 nt, Homo sapiens
gagcagcugaaaaucuca

SEQ ID NO: 23793 - RNA, 20 nt, Homo sapiens
uauuuagggaucugcagcga

SEQ ID NO: 23794 - RNA, 22 nt, Homo sapiens
auacuucuuugggugcugugcu

SEQ ID NO: 23795 - RNA, 23 nt, Homo sapiens
aacguaacacgagcagcaggcug

SEQ ID NO: 23796 - RNA, 23 nt, Homo sapiens
gccgcgagggagaggccgcggcc

SEQ ID NO: 23797 - RNA, 23 nt, Homo sapiens
cccgccacaccaaccaaccaaua

SEQ ID NO: 23798 - RNA, 23 nt, Homo sapiens
ggaggacgcggaaggccugcgag

SEQ ID NO: 23799 - RNA, 23 nt, Homo sapiens
ccacccccauucucagcuccucc

SEQ ID NO: 23800 - RNA, 22 nt, Homo sapiens
uaccgccucuguuucugcggcg

SEQ ID NO: 23801 - RNA, 18 nt, Homo sapiens
acuggugccugcuguggc

SEQ ID NO: 23802 - RNA, 23 nt, Homo sapiens
cugagccuccaggagcugccaga

SEQ ID NO: 23803 - RNA, 19 nt, Homo sapiens
guugauagcccucuaguca

SEQ ID NO: 23804 - RNA, 19 nt, Homo sapiens
ucuuugcugaaacaaccca

SEQ ID NO: 23805 - RNA, 19 nt, Homo sapiens
uuaaugaggaaggcacuga

SEQ ID NO: 23806 - RNA, 21 nt, Homo sapiens
aaaagcagcagcaaaugaaga

SEQ ID NO: 23807 - RNA, 23 nt, Homo sapiens
auuugaguaaguuuuacaugaca

SEQ ID NO: 23808 - RNA, 18 nt, Homo sapiens
gcugacuagguuggguca

SEQ ID NO: 23809 - RNA, 19 nt, Homo sapiens
uucagcacuuuaacgcuuu

SEQ ID NO: 23810 - RNA, 20 nt, Homo sapiens
auauauuaggucagcucuua

SEQ ID NO: 23811 - RNA, 22 nt, Homo sapiens
caaacuagcuaaaggaaaccaa

SEQ ID NO: 23812 - RNA, 28 nt, Homo sapiens
gccuaaaugcuuuaguuuuaggucauuu

SEQ ID NO: 23813 - RNA, 24 nt, Homo sapiens
guagcuuuaacaacuuuucuguua

SEQ ID NO: 23814 - RNA, 23 nt, Homo sapiens
uaagaacuggagcaaguacucuu

SEQ ID NO: 23815 - RNA, 16 nt, Homo sapiens
ugaacuuuguuuccca

SEQ ID NO: 23816 - RNA, 23 nt, Homo sapiens
uggguucuacgacauugaaguug

SEQ ID NO: 23817 - RNA, 23 nt, Homo sapiens
uuucuuuauagagaaaguaccuu

SEQ ID NO: 23818 - RNA, 21 nt, Homo sapiens
caagcacaaggccaugcaggu

SEQ ID NO: 23819 - RNA, 17 nt, Homo sapiens
caccccauggccccggc

SEQ ID NO: 23820 - RNA, 20 nt, Homo sapiens
ugccaccaccaccagacuca

SEQ ID NO: 23821 - RNA, 18 nt, Homo sapiens
uuggugccuuuucagcca

SEQ ID NO: 23822 - RNA, 16 nt, Homo sapiens
ucccugcaaagccucu

SEQ ID NO: 23823 - RNA, 16 nt, Homo sapiens
ugaagagauccaggua

SEQ ID NO: 23824 - RNA, 17 nt, Homo sapiens
gcaaauuuggcucgaua

SEQ ID NO: 23825 - RNA, 18 nt, Homo sapiens
gcacaucacugacuggua

SEQ ID NO: 23826 - RNA, 17 nt, Homo sapiens
uaaaaacaucauucaga

SEQ ID NO: 23827 - RNA, 20 nt, Homo sapiens
uggaaguuacaggguagcau

SEQ ID NO: 23828 - RNA, 17 nt, Homo sapiens
ugagcauggcagugcca

SEQ ID NO: 23829 - RNA, 19 nt, Homo sapiens
accauaguguccccauccc

SEQ ID NO: 23830 - RNA, 19 nt, Homo sapiens
aagauuggaggcuuaauua

SEQ ID NO: 23831 - RNA, 17 nt, Homo sapiens
gggacuguuuccaggca

SEQ ID NO: 23832 - RNA, 21 nt, Homo sapiens
aaccuccgccuccucaucuca

SEQ ID NO: 23833 - RNA, 20 nt, Homo sapiens
augggcacacagaaaugcac

SEQ ID NO: 23834 - RNA, 22 nt, Homo sapiens
gugggguauguuuaauuccucu

SEQ ID NO: 23835 - RNA, 20 nt, Homo sapiens
uucaaaugcagauuaauucu

SEQ ID NO: 23836 - RNA, 17 nt, Homo sapiens
acugugaccucuggcuu

SEQ ID NO: 23837 - RNA, 18 nt, Homo sapiens
cuccucucucuuccucuc

SEQ ID NO: 23838 - RNA, 20 nt, Homo sapiens
cucuuccucuccucucucuc

SEQ ID NO: 23839 - RNA, 20 nt, Homo sapiens
cucuuccucuccucucucuc

SEQ ID NO: 23840 - RNA, 20 nt, Homo sapiens
cucuuccucuccucucucuc

SEQ ID NO: 23841 - RNA, 22 nt, Homo sapiens
cucuuccucuccucucucucuc

SEQ ID NO: 23842 - RNA, 22 nt, Homo sapiens
cucuuccucuccucucuuccuc

SEQ ID NO: 23843 - RNA, 20 nt, Homo sapiens
cucuuucucuccucugucuc

SEQ ID NO: 23844 - RNA, 23 nt, Homo sapiens
uccugucucuccuccccuccucu

SEQ ID NO: 23845 - RNA, 17 nt, Homo sapiens
ucuuccucuccucucuc

SEQ ID NO: 23846 - RNA, 17 nt, Homo sapiens
ucuuccucucuucucuc

SEQ ID NO: 23847 - RNA, 21 nt, Homo sapiens
cgaggcugacuccgcgugaga

SEQ ID NO: 23848 - RNA, 20 nt, Homo sapiens
cugacccaagcucaggcaca

SEQ ID NO: 23849 - RNA, 23 nt, Homo sapiens
uucuggggcgugaggccugugag

SEQ ID NO: 23850 - RNA, 19 nt, Homo sapiens
caccaccaagucacuuccc

SEQ ID NO: 23851 - RNA, 27 nt, Homo sapiens
ggccgucccaaaacaaccauuuccucu

SEQ ID NO: 23852 - RNA, 20 nt, Homo sapiens
uggcgccugccuucuggcca

SEQ ID NO: 23853 - RNA, 16 nt, Homo sapiens
cccuugccugaacuga

SEQ ID NO: 23854 - RNA, 24 nt, Homo sapiens
agaguuuugugguuggguuagguu

SEQ ID NO: 23855 - RNA, 19 nt, Homo sapiens
aggccuuuccugcaagcug

SEQ ID NO: 23856 - RNA, 19 nt, Homo sapiens
aucacgucacugcauuuca

SEQ ID NO: 23857 - RNA, 21 nt, Homo sapiens
cagauuacacaaccagugucu

SEQ ID NO: 23858 - RNA, 18 nt, Homo sapiens
ccacgagagucugugcac

SEQ ID NO: 23859 - RNA, 18 nt, Homo sapiens
gccaaggcgggcagcuca

SEQ ID NO: 23860 - RNA, 22 nt, Homo sapiens
gugccuuggcuccuagaguuuu

SEQ ID NO: 23861 - RNA, 23 nt, Homo sapiens
ucuuuuauuuucuguuuugccuu

SEQ ID NO: 23862 - RNA, 20 nt, Homo sapiens
uuucuguuuugccuuaucuu

SEQ ID NO: 23863 - RNA, 22 nt, Homo sapiens
gcccuccugggccgucuggccu

SEQ ID NO: 23864 - RNA, 18 nt, Homo sapiens
agcucaucaguucccaua

SEQ ID NO: 23865 - RNA, 18 nt, Homo sapiens
aguagcuauagccauuaa

SEQ ID NO: 23866 - RNA, 20 nt, Homo sapiens
auaagcaaugauacaugaaa

SEQ ID NO: 23867 - RNA, 19 nt, Homo sapiens
uauuucaucguguuucaaa

SEQ ID NO: 23868 - RNA, 22 nt, Homo sapiens
aaaucuucaaaucugaauauac

SEQ ID NO: 23869 - RNA, 22 nt, Homo sapiens
aacaaaaacacaugauuuggaa

SEQ ID NO: 23870 - RNA, 19 nt, Homo sapiens
gcucucucucuguuuuguu

SEQ ID NO: 23871 - RNA, 20 nt, Homo sapiens
agucucacucuguugcccag

SEQ ID NO: 23872 - RNA, 22 nt, Homo sapiens
guguccggaauugguggguucu

SEQ ID NO: 23873 - RNA, 24 nt, Homo sapiens
ugcaaccucuaccuccuggauuca

SEQ ID NO: 23874 - RNA, 16 nt, Homo sapiens
ugcccacucgugcugc

SEQ ID NO: 23875 - RNA, 20 nt, Homo sapiens
uggccaggcuggucuugaac

SEQ ID NO: 23876 - RNA, 18 nt, Homo sapiens
uguuuaaaaacagcauua

SEQ ID NO: 23877 - RNA, 22 nt, Homo sapiens
acacaggaccuuuggccgcucc

SEQ ID NO: 23878 - RNA, 24 nt, Homo sapiens
gaaaacaaguaguccuguuugcca

SEQ ID NO: 23879 - RNA, 19 nt, Homo sapiens
uaaaaacauuuucaaagga

SEQ ID NO: 23880 - RNA, 17 nt, Homo sapiens
uugcuucuguuauuacc

SEQ ID NO: 23881 - RNA, 18 nt, Homo sapiens
augauucagucuguacca

SEQ ID NO: 23882 - RNA, 17 nt, Homo sapiens
cagcaaccucugccucc

SEQ ID NO: 23883 - RNA, 20 nt, Homo sapiens
ccucugccucccagguucaa

SEQ ID NO: 23884 - RNA, 20 nt, Homo sapiens
uugccauguugaaaauguuu

SEQ ID NO: 23885 - RNA, 18 nt, Homo sapiens
acacaggacuuggccaug

SEQ ID NO: 23886 - RNA, 17 nt, Homo sapiens
ccacaguaccacagugu

SEQ ID NO: 23887 - RNA, 16 nt, Homo sapiens
ccaggagaguccucag

SEQ ID NO: 23888 - RNA, 20 nt, Homo sapiens
cggugugccagcuucugggu

SEQ ID NO: 23889 - RNA, 20 nt, Homo sapiens
ugggcaaagaugcugccuua

SEQ ID NO: 23890 - RNA, 21 nt, Homo sapiens
uguggggguggcaggcaggug

SEQ ID NO: 23891 - RNA, 18 nt, Homo sapiens
gaugcaagccccuugcca

SEQ ID NO: 23892 - RNA, 19 nt, Homo sapiens
aagcaauucuccugccuca

SEQ ID NO: 23893 - RNA, 25 nt, Homo sapiens
caccaccaccacccagcuauuuuuu

SEQ ID NO: 23894 - RNA, 16 nt, Homo sapiens
cgucuucgucuuccuc

SEQ ID NO: 23895 - RNA, 23 nt, Homo sapiens
cguucacagcaaacaggauuccu

SEQ ID NO: 23896 - RNA, 20 nt, Homo sapiens
uucuuuuggugacccuccag

SEQ ID NO: 23897 - RNA, 24 nt, Homo sapiens
cccggaccaccccucauccagaug

SEQ ID NO: 23898 - RNA, 21 nt, Homo sapiens
gagaccuuuguuucugugaug

SEQ ID NO: 23899 - RNA, 19 nt, Homo sapiens
ugaguuucauaugaaauug

SEQ ID NO: 23900 - RNA, 25 nt, Homo sapiens
caggauagcagauaaccugcuuuga

SEQ ID NO: 23901 - RNA, 19 nt, Homo sapiens
cgcguaugugagcauagca

SEQ ID NO: 23902 - RNA, 22 nt, Homo sapiens
gccuguggucucucagaagcca

SEQ ID NO: 23903 - RNA, 20 nt, Homo sapiens
guaaaacaugcauuugcaau

SEQ ID NO: 23904 - RNA, 24 nt, Homo sapiens
ucuuggaaaaugaggaucucugag

SEQ ID NO: 23905 - RNA, 20 nt, Homo sapiens
ugacgcugaugaucacacca

SEQ ID NO: 23906 - RNA, 21 nt, Homo sapiens
aaacacuagaaaaagcauuga

SEQ ID NO: 23907 - RNA, 19 nt, Homo sapiens
aacacuagaaaaagcauug

SEQ ID NO: 23908 - RNA, 16 nt, Homo sapiens
cagcacaauggugacc

SEQ ID NO: 23909 - RNA, 19 nt, Homo sapiens
ugagguuuuuguuguuuuu

SEQ ID NO: 23910 - RNA, 20 nt, Homo sapiens
ccucugccucccagguucaa

SEQ ID NO: 23911 - RNA, 19 nt, Homo sapiens
cugcaaccucugccuccca

SEQ ID NO: 23912 - RNA, 25 nt, Homo sapiens
acuuggacagagcccugccuggccu

SEQ ID NO: 23913 - RNA, 18 nt, Homo sapiens
caaggggauggcccaggc

SEQ ID NO: 23914 - RNA, 21 nt, Homo sapiens
ccugggcaauucacuuaacuu

SEQ ID NO: 23915 - RNA, 19 nt, Homo sapiens
cuauaaggaauacacauac

SEQ ID NO: 23916 - RNA, 18 nt, Homo sapiens
cuggcgucugcuugguuu

SEQ ID NO: 23917 - RNA, 21 nt, Homo sapiens
gcaagaagucacuuaucacca

SEQ ID NO: 23918 - RNA, 17 nt, Homo sapiens
uacacccacaugcacac

SEQ ID NO: 23919 - RNA, 16 nt, Homo sapiens
uagcccuaguugucau

SEQ ID NO: 23920 - RNA, 18 nt, Homo sapiens
uccugaccucaugaucca

SEQ ID NO: 23921 - RNA, 19 nt, Homo sapiens
cucugggaagcaggaaggc

SEQ ID NO: 23922 - RNA, 19 nt, Homo sapiens
cacaugagaaaauaucuga

SEQ ID NO: 23923 - RNA, 19 nt, Homo sapiens
ccugaaauggcuuuaaauu

SEQ ID NO: 23924 - RNA, 19 nt, Homo sapiens
uacccuucacaauaccaca

SEQ ID NO: 23925 - RNA, 18 nt, Homo sapiens
uggaaauccacaauuuga

SEQ ID NO: 23926 - RNA, 18 nt, Homo sapiens
uuugcagauuugugguua

SEQ ID NO: 23927 - RNA, 20 nt, Homo sapiens
ccaggacucugcccaacaaa

SEQ ID NO: 23928 - RNA, 16 nt, Homo sapiens
cguggagaauugcuua

SEQ ID NO: 23929 - RNA, 18 nt, Homo sapiens
uauucuguuaaauccuca

SEQ ID NO: 23930 - RNA, 19 nt, Homo sapiens
ugugucagcaauuucugga

SEQ ID NO: 23931 - RNA, 21 nt, Homo sapiens
uuuuuuuaugauguuuggccu

SEQ ID NO: 23932 - RNA, 22 nt, Homo sapiens
caagaucgugccacuucacucc

SEQ ID NO: 23933 - RNA, 15 nt, Homo sapiens
ccaagaucgugccac

SEQ ID NO: 23934 - RNA, 18 nt, Homo sapiens
ccugcaaccuccaccucc

SEQ ID NO: 23935 - RNA, 19 nt, Homo sapiens
ucaugauccaccugccuca

SEQ ID NO: 23936 - RNA, 18 nt, Homo sapiens
uccaccucccggguucaa

SEQ ID NO: 23937 - RNA, 21 nt, Homo sapiens
ugcagugacccaagaucgugc

SEQ ID NO: 23938 - RNA, 20 nt, Homo sapiens
uggccaggcuggucuugaac

SEQ ID NO: 23939 - RNA, 24 nt, Homo sapiens
auaucaaucuuagacauuaccugu

SEQ ID NO: 23940 - RNA, 23 nt, Homo sapiens
cccgcuuccucaccacccccacu

SEQ ID NO: 23941 - RNA, 20 nt, Homo sapiens
gucucucccauucucuagua

SEQ ID NO: 23942 - RNA, 26 nt, Homo sapiens
uauacccacuuacuaauguggaauua

SEQ ID NO: 23943 - RNA, 20 nt, Homo sapiens
agucucacucuguuacccag

SEQ ID NO: 23944 - RNA, 18 nt, Homo sapiens
ccugcaaccuccaccucc

SEQ ID NO: 23945 - RNA, 19 nt, Homo sapiens
cugcaaccuccaccuccca

SEQ ID NO: 23946 - RNA, 18 nt, Homo sapiens
uccaccucccagguucaa

SEQ ID NO: 23947 - RNA, 18 nt, Homo sapiens
uucaagugauucucaugc

SEQ ID NO: 23948 - RNA, 20 nt, Homo sapiens
acaugcauuacacacaugca

SEQ ID NO: 23949 - RNA, 22 nt, Homo sapiens
ccccaggucucagauggaauua

SEQ ID NO: 23950 - RNA, 16 nt, Homo sapiens
acgaugaugaugaaca

SEQ ID NO: 23951 - RNA, 23 nt, Homo sapiens
agccgagaccagccuuuuaccuc

SEQ ID NO: 23952 - RNA, 25 nt, Homo sapiens
ggagauggccucagcuguggggcug

SEQ ID NO: 23953 - RNA, 21 nt, Homo sapiens
aagcuccacggccaccauaga

SEQ ID NO: 23954 - RNA, 21 nt, Homo sapiens
agaugaacuuuuguaucauua

SEQ ID NO: 23955 - RNA, 24 nt, Homo sapiens
uccacggccaccauagauaaccca

SEQ ID NO: 23956 - RNA, 27 nt, Homo sapiens
uuugcuuaauauuacagaaccaguucu

SEQ ID NO: 23957 - RNA, 18 nt, Homo sapiens
gccagcucuugcuaagca

SEQ ID NO: 23958 - RNA, 18 nt, Homo sapiens
gugguguccagccagcuc

SEQ ID NO: 23959 - RNA, 20 nt, Homo sapiens
ucaagcaguuacugaucaga

SEQ ID NO: 23960 - RNA, 18 nt, Homo sapiens
uuuuucuuuuuuuccuca

SEQ ID NO: 23961 - RNA, 18 nt, Homo sapiens
uggccacacugucaguga

SEQ ID NO: 23962 - RNA, 18 nt, Homo sapiens
aacgcucacacuuggcug

SEQ ID NO: 23963 - RNA, 17 nt, Homo sapiens
ucccugccaccacccca

SEQ ID NO: 23964 - RNA, 16 nt, Homo sapiens
acuuacaaaaacuugc

SEQ ID NO: 23965 - RNA, 22 nt, Homo sapiens
agaagagagaaaaauauacauu

SEQ ID NO: 23966 - RNA, 20 nt, Homo sapiens
guaguuuuggguuuuuuguu

SEQ ID NO: 23967 - RNA, 19 nt, Homo sapiens
cccagaggaacugauaagc

SEQ ID NO: 23968 - RNA, 21 nt, Homo sapiens
ccugggugauuuggguuuucu

SEQ ID NO: 23969 - RNA, 23 nt, Homo sapiens
gguggguggggaagugaaauguu

SEQ ID NO: 23970 - RNA, 22 nt, Homo sapiens
uuguucuaggaaugaggguagg

SEQ ID NO: 23971 - RNA, 16 nt, Homo sapiens
cccgcccccauaccuc

SEQ ID NO: 23972 - RNA, 18 nt, Homo sapiens
gauaacccagugcuuaaa

SEQ ID NO: 23973 - RNA, 19 nt, Homo sapiens
agaaacaguuaauuugggc

SEQ ID NO: 23974 - RNA, 23 nt, Homo sapiens
caagacauuugccaaauguauua

SEQ ID NO: 23975 - RNA, 22 nt, Homo sapiens
gagccaagaucauaccacugca

SEQ ID NO: 23976 - RNA, 23 nt, Homo sapiens
ugaguguaugucugaaccuguaa

SEQ ID NO: 23977 - RNA, 21 nt, Homo sapiens
uguuucaagacauuugccaaa

SEQ ID NO: 23978 - RNA, 22 nt, Homo sapiens
aauaggagacgaacgaauguaa

SEQ ID NO: 23979 - RNA, 26 nt, Homo sapiens
agguuucccauuuucuaaucauuuuu

SEQ ID NO: 23980 - RNA, 27 nt, Homo sapiens
cugugagaucaccgcaaaccuaccuua

SEQ ID NO: 23981 - RNA, 19 nt, Homo sapiens
ggguguguguguguuugua

SEQ ID NO: 23982 - RNA, 20 nt, Homo sapiens
uaggagaggcugggcccggu

SEQ ID NO: 23983 - RNA, 20 nt, Homo sapiens
uccagaucuguucuucacca

SEQ ID NO: 23984 - RNA, 17 nt, Homo sapiens
gucaucaaaaagaggau

SEQ ID NO: 23985 - RNA, 18 nt, Homo sapiens
accaccgcucccccuccu

SEQ ID NO: 23986 - RNA, 25 nt, Homo sapiens
ccuccucguccucgucgucguccuc

SEQ ID NO: 23987 - RNA, 21 nt, Homo sapiens
acuuuuucaacuugaaccuuc

SEQ ID NO: 23988 - RNA, 19 nt, Homo sapiens
cuuuugggaguucugugga

SEQ ID NO: 23989 - RNA, 17 nt, Homo sapiens
gcuucuguuccuccgcc

SEQ ID NO: 23990 - RNA, 17 nt, Homo sapiens
ccucuucucuuauccuc

SEQ ID NO: 23991 - RNA, 22 nt, Homo sapiens
ccuuccccuuucucugucucca

SEQ ID NO: 23992 - RNA, 18 nt, Homo sapiens
cagaauucugcacccuuc

SEQ ID NO: 23993 - RNA, 23 nt, Homo sapiens
uggggauuuguucaaugugaaau

SEQ ID NO: 23994 - RNA, 24 nt, Homo sapiens
ccagggggucacuccucccacccc

SEQ ID NO: 23995 - RNA, 17 nt, Homo sapiens
cccagccauuugcauug

SEQ ID NO: 23996 - RNA, 18 nt, Homo sapiens
aguauucagaagugcuug

SEQ ID NO: 23997 - RNA, 22 nt, Homo sapiens
ucaucuaacucaagccaaguaa

SEQ ID NO: 23998 - RNA, 23 nt, Homo sapiens
uucaaaaaauauaccauuggaga

SEQ ID NO: 23999 - RNA, 16 nt, Homo sapiens
caccuccagucucauu

SEQ ID NO: 24000 - RNA, 22 nt, Homo sapiens
ccagcguuucaaccucauucaa

SEQ ID NO: 24001 - RNA, 20 nt, Homo sapiens
uucaaaugugacucacuuuu

SEQ ID NO: 24002 - RNA, 18 nt, Homo sapiens
caauuuuggaaacaucuc

SEQ ID NO: 24003 - RNA, 25 nt, Homo sapiens
gagacuaggaccagaguccuuagca

SEQ ID NO: 24004 - RNA, 22 nt, Homo sapiens
accugagcccaaauccuggccc

SEQ ID NO: 24005 - RNA, 19 nt, Homo sapiens
uaaaaacaaaauggacaaa

SEQ ID NO: 24006 - RNA, 21 nt, Homo sapiens
agacaccgcggugggauucca

SEQ ID NO: 24007 - RNA, 16 nt, Homo sapiens
caguccugaugucaca

SEQ ID NO: 24008 - RNA, 21 nt, Homo sapiens
ucuccacgccggggacauuuc

SEQ ID NO: 24009 - RNA, 18 nt, Homo sapiens
ucuuuuuuguuuguguga

SEQ ID NO: 24010 - RNA, 19 nt, Homo sapiens
ucuuucuuuauucuaauaa

SEQ ID NO: 24011 - RNA, 27 nt, Homo sapiens
aaccgacagcagugugaagguguguca

SEQ ID NO: 24012 - RNA, 21 nt, Homo sapiens
cagccuggccaacuugaugaa

SEQ ID NO: 24013 - RNA, 22 nt, Homo sapiens
ccucuuuuacggaccauccuca

SEQ ID NO: 24014 - RNA, 18 nt, Homo sapiens
guuucugcauggaauaac

SEQ ID NO: 24015 - RNA, 17 nt, Homo sapiens
aaaaacaaacaaacaaa

SEQ ID NO: 24016 - RNA, 18 nt, Homo sapiens
ccagacccucagcacgca

SEQ ID NO: 24017 - RNA, 18 nt, Homo sapiens
agacaacgcugcagagcc

SEQ ID NO: 24018 - RNA, 17 nt, Homo sapiens
cugaacucaccuggccu

SEQ ID NO: 24019 - RNA, 22 nt, Homo sapiens
gccugggaagcaccgucugccc

SEQ ID NO: 24020 - RNA, 20 nt, Homo sapiens
ggacuuaauguagcauugca

SEQ ID NO: 24021 - RNA, 19 nt, Homo sapiens
uuuuucuuuuuuucccuca

SEQ ID NO: 24022 - RNA, 20 nt, Homo sapiens
aguucccaaacugcacuuua

SEQ ID NO: 24023 - RNA, 20 nt, Homo sapiens
cugaagauacuccccagugc

SEQ ID NO: 24024 - RNA, 22 nt, Homo sapiens
ugagaccuccugggucuaguca

SEQ ID NO: 24025 - RNA, 18 nt, Homo sapiens
accucugccccaaggcug

SEQ ID NO: 24026 - RNA, 20 nt, Homo sapiens
aggcugauccccguaaccua

SEQ ID NO: 24027 - RNA, 19 nt, Homo sapiens
gccucccugcaccucugcc

SEQ ID NO: 24028 - RNA, 16 nt, Homo sapiens
aagagacuucuuuugu

SEQ ID NO: 24029 - RNA, 21 nt, Homo sapiens
agcauccugucuucuucugug

SEQ ID NO: 24030 - RNA, 20 nt, Homo sapiens
agugagugggaaggagagug

SEQ ID NO: 24031 - RNA, 19 nt, Homo sapiens
caagccuguuuggcccuga

SEQ ID NO: 24032 - RNA, 19 nt, Homo sapiens
caggaccagugacagcacc

SEQ ID NO: 24033 - RNA, 22 nt, Homo sapiens
cuucuucugugcugccugguuu

SEQ ID NO: 24034 - RNA, 18 nt, Homo sapiens
gccacguguuugcagcga

SEQ ID NO: 24035 - RNA, 19 nt, Homo sapiens
gcucaugcuucucuaauca

SEQ ID NO: 24036 - RNA, 18 nt, Homo sapiens
acuuuucuacuccuguau

SEQ ID NO: 24037 - RNA, 20 nt, Homo sapiens
augcccagaucacauuccag

SEQ ID NO: 24038 - RNA, 20 nt, Homo sapiens
ggagaugaucagaaaucuca

SEQ ID NO: 24039 - RNA, 24 nt, Homo sapiens
ucacacaucaucccauccuuaaua

SEQ ID NO: 24040 - RNA, 19 nt, Homo sapiens
acguaauccaguauuugga

SEQ ID NO: 24041 - RNA, 20 nt, Homo sapiens
cagcuaauuaccucaucaua

SEQ ID NO: 24042 - RNA, 24 nt, Homo sapiens
gaggccguccgcccgacuccaaga

SEQ ID NO: 24043 - RNA, 20 nt, Homo sapiens
uuauuaucaguucuaugcua

SEQ ID NO: 24044 - RNA, 23 nt, Homo sapiens
accugaaccuccuugccugggcu

SEQ ID NO: 24045 - RNA, 19 nt, Homo sapiens
ccuccucgcccugggcugc

SEQ ID NO: 24046 - RNA, 19 nt, Homo sapiens
ccuccucgcccugggcugc

SEQ ID NO: 24047 - RNA, 23 nt, Homo sapiens
gccugggcugccccgccuggguc

SEQ ID NO: 24048 - RNA, 20 nt, Homo sapiens
gcugucguccuggugucaga

SEQ ID NO: 24049 - RNA, 19 nt, Homo sapiens
ggcaagacagcgcuguggc

SEQ ID NO: 24050 - RNA, 20 nt, Homo sapiens
uccugaugagggcguugugg

SEQ ID NO: 24051 - RNA, 23 nt, Homo sapiens
cauccugucuucauccucaagug

SEQ ID NO: 24052 - RNA, 20 nt, Homo sapiens
guaccucgggacauccauca

SEQ ID NO: 24053 - RNA, 19 nt, Homo sapiens
gugaacugucaggaguucu

SEQ ID NO: 24054 - RNA, 22 nt, Homo sapiens
guuuccuuguucuauuucagua

SEQ ID NO: 24055 - RNA, 21 nt, Homo sapiens
ucuuucuuucuguaacuccuu

SEQ ID NO: 24056 - RNA, 18 nt, Homo sapiens
ucaguugcaggcauuaca

SEQ ID NO: 24057 - RNA, 18 nt, Homo sapiens
cauucaaaauuccccguc

SEQ ID NO: 24058 - RNA, 21 nt, Homo sapiens
ccccaccccucccugcagcuu

SEQ ID NO: 24059 - RNA, 19 nt, Homo sapiens
gaagugaauccuuggcuua

SEQ ID NO: 24060 - RNA, 21 nt, Homo sapiens
gacccuggaggcccccucaca

SEQ ID NO: 24061 - RNA, 18 nt, Homo sapiens
ugagccuuccuaggguuu

SEQ ID NO: 24062 - RNA, 19 nt, Homo sapiens
gaaaaagaaaacuacauca

SEQ ID NO: 24063 - RNA, 18 nt, Homo sapiens
guaucauuacuauuacua

SEQ ID NO: 24064 - RNA, 22 nt, Homo sapiens
uuuguaaauauauauauauauu

SEQ ID NO: 24065 - RNA, 21 nt, Homo sapiens
caacccauucccucugcuucu

SEQ ID NO: 24066 - RNA, 20 nt, Homo sapiens
ccccaccuggguccccugca

SEQ ID NO: 24067 - RNA, 21 nt, Homo sapiens
ccugaacuccugagcgacaga

SEQ ID NO: 24068 - RNA, 20 nt, Homo sapiens
cgacagaagccccaggccuc

SEQ ID NO: 24069 - RNA, 18 nt, Homo sapiens
gggagugggacggcuccu

SEQ ID NO: 24070 - RNA, 18 nt, Homo sapiens
caguugccgcucuccacc

SEQ ID NO: 24071 - RNA, 18 nt, Homo sapiens
cccccaugaccuucuccc

SEQ ID NO: 24072 - RNA, 17 nt, Homo sapiens
cgccaccauacccagcu

SEQ ID NO: 24073 - RNA, 22 nt, Homo sapiens
uuaauuccaaaggcucuuccaa

SEQ ID NO: 24074 - RNA, 20 nt, Homo sapiens
aacagagagaacgagccugg

SEQ ID NO: 24075 - RNA, 17 nt, Homo sapiens
cggcggcggccgacagc

SEQ ID NO: 24076 - RNA, 20 nt, Homo sapiens
guguccagagcuggcccuuc

SEQ ID NO: 24077 - RNA, 18 nt, Homo sapiens
ugggauuguggcagccag

SEQ ID NO: 24078 - RNA, 21 nt, Homo sapiens
ucuaggcaguuauuuuuguuu

SEQ ID NO: 24079 - RNA, 19 nt, Homo sapiens
ccuugcuauuuucauauua

SEQ ID NO: 24080 - RNA, 19 nt, Homo sapiens
uuauaaaauuuauuugaua

SEQ ID NO: 24081 - RNA, 21 nt, Homo sapiens
uccugaggaacgacuaucuca

SEQ ID NO: 24082 - RNA, 18 nt, Homo sapiens
gguguugaguugccuuca

SEQ ID NO: 24083 - RNA, 18 nt, Homo sapiens
ucuggccuccauccucca

SEQ ID NO: 24084 - RNA, 18 nt, Homo sapiens
aguaguggacucgacuca

SEQ ID NO: 24085 - RNA, 17 nt, Homo sapiens
cccccaacucccuccca

SEQ ID NO: 24086 - RNA, 19 nt, Homo sapiens
ccggcuuccuuuucugucc

SEQ ID NO: 24087 - RNA, 22 nt, Homo sapiens
cuaggcaccccacgauuagcug

SEQ ID NO: 24088 - RNA, 22 nt, Homo sapiens
ggcaaaagcguagaucuuguca

SEQ ID NO: 24089 - RNA, 19 nt, Homo sapiens
uggauggacuccugcaggc

SEQ ID NO: 24090 - RNA, 20 nt, Homo sapiens
uuguuugacuuuuuguacaa

SEQ ID NO: 24091 - RNA, 17 nt, Homo sapiens
aagccccagcagcccca

SEQ ID NO: 24092 - RNA, 19 nt, Homo sapiens
cagcagcagcagcagcccc

SEQ ID NO: 24093 - RNA, 21 nt, Homo sapiens
cccgaggcaccgccgguaagc

SEQ ID NO: 24094 - RNA, 22 nt, Homo sapiens
agcuaugucuuucuccagugau

SEQ ID NO: 24095 - RNA, 22 nt, Homo sapiens
auuugaacuuagguguugguuu

SEQ ID NO: 24096 - RNA, 20 nt, Homo sapiens
ccacauuaucucuuuucaga

SEQ ID NO: 24097 - RNA, 19 nt, Homo sapiens
gcagagaacaaaaauuuca

SEQ ID NO: 24098 - RNA, 17 nt, Homo sapiens
aaaagaaagcaaggaua

SEQ ID NO: 24099 - RNA, 25 nt, Homo sapiens
gccuuagcucuguggugucuggcuc

SEQ ID NO: 24100 - RNA, 18 nt, Homo sapiens
ucuuagcugucuaauuuu

SEQ ID NO: 24101 - RNA, 17 nt, Homo sapiens
uuuagguaaucugcacu

SEQ ID NO: 24102 - RNA, 23 nt, Homo sapiens
acucuucaccacacccuguauuc

SEQ ID NO: 24103 - RNA, 19 nt, Homo sapiens
gccugaaccuuggcuuggc

SEQ ID NO: 24104 - RNA, 17 nt, Homo sapiens
aaggaguacuuguacug

SEQ ID NO: 24105 - RNA, 18 nt, Homo sapiens
cacaguaagauucccucu

SEQ ID NO: 24106 - RNA, 21 nt, Homo sapiens
cagacgugguguggugcacac

SEQ ID NO: 24107 - RNA, 18 nt, Homo sapiens
uuguacugcuuugauuuu

SEQ ID NO: 24108 - RNA, 22 nt, Homo sapiens
caccuuuuuaaaaaauugcaca

SEQ ID NO: 24109 - RNA, 21 nt, Homo sapiens
ccuauggaacuuugccugaug

SEQ ID NO: 24110 - RNA, 20 nt, Homo sapiens
gccccugcacaaggcugaca

SEQ ID NO: 24111 - RNA, 18 nt, Homo sapiens
agcacuucgccuuguccu

SEQ ID NO: 24112 - RNA, 17 nt, Homo sapiens
auuaucagggcauucua

SEQ ID NO: 24113 - RNA, 20 nt, Homo sapiens
caaaauuaauuucugccccu

SEQ ID NO: 24114 - RNA, 17 nt, Homo sapiens
cccaccugccccgagcu

SEQ ID NO: 24115 - RNA, 23 nt, Homo sapiens
ccuuuccaauuuuucuauuccag

SEQ ID NO: 24116 - RNA, 20 nt, Homo sapiens
cucuccccacuccacgcucc

SEQ ID NO: 24117 - RNA, 20 nt, Homo sapiens
ggagcgacggcggcugcagc

SEQ ID NO: 24118 - RNA, 19 nt, Homo sapiens
accaccacuccuaccuuuu

SEQ ID NO: 24119 - RNA, 22 nt, Homo sapiens
ucuggcugcauaacucacagga

SEQ ID NO: 24120 - RNA, 19 nt, Homo sapiens
ucugauugugaauacugcu

SEQ ID NO: 24121 - RNA, 19 nt, Homo sapiens
uuacgacguugccuggucu

SEQ ID NO: 24122 - RNA, 21 nt, Homo sapiens
uuugauguauaacuuccccuu

SEQ ID NO: 24123 - RNA, 24 nt, Homo sapiens
accagagacccagaccccacucca

SEQ ID NO: 24124 - RNA, 18 nt, Homo sapiens
agucagacagcagcucug

SEQ ID NO: 24125 - RNA, 19 nt, Homo sapiens
cagcuggucugaccaccgu

SEQ ID NO: 24126 - RNA, 17 nt, Homo sapiens
cugucuccuuccuccca

SEQ ID NO: 24127 - RNA, 19 nt, Homo sapiens
cuugagucucugcuggcuc

SEQ ID NO: 24128 - RNA, 19 nt, Homo sapiens
ggcucccugguagaagcug

SEQ ID NO: 24129 - RNA, 17 nt, Homo sapiens
aagacugaacuuuguaa

SEQ ID NO: 24130 - RNA, 21 nt, Homo sapiens
aguaaaccaguucccaaacac

SEQ ID NO: 24131 - RNA, 21 nt, Homo sapiens
uuccagaaaccauugcaccag

SEQ ID NO: 24132 - RNA, 19 nt, Homo sapiens
accuaacagcucccuuugg

SEQ ID NO: 24133 - RNA, 20 nt, Homo sapiens
aucccacccucugcccaacu

SEQ ID NO: 24134 - RNA, 23 nt, Homo sapiens
guacacagggccucccucaccca

SEQ ID NO: 24135 - RNA, 17 nt, Homo sapiens
auauauuugagcagucc

SEQ ID NO: 24136 - RNA, 17 nt, Homo sapiens
uguaagcuggaaauuua

SEQ ID NO: 24137 - RNA, 24 nt, Homo sapiens
uuugagcagucccugcugacauuu

SEQ ID NO: 24138 - RNA, 24 nt, Homo sapiens
aagaaucucagcaguauuaucaca

SEQ ID NO: 24139 - RNA, 18 nt, Homo sapiens
acaucuucaccuucuuca

SEQ ID NO: 24140 - RNA, 17 nt, Homo sapiens
caacaacugacuuacua

SEQ ID NO: 24141 - RNA, 23 nt, Homo sapiens
gcagguaaaaaugaaaauccaua

SEQ ID NO: 24142 - RNA, 22 nt, Homo sapiens
ugccauccuuagcaucagccca

SEQ ID NO: 24143 - RNA, 20 nt, Homo sapiens
uuccuugcugaagucccuaa

SEQ ID NO: 24144 - RNA, 17 nt, Homo sapiens
ccgccccucccugcuga

SEQ ID NO: 24145 - RNA, 25 nt, Homo sapiens
uggaugaugagccugacguggaacu

SEQ ID NO: 24146 - RNA, 19 nt, Homo sapiens
auguugagaacccugauga

SEQ ID NO: 24147 - RNA, 19 nt, Homo sapiens
ucaaucacucagccccucc

SEQ ID NO: 24148 - RNA, 23 nt, Homo sapiens
ucucucccaagugccuugaucuu

SEQ ID NO: 24149 - RNA, 22 nt, Homo sapiens
cccaccgugaugacuugaaaua

SEQ ID NO: 24150 - RNA, 17 nt, Homo sapiens
gaagaaaauccaaggcu

SEQ ID NO: 24151 - RNA, 22 nt, Homo sapiens
ucuagugaucugcccaccucaa

SEQ ID NO: 24152 - RNA, 23 nt, Homo sapiens
aagacaccccccuggacccauca

SEQ ID NO: 24153 - RNA, 16 nt, Homo sapiens
aguacuacaagaacaa

SEQ ID NO: 24154 - RNA, 19 nt, Homo sapiens
cauggcacacuucauggca

SEQ ID NO: 24155 - RNA, 18 nt, Homo sapiens
cccaucccagaccccuca

SEQ ID NO: 24156 - RNA, 18 nt, Homo sapiens
gcauguggucaagaugca

SEQ ID NO: 24157 - RNA, 22 nt, Homo sapiens
ucaccaucaccaacccauccca

SEQ ID NO: 24158 - RNA, 25 nt, Homo sapiens
ugucaguggcaaacaacccuaucca

SEQ ID NO: 24159 - RNA, 21 nt, Homo sapiens
agccaccaugcccagccuccu

SEQ ID NO: 24160 - RNA, 20 nt, Homo sapiens
ccucugccucccagguucaa

SEQ ID NO: 24161 - RNA, 19 nt, Homo sapiens
cugcaaccucugccuccca

SEQ ID NO: 24162 - RNA, 21 nt, Homo sapiens
caauauggacugcuauuuacu

SEQ ID NO: 24163 - RNA, 24 nt, Homo sapiens
caggagcacguguuagucugguua

SEQ ID NO: 24164 - RNA, 20 nt, Homo sapiens
ccagcuaugggugcccaccu

SEQ ID NO: 24165 - RNA, 22 nt, Homo sapiens
gcaaagaggaccucagaaccca

SEQ ID NO: 24166 - RNA, 17 nt, Homo sapiens
ggggucacauucugcag

SEQ ID NO: 24167 - RNA, 19 nt, Homo sapiens
ccucauggaugucuggucc

SEQ ID NO: 24168 - RNA, 19 nt, Homo sapiens
ggaaagaucaaggaaccaa

SEQ ID NO: 24169 - RNA, 20 nt, Homo sapiens
cagggugcucaggccugguu

SEQ ID NO: 24170 - RNA, 25 nt, Homo sapiens
gcggguagcuccuggggcugagcca

SEQ ID NO: 24171 - RNA, 24 nt, Homo sapiens
ggaauacaggcaugagccaccgca

SEQ ID NO: 24172 - RNA, 18 nt, Homo sapiens
aaguagaguaauagcacu

SEQ ID NO: 24173 - RNA, 19 nt, Homo sapiens
ccgagccgcccgccucuuc

SEQ ID NO: 24174 - RNA, 17 nt, Homo sapiens
ucuuccuucagcgcguc

SEQ ID NO: 24175 - RNA, 19 nt, Homo sapiens
aagcaauucuccugccuca

SEQ ID NO: 24176 - RNA, 18 nt, Homo sapiens
uggguggaucaccugagg

SEQ ID NO: 24177 - RNA, 19 nt, Homo sapiens
ccuuucggccgccgggcuc

SEQ ID NO: 24178 - RNA, 17 nt, Homo sapiens
cuccaagacaaaacuuc

SEQ ID NO: 24179 - RNA, 24 nt, Homo sapiens
ccuuuuuguguuugcuuuuguuuu

SEQ ID NO: 24180 - RNA, 22 nt, Homo sapiens
uccuggugacugaacuucuggg

SEQ ID NO: 24181 - RNA, 21 nt, Homo sapiens
ugcagugagccaagaucgugc

SEQ ID NO: 24182 - RNA, 17 nt, Homo sapiens
acaaaauuuacaguuuu

SEQ ID NO: 24183 - RNA, 19 nt, Homo sapiens
acuggaggaccaagcuggu

SEQ ID NO: 24184 - RNA, 19 nt, Homo sapiens
ucauuauugacucacuuuu

SEQ ID NO: 24185 - RNA, 23 nt, Homo sapiens
accugggcuccaagucugaguuc

SEQ ID NO: 24186 - RNA, 20 nt, Homo sapiens
acugguggggagaccauggc

SEQ ID NO: 24187 - RNA, 21 nt, Homo sapiens
ccgaggaaucugccucccacc

SEQ ID NO: 24188 - RNA, 24 nt, Homo sapiens
cuugugcagugcuggacucaccca

SEQ ID NO: 24189 - RNA, 27 nt, Homo sapiens
uggauggcccugcccugacuggggcug

SEQ ID NO: 24190 - RNA, 19 nt, Homo sapiens
aaucccacaccuccuguuu

SEQ ID NO: 24191 - RNA, 20 nt, Homo sapiens
ccaaccccauccccaccucc

SEQ ID NO: 24192 - RNA, 21 nt, Homo sapiens
ugcccaggguccugcccucag

SEQ ID NO: 24193 - RNA, 23 nt, Homo sapiens
agccgagcagccgcugggcgcuc

SEQ ID NO: 24194 - RNA, 18 nt, Homo sapiens
aggucaguuuaugaaaca

SEQ ID NO: 24195 - RNA, 18 nt, Homo sapiens
gccucucuguacacugcc

SEQ ID NO: 24196 - RNA, 19 nt, Homo sapiens
gggauuuggggucugguua

SEQ ID NO: 24197 - RNA, 20 nt, Homo sapiens
uaucaauaaauuccauguuu

SEQ ID NO: 24198 - RNA, 20 nt, Homo sapiens
ucaauaaauuccauguuuag

SEQ ID NO: 24199 - RNA, 19 nt, Homo sapiens
ucuggaaguauuuuccucc

SEQ ID NO: 24200 - RNA, 20 nt, Homo sapiens
accagaaagcagcccacugg

SEQ ID NO: 24201 - RNA, 22 nt, Homo sapiens
ucucccaucucccaguccuuca

SEQ ID NO: 24202 - RNA, 22 nt, Homo sapiens
uagcccgcggcucggcucaguc

SEQ ID NO: 24203 - RNA, 21 nt, Homo sapiens
ccaacuugugaagcacacagc

SEQ ID NO: 24204 - RNA, 20 nt, Homo sapiens
ccagcauggggccuguacuu

SEQ ID NO: 24205 - RNA, 21 nt, Homo sapiens
cugccucagccgccuccccca

SEQ ID NO: 24206 - RNA, 20 nt, Homo sapiens
ggggaaaccaggugauugcc

SEQ ID NO: 24207 - RNA, 18 nt, Homo sapiens
gucaccaccccugccucc

SEQ ID NO: 24208 - RNA, 19 nt, Homo sapiens
ucaccauguacugaugauc

SEQ ID NO: 24209 - RNA, 23 nt, Homo sapiens
cagggagaaggacaaggcauaca

SEQ ID NO: 24210 - RNA, 19 nt, Homo sapiens
gcgggccccagccugaggg

SEQ ID NO: 24211 - RNA, 18 nt, Homo sapiens
caucuuaaaacauguuga

SEQ ID NO: 24212 - RNA, 19 nt, Homo sapiens
cuucucuguaucugccuuu

SEQ ID NO: 24213 - RNA, 24 nt, Homo sapiens
gcgcaggucucaaggcggcugaga

SEQ ID NO: 24214 - RNA, 22 nt, Homo sapiens
ucugugauucuuuuuccccucc

SEQ ID NO: 24215 - RNA, 27 nt, Homo sapiens
auguugaugaagaacuuccugauuaca

SEQ ID NO: 24216 - RNA, 22 nt, Homo sapiens
ccacuugccauuccuagcgcga

SEQ ID NO: 24217 - RNA, 19 nt, Homo sapiens
ccaguggccgagccugcug

SEQ ID NO: 24218 - RNA, 18 nt, Homo sapiens
uccccuuggucaugggau

SEQ ID NO: 24219 - RNA, 22 nt, Homo sapiens
cugagaaaaacuuuuuuauuaa

SEQ ID NO: 24220 - RNA, 19 nt, Homo sapiens
ucuaggauuuuaucugaug

SEQ ID NO: 24221 - RNA, 18 nt, Homo sapiens
uuauccccccaucacuaa

SEQ ID NO: 24222 - RNA, 16 nt, Homo sapiens
agagacaucccgaucu

SEQ ID NO: 24223 - RNA, 21 nt, Homo sapiens
cccuggccugcggggaccugc

SEQ ID NO: 24224 - RNA, 23 nt, Homo sapiens
cuuugguagcuaacagucacuga

SEQ ID NO: 24225 - RNA, 17 nt, Homo sapiens
gcgcgcacgcggauccc

SEQ ID NO: 24226 - RNA, 20 nt, Homo sapiens
ucugaggcuguuugggcuuu

SEQ ID NO: 24227 - RNA, 18 nt, Homo sapiens
gcaauauauuuuguaaua

SEQ ID NO: 24228 - RNA, 19 nt, Homo sapiens
ucuuuuucacucauagaau

SEQ ID NO: 24229 - RNA, 25 nt, Homo sapiens
acccaccccauccucggucuuugca

SEQ ID NO: 24230 - RNA, 21 nt, Homo sapiens
ccagcaucucaggagcaccuc

SEQ ID NO: 24231 - RNA, 17 nt, Homo sapiens
ccggagcaaggccagga

SEQ ID NO: 24232 - RNA, 21 nt, Homo sapiens
ccggcgcccucuucacacgua

SEQ ID NO: 24233 - RNA, 20 nt, Homo sapiens
gcccagccccgccucaggga

SEQ ID NO: 24234 - RNA, 17 nt, Homo sapiens
ggacaguugugaaaaua

SEQ ID NO: 24235 - RNA, 18 nt, Homo sapiens
ucccccacacccacccca

SEQ ID NO: 24236 - RNA, 21 nt, Homo sapiens
aaccaagacacuacauugucu

SEQ ID NO: 24237 - RNA, 20 nt, Homo sapiens
guucucuguuuuuccaguuc

SEQ ID NO: 24238 - RNA, 22 nt, Homo sapiens
guuuucauuuuuauaacuggua

SEQ ID NO: 24239 - RNA, 22 nt, Homo sapiens
uuuccaaaaaucugggguacua

SEQ ID NO: 24240 - RNA, 22 nt, Homo sapiens
ccccgccccagucccgcagucc

SEQ ID NO: 24241 - RNA, 21 nt, Homo sapiens
gagaaguaaaacuuagcugca

SEQ ID NO: 24242 - RNA, 21 nt, Homo sapiens
gggaugagcuccagcaugggg

SEQ ID NO: 24243 - RNA, 21 nt, Homo sapiens
cucuacaaaccaggacagcug

SEQ ID NO: 24244 - RNA, 24 nt, Homo sapiens
acaugagaacuccaugucaccucc

SEQ ID NO: 24245 - RNA, 18 nt, Homo sapiens
auuuccacucccacaccc

SEQ ID NO: 24246 - RNA, 19 nt, Homo sapiens
cugcaaccuccgccuccca

SEQ ID NO: 24247 - RNA, 19 nt, Homo sapiens
uacuuuugccuucugcuca

SEQ ID NO: 24248 - RNA, 17 nt, Homo sapiens
ucaagugauucuccugc

SEQ ID NO: 24249 - RNA, 18 nt, Homo sapiens
uccgccucccagguucaa

SEQ ID NO: 24250 - RNA, 18 nt, Homo sapiens
caggugugagccacuuca

SEQ ID NO: 24251 - RNA, 20 nt, Homo sapiens
auguggagguuuauggguga

SEQ ID NO: 24252 - RNA, 24 nt, Homo sapiens
ccaggaugaggaccccuccaucuc

SEQ ID NO: 24253 - RNA, 19 nt, Homo sapiens
cccugggccuuuccaucuc

SEQ ID NO: 24254 - RNA, 20 nt, Homo sapiens
ggaagugucaguauagaccc

SEQ ID NO: 24255 - RNA, 21 nt, Homo sapiens
guaguugucggucucacugau

SEQ ID NO: 24256 - RNA, 24 nt, Homo sapiens
ucuugauggcauuucccuucugag

SEQ ID NO: 24257 - RNA, 23 nt, Homo sapiens
uuuugacccaggagggccgcgag

SEQ ID NO: 24258 - RNA, 19 nt, Homo sapiens
aaacagugauugaaauuuc

SEQ ID NO: 24259 - RNA, 20 nt, Homo sapiens
acaaaauuccaggguuuuug

SEQ ID NO: 24260 - RNA, 22 nt, Homo sapiens
agaaacucuacaccaaauacac

SEQ ID NO: 24261 - RNA, 17 nt, Homo sapiens
agccacacuccaucaua

SEQ ID NO: 24262 - RNA, 18 nt, Homo sapiens
aucccuggccuguuguca

SEQ ID NO: 24263 - RNA, 19 nt, Homo sapiens
auguaagcugugcuguuua

SEQ ID NO: 24264 - RNA, 16 nt, Homo sapiens
cagcccucugccuggc

SEQ ID NO: 24265 - RNA, 23 nt, Homo sapiens
cuccaaacacuccucuaagcacu

SEQ ID NO: 24266 - RNA, 19 nt, Homo sapiens
cuccuauuagccauaugau

SEQ ID NO: 24267 - RNA, 19 nt, Homo sapiens
guuguagagauagagccau

SEQ ID NO: 24268 - RNA, 23 nt, Homo sapiens
uagauaacuccagcaggaaacug

SEQ ID NO: 24269 - RNA, 20 nt, Homo sapiens
uuucuuuuuagguaacuggu

SEQ ID NO: 24270 - RNA, 21 nt, Homo sapiens
aguguccagcccaguguugaa

SEQ ID NO: 24271 - RNA, 17 nt, Homo sapiens
cuccccucccugcuucu

SEQ ID NO: 24272 - RNA, 21 nt, Homo sapiens
gaggaguggcccccacuccuc

SEQ ID NO: 24273 - RNA, 18 nt, Homo sapiens
gcaggggugggguggggg

SEQ ID NO: 24274 - RNA, 23 nt, Homo sapiens
cuucacggaggagggcuugugag

SEQ ID NO: 24275 - RNA, 19 nt, Homo sapiens
ggcaugcucuuaggcccag

SEQ ID NO: 24276 - RNA, 16 nt, Homo sapiens
ucuccugcgucagccu

SEQ ID NO: 24277 - RNA, 18 nt, Homo sapiens
ucucuacaaaaaauacaa

SEQ ID NO: 24278 - RNA, 24 nt, Homo sapiens
uuaucaugaugcugucccuccuga

SEQ ID NO: 24279 - RNA, 23 nt, Homo sapiens
gaacagaaguuuaaguuauuguu

SEQ ID NO: 24280 - RNA, 27 nt, Homo sapiens
ucuaagcugaccuagugauucugcuga

SEQ ID NO: 24281 - RNA, 20 nt, Homo sapiens
uucaagaccagccugaccaa

SEQ ID NO: 24282 - RNA, 22 nt, Homo sapiens
gaacccaggagagccacucugg

SEQ ID NO: 24283 - RNA, 20 nt, Homo sapiens
agggacuucuagcaaaccug

SEQ ID NO: 24284 - RNA, 16 nt, Homo sapiens
cuacaagcuuguccaa

SEQ ID NO: 24285 - RNA, 26 nt, Homo sapiens
cuucuucuggaaguugccugaauuuu

SEQ ID NO: 24286 - RNA, 18 nt, Homo sapiens
uagguaaguuaucuacuu

SEQ ID NO: 24287 - RNA, 20 nt, Homo sapiens
uuuauaaccugaaaucaucu

SEQ ID NO: 24288 - RNA, 20 nt, Homo sapiens
acagagcccuacagccaggg

SEQ ID NO: 24289 - RNA, 22 nt, Homo sapiens
gagccaagaucgcaccacugca

SEQ ID NO: 24290 - RNA, 17 nt, Homo sapiens
ggcgggguggggcugcc

SEQ ID NO: 24291 - RNA, 17 nt, Homo sapiens
ggugaagacaagcugcg

SEQ ID NO: 24292 - RNA, 17 nt, Homo sapiens
guucccggcacgggaga

SEQ ID NO: 24293 - RNA, 18 nt, Homo sapiens
aguucagucuagauggca

SEQ ID NO: 24294 - RNA, 16 nt, Homo sapiens
ccuuccccaggcaucc

SEQ ID NO: 24295 - RNA, 22 nt, Homo sapiens
cucccccucuccuuuugcucuc

SEQ ID NO: 24296 - RNA, 19 nt, Homo sapiens
aauaacaaugccaacaucc

SEQ ID NO: 24297 - RNA, 18 nt, Homo sapiens
gaggaaagcagcugugag

SEQ ID NO: 24298 - RNA, 18 nt, Homo sapiens
guaucaaauaucuggcaa

SEQ ID NO: 24299 - RNA, 19 nt, Homo sapiens
gugaaguaugguuuggcug

SEQ ID NO: 24300 - RNA, 17 nt, Homo sapiens
cuguuuugcuauauccc

SEQ ID NO: 24301 - RNA, 24 nt, Homo sapiens
ggcgcccgccaccucgcccggcua

SEQ ID NO: 24302 - RNA, 21 nt, Homo sapiens
ucuuaaagcugccuuaaccuu

SEQ ID NO: 24303 - RNA, 20 nt, Homo sapiens
agacgucccucccucgggga

SEQ ID NO: 24304 - RNA, 19 nt, Homo sapiens
ccuuccaugaggccuggac

SEQ ID NO: 24305 - RNA, 20 nt, Homo sapiens
aagagacuuuuccccuguuu

SEQ ID NO: 24306 - RNA, 20 nt, Homo sapiens
agauggaugaugcacgacuc

SEQ ID NO: 24307 - RNA, 19 nt, Homo sapiens
ugaggcuuguuucugccac

SEQ ID NO: 24308 - RNA, 21 nt, Homo sapiens
uuccuauccacagucacuucu

SEQ ID NO: 24309 - RNA, 19 nt, Homo sapiens
ccuucccccaccuuccucc

SEQ ID NO: 24310 - RNA, 17 nt, Homo sapiens
cgggaggcccgucccag

SEQ ID NO: 24311 - RNA, 20 nt, Homo sapiens
gaacugggcacccucgagcc

SEQ ID NO: 24312 - RNA, 20 nt, Homo sapiens
ggcugagaacgaaggaucac

SEQ ID NO: 24313 - RNA, 20 nt, Homo sapiens
ugccucaguuucuccaucuc

SEQ ID NO: 24314 - RNA, 19 nt, Homo sapiens
uuucccucagccugugcac

SEQ ID NO: 24315 - RNA, 20 nt, Homo sapiens
agucaccagaggagauucaa

SEQ ID NO: 24316 - RNA, 19 nt, Homo sapiens
uccucaagaaaacuauuua

SEQ ID NO: 24317 - RNA, 20 nt, Homo sapiens
ugaaccugccgccuccgugc

SEQ ID NO: 24318 - RNA, 17 nt, Homo sapiens
aggcagaaggaucacuu

SEQ ID NO: 24319 - RNA, 18 nt, Homo sapiens
caccauucuccugccuca

SEQ ID NO: 24320 - RNA, 21 nt, Homo sapiens
ucuuggugauggucaacucug

SEQ ID NO: 24321 - RNA, 24 nt, Homo sapiens
uggaugcuggaguaaguggaauug

SEQ ID NO: 24322 - RNA, 17 nt, Homo sapiens
aggagcgaacacugcac

SEQ ID NO: 24323 - RNA, 19 nt, Homo sapiens
ccgcugcugcgcgccuggc

SEQ ID NO: 24324 - RNA, 22 nt, Homo sapiens
cuucucucuucuccuuugccuc

SEQ ID NO: 24325 - RNA, 16 nt, Homo sapiens
gcucuauuucuguggc

SEQ ID NO: 24326 - RNA, 22 nt, Homo sapiens
uccuuugccuccucuucccuca

SEQ ID NO: 24327 - RNA, 24 nt, Homo sapiens
auuuggacaauuauguccuggucu

SEQ ID NO: 24328 - RNA, 20 nt, Homo sapiens
cacuuguuccucacaaaaac

SEQ ID NO: 24329 - RNA, 21 nt, Homo sapiens
ccaccucugcaguccuggaga

SEQ ID NO: 24330 - RNA, 17 nt, Homo sapiens
cgcuccucuucuccccu

SEQ ID NO: 24331 - RNA, 23 nt, Homo sapiens
cuucccacuuccauucuugcaca

SEQ ID NO: 24332 - RNA, 23 nt, Homo sapiens
gcuccucuucuccccuccuccuc

SEQ ID NO: 24333 - RNA, 18 nt, Homo sapiens
ucuuuuuuuaaacuuugc

SEQ ID NO: 24334 - RNA, 16 nt, Homo sapiens
uguuggcaucaucucu

SEQ ID NO: 24335 - RNA, 22 nt, Homo sapiens
caggaacgacuggccuugguca

SEQ ID NO: 24336 - RNA, 21 nt, Homo sapiens
ccguaggagggacaguaccuc

SEQ ID NO: 24337 - RNA, 21 nt, Homo sapiens
cucuccuuuuuucauuccgau

SEQ ID NO: 24338 - RNA, 19 nt, Homo sapiens
ucaccauccagacugcaga

SEQ ID NO: 24339 - RNA, 20 nt, Homo sapiens
uuaaagaccccacucgacca

SEQ ID NO: 24340 - RNA, 26 nt, Homo sapiens
cggacgcgcugcucaccugucuuuuu

SEQ ID NO: 24341 - RNA, 24 nt, Homo sapiens
cauccacaccuggcacuccccucu

SEQ ID NO: 24342 - RNA, 21 nt, Homo sapiens
cccacccgccucuuccccuuu

SEQ ID NO: 24343 - RNA, 18 nt, Homo sapiens
ccugcccucaccaucuca

SEQ ID NO: 24344 - RNA, 21 nt, Homo sapiens
ugaggcuggccaccugccacu

SEQ ID NO: 24345 - RNA, 17 nt, Homo sapiens
ugccagacacggcgauu

SEQ ID NO: 24346 - RNA, 16 nt, Homo sapiens
uucgagguuucucuca

SEQ ID NO: 24347 - RNA, 21 nt, Homo sapiens
ccuucccaaacaccuccuucc

SEQ ID NO: 24348 - RNA, 21 nt, Homo sapiens
ccuucccaaacaccuccuucc

SEQ ID NO: 24349 - RNA, 21 nt, Homo sapiens
ccuucccaaacaccucuuucc

SEQ ID NO: 24350 - RNA, 19 nt, Homo sapiens
ccuucccaaaccccuuucc

SEQ ID NO: 24351 - RNA, 22 nt, Homo sapiens
ccuucccaacaccgccuuccca

SEQ ID NO: 24352 - RNA, 20 nt, Homo sapiens
ccuucccaacaccuccuucc

SEQ ID NO: 24353 - RNA, 20 nt, Homo sapiens
ccuucccaacaccuccuucc

SEQ ID NO: 24354 - RNA, 20 nt, Homo sapiens
ccuucccaacaccuccuucc

SEQ ID NO: 24355 - RNA, 20 nt, Homo sapiens
ccuucccaacaccuccuucc

SEQ ID NO: 24356 - RNA, 20 nt, Homo sapiens
ccuucccaacaccuccuucc

SEQ ID NO: 24357 - RNA, 21 nt, Homo sapiens
ccuucccagacaccuccuucc

SEQ ID NO: 24358 - RNA, 21 nt, Homo sapiens
ccuuccccaacaccuccuucc

SEQ ID NO: 24359 - RNA, 21 nt, Homo sapiens
ccuuccccaacaccuccuucc

SEQ ID NO: 24360 - RNA, 21 nt, Homo sapiens
ccuuccccaacaccuccuucc

SEQ ID NO: 24361 - RNA, 21 nt, Homo sapiens
ccuuccccaacacuuccuucc

SEQ ID NO: 24362 - RNA, 21 nt, Homo sapiens
ccuuccccaacauccuuccca

SEQ ID NO: 24363 - RNA, 24 nt, Homo sapiens
gaagagacauucaaauacauuuca

SEQ ID NO: 24364 - RNA, 21 nt, Homo sapiens
ucuccgcucacucucuuccuc

SEQ ID NO: 24365 - RNA, 17 nt, Homo sapiens
gccugaucaggagacug

SEQ ID NO: 24366 - RNA, 20 nt, Homo sapiens
ucagccaguggcguugcgca

SEQ ID NO: 24367 - RNA, 22 nt, Homo sapiens
gagccaagaucacacuacugca

SEQ ID NO: 24368 - RNA, 16 nt, Homo sapiens
cugagaagcagagcca

SEQ ID NO: 24369 - RNA, 22 nt, Homo sapiens
ggccgcuugggcgcacuugccg

SEQ ID NO: 24370 - RNA, 22 nt, Homo sapiens
uggauggauucugguggaugaa

SEQ ID NO: 24371 - RNA, 21 nt, Homo sapiens
aaccauccagaaauaccaucc

SEQ ID NO: 24372 - RNA, 17 nt, Homo sapiens
cagaucuccaagaacuc

SEQ ID NO: 24373 - RNA, 22 nt, Homo sapiens
cauguacguucuuguacacaga

SEQ ID NO: 24374 - RNA, 18 nt, Homo sapiens
ccagaucuccaagaacuc

SEQ ID NO: 24375 - RNA, 26 nt, Homo sapiens
cuuuccccacggcuuuaaucaugaaa

SEQ ID NO: 24376 - RNA, 21 nt, Homo sapiens
gugccuuguggguuggacuuu

SEQ ID NO: 24377 - RNA, 22 nt, Homo sapiens
accucucauggcuuuuugguuc

SEQ ID NO: 24378 - RNA, 23 nt, Homo sapiens
ggacaaagccaacaauccacuuc

SEQ ID NO: 24379 - RNA, 24 nt, Homo sapiens
gguguaucacagcaguaccucuca

SEQ ID NO: 24380 - RNA, 21 nt, Homo sapiens
ucuugaaagguggucugugga

SEQ ID NO: 24381 - RNA, 24 nt, Homo sapiens
uuaaggacaaagccaacaauccac

SEQ ID NO: 24382 - RNA, 16 nt, Homo sapiens
acugauaaauugugau

SEQ ID NO: 24383 - RNA, 21 nt, Homo sapiens
gguuuguuauuuuaaaaucac

SEQ ID NO: 24384 - RNA, 21 nt, Homo sapiens
agagcaucuuccacaucaacu

SEQ ID NO: 24385 - RNA, 21 nt, Homo sapiens
cgagcgagcggcgcccagccc

SEQ ID NO: 24386 - RNA, 21 nt, Homo sapiens
gcaguuuugugaggcuuuugu

SEQ ID NO: 24387 - RNA, 16 nt, Homo sapiens
ucuggcugaggcuugc

SEQ ID NO: 24388 - RNA, 20 nt, Homo sapiens
uguagaaaaugcuuguggug

SEQ ID NO: 24389 - RNA, 18 nt, Homo sapiens
gacagcgcguggcuuggc

SEQ ID NO: 24390 - RNA, 19 nt, Homo sapiens
aauguuuccuuuuacuuca

SEQ ID NO: 24391 - RNA, 22 nt, Homo sapiens
ggcucccgugaaaacucuauca

SEQ ID NO: 24392 - RNA, 19 nt, Homo sapiens
gguggaagcucucaagcuc

SEQ ID NO: 24393 - RNA, 19 nt, Homo sapiens
guggcagauacuucaggcu

SEQ ID NO: 24394 - RNA, 21 nt, Homo sapiens
ucgcucuguaaccugcgggua

SEQ ID NO: 24395 - RNA, 15 nt, Homo sapiens
acagacgccggccgc

SEQ ID NO: 24396 - RNA, 19 nt, Homo sapiens
cgcccccacccucgagcuc

SEQ ID NO: 24397 - RNA, 22 nt, Homo sapiens
cgggcgcccaccucgcccagcc

SEQ ID NO: 24398 - RNA, 19 nt, Homo sapiens
cugagauucuauuuccaca

SEQ ID NO: 24399 - RNA, 20 nt, Homo sapiens
cuguuagguccgcuuggucc

SEQ ID NO: 24400 - RNA, 22 nt, Homo sapiens
cuucuuugucuuuuuugaucuu

SEQ ID NO: 24401 - RNA, 19 nt, Homo sapiens
guauuaggugcauacauau

SEQ ID NO: 24402 - RNA, 20 nt, Homo sapiens
uaaauaaaaacauaaguaua

SEQ ID NO: 24403 - RNA, 18 nt, Homo sapiens
ugagauucuauuuccaca

SEQ ID NO: 24404 - RNA, 21 nt, Homo sapiens
cccccugggccacgccgauca

SEQ ID NO: 24405 - RNA, 19 nt, Homo sapiens
cccgccgcugccgccuccg

SEQ ID NO: 24406 - RNA, 18 nt, Homo sapiens
cccgcaaccuccgccucc

SEQ ID NO: 24407 - RNA, 22 nt, Homo sapiens
cugggauuacaggcaccugcca

SEQ ID NO: 24408 - RNA, 18 nt, Homo sapiens
uccgccucccagguucaa

SEQ ID NO: 24409 - RNA, 22 nt, Homo sapiens
cccugcccugggagaccugggg

SEQ ID NO: 24410 - RNA, 20 nt, Homo sapiens
cuucucuguuuuucucuccc

SEQ ID NO: 24411 - RNA, 20 nt, Homo sapiens
aaacacagaaggggcaggga

SEQ ID NO: 24412 - RNA, 22 nt, Homo sapiens
acacaggguuaauaaccaauca

SEQ ID NO: 24413 - RNA, 25 nt, Homo sapiens
auuugaaccagagaccgcuuggccu

SEQ ID NO: 24414 - RNA, 18 nt, Homo sapiens
ggggcaaacugcuuggca

SEQ ID NO: 24415 - RNA, 20 nt, Homo sapiens
ucaccaggacauucuuucca

SEQ ID NO: 24416 - RNA, 20 nt, Homo sapiens
uccucuuuccucuaaaccuc

SEQ ID NO: 24417 - RNA, 22 nt, Homo sapiens
uucaguugcaccccucacuugu

SEQ ID NO: 24418 - RNA, 17 nt, Homo sapiens
ugacgguagcuuuugga

SEQ ID NO: 24419 - RNA, 21 nt, Homo sapiens
uguggggguggggugggggug

SEQ ID NO: 24420 - RNA, 15 nt, Homo sapiens
accacuguuuggucc

SEQ ID NO: 24421 - RNA, 20 nt, Homo sapiens
caaggucccucaggcugguu

SEQ ID NO: 24422 - RNA, 17 nt, Homo sapiens
cacuuguguggcugccu

SEQ ID NO: 24423 - RNA, 15 nt, Homo sapiens
ccaccaccuugcaga

SEQ ID NO: 24424 - RNA, 21 nt, Homo sapiens
ccccacccagcugcccucagc

SEQ ID NO: 24425 - RNA, 21 nt, Homo sapiens
cuuugggucguuaguccucca

SEQ ID NO: 24426 - RNA, 23 nt, Homo sapiens
gcaccagcaucaguccugccucc

SEQ ID NO: 24427 - RNA, 17 nt, Homo sapiens
gcaccuacugugugcuu

SEQ ID NO: 24428 - RNA, 21 nt, Homo sapiens
ggaggaggacccggcaugaca

SEQ ID NO: 24429 - RNA, 16 nt, Homo sapiens
uccauuucucaucucu

SEQ ID NO: 24430 - RNA, 19 nt, Homo sapiens
ucccucaggcugguuguga

SEQ ID NO: 24431 - RNA, 18 nt, Homo sapiens
ccgcacuuaacucuuacc

SEQ ID NO: 24432 - RNA, 17 nt, Homo sapiens
ccuggauugaucugguc

SEQ ID NO: 24433 - RNA, 19 nt, Homo sapiens
cgcgcgccgccgccgcugc

SEQ ID NO: 24434 - RNA, 18 nt, Homo sapiens
gcugcauaaaaucuugca

SEQ ID NO: 24435 - RNA, 16 nt, Homo sapiens
ccacuuucuggucaga

SEQ ID NO: 24436 - RNA, 21 nt, Homo sapiens
cccucuccuucuccaugggca

SEQ ID NO: 24437 - RNA, 18 nt, Homo sapiens
gaaacuguuuguuugcca

SEQ ID NO: 24438 - RNA, 22 nt, Homo sapiens
gaugcccacuuucuggucagac

SEQ ID NO: 24439 - RNA, 18 nt, Homo sapiens
ucggcagacuggggcuuc

SEQ ID NO: 24440 - RNA, 19 nt, Homo sapiens
acccagggcagggggaagc

SEQ ID NO: 24441 - RNA, 22 nt, Homo sapiens
gagccaagaucgcgccacugca

SEQ ID NO: 24442 - RNA, 19 nt, Homo sapiens
ggccgggugcgguggcuca

SEQ ID NO: 24443 - RNA, 21 nt, Homo sapiens
ugcacagacggcggcauccuc

SEQ ID NO: 24444 - RNA, 18 nt, Homo sapiens
ugugaccugccagcuuca

SEQ ID NO: 24445 - RNA, 20 nt, Homo sapiens
cccugguggugggcaccugu

SEQ ID NO: 24446 - RNA, 17 nt, Homo sapiens
ucaagugauucucgugc

SEQ ID NO: 24447 - RNA, 18 nt, Homo sapiens
uccgccucccggguucaa

SEQ ID NO: 24448 - RNA, 23 nt, Homo sapiens
ugagugaucaucagaugagauua

SEQ ID NO: 24449 - RNA, 20 nt, Homo sapiens
uuugcuuggguuugaccacu

SEQ ID NO: 24450 - RNA, 20 nt, Homo sapiens
aagcuuacaugauuccuaac

SEQ ID NO: 24451 - RNA, 19 nt, Homo sapiens
auggaagagcugguuauag

SEQ ID NO: 24452 - RNA, 19 nt, Homo sapiens
gcuuauagaaagcuugcuu

SEQ ID NO: 24453 - RNA, 16 nt, Homo sapiens
uuggacuguuuaugac

SEQ ID NO: 24454 - RNA, 23 nt, Homo sapiens
ccacuuuaaaguauuacaacuca

SEQ ID NO: 24455 - RNA, 25 nt, Homo sapiens
ucaaauaggucuugauaugaagcua

SEQ ID NO: 24456 - RNA, 17 nt, Homo sapiens
aaacacagaauauggga

SEQ ID NO: 24457 - RNA, 19 nt, Homo sapiens
acaagagugucagcacugu

SEQ ID NO: 24458 - RNA, 19 nt, Homo sapiens
caguccuggccccugcaca

SEQ ID NO: 24459 - RNA, 19 nt, Homo sapiens
cucgggcugcaaaagguga

SEQ ID NO: 24460 - RNA, 21 nt, Homo sapiens
gcaccaauccacacucuguau

SEQ ID NO: 24461 - RNA, 22 nt, Homo sapiens
gcacggcagcccgccucucccc

SEQ ID NO: 24462 - RNA, 20 nt, Homo sapiens
aacagaggugagcaccuuuc

SEQ ID NO: 24463 - RNA, 17 nt, Homo sapiens
aaccuugcaugucauca

SEQ ID NO: 24464 - RNA, 23 nt, Homo sapiens
ucaccaucaagcaauccauguca

SEQ ID NO: 24465 - RNA, 20 nt, Homo sapiens
gggcggggucgucgccgcca

SEQ ID NO: 24466 - RNA, 18 nt, Homo sapiens
ccccucaaagcagagcca

SEQ ID NO: 24467 - RNA, 23 nt, Homo sapiens
cuugucaagggcucuuuggcuga

SEQ ID NO: 24468 - RNA, 20 nt, Homo sapiens
acagggaagaaagugaaggu

SEQ ID NO: 24469 - RNA, 23 nt, Homo sapiens
agggaagaaagugaagguaaccc

SEQ ID NO: 24470 - RNA, 18 nt, Homo sapiens
uuguggacccugggaccu

SEQ ID NO: 24471 - RNA, 16 nt, Homo sapiens
accuuccugggccuca

SEQ ID NO: 24472 - RNA, 20 nt, Homo sapiens
ccucugccucccggguucaa

SEQ ID NO: 24473 - RNA, 21 nt, Homo sapiens
gccucucuggagacuugggga

SEQ ID NO: 24474 - RNA, 17 nt, Homo sapiens
uucuccugccuuagccu

SEQ ID NO: 24475 - RNA, 20 nt, Homo sapiens
uuucugagcuagauaacagg

SEQ ID NO: 24476 - RNA, 20 nt, Homo sapiens
ccuccuuguugacugcuguu

SEQ ID NO: 24477 - RNA, 21 nt, Homo sapiens
cuucuaaucauuuuuuuugaa

SEQ ID NO: 24478 - RNA, 23 nt, Homo sapiens
ggcaauuaauaaaucucauugga

SEQ ID NO: 24479 - RNA, 18 nt, Homo sapiens
uaaguuccaauucuacac

SEQ ID NO: 24480 - RNA, 20 nt, Homo sapiens
uuauacagaauaucucuuua

SEQ ID NO: 24481 - RNA, 21 nt, Homo sapiens
acacaggacccuuaacuuugc

SEQ ID NO: 24482 - RNA, 22 nt, Homo sapiens
caaacuauuuugauggacugug

SEQ ID NO: 24483 - RNA, 19 nt, Homo sapiens
cccauauugcaucuuugaa

SEQ ID NO: 24484 - RNA, 21 nt, Homo sapiens
ugaagagauggauaucaagua

SEQ ID NO: 24485 - RNA, 22 nt, Homo sapiens
acacgagucagcacacuuuuua

SEQ ID NO: 24486 - RNA, 20 nt, Homo sapiens
agcauuaauguaacaaaaag

SEQ ID NO: 24487 - RNA, 18 nt, Homo sapiens
guaaacaucagaacuagc

SEQ ID NO: 24488 - RNA, 22 nt, Homo sapiens
gaaccaagaucacgccacugca

SEQ ID NO: 24489 - RNA, 20 nt, Homo sapiens
caaaugaaauggacaaugca

SEQ ID NO: 24490 - RNA, 18 nt, Homo sapiens
gcucucugaggguucuga

SEQ ID NO: 24491 - RNA, 16 nt, Homo sapiens
gggcagcugggcucgg

SEQ ID NO: 24492 - RNA, 19 nt, Homo sapiens
uaguugcaaaguuagucua

SEQ ID NO: 24493 - RNA, 17 nt, Homo sapiens
ugguugagaccagguga

SEQ ID NO: 24494 - RNA, 18 nt, Homo sapiens
augaaauuucauagcuua

SEQ ID NO: 24495 - RNA, 24 nt, Homo sapiens
gauuauauugaaugauuuaaaacu

SEQ ID NO: 24496 - RNA, 19 nt, Homo sapiens
ggaacaauuaaaaacaaca

SEQ ID NO: 24497 - RNA, 18 nt, Homo sapiens
ggugacccacuauuguug

SEQ ID NO: 24498 - RNA, 21 nt, Homo sapiens
ccuguggcccgaaucguguuu

SEQ ID NO: 24499 - RNA, 19 nt, Homo sapiens
ugaauguguuguuugguuc

SEQ ID NO: 24500 - RNA, 21 nt, Homo sapiens
cuuucuucuauauuuauaaac

SEQ ID NO: 24501 - RNA, 21 nt, Homo sapiens
gcagcugcuguuuccggaguu

SEQ ID NO: 24502 - RNA, 20 nt, Homo sapiens
ugguaucacugauuaacugu

SEQ ID NO: 24503 - RNA, 25 nt, Homo sapiens
aaaccauacuuauuacucaauaacc

SEQ ID NO: 24504 - RNA, 18 nt, Homo sapiens
ccaaugauucacagugac

SEQ ID NO: 24505 - RNA, 20 nt, Homo sapiens
cuaacaugagagaugaacuu

SEQ ID NO: 24506 - RNA, 20 nt, Homo sapiens
gccagcaucaaggcuuuuaa

SEQ ID NO: 24507 - RNA, 27 nt, Homo sapiens
ucugagccuagaacuuuaauuacuuuu

SEQ ID NO: 24508 - RNA, 22 nt, Homo sapiens
aaaccaauguauuucucaaaug

SEQ ID NO: 24509 - RNA, 22 nt, Homo sapiens
ccuccuuggaagaaagaauuca

SEQ ID NO: 24510 - RNA, 17 nt, Homo sapiens
gacccuggcauaacauu

SEQ ID NO: 24511 - RNA, 18 nt, Homo sapiens
ucaaaguaguuuaccuca

SEQ ID NO: 24512 - RNA, 19 nt, Homo sapiens
gcugucucccuccucugcc

SEQ ID NO: 24513 - RNA, 18 nt, Homo sapiens
gcacuuaccgcugugcuu

SEQ ID NO: 24514 - RNA, 19 nt, Homo sapiens
cccucugagaagggcugga

SEQ ID NO: 24515 - RNA, 21 nt, Homo sapiens
ccuugccguggggaccuugga

SEQ ID NO: 24516 - RNA, 20 nt, Homo sapiens
agucaaggcagggcacagug

SEQ ID NO: 24517 - RNA, 19 nt, Homo sapiens
ucacuuacccaaugcccca

SEQ ID NO: 24518 - RNA, 18 nt, Homo sapiens
aauaguuucccaguauua

SEQ ID NO: 24519 - RNA, 18 nt, Homo sapiens
agugaaaccccaugucua

SEQ ID NO: 24520 - RNA, 21 nt, Homo sapiens
cugucuuucugguugacccuu

SEQ ID NO: 24521 - RNA, 20 nt, Homo sapiens
gaauuuccauugguguuucu

SEQ ID NO: 24522 - RNA, 20 nt, Homo sapiens
ggcucacgccuacaaucuca

SEQ ID NO: 24523 - RNA, 20 nt, Homo sapiens
acauuuguuuuaacugugaa

SEQ ID NO: 24524 - RNA, 23 nt, Homo sapiens
cacugagaacacaaaggccucua

SEQ ID NO: 24525 - RNA, 17 nt, Homo sapiens
ccgucccgccucacaaa

SEQ ID NO: 24526 - RNA, 21 nt, Homo sapiens
ccuuuaaugcaauccucaguc

SEQ ID NO: 24527 - RNA, 21 nt, Homo sapiens
gccugggacuuuguuagguuu

SEQ ID NO: 24528 - RNA, 23 nt, Homo sapiens
ugggacuuuguuagguuuagccg

SEQ ID NO: 24529 - RNA, 21 nt, Homo sapiens
ugggucgcccuacaagagagu

SEQ ID NO: 24530 - RNA, 23 nt, Homo sapiens
augggcacgugcccagaacacac

SEQ ID NO: 24531 - RNA, 21 nt, Homo sapiens
cgaggcugcagugagcuguga

SEQ ID NO: 24532 - RNA, 19 nt, Homo sapiens
cccuugugcguaucucaca

SEQ ID NO: 24533 - RNA, 24 nt, Homo sapiens
ugccuuuuauggauacauaaugcu

SEQ ID NO: 24534 - RNA, 22 nt, Homo sapiens
uuugaaaguguauuauuacuaa

SEQ ID NO: 24535 - RNA, 19 nt, Homo sapiens
cuccuuuguuaaaacuuuu

SEQ ID NO: 24536 - RNA, 18 nt, Homo sapiens
gauugcuaaccaagugau

SEQ ID NO: 24537 - RNA, 22 nt, Homo sapiens
acacaacguaggccuaaucaca

SEQ ID NO: 24538 - RNA, 19 nt, Homo sapiens
ccuuagguuugccccugaa

SEQ ID NO: 24539 - RNA, 18 nt, Homo sapiens
ccuggccaagccugugga

SEQ ID NO: 24540 - RNA, 20 nt, Homo sapiens
ggguguguuuggucugguca

SEQ ID NO: 24541 - RNA, 22 nt, Homo sapiens
gguaccgggguggggcgcggcg

SEQ ID NO: 24542 - RNA, 18 nt, Homo sapiens
ugcagacaaguuagcaaa

SEQ ID NO: 24543 - RNA, 22 nt, Homo sapiens
gcgcagagcagcggggcugggg

SEQ ID NO: 24544 - RNA, 19 nt, Homo sapiens
ggccuaacccccaugugac

SEQ ID NO: 24545 - RNA, 23 nt, Homo sapiens
uaccuaggaacaaagaaacgcca

SEQ ID NO: 24546 - RNA, 20 nt, Homo sapiens
ccaguucucaugcccuuuca

SEQ ID NO: 24547 - RNA, 18 nt, Homo sapiens
cucauuguggagcugcaa

SEQ ID NO: 24548 - RNA, 21 nt, Homo sapiens
cucugggucugggucugugag

SEQ ID NO: 24549 - RNA, 26 nt, Homo sapiens
cuguccagaaccccgacaggcacauc

SEQ ID NO: 24550 - RNA, 23 nt, Homo sapiens
ucaaaggccucauuguggagcug

SEQ ID NO: 24551 - RNA, 18 nt, Homo sapiens
agagagguuaaauucugg

SEQ ID NO: 24552 - RNA, 19 nt, Homo sapiens
ccaaaagaaaugauaugua

SEQ ID NO: 24553 - RNA, 17 nt, Homo sapiens
ggguugauuuuguugua

SEQ ID NO: 24554 - RNA, 18 nt, Homo sapiens
uaaaaacacacauacaaa

SEQ ID NO: 24555 - RNA, 22 nt, Homo sapiens
aaaaugggaagaaagcaaccuc

SEQ ID NO: 24556 - RNA, 22 nt, Homo sapiens
auagaccaccaccacccacuca

SEQ ID NO: 24557 - RNA, 19 nt, Homo sapiens
caaagugcccucugcuccu

SEQ ID NO: 24558 - RNA, 20 nt, Homo sapiens
uugaagauaaagcuacugua

SEQ ID NO: 24559 - RNA, 19 nt, Homo sapiens
cuguggaacugcugcuucu

SEQ ID NO: 24560 - RNA, 21 nt, Homo sapiens
aacaucaccacugacauucug

SEQ ID NO: 24561 - RNA, 21 nt, Homo sapiens
aagcaacccaugcccauucca

SEQ ID NO: 24562 - RNA, 22 nt, Homo sapiens
aggaaugacacagagcauggag

SEQ ID NO: 24563 - RNA, 18 nt, Homo sapiens
auggagcaccaucacuga

SEQ ID NO: 24564 - RNA, 19 nt, Homo sapiens
ccaccuguuucucaucucu

SEQ ID NO: 24565 - RNA, 22 nt, Homo sapiens
gccaaucauccuuacuuccuua

SEQ ID NO: 24566 - RNA, 16 nt, Homo sapiens
ugcaucauuuuccauc

SEQ ID NO: 24567 - RNA, 19 nt, Homo sapiens
uucugacguguccauucca

SEQ ID NO: 24568 - RNA, 19 nt, Homo sapiens
uauguauuuauauguguuu

SEQ ID NO: 24569 - RNA, 16 nt, Homo sapiens
uuagaauacuguucca

SEQ ID NO: 24570 - RNA, 20 nt, Homo sapiens
aaugauacuuucaaugugcc

SEQ ID NO: 24571 - RNA, 22 nt, Homo sapiens
caaauauccugucagccaaaug

SEQ ID NO: 24572 - RNA, 19 nt, Homo sapiens
auugucuccuguguucuca

SEQ ID NO: 24573 - RNA, 19 nt, Homo sapiens
cccgccgggcagccgugca

SEQ ID NO: 24574 - RNA, 20 nt, Homo sapiens
ugcucucacgcuuguuaaaa

SEQ ID NO: 24575 - RNA, 18 nt, Homo sapiens
uggguggaucaccugaag

SEQ ID NO: 24576 - RNA, 19 nt, Homo sapiens
cuaaauaucaagaccagga

SEQ ID NO: 24577 - RNA, 24 nt, Homo sapiens
uuauuggguggcauuauuugguua

SEQ ID NO: 24578 - RNA, 21 nt, Homo sapiens
uuucuucuuugcuuaaaucuu

SEQ ID NO: 24579 - RNA, 24 nt, Homo sapiens
cccaggaguggagggcucugugag

SEQ ID NO: 24580 - RNA, 21 nt, Homo sapiens
auaaaacuuguuuuagaagac

SEQ ID NO: 24581 - RNA, 18 nt, Homo sapiens
ggcaacggcggcuggagc

SEQ ID NO: 24582 - RNA, 20 nt, Homo sapiens
agauaaggacuggaaaugug

SEQ ID NO: 24583 - RNA, 18 nt, Homo sapiens
caaagacgccugcugcac

SEQ ID NO: 24584 - RNA, 20 nt, Homo sapiens
caaauucagugcccaccgga

SEQ ID NO: 24585 - RNA, 21 nt, Homo sapiens
gcaccucuuaauucauuuuca

SEQ ID NO: 24586 - RNA, 17 nt, Homo sapiens
gugaucaugucuaguaa

SEQ ID NO: 24587 - RNA, 16 nt, Homo sapiens
guggaucaguuugauu

SEQ ID NO: 24588 - RNA, 21 nt, Homo sapiens
ugcaaugagcuaagaucgugc

SEQ ID NO: 24589 - RNA, 22 nt, Homo sapiens
ccaaaaaccauguacuaacuua

SEQ ID NO: 24590 - RNA, 19 nt, Homo sapiens
ccaccuuguagaggcuaga

SEQ ID NO: 24591 - RNA, 17 nt, Homo sapiens
cccauggaagacccuga

SEQ ID NO: 24592 - RNA, 20 nt, Homo sapiens
ccuccuggauuccugcaacu

SEQ ID NO: 24593 - RNA, 24 nt, Homo sapiens
ccugggggauuccaaguuguugcu

SEQ ID NO: 24594 - RNA, 19 nt, Homo sapiens
gaaaaugugguuucugcug

SEQ ID NO: 24595 - RNA, 18 nt, Homo sapiens
ggacauguaagcaaguaa

SEQ ID NO: 24596 - RNA, 18 nt, Homo sapiens
guggcccaucugggaguc

SEQ ID NO: 24597 - RNA, 18 nt, Homo sapiens
uucaccuguguccucugc

SEQ ID NO: 24598 - RNA, 19 nt, Homo sapiens
uuuugaggcaaaguucagu

SEQ ID NO: 24599 - RNA, 21 nt, Homo sapiens
agaucacaagaccaguuccuc

SEQ ID NO: 24600 - RNA, 17 nt, Homo sapiens
cacaugugcacaugcac

SEQ ID NO: 24601 - RNA, 22 nt, Homo sapiens
cagccuggccaacauaaugaaa

SEQ ID NO: 24602 - RNA, 18 nt, Homo sapiens
cgccuuccuucugccucc

SEQ ID NO: 24603 - RNA, 24 nt, Homo sapiens
cuagugguggagucugguccucca

SEQ ID NO: 24604 - RNA, 19 nt, Homo sapiens
cugccuuucucugucuuuu

SEQ ID NO: 24605 - RNA, 19 nt, Homo sapiens
ugcaggggucccuguaggu

SEQ ID NO: 24606 - RNA, 20 nt, Homo sapiens
uuccagaaacugugcaucua

SEQ ID NO: 24607 - RNA, 23 nt, Homo sapiens
agauccuucuaaaacaacaguca

SEQ ID NO: 24608 - RNA, 21 nt, Homo sapiens
cccggugggucauucugugga

SEQ ID NO: 24609 - RNA, 16 nt, Homo sapiens
ccugagcucccacaaa

SEQ ID NO: 24610 - RNA, 18 nt, Homo sapiens
cuucugccuccccggugg

SEQ ID NO: 24611 - RNA, 19 nt, Homo sapiens
gacaugcccugcagcccca

SEQ ID NO: 24612 - RNA, 22 nt, Homo sapiens
uccugagacccaagguuccucc

SEQ ID NO: 24613 - RNA, 22 nt, Homo sapiens
uguccuucugccuccccggugg

SEQ ID NO: 24614 - RNA, 20 nt, Homo sapiens
ccugggaagccccccgcagc

SEQ ID NO: 24615 - RNA, 21 nt, Homo sapiens
ucugagggcuccugggucacu

SEQ ID NO: 24616 - RNA, 27 nt, Homo sapiens
agauuucuuuaacucucggaccaguga

SEQ ID NO: 24617 - RNA, 18 nt, Homo sapiens
cuuccacccaguccccuc

SEQ ID NO: 24618 - RNA, 20 nt, Homo sapiens
ucaucuggagcucuuaccuu

SEQ ID NO: 24619 - RNA, 19 nt, Homo sapiens
ugaaugagaugacuaacgg

SEQ ID NO: 24620 - RNA, 23 nt, Homo sapiens
caggaagucuggaggcugaaaca

SEQ ID NO: 24621 - RNA, 25 nt, Homo sapiens
cucccagggugcagaggccugcggg

SEQ ID NO: 24622 - RNA, 17 nt, Homo sapiens
gugccacacagaugcca

SEQ ID NO: 24623 - RNA, 21 nt, Homo sapiens
agugcacauccugugucauca

SEQ ID NO: 24624 - RNA, 23 nt, Homo sapiens
aguuugcagugccccuaaucuca

SEQ ID NO: 24625 - RNA, 21 nt, Homo sapiens
cacccuuauauccucauuuga

SEQ ID NO: 24626 - RNA, 25 nt, Homo sapiens
cuucuugccuuuuugucuaagccuu

SEQ ID NO: 24627 - RNA, 20 nt, Homo sapiens
uccugugucaucaauguaaa

SEQ ID NO: 24628 - RNA, 21 nt, Homo sapiens
ugaaugagauccugaaaauga

SEQ ID NO: 24629 - RNA, 21 nt, Homo sapiens
agccugggcaacauagugagu

SEQ ID NO: 24630 - RNA, 18 nt, Homo sapiens
aggucuuaaugcaguguu

SEQ ID NO: 24631 - RNA, 23 nt, Homo sapiens
aagacuaucuguuucccuugaca

SEQ ID NO: 24632 - RNA, 23 nt, Homo sapiens
aauuauuccagaaacagcuguca

SEQ ID NO: 24633 - RNA, 18 nt, Homo sapiens
gaaaucauguccuugaaa

SEQ ID NO: 24634 - RNA, 20 nt, Homo sapiens
acacagggcaaaguacuaug

SEQ ID NO: 24635 - RNA, 19 nt, Homo sapiens
auauaauccagagcuaaga

SEQ ID NO: 24636 - RNA, 19 nt, Homo sapiens
aaacuccugaccucaggug

SEQ ID NO: 24637 - RNA, 18 nt, Homo sapiens
ccgugcaccuccaccucc

SEQ ID NO: 24638 - RNA, 18 nt, Homo sapiens
cgguucaccuugugcugc

SEQ ID NO: 24639 - RNA, 16 nt, Homo sapiens
gacagagccagacccu

SEQ ID NO: 24640 - RNA, 22 nt, Homo sapiens
gagccaagaucgcaccacugca

SEQ ID NO: 24641 - RNA, 18 nt, Homo sapiens
uccgccucucagguucaa

SEQ ID NO: 24642 - RNA, 19 nt, Homo sapiens
aaacuccugaccucaggug

SEQ ID NO: 24643 - RNA, 22 nt, Homo sapiens
cuggaauuacaggcaccugcca

SEQ ID NO: 24644 - RNA, 19 nt, Homo sapiens
cagugagccaagaucgugc

SEQ ID NO: 24645 - RNA, 22 nt, Homo sapiens
gagccaagaucgugccacugca

SEQ ID NO: 24646 - RNA, 19 nt, Homo sapiens
ccgggcccgggcccaccuu

SEQ ID NO: 24647 - RNA, 18 nt, Homo sapiens
gaacaggaagugccuugu

SEQ ID NO: 24648 - RNA, 17 nt, Homo sapiens
ugucccucugcacucca

SEQ ID NO: 24649 - RNA, 20 nt, Homo sapiens
ucuuaucaaguucugucaau

SEQ ID NO: 24650 - RNA, 23 nt, Homo sapiens
uggguaaaauguuagaacuguaa

SEQ ID NO: 24651 - RNA, 23 nt, Homo sapiens
uuguuaaagaucuacuuauuuac

SEQ ID NO: 24652 - RNA, 20 nt, Homo sapiens
ggguuuagaaaucuuugcca

SEQ ID NO: 24653 - RNA, 22 nt, Homo sapiens
ggauucgugcugggcccacucc

SEQ ID NO: 24654 - RNA, 18 nt, Homo sapiens
aaaugccucauaaccuca

SEQ ID NO: 24655 - RNA, 22 nt, Homo sapiens
auccuucaccaugcaauuaaug

SEQ ID NO: 24656 - RNA, 22 nt, Homo sapiens
auuuacguggacaacuuucaua

SEQ ID NO: 24657 - RNA, 22 nt, Homo sapiens
ggucaugggggcaaucuuaaac

SEQ ID NO: 24658 - RNA, 22 nt, Homo sapiens
uaugcuuauuugguacuuucac

SEQ ID NO: 24659 - RNA, 22 nt, Homo sapiens
ucaccauuauuuacuguuuccu

SEQ ID NO: 24660 - RNA, 18 nt, Homo sapiens
ccacaccaaggcccaccu

SEQ ID NO: 24661 - RNA, 19 nt, Homo sapiens
cuuuugacuggaaagguca

SEQ ID NO: 24662 - RNA, 19 nt, Homo sapiens
ugucugugaagugccuaac

SEQ ID NO: 24663 - RNA, 19 nt, Homo sapiens
aagaaauaggggcccugcu

SEQ ID NO: 24664 - RNA, 23 nt, Homo sapiens
agccacucuccugucuucucucc

SEQ ID NO: 24665 - RNA, 19 nt, Homo sapiens
cuggaucucuguuggguuu

SEQ ID NO: 24666 - RNA, 18 nt, Homo sapiens
guuccaggcacgcaucua

SEQ ID NO: 24667 - RNA, 18 nt, Homo sapiens
ccuggaggaagaagggcu

SEQ ID NO: 24668 - RNA, 18 nt, Homo sapiens
cuuggagaggacuuugaa

SEQ ID NO: 24669 - RNA, 20 nt, Homo sapiens
cgcgcgcccgcccgcggcgc

SEQ ID NO: 24670 - RNA, 19 nt, Homo sapiens
aauuaaagguaucaggugg

SEQ ID NO: 24671 - RNA, 22 nt, Homo sapiens
caauauuuuccaguaacauuaa

SEQ ID NO: 24672 - RNA, 17 nt, Homo sapiens
gugaaugcacacaugug

SEQ ID NO: 24673 - RNA, 21 nt, Homo sapiens
ucauucccgucccaguuuacu

SEQ ID NO: 24674 - RNA, 22 nt, Homo sapiens
ugucuuucauuccuagcacuaa

SEQ ID NO: 24675 - RNA, 19 nt, Homo sapiens
aaacuaagugcucugccca

SEQ ID NO: 24676 - RNA, 19 nt, Homo sapiens
agugaggaaggcaugugug

SEQ ID NO: 24677 - RNA, 21 nt, Homo sapiens
uuguaaauggaagguuucgag

SEQ ID NO: 24678 - RNA, 26 nt, Homo sapiens
aguccuuggggacguggcagaugcca

SEQ ID NO: 24679 - RNA, 22 nt, Homo sapiens
gcaccucuagcugucugccuca

SEQ ID NO: 24680 - RNA, 17 nt, Homo sapiens
gugggucagaagcgauc

SEQ ID NO: 24681 - RNA, 21 nt, Homo sapiens
ccaagccugcucuccuacauu

SEQ ID NO: 24682 - RNA, 21 nt, Homo sapiens
cuggucuagcccagguugcca

SEQ ID NO: 24683 - RNA, 19 nt, Homo sapiens
gagaucacccuugcaguga

SEQ ID NO: 24684 - RNA, 20 nt, Homo sapiens
agaaggugugagugugagug

SEQ ID NO: 24685 - RNA, 20 nt, Homo sapiens
uggcugccuccuucauccaa

SEQ ID NO: 24686 - RNA, 20 nt, Homo sapiens
aagacaccugucaaauguca

SEQ ID NO: 24687 - RNA, 22 nt, Homo sapiens
acucgccucugcuccugugguc

SEQ ID NO: 24688 - RNA, 17 nt, Homo sapiens
acugugcucagauuccc

SEQ ID NO: 24689 - RNA, 17 nt, Homo sapiens
cccccugggauggcuca

SEQ ID NO: 24690 - RNA, 21 nt, Homo sapiens
ggccccucucugggcagucag

SEQ ID NO: 24691 - RNA, 17 nt, Homo sapiens
ugcuagcagcugugaug

SEQ ID NO: 24692 - RNA, 21 nt, Homo sapiens
aacugggacauauagauacca

SEQ ID NO: 24693 - RNA, 18 nt, Homo sapiens
aagaaccaaaugcacugu

SEQ ID NO: 24694 - RNA, 18 nt, Homo sapiens
agcauccauuuuacuuca

SEQ ID NO: 24695 - RNA, 23 nt, Homo sapiens
cuuuucccuuaugcuuuggcuuu

SEQ ID NO: 24696 - RNA, 25 nt, Homo sapiens
cuuuuuguggaacauguaguuuaua

SEQ ID NO: 24697 - RNA, 20 nt, Homo sapiens
gaacacuaguccuaccucug

SEQ ID NO: 24698 - RNA, 19 nt, Homo sapiens
gcuuaauauucucauugca

SEQ ID NO: 24699 - RNA, 19 nt, Homo sapiens
uaucuugcucugaguagua

SEQ ID NO: 24700 - RNA, 18 nt, Homo sapiens
ucaucuuuuugccuuuga

SEQ ID NO: 24701 - RNA, 21 nt, Homo sapiens
acccauccccaucucaucuca

SEQ ID NO: 24702 - RNA, 17 nt, Homo sapiens
cagcuggugcagccuca

SEQ ID NO: 24703 - RNA, 19 nt, Homo sapiens
cccugccaccuucucucca

SEQ ID NO: 24704 - RNA, 20 nt, Homo sapiens
gacagugcuggacauuuccu

SEQ ID NO: 24705 - RNA, 22 nt, Homo sapiens
ggacuugcccguuggugccagc

SEQ ID NO: 24706 - RNA, 17 nt, Homo sapiens
ccgcagcacacuggcca

SEQ ID NO: 24707 - RNA, 19 nt, Homo sapiens
cucaggaagcuuuguaaga

SEQ ID NO: 24708 - RNA, 21 nt, Homo sapiens
gccugggcucaagccuggccc

SEQ ID NO: 24709 - RNA, 20 nt, Homo sapiens
ggagggucuggguccaguua

SEQ ID NO: 24710 - RNA, 22 nt, Homo sapiens
ucaggccuccccgggcccccca

SEQ ID NO: 24711 - RNA, 19 nt, Homo sapiens
ugcccucagugacaccuca

SEQ ID NO: 24712 - RNA, 18 nt, Homo sapiens
ccaagucugcacauccca

SEQ ID NO: 24713 - RNA, 19 nt, Homo sapiens
ccugcaaccccccuucagc

SEQ ID NO: 24714 - RNA, 23 nt, Homo sapiens
gcccccccggagccccucugaga

SEQ ID NO: 24715 - RNA, 17 nt, Homo sapiens
caagaacaagaugugau

SEQ ID NO: 24716 - RNA, 19 nt, Homo sapiens
cuccugagagcagugguca

SEQ ID NO: 24717 - RNA, 19 nt, Homo sapiens
gccaggugugcaugggucc

SEQ ID NO: 24718 - RNA, 20 nt, Homo sapiens
ggccccuucagaauuccuca

SEQ ID NO: 24719 - RNA, 26 nt, Homo sapiens
gucugagccugcaucaccucuggccu

SEQ ID NO: 24720 - RNA, 19 nt, Homo sapiens
agaaacaaaucauucgugc

SEQ ID NO: 24721 - RNA, 18 nt, Homo sapiens
agaugggaugaaauuuca

SEQ ID NO: 24722 - RNA, 19 nt, Homo sapiens
cagaugggaugaaauuuca

SEQ ID NO: 24723 - RNA, 25 nt, Homo sapiens
cugguugugacauugugguauaaua

SEQ ID NO: 24724 - RNA, 19 nt, Homo sapiens
gacccagcaguugcacuca

SEQ ID NO: 24725 - RNA, 25 nt, Homo sapiens
uaauauugcaagauguuaccauugg

SEQ ID NO: 24726 - RNA, 18 nt, Homo sapiens
aggagaaauaccgccagg

SEQ ID NO: 24727 - RNA, 23 nt, Homo sapiens
cccagcucaagagcuaccugagg

SEQ ID NO: 24728 - RNA, 23 nt, Homo sapiens
ccgacuucgccgacuccgcgcca

SEQ ID NO: 24729 - RNA, 19 nt, Homo sapiens
ccugcgcagggcccgggga

SEQ ID NO: 24730 - RNA, 20 nt, Homo sapiens
gggugggggagcccuggcca

SEQ ID NO: 24731 - RNA, 21 nt, Homo sapiens
uguagggguggcgccugcggg

SEQ ID NO: 24732 - RNA, 20 nt, Homo sapiens
aagguuccaauuuauugugc

SEQ ID NO: 24733 - RNA, 17 nt, Homo sapiens
aucuguuauugcaaggu

SEQ ID NO: 24734 - RNA, 21 nt, Homo sapiens
ccggagacuucuccuaacaaa

SEQ ID NO: 24735 - RNA, 18 nt, Homo sapiens
cgauaucaugccaauuga

SEQ ID NO: 24736 - RNA, 18 nt, Homo sapiens
uguuuuuucagaauggcc

SEQ ID NO: 24737 - RNA, 20 nt, Homo sapiens
uucaacaaauguaaaagauc

SEQ ID NO: 24738 - RNA, 17 nt, Homo sapiens
uucugauguuuuuucag

SEQ ID NO: 24739 - RNA, 15 nt, Homo sapiens
uuguuuguuuucugg

SEQ ID NO: 24740 - RNA, 18 nt, Homo sapiens
cagauucccaacucuucu

SEQ ID NO: 24741 - RNA, 20 nt, Homo sapiens
caggccuccaccuccagccc

SEQ ID NO: 24742 - RNA, 20 nt, Homo sapiens
caacccaccucccgugcccc

SEQ ID NO: 24743 - RNA, 24 nt, Homo sapiens
cagcuggagcgccaaucgugcugc

SEQ ID NO: 24744 - RNA, 22 nt, Homo sapiens
cucaaccacugcggccuaaucc

SEQ ID NO: 24745 - RNA, 22 nt, Homo sapiens
cugcuggacuguuauuucuuga

SEQ ID NO: 24746 - RNA, 20 nt, Homo sapiens
guggaagcuccgugagacca

SEQ ID NO: 24747 - RNA, 20 nt, Homo sapiens
uggagcgccaaucgugcugc

SEQ ID NO: 24748 - RNA, 25 nt, Homo sapiens
uuccaaaaauaccccaguguuucag

SEQ ID NO: 24749 - RNA, 19 nt, Homo sapiens
ucucugggcacuguacucu

SEQ ID NO: 24750 - RNA, 19 nt, Homo sapiens
uggguggaccacuugaggc

SEQ ID NO: 24751 - RNA, 22 nt, Homo sapiens
aauuugaggaacuggaugugac

SEQ ID NO: 24752 - RNA, 17 nt, Homo sapiens
acuucgugcucugugac

SEQ ID NO: 24753 - RNA, 18 nt, Homo sapiens
ccuuuaagaauucgugga

SEQ ID NO: 24754 - RNA, 18 nt, Homo sapiens
ggccuguucacagcuaca

SEQ ID NO: 24755 - RNA, 17 nt, Homo sapiens
ugcuaugaaagaugcaa

SEQ ID NO: 24756 - RNA, 22 nt, Homo sapiens
ggagagcagcggcggcggcggc

SEQ ID NO: 24757 - RNA, 20 nt, Homo sapiens
ugcggcgggcgcggcccggg

SEQ ID NO: 24758 - RNA, 20 nt, Homo sapiens
acccuggcugaccacuuuga

SEQ ID NO: 24759 - RNA, 26 nt, Homo sapiens
aagaccauuuauuugugacucugaca

SEQ ID NO: 24760 - RNA, 19 nt, Homo sapiens
gggcaaguugauuuugcca

SEQ ID NO: 24761 - RNA, 19 nt, Homo sapiens
accgggagcgcgguggcca

SEQ ID NO: 24762 - RNA, 19 nt, Homo sapiens
cgcgcggcguuuacccagc

SEQ ID NO: 24763 - RNA, 22 nt, Homo sapiens
gccuccgcugguugccaggcuu

SEQ ID NO: 24764 - RNA, 18 nt, Homo sapiens
uucucaucauccugaaca

SEQ ID NO: 24765 - RNA, 20 nt, Homo sapiens
agucucacucugucgcccag

SEQ ID NO: 24766 - RNA, 22 nt, Homo sapiens
cuccuucccucuucagcggauc

SEQ ID NO: 24767 - RNA, 20 nt, Homo sapiens
ccauccacccacuucccuca

SEQ ID NO: 24768 - RNA, 22 nt, Homo sapiens
gcagaggacuucagcuaccuuc

SEQ ID NO: 24769 - RNA, 18 nt, Homo sapiens
uauccucucaaacuucca

SEQ ID NO: 24770 - RNA, 19 nt, Homo sapiens
uuauuuccccuucauccua

SEQ ID NO: 24771 - RNA, 22 nt, Homo sapiens
aaggcuggcuggaguggagcca

SEQ ID NO: 24772 - RNA, 18 nt, Homo sapiens
gaguucgacagggagcug

SEQ ID NO: 24773 - RNA, 23 nt, Homo sapiens
uccugguggaccugggucuggaa

SEQ ID NO: 24774 - RNA, 20 nt, Homo sapiens
aaccaggacgaccugcaagg

SEQ ID NO: 24775 - RNA, 23 nt, Homo sapiens
uugcaacauagcccccuccauca

SEQ ID NO: 24776 - RNA, 23 nt, Homo sapiens
uuggacauggccuauguaccuaa

SEQ ID NO: 24777 - RNA, 23 nt, Homo sapiens
cacuacugauguucacgaugcca

SEQ ID NO: 24778 - RNA, 16 nt, Homo sapiens
ccgacccauucuccuu

SEQ ID NO: 24779 - RNA, 21 nt, Homo sapiens
uguuuaaucccaugcaugcca

SEQ ID NO: 24780 - RNA, 18 nt, Homo sapiens
guauauaugaaaauuuga

SEQ ID NO: 24781 - RNA, 17 nt, Homo sapiens
aggguaaugaaauguca

SEQ ID NO: 24782 - RNA, 21 nt, Homo sapiens
gguaguugggcugcagaguca

SEQ ID NO: 24783 - RNA, 18 nt, Homo sapiens
ugccuuucugcacuguca

SEQ ID NO: 24784 - RNA, 19 nt, Homo sapiens
uggcccugccacuguggac

SEQ ID NO: 24785 - RNA, 19 nt, Homo sapiens
uuuacaucuucccacuuuu

SEQ ID NO: 24786 - RNA, 20 nt, Homo sapiens
aucuguuggaggacauccca

SEQ ID NO: 24787 - RNA, 18 nt, Homo sapiens
cccguuccuuuuucuuca

SEQ ID NO: 24788 - RNA, 20 nt, Homo sapiens
uucaagaccagccugaccaa

SEQ ID NO: 24789 - RNA, 19 nt, Homo sapiens
aucuuugucuggugccaga

SEQ ID NO: 24790 - RNA, 20 nt, Homo sapiens
cuuuuuuauggcugcauaau

SEQ ID NO: 24791 - RNA, 22 nt, Homo sapiens
uuuuaacacauuguaucauuaa

SEQ ID NO: 24792 - RNA, 20 nt, Homo sapiens
agucucacucuguugcccag

SEQ ID NO: 24793 - RNA, 20 nt, Homo sapiens
cacugugaggagacagccac

SEQ ID NO: 24794 - RNA, 19 nt, Homo sapiens
uuucuacagacugccauug

SEQ ID NO: 24795 - RNA, 22 nt, Homo sapiens
cagccuaggcaacacagugaaa

SEQ ID NO: 24796 - RNA, 18 nt, Homo sapiens
cggagaggauuuccaccu

SEQ ID NO: 24797 - RNA, 20 nt, Homo sapiens
gcauggccauuggcgggucu

SEQ ID NO: 24798 - RNA, 20 nt, Homo sapiens
uugggcaacccccucccuca

SEQ ID NO: 24799 - RNA, 18 nt, Homo sapiens
auuugaagaaacauagga

SEQ ID NO: 24800 - RNA, 18 nt, Homo sapiens
gccggguguaguggcuca

SEQ ID NO: 24801 - RNA, 21 nt, Homo sapiens
augacucccacugcugccucu

SEQ ID NO: 24802 - RNA, 21 nt, Homo sapiens
gacagagcacccacugcccaa

SEQ ID NO: 24803 - RNA, 19 nt, Homo sapiens
aaaaugucaaaugcuuuga

SEQ ID NO: 24804 - RNA, 21 nt, Homo sapiens
aaagaaugaucaucaguaaca

SEQ ID NO: 24805 - RNA, 20 nt, Homo sapiens
caugauaauaauuaugaaga

SEQ ID NO: 24806 - RNA, 19 nt, Homo sapiens
cacccuauucauuuccuuu

SEQ ID NO: 24807 - RNA, 16 nt, Homo sapiens
uuaacacuucuugaca

SEQ ID NO: 24808 - RNA, 18 nt, Homo sapiens
ccugccuugggccuccca

SEQ ID NO: 24809 - RNA, 23 nt, Homo sapiens
ugggccucccagugcuggaauua

SEQ ID NO: 24810 - RNA, 20 nt, Homo sapiens
gacccuggcugucagaguga

SEQ ID NO: 24811 - RNA, 17 nt, Homo sapiens
uuccagaaaaggcuuca

SEQ ID NO: 24812 - RNA, 17 nt, Homo sapiens
uucccaguuuugccacu

SEQ ID NO: 24813 - RNA, 22 nt, Homo sapiens
agaaggugguucuucaagccga

SEQ ID NO: 24814 - RNA, 20 nt, Homo sapiens
cuguuuuuuguuuuguuuua

SEQ ID NO: 24815 - RNA, 21 nt, Homo sapiens
ggccuccacgagguuccauuu

SEQ ID NO: 24816 - RNA, 23 nt, Homo sapiens
uucugccucugugacugcugcuu

SEQ ID NO: 24817 - RNA, 26 nt, Homo sapiens
uauagcccagcuugauaauggaacua

SEQ ID NO: 24818 - RNA, 23 nt, Homo sapiens
uuucuaaaggcuauauugcugua

SEQ ID NO: 24819 - RNA, 23 nt, Homo sapiens
cagcuaggcuugaggccucuuca

SEQ ID NO: 24820 - RNA, 20 nt, Homo sapiens
aaggcugugcaaauccucca

SEQ ID NO: 24821 - RNA, 23 nt, Homo sapiens
ucgcguuaagaagccuggacaag

SEQ ID NO: 24822 - RNA, 23 nt, Homo sapiens
caaacugguugaaacacagcuuu

SEQ ID NO: 24823 - RNA, 21 nt, Homo sapiens
caccaccacccaugccccucu

SEQ ID NO: 24824 - RNA, 18 nt, Homo sapiens
ggaaagcggggcuguggc

SEQ ID NO: 24825 - RNA, 17 nt, Homo sapiens
ggccugcuggugccagc

SEQ ID NO: 24826 - RNA, 22 nt, Homo sapiens
gggucccuucugcgcugccgca

SEQ ID NO: 24827 - RNA, 21 nt, Homo sapiens
ccuccugaguagaucuguggg

SEQ ID NO: 24828 - RNA, 17 nt, Homo sapiens
ccugaguagaucugugg

SEQ ID NO: 24829 - RNA, 19 nt, Homo sapiens
gccucgucuucccgucugc

SEQ ID NO: 24830 - RNA, 19 nt, Homo sapiens
agaguggcacuccaucuca

SEQ ID NO: 24831 - RNA, 18 nt, Homo sapiens
agccucuaacccguccug

SEQ ID NO: 24832 - RNA, 22 nt, Homo sapiens
gccugagcuccaggucucgucu

SEQ ID NO: 24833 - RNA, 20 nt, Homo sapiens
ggagaucuacagcuaagacg

SEQ ID NO: 24834 - RNA, 22 nt, Homo sapiens
aaacuccaacguuguaauuaca

SEQ ID NO: 24835 - RNA, 21 nt, Homo sapiens
agcuuuuaaaauuuaaauuac

SEQ ID NO: 24836 - RNA, 23 nt, Homo sapiens
cccaugccaaauucaucaugaag

SEQ ID NO: 24837 - RNA, 23 nt, Homo sapiens
ccuuauuugcaauacuuuuccca

SEQ ID NO: 24838 - RNA, 20 nt, Homo sapiens
cucucucaagaagcuuuuaa

SEQ ID NO: 24839 - RNA, 18 nt, Homo sapiens
cuuuuuuauaguaaagcc

SEQ ID NO: 24840 - RNA, 18 nt, Homo sapiens
guauguuuagaucccagg

SEQ ID NO: 24841 - RNA, 19 nt, Homo sapiens
uccuuuaagagauauuaga

SEQ ID NO: 24842 - RNA, 19 nt, Homo sapiens
ugauggagaauucacuuug

SEQ ID NO: 24843 - RNA, 22 nt, Homo sapiens
uucagguauuuucaaguuuuaa

SEQ ID NO: 24844 - RNA, 20 nt, Homo sapiens
caauuaccucuuuuuugcuc

SEQ ID NO: 24845 - RNA, 18 nt, Homo sapiens
gaacacauuuaaacauca

SEQ ID NO: 24846 - RNA, 24 nt, Homo sapiens
gacugaucgaaagaaaacuugcca

SEQ ID NO: 24847 - RNA, 19 nt, Homo sapiens
gcagggccaggcuuuggca

SEQ ID NO: 24848 - RNA, 19 nt, Homo sapiens
uugucaccccaccaagcca

SEQ ID NO: 24849 - RNA, 21 nt, Homo sapiens
uccugauggccgcuuggugag

SEQ ID NO: 24850 - RNA, 18 nt, Homo sapiens
uucccaccucucuaccua

SEQ ID NO: 24851 - RNA, 16 nt, Homo sapiens
gaagaauauuuuuggc

SEQ ID NO: 24852 - RNA, 23 nt, Homo sapiens
gcaacuacaggacuaacuguguu

SEQ ID NO: 24853 - RNA, 22 nt, Homo sapiens
ggcacagucugugagugggaag

SEQ ID NO: 24854 - RNA, 21 nt, Homo sapiens
aaacugggcccccaugccaca

SEQ ID NO: 24855 - RNA, 19 nt, Homo sapiens
ccaaaggaugcaacaacau

SEQ ID NO: 24856 - RNA, 22 nt, Homo sapiens
ccagcccccaggaggccccugc

SEQ ID NO: 24857 - RNA, 21 nt, Homo sapiens
ccaguggugccaggugccacc

SEQ ID NO: 24858 - RNA, 21 nt, Homo sapiens
gcggcacuugggguuucuggg

SEQ ID NO: 24859 - RNA, 16 nt, Homo sapiens
uggaugacaguccuga

SEQ ID NO: 24860 - RNA, 20 nt, Homo sapiens
caaagucauggccauacuca

SEQ ID NO: 24861 - RNA, 17 nt, Homo sapiens
cucugcuccucugcccu

SEQ ID NO: 24862 - RNA, 17 nt, Homo sapiens
cucugucuccugccucu

SEQ ID NO: 24863 - RNA, 18 nt, Homo sapiens
cuguaagaacgaaagaau

SEQ ID NO: 24864 - RNA, 20 nt, Homo sapiens
ggaggaacagcaugccacca

SEQ ID NO: 24865 - RNA, 25 nt, Homo sapiens
uaauggugggucuuaauggaggcug

SEQ ID NO: 24866 - RNA, 21 nt, Homo sapiens
agauaccuuggcauuguuaua

SEQ ID NO: 24867 - RNA, 20 nt, Homo sapiens
aguaccagcuuagucaggua

SEQ ID NO: 24868 - RNA, 19 nt, Homo sapiens
uccuuuuccccccuuccuu

SEQ ID NO: 24869 - RNA, 23 nt, Homo sapiens
ucugggcccggccucgccugccc

SEQ ID NO: 24870 - RNA, 17 nt, Homo sapiens
ucuggucugacccucug

SEQ ID NO: 24871 - RNA, 19 nt, Homo sapiens
accggagacccugccccca

SEQ ID NO: 24872 - RNA, 22 nt, Homo sapiens
caacccuucaaugccugcuccu

SEQ ID NO: 24873 - RNA, 18 nt, Homo sapiens
ccacccaccucugccucc

SEQ ID NO: 24874 - RNA, 21 nt, Homo sapiens
cgagaauccacucaccggaga

SEQ ID NO: 24875 - RNA, 18 nt, Homo sapiens
uccaccuccuggguucaa

SEQ ID NO: 24876 - RNA, 18 nt, Homo sapiens
uccaccuccuggguucaa

SEQ ID NO: 24877 - RNA, 22 nt, Homo sapiens
auuugauaggauccauaucuaa

SEQ ID NO: 24878 - RNA, 19 nt, Homo sapiens
auuuuuucuuauugccuug

SEQ ID NO: 24879 - RNA, 21 nt, Homo sapiens
ccaaacuacaccaauuaauuu

SEQ ID NO: 24880 - RNA, 18 nt, Homo sapiens
gcccuaucugcacuuuuu

SEQ ID NO: 24881 - RNA, 17 nt, Homo sapiens
guugucaauugugguaa

SEQ ID NO: 24882 - RNA, 20 nt, Homo sapiens
ucuauuguucaauucucuaa

SEQ ID NO: 24883 - RNA, 22 nt, Homo sapiens
uggccguacaaauuacauuuca

SEQ ID NO: 24884 - RNA, 21 nt, Homo sapiens
cuuccaaugcugccuugaucu

SEQ ID NO: 24885 - RNA, 20 nt, Homo sapiens
uugcaaaacgucgaucuccu

SEQ ID NO: 24886 - RNA, 18 nt, Homo sapiens
agcacuuuacuuguauua

SEQ ID NO: 24887 - RNA, 24 nt, Homo sapiens
caaacauauuugaaaguuaacuuu

SEQ ID NO: 24888 - RNA, 24 nt, Homo sapiens
ccucaccacacaucagagaaugac

SEQ ID NO: 24889 - RNA, 19 nt, Homo sapiens
cuggacuaccauugugaga

SEQ ID NO: 24890 - RNA, 21 nt, Homo sapiens
guggugaaaccaccuaugcaa

SEQ ID NO: 24891 - RNA, 23 nt, Homo sapiens
uaccuugauuacauauguuguua

SEQ ID NO: 24892 - RNA, 24 nt, Homo sapiens
ucauggcugccucaccacacauca

SEQ ID NO: 24893 - RNA, 20 nt, Homo sapiens
uggauggacucuucaaaacu

SEQ ID NO: 24894 - RNA, 22 nt, Homo sapiens
uucuuuguagguggaguuugug

SEQ ID NO: 24895 - RNA, 19 nt, Homo sapiens
gucccacugggcugugagc

SEQ ID NO: 24896 - RNA, 20 nt, Homo sapiens
uccccggaccccugugccag

SEQ ID NO: 24897 - RNA, 20 nt, Homo sapiens
agcuuuucuaacugucacug

SEQ ID NO: 24898 - RNA, 18 nt, Homo sapiens
aggguuaugacuugcuca

SEQ ID NO: 24899 - RNA, 20 nt, Homo sapiens
cccaaguucaugacuuuugc

SEQ ID NO: 24900 - RNA, 16 nt, Homo sapiens
ucucugcaguauuagc

SEQ ID NO: 24901 - RNA, 22 nt, Homo sapiens
agggaagagaauagcaugaucc

SEQ ID NO: 24902 - RNA, 17 nt, Homo sapiens
guggcacacggcuguaa

SEQ ID NO: 24903 - RNA, 17 nt, Homo sapiens
aacaaagagaaaugcug

SEQ ID NO: 24904 - RNA, 18 nt, Homo sapiens
aacuucaauaauguaaua

SEQ ID NO: 24905 - RNA, 17 nt, Homo sapiens
accaaauauguaucugu

SEQ ID NO: 24906 - RNA, 20 nt, Homo sapiens
ccaagggguaggcaauucua

SEQ ID NO: 24907 - RNA, 23 nt, Homo sapiens
cccagcaucacuuacacauccca

SEQ ID NO: 24908 - RNA, 22 nt, Homo sapiens
uccauaucuggcuugcaugugc

SEQ ID NO: 24909 - RNA, 22 nt, Homo sapiens
gggacagccggaucgccccucu

SEQ ID NO: 24910 - RNA, 22 nt, Homo sapiens
uccagcgcgggaccagcagcaa

SEQ ID NO: 24911 - RNA, 20 nt, Homo sapiens
caaagcagcaguggccucua

SEQ ID NO: 24912 - RNA, 26 nt, Homo sapiens
cuaugagugaaucuggaauugcuuuu

SEQ ID NO: 24913 - RNA, 21 nt, Homo sapiens
gcugucaguuugugcaccaua

SEQ ID NO: 24914 - RNA, 16 nt, Homo sapiens
aaugagaucucagugg

SEQ ID NO: 24915 - RNA, 20 nt, Homo sapiens
ccaaccuccuaugacugcuu

SEQ ID NO: 24916 - RNA, 15 nt, Homo sapiens
uacaguacuuccuga

SEQ ID NO: 24917 - RNA, 17 nt, Homo sapiens
agggagcagccaucaca

SEQ ID NO: 24918 - RNA, 21 nt, Homo sapiens
gcagaaauggaagcauuuuca

SEQ ID NO: 24919 - RNA, 23 nt, Homo sapiens
uucuguccucugcgcgugguuug

SEQ ID NO: 24920 - RNA, 23 nt, Homo sapiens
uaagccucaguuaaauggaauua

SEQ ID NO: 24921 - RNA, 17 nt, Homo sapiens
ucaaaaacauaaauggc

SEQ ID NO: 24922 - RNA, 20 nt, Homo sapiens
ugaaacugcaugcagccaua

SEQ ID NO: 24923 - RNA, 23 nt, Homo sapiens
gauuguuuuguuuuuccuuuugg

SEQ ID NO: 24924 - RNA, 17 nt, Homo sapiens
aaaaccucaguuuuaga

SEQ ID NO: 24925 - RNA, 19 nt, Homo sapiens
uuuuaauuggauuuugaua

SEQ ID NO: 24926 - RNA, 18 nt, Homo sapiens
ccuacagcugccuggcuc

SEQ ID NO: 24927 - RNA, 21 nt, Homo sapiens
uucuaugugauggaguacugc

SEQ ID NO: 24928 - RNA, 22 nt, Homo sapiens
ccaggcuccuuuuucuguuucu

SEQ ID NO: 24929 - RNA, 18 nt, Homo sapiens
ucaaguaggaacacccca

SEQ ID NO: 24930 - RNA, 21 nt, Homo sapiens
acccaucccauccaccacuuc

SEQ ID NO: 24931 - RNA, 21 nt, Homo sapiens
agacccaugacaugucuuaua

SEQ ID NO: 24932 - RNA, 22 nt, Homo sapiens
cccaacaugggagaauugugaa

SEQ ID NO: 24933 - RNA, 17 nt, Homo sapiens
uauggucuaucuaugau

SEQ ID NO: 24934 - RNA, 19 nt, Homo sapiens
cccccccccaccucacucc

SEQ ID NO: 24935 - RNA, 24 nt, Homo sapiens
gaaacgcuaccagcagauucugag

SEQ ID NO: 24936 - RNA, 19 nt, Homo sapiens
uccagcccucacccaccuu

SEQ ID NO: 24937 - RNA, 24 nt, Homo sapiens
ugaaguucguggacuccuacaaua

SEQ ID NO: 24938 - RNA, 21 nt, Homo sapiens
ugugcugcuuuaccgacacau

SEQ ID NO: 24939 - RNA, 19 nt, Homo sapiens
cauccccuccuucauccuu

SEQ ID NO: 24940 - RNA, 19 nt, Homo sapiens
gccacccucaccuccuuca

SEQ ID NO: 24941 - RNA, 19 nt, Homo sapiens
gcuucgcuuuugauggagu

SEQ ID NO: 24942 - RNA, 19 nt, Homo sapiens
ggugcacagccccugacca

SEQ ID NO: 24943 - RNA, 24 nt, Homo sapiens
uccaauaaaauaagcuaccuguga

SEQ ID NO: 24944 - RNA, 17 nt, Homo sapiens
uuggcuucgcuuuugau

SEQ ID NO: 24945 - RNA, 20 nt, Homo sapiens
ccacccccacccccaccccc

SEQ ID NO: 24946 - RNA, 19 nt, Homo sapiens
aauuucagagcaagagucg

SEQ ID NO: 24947 - RNA, 21 nt, Homo sapiens
aauuauccaaagcaucacuga

SEQ ID NO: 24948 - RNA, 19 nt, Homo sapiens
cgcagcucccgacgcaaug

SEQ ID NO: 24949 - RNA, 20 nt, Homo sapiens
cccccggagcaggccgugca

SEQ ID NO: 24950 - RNA, 22 nt, Homo sapiens
cgcgcccuccucguacccgugc

SEQ ID NO: 24951 - RNA, 21 nt, Homo sapiens
cuccccuaucuaggugccuuu

SEQ ID NO: 24952 - RNA, 19 nt, Homo sapiens
cugccaguugcauucuucc

SEQ ID NO: 24953 - RNA, 25 nt, Homo sapiens
aguggguaggaauuucaucaacaaa

SEQ ID NO: 24954 - RNA, 20 nt, Homo sapiens
guggaauaucuagccgccca

SEQ ID NO: 24955 - RNA, 21 nt, Homo sapiens
aaauaaaagugaccuuuuaca

SEQ ID NO: 24956 - RNA, 23 nt, Homo sapiens
gcuuggaucaguaagucugguuc

SEQ ID NO: 24957 - RNA, 21 nt, Homo sapiens
cacagccacacuuccaucuca

SEQ ID NO: 24958 - RNA, 22 nt, Homo sapiens
cuccccaaaacuggggucccag

SEQ ID NO: 24959 - RNA, 19 nt, Homo sapiens
ugccuuuccauuuauuuaa

SEQ ID NO: 24960 - RNA, 17 nt, Homo sapiens
uucaacaucgucuucca

SEQ ID NO: 24961 - RNA, 19 nt, Homo sapiens
cccucugauugauaagaca

SEQ ID NO: 24962 - RNA, 26 nt, Homo sapiens
gccugggucuggagccguccuggccu

SEQ ID NO: 24963 - RNA, 17 nt, Homo sapiens
acacagagaucucaaac

SEQ ID NO: 24964 - RNA, 18 nt, Homo sapiens
cccccuccggggucaugc

SEQ ID NO: 24965 - RNA, 22 nt, Homo sapiens
gcucacuugacucaugcugcua

SEQ ID NO: 24966 - RNA, 20 nt, Homo sapiens
agguauuccaaaucucuucu

SEQ ID NO: 24967 - RNA, 21 nt, Homo sapiens
ggucuagaaaugcuuaaacua

SEQ ID NO: 24968 - RNA, 24 nt, Homo sapiens
cgaaaccaguuuugcaaucaauuc

SEQ ID NO: 24969 - RNA, 19 nt, Homo sapiens
cuccagucugggugucaga

SEQ ID NO: 24970 - RNA, 18 nt, Homo sapiens
ucacagcccccugccaga

SEQ ID NO: 24971 - RNA, 22 nt, Homo sapiens
ucuaaacauauguaaacagaga

SEQ ID NO: 24972 - RNA, 22 nt, Homo sapiens
ugaauggauucuggguggagau

SEQ ID NO: 24973 - RNA, 19 nt, Homo sapiens
uguguaucuaaacauaugu

SEQ ID NO: 24974 - RNA, 20 nt, Homo sapiens
cacacccacacccuauucau

SEQ ID NO: 24975 - RNA, 19 nt, Homo sapiens
cagaagaacguggauugug

SEQ ID NO: 24976 - RNA, 20 nt, Homo sapiens
guaaaagucucguugcucau

SEQ ID NO: 24977 - RNA, 21 nt, Homo sapiens
uaacagucaguauccagccuc

SEQ ID NO: 24978 - RNA, 19 nt, Homo sapiens
uguguccuaguugaggcua

SEQ ID NO: 24979 - RNA, 23 nt, Homo sapiens
uuucuuaugccugucuuuacuuu

SEQ ID NO: 24980 - RNA, 24 nt, Homo sapiens
uuugugacccacacccacacccua

SEQ ID NO: 24981 - RNA, 21 nt, Homo sapiens
cuccucuuccuccuccuccuc

SEQ ID NO: 24982 - RNA, 18 nt, Homo sapiens
cugcuccuccucuuccuc

SEQ ID NO: 24983 - RNA, 18 nt, Homo sapiens
auccugaaugaacagugg

SEQ ID NO: 24984 - RNA, 17 nt, Homo sapiens
cuuccccuccuccuucc

SEQ ID NO: 24985 - RNA, 24 nt, Homo sapiens
gaagaagauauuccaggaaccuaa

SEQ ID NO: 24986 - RNA, 23 nt, Homo sapiens
gccuggauuuguauccuuggcuu

SEQ ID NO: 24987 - RNA, 18 nt, Homo sapiens
ggccaggcacccccaggg

SEQ ID NO: 24988 - RNA, 19 nt, Homo sapiens
aaagaaauguuccucuccc

SEQ ID NO: 24989 - RNA, 19 nt, Homo sapiens
aagaaaacuuagccaugga

SEQ ID NO: 24990 - RNA, 18 nt, Homo sapiens
gaaauacaagucauagua

SEQ ID NO: 24991 - RNA, 22 nt, Homo sapiens
gcagucuucagccuccccagua

SEQ ID NO: 24992 - RNA, 20 nt, Homo sapiens
aaaucaaaggcgcuuugaaa

SEQ ID NO: 24993 - RNA, 22 nt, Homo sapiens
gcgccaggagagucucccccca

SEQ ID NO: 24994 - RNA, 21 nt, Homo sapiens
ggggcuccaggcggcugcggc

SEQ ID NO: 24995 - RNA, 22 nt, Homo sapiens
gccugggccgcggccgcagccc

SEQ ID NO: 24996 - RNA, 22 nt, Homo sapiens
ccuaagcggaguuguuguuuuu

SEQ ID NO: 24997 - RNA, 22 nt, Homo sapiens
cuugagcgaucuaauguuucuu

SEQ ID NO: 24998 - RNA, 18 nt, Homo sapiens
guaccuaaaaauauucuc

SEQ ID NO: 24999 - RNA, 18 nt, Homo sapiens
uaaaagauauuucugcug

SEQ ID NO: 25000 - RNA, 23 nt, Homo sapiens
ucugcugaucaaagaugaucaag

SEQ ID NO: 25001 - RNA, 18 nt, Homo sapiens
acaacagaaaacacuuug

SEQ ID NO: 25002 - RNA, 24 nt, Homo sapiens
agggaagagagggguucuacccac

SEQ ID NO: 25003 - RNA, 18 nt, Homo sapiens
auuuaugaaguuauggca

SEQ ID NO: 25004 - RNA, 16 nt, Homo sapiens
cugcagcaugcuggga

SEQ ID NO: 25005 - RNA, 19 nt, Homo sapiens
cuugcuuccagauuguuuu

SEQ ID NO: 25006 - RNA, 19 nt, Homo sapiens
ggacauuuaauaauggacc

SEQ ID NO: 25007 - RNA, 18 nt, Homo sapiens
acaacagaaaacacuuug

SEQ ID NO: 25008 - RNA, 24 nt, Homo sapiens
agggaagagagggguucuacccac

SEQ ID NO: 25009 - RNA, 18 nt, Homo sapiens
auuuaugaaguuauggca

SEQ ID NO: 25010 - RNA, 21 nt, Homo sapiens
ccuacguucauagccgucuca

SEQ ID NO: 25011 - RNA, 20 nt, Homo sapiens
cuacguucauagccgucuca

SEQ ID NO: 25012 - RNA, 16 nt, Homo sapiens
cugcagcaugcuggga

SEQ ID NO: 25013 - RNA, 19 nt, Homo sapiens
cuugcuuccagauuguuuu

SEQ ID NO: 25014 - RNA, 19 nt, Homo sapiens
ggacauuuaauaauggacc

SEQ ID NO: 25015 - RNA, 19 nt, Homo sapiens
gugaccaucuccagccuuc

SEQ ID NO: 25016 - RNA, 18 nt, Homo sapiens
acaacagaaaacacuuug

SEQ ID NO: 25017 - RNA, 24 nt, Homo sapiens
agggaagagagggguucuacccac

SEQ ID NO: 25018 - RNA, 18 nt, Homo sapiens
auuuaugaaguuauggca

SEQ ID NO: 25019 - RNA, 21 nt, Homo sapiens
ccuacguucauagccgucuca

SEQ ID NO: 25020 - RNA, 20 nt, Homo sapiens
cuacguucauagccgucuca

SEQ ID NO: 25021 - RNA, 16 nt, Homo sapiens
cugcagcaugcuggga

SEQ ID NO: 25022 - RNA, 19 nt, Homo sapiens
cuugcuuccagauuguuuu

SEQ ID NO: 25023 - RNA, 19 nt, Homo sapiens
ggacauuuaauaauggacc

SEQ ID NO: 25024 - RNA, 19 nt, Homo sapiens
gugaccaucuccagccuuc

SEQ ID NO: 25025 - RNA, 18 nt, Homo sapiens
acaacagaaaacacuuug

SEQ ID NO: 25026 - RNA, 24 nt, Homo sapiens
agggaagagagggguucuacccac

SEQ ID NO: 25027 - RNA, 18 nt, Homo sapiens
auuuaugaaguuauggca

SEQ ID NO: 25028 - RNA, 20 nt, Homo sapiens
caucugcauggguugugaga

SEQ ID NO: 25029 - RNA, 21 nt, Homo sapiens
ccuacguucauagccgucuca

SEQ ID NO: 25030 - RNA, 20 nt, Homo sapiens
cuacguucauagccgucuca

SEQ ID NO: 25031 - RNA, 16 nt, Homo sapiens
cugcagcaugcuggga

SEQ ID NO: 25032 - RNA, 18 nt, Homo sapiens
cugucuuucuuugucuca

SEQ ID NO: 25033 - RNA, 19 nt, Homo sapiens
cuugcuuccagauuguuuu

SEQ ID NO: 25034 - RNA, 19 nt, Homo sapiens
ggacauuuaauaauggacc

SEQ ID NO: 25035 - RNA, 19 nt, Homo sapiens
gugaccaucuccagccuuc

SEQ ID NO: 25036 - RNA, 18 nt, Homo sapiens
gaaaaccuauggaaccua

SEQ ID NO: 25037 - RNA, 19 nt, Homo sapiens
agaucaucuacagauucua

SEQ ID NO: 25038 - RNA, 24 nt, Homo sapiens
gugugugugcgcgugcauugauua

SEQ ID NO: 25039 - RNA, 18 nt, Homo sapiens
uuuucuuauugcugugga

SEQ ID NO: 25040 - RNA, 19 nt, Homo sapiens
ccuuccccuccccuccucc

SEQ ID NO: 25041 - RNA, 21 nt, Homo sapiens
aucuuggcucacugcaaccuc

SEQ ID NO: 25042 - RNA, 20 nt, Homo sapiens
gaucuagccuuuccaguaua

SEQ ID NO: 25043 - RNA, 17 nt, Homo sapiens
uauuugaaacaugcuuu

SEQ ID NO: 25044 - RNA, 23 nt, Homo sapiens
cuuaugcugucuuaaauuauuuu

SEQ ID NO: 25045 - RNA, 21 nt, Homo sapiens
uaauuccagagaauuuuuauc

SEQ ID NO: 25046 - RNA, 20 nt, Homo sapiens
aaaaugugauuuuugacaua

SEQ ID NO: 25047 - RNA, 18 nt, Homo sapiens
caauaucaccaaaguaug

SEQ ID NO: 25048 - RNA, 19 nt, Homo sapiens
cgacuugaguguaaacaua

SEQ ID NO: 25049 - RNA, 21 nt, Homo sapiens
gccagaacgugccucaggagg

SEQ ID NO: 25050 - RNA, 20 nt, Homo sapiens
cauagaaagacuacugucaa

SEQ ID NO: 25051 - RNA, 22 nt, Homo sapiens
gguggaugggaaaaaauacuug

SEQ ID NO: 25052 - RNA, 19 nt, Homo sapiens
guggagccaagcuacugua

SEQ ID NO: 25053 - RNA, 18 nt, Homo sapiens
ugacaugacagccauucc

SEQ ID NO: 25054 - RNA, 17 nt, Homo sapiens
cgcacaccacugccuca

SEQ ID NO: 25055 - RNA, 24 nt, Homo sapiens
guccucuuucucacuagagacuca

SEQ ID NO: 25056 - RNA, 23 nt, Homo sapiens
augucaggaaagcccuaaacuga

SEQ ID NO: 25057 - RNA, 21 nt, Homo sapiens
caaggucaucucuggcccagu

SEQ ID NO: 25058 - RNA, 21 nt, Homo sapiens
cucccggccccccugcacucu

SEQ ID NO: 25059 - RNA, 21 nt, Homo sapiens
uagauggguuccguaagaggc

SEQ ID NO: 25060 - RNA, 18 nt, Homo sapiens
ugcaccucccggacuuca

SEQ ID NO: 25061 - RNA, 21 nt, Homo sapiens
aggcccaggggacucucucca

SEQ ID NO: 25062 - RNA, 21 nt, Homo sapiens
aucuuggcucacugcaaccuc

SEQ ID NO: 25063 - RNA, 18 nt, Homo sapiens
auugacuuggacauuuuu

SEQ ID NO: 25064 - RNA, 20 nt, Homo sapiens
uaguguaaacaaaaauuuca

SEQ ID NO: 25065 - RNA, 23 nt, Homo sapiens
aaagucuucugcagaaucuccca

SEQ ID NO: 25066 - RNA, 22 nt, Homo sapiens
aagucuucugcagaaucuccca

SEQ ID NO: 25067 - RNA, 23 nt, Homo sapiens
auguuacagagcaugucauuguc

SEQ ID NO: 25068 - RNA, 20 nt, Homo sapiens
cuaaauuugacccucugggc

SEQ ID NO: 25069 - RNA, 18 nt, Homo sapiens
ccugcaaccuccaccucc

SEQ ID NO: 25070 - RNA, 19 nt, Homo sapiens
uccaguucuuguuuuuugg

SEQ ID NO: 25071 - RNA, 17 nt, Homo sapiens
ucaagugauucuccugc

SEQ ID NO: 25072 - RNA, 26 nt, Homo sapiens
uggucggugaggcccggguuauuuuu

SEQ ID NO: 25073 - RNA, 17 nt, Homo sapiens
uucuccugccuuagccu

SEQ ID NO: 25074 - RNA, 17 nt, Homo sapiens
aggcagcgaugcugagc

SEQ ID NO: 25075 - RNA, 19 nt, Homo sapiens
cgcgcguguguacacaugc

SEQ ID NO: 25076 - RNA, 16 nt, Homo sapiens
cuaagaccccgcgggc

SEQ ID NO: 25077 - RNA, 18 nt, Homo sapiens
gagccuuccuuucacaca

SEQ ID NO: 25078 - RNA, 28 nt, Homo sapiens
gccuggucagccccguggccucuggccc

SEQ ID NO: 25079 - RNA, 18 nt, Homo sapiens
uuccagaauguauuucca

SEQ ID NO: 25080 - RNA, 20 nt, Homo sapiens
cuagugccagaaacuuggca

SEQ ID NO: 25081 - RNA, 27 nt, Homo sapiens
uaaauaaaacccaucagcaugggguua

SEQ ID NO: 25082 - RNA, 19 nt, Homo sapiens
aacaauccaaucccaugau

SEQ ID NO: 25083 - RNA, 16 nt, Homo sapiens
cucuaauguaagucua

SEQ ID NO: 25084 - RNA, 24 nt, Homo sapiens
cuuaaucaccuucuaaagaucuca

SEQ ID NO: 25085 - RNA, 20 nt, Homo sapiens
uagaacucuggauuuuuaga

SEQ ID NO: 25086 - RNA, 17 nt, Homo sapiens
uuuugugguuguagcaa

SEQ ID NO: 25087 - RNA, 19 nt, Homo sapiens
auguaaaaauaagacauua

SEQ ID NO: 25088 - RNA, 21 nt, Homo sapiens
uaugcaauuauauaucugaua

SEQ ID NO: 25089 - RNA, 21 nt, Homo sapiens
agccgcagccucucuugaggg

SEQ ID NO: 25090 - RNA, 17 nt, Homo sapiens
cugaggcccagcugggc

SEQ ID NO: 25091 - RNA, 21 nt, Homo sapiens
gagcgccucugguuccugcuc

SEQ ID NO: 25092 - RNA, 16 nt, Homo sapiens
gccaggaggcaccuga

SEQ ID NO: 25093 - RNA, 20 nt, Homo sapiens
ucccaggugaccauucucug

SEQ ID NO: 25094 - RNA, 20 nt, Homo sapiens
ugggcacgaguauggugaga

SEQ ID NO: 25095 - RNA, 17 nt, Homo sapiens
cagcugcagcagcacca

SEQ ID NO: 25096 - RNA, 23 nt, Homo sapiens
cuccagcucacacaacacugcuu

SEQ ID NO: 25097 - RNA, 19 nt, Homo sapiens
gaaacuccagcucacacaa

SEQ ID NO: 25098 - RNA, 18 nt, Homo sapiens
gaggaaagcagcugugag

SEQ ID NO: 25099 - RNA, 18 nt, Homo sapiens
ucacacaacacugcuucu

SEQ ID NO: 25100 - RNA, 24 nt, Homo sapiens
ugcuauuucuuucugguuccugca

SEQ ID NO: 25101 - RNA, 19 nt, Homo sapiens
agaccuuccugaggcugcc

SEQ ID NO: 25102 - RNA, 18 nt, Homo sapiens
cucuagaauagccaccca

SEQ ID NO: 25103 - RNA, 21 nt, Homo sapiens
cagcaacccaccugaguauga

SEQ ID NO: 25104 - RNA, 19 nt, Homo sapiens
ccucuggggccugcgagcc

SEQ ID NO: 25105 - RNA, 16 nt, Homo sapiens
cgagcccgccaugaga

SEQ ID NO: 25106 - RNA, 17 nt, Homo sapiens
cuacaagaagaucccca

SEQ ID NO: 25107 - RNA, 23 nt, Homo sapiens
gcacccauuccucggcgaucuga

SEQ ID NO: 25108 - RNA, 24 nt, Homo sapiens
gggagaagaggcuggcucagugcc

SEQ ID NO: 25109 - RNA, 23 nt, Homo sapiens
ccaaagacacuauuuuugcagcu

SEQ ID NO: 25110 - RNA, 19 nt, Homo sapiens
gauagaucccccauccucu

SEQ ID NO: 25111 - RNA, 20 nt, Homo sapiens
aguaguugaaguccagggca

SEQ ID NO: 25112 - RNA, 20 nt, Homo sapiens
aguuaaaacaaaggacgcua

SEQ ID NO: 25113 - RNA, 18 nt, Homo sapiens
cugagucaagacucucaa

SEQ ID NO: 25114 - RNA, 19 nt, Homo sapiens
cugcuaccccagccaaaga

SEQ ID NO: 25115 - RNA, 21 nt, Homo sapiens
gcagcuugaugaguuuuuguu

SEQ ID NO: 25116 - RNA, 20 nt, Homo sapiens
guauaggcaggugugaggga

SEQ ID NO: 25117 - RNA, 20 nt, Homo sapiens
gugaccaaggcccaugugug

SEQ ID NO: 25118 - RNA, 18 nt, Homo sapiens
uauuuuucuuuguuccca

SEQ ID NO: 25119 - RNA, 22 nt, Homo sapiens
ucuggauugcggagggugguuc

SEQ ID NO: 25120 - RNA, 17 nt, Homo sapiens
uguaauugugggcaugu

SEQ ID NO: 25121 - RNA, 22 nt, Homo sapiens
ggaggagggggagccccggaca

SEQ ID NO: 25122 - RNA, 18 nt, Homo sapiens
ccugcccuccuccaacaa

SEQ ID NO: 25123 - RNA, 22 nt, Homo sapiens
cucugaugguguccuccucugg

SEQ ID NO: 25124 - RNA, 20 nt, Homo sapiens
ccagauuccaaaggauucaa

SEQ ID NO: 25125 - RNA, 15 nt, Homo sapiens
cccugaagucucuaa

SEQ ID NO: 25126 - RNA, 23 nt, Homo sapiens
ccucuuugugagaucugagcuuu

SEQ ID NO: 25127 - RNA, 19 nt, Homo sapiens
cuccuacuuaucuugcuca

SEQ ID NO: 25128 - RNA, 21 nt, Homo sapiens
gcuacaguugugacucacacu

SEQ ID NO: 25129 - RNA, 23 nt, Homo sapiens
ggcgcuagagguccugccucuua

SEQ ID NO: 25130 - RNA, 19 nt, Homo sapiens
gguucuuuacauugugaua

SEQ ID NO: 25131 - RNA, 19 nt, Homo sapiens
cccuaacuagaguucuaga

SEQ ID NO: 25132 - RNA, 18 nt, Homo sapiens
uuggaugucuuccuuaga

SEQ ID NO: 25133 - RNA, 20 nt, Homo sapiens
aaucuggccaugaaaaccuc

SEQ ID NO: 25134 - RNA, 19 nt, Homo sapiens
caacaggcacuucccaaca

SEQ ID NO: 25135 - RNA, 21 nt, Homo sapiens
cagccgucaggaaucuggcca

SEQ ID NO: 25136 - RNA, 20 nt, Homo sapiens
ugaggucccaguaugaacug

SEQ ID NO: 25137 - RNA, 18 nt, Homo sapiens
ggacaaaugcuuucagug

SEQ ID NO: 25138 - RNA, 25 nt, Homo sapiens
aguccugcucccucacaugaagcug

SEQ ID NO: 25139 - RNA, 21 nt, Homo sapiens
ccauuaaaaaaauaauccuua

SEQ ID NO: 25140 - RNA, 23 nt, Homo sapiens
ccucuggguccucuccaaguccu

SEQ ID NO: 25141 - RNA, 22 nt, Homo sapiens
gcauuuuagaucaaacaauuca

SEQ ID NO: 25142 - RNA, 24 nt, Homo sapiens
ggcaugagccaccucgccuggcca

SEQ ID NO: 25143 - RNA, 18 nt, Homo sapiens
uccgacuccuggguucaa

SEQ ID NO: 25144 - RNA, 20 nt, Homo sapiens
uggccaggcuggucuugaac

SEQ ID NO: 25145 - RNA, 18 nt, Homo sapiens
uggcuuggccugagacug

SEQ ID NO: 25146 - RNA, 20 nt, Homo sapiens
uucuuggacacaacccuccu

SEQ ID NO: 25147 - RNA, 22 nt, Homo sapiens
ucuucgcagggaagccugugga

SEQ ID NO: 25148 - RNA, 20 nt, Homo sapiens
gugccaggagccaugucuga

SEQ ID NO: 25149 - RNA, 19 nt, Homo sapiens
uaaaaacauuuuagacaaa

SEQ ID NO: 25150 - RNA, 22 nt, Homo sapiens
caauaucaaaaacaagugcuug

SEQ ID NO: 25151 - RNA, 19 nt, Homo sapiens
gaaggugaugugaaugcga

SEQ ID NO: 25152 - RNA, 24 nt, Homo sapiens
cuugggcaacucgagcagcucucc

SEQ ID NO: 25153 - RNA, 20 nt, Homo sapiens
ggaaaugauugugcggcugu

SEQ ID NO: 25154 - RNA, 21 nt, Homo sapiens
ugaguggguucccucgugggg

SEQ ID NO: 25155 - RNA, 19 nt, Homo sapiens
ccaggcuucucccaacaga

SEQ ID NO: 25156 - RNA, 21 nt, Homo sapiens
guuauguuguugguagauuuu

SEQ ID NO: 25157 - RNA, 19 nt, Homo sapiens
ugacuauccaaacagcuca

SEQ ID NO: 25158 - RNA, 18 nt, Homo sapiens
acacuggagccugcaaua

SEQ ID NO: 25159 - RNA, 23 nt, Homo sapiens
agagaguaucugagaaccaacca

SEQ ID NO: 25160 - RNA, 21 nt, Homo sapiens
agcagugcagccaccagggca

SEQ ID NO: 25161 - RNA, 21 nt, Homo sapiens
caagaggacccugccuuggug

SEQ ID NO: 25162 - RNA, 23 nt, Homo sapiens
gaagaaguaguuuacuuuggacu

SEQ ID NO: 25163 - RNA, 18 nt, Homo sapiens
gccucccacggucagcug

SEQ ID NO: 25164 - RNA, 18 nt, Homo sapiens
gcguccucccccguaccu

SEQ ID NO: 25165 - RNA, 19 nt, Homo sapiens
augacacagaagagcgcug

SEQ ID NO: 25166 - RNA, 20 nt, Homo sapiens
cgaccuuccagcagcugacc

SEQ ID NO: 25167 - RNA, 20 nt, Homo sapiens
acuugucuacaaaccaggug

SEQ ID NO: 25168 - RNA, 21 nt, Homo sapiens
aucauugcaaccuuauuaggc

SEQ ID NO: 25169 - RNA, 19 nt, Homo sapiens
cucuuuaauucauagccuu

SEQ ID NO: 25170 - RNA, 17 nt, Homo sapiens
ggaacaguacgaucuua

SEQ ID NO: 25171 - RNA, 19 nt, Homo sapiens
ucuaacucauguuuuugau

SEQ ID NO: 25172 - RNA, 24 nt, Homo sapiens
accuggguuguuaccugccugucu

SEQ ID NO: 25173 - RNA, 17 nt, Homo sapiens
auggcuggggguucuga

SEQ ID NO: 25174 - RNA, 23 nt, Homo sapiens
ccugacuaaauagcagucaggga

SEQ ID NO: 25175 - RNA, 18 nt, Homo sapiens
cucuccuuagagacaccu

SEQ ID NO: 25176 - RNA, 18 nt, Homo sapiens
guaugaguauucauuccu

SEQ ID NO: 25177 - RNA, 17 nt, Homo sapiens
gucaugaguaaaagcuu

SEQ ID NO: 25178 - RNA, 23 nt, Homo sapiens
ugccauuuuuuuucuucuguaca

SEQ ID NO: 25179 - RNA, 19 nt, Homo sapiens
cacacccccguggcuggaa

SEQ ID NO: 25180 - RNA, 18 nt, Homo sapiens
ccgggcucgggaguuaug

SEQ ID NO: 25181 - RNA, 16 nt, Homo sapiens
guggacuuccuguucu

SEQ ID NO: 25182 - RNA, 18 nt, Homo sapiens
ugccaaugauagugacca

SEQ ID NO: 25183 - RNA, 19 nt, Homo sapiens
agguuuccuaucccccuca

SEQ ID NO: 25184 - RNA, 19 nt, Homo sapiens
aggcaguggugggauucca

SEQ ID NO: 25185 - RNA, 23 nt, Homo sapiens
ccauuuugcuucccagcacuuuu

SEQ ID NO: 25186 - RNA, 21 nt, Homo sapiens
uagcauuuuuuuuuuuccaaa

SEQ ID NO: 25187 - RNA, 18 nt, Homo sapiens
gugugugucauguggcug

SEQ ID NO: 25188 - RNA, 21 nt, Homo sapiens
aucuggguuuucuccuggcuu

SEQ ID NO: 25189 - RNA, 15 nt, Homo sapiens
augguguguccgacg

SEQ ID NO: 25190 - RNA, 23 nt, Homo sapiens
ccaauaacucuuuuuuuuuuccu

SEQ ID NO: 25191 - RNA, 18 nt, Homo sapiens
ggagguggcggcggcggc

SEQ ID NO: 25192 - RNA, 22 nt, Homo sapiens
ugguguguccgacguagagcug

SEQ ID NO: 25193 - RNA, 21 nt, Homo sapiens
caccaccaccaucauccuggc

SEQ ID NO: 25194 - RNA, 18 nt, Homo sapiens
gguagaaggccuguugug

SEQ ID NO: 25195 - RNA, 24 nt, Homo sapiens
gcaccuuuuucccuuuccuucuca

SEQ ID NO: 25196 - RNA, 20 nt, Homo sapiens
aggcauuuuguuucugguga

SEQ ID NO: 25197 - RNA, 19 nt, Homo sapiens
ccagggcuggcuggccugc

SEQ ID NO: 25198 - RNA, 20 nt, Homo sapiens
uacugguggcuguugaugac

SEQ ID NO: 25199 - RNA, 20 nt, Homo sapiens
ugcagcucaagcaugucugc

SEQ ID NO: 25200 - RNA, 24 nt, Homo sapiens
uuugccauagcucagaccacuucu

SEQ ID NO: 25201 - RNA, 19 nt, Homo sapiens
augggaggccuauuugacu

SEQ ID NO: 25202 - RNA, 19 nt, Homo sapiens
gaucuuauaccacucugua

SEQ ID NO: 25203 - RNA, 16 nt, Homo sapiens
uugaaaagaccuggaa

SEQ ID NO: 25204 - RNA, 19 nt, Homo sapiens
augugauguucagcagcaa

SEQ ID NO: 25205 - RNA, 19 nt, Homo sapiens
ccuggggauuucuugguuu

SEQ ID NO: 25206 - RNA, 19 nt, Homo sapiens
uuauaccagcugaauggca

SEQ ID NO: 25207 - RNA, 15 nt, Homo sapiens
uugggauguuuuuga

SEQ ID NO: 25208 - RNA, 21 nt, Homo sapiens
uuucuugagcguuuugauuuu

SEQ ID NO: 25209 - RNA, 24 nt, Homo sapiens
ccuggauuuuuuuaaaucauuuuu

SEQ ID NO: 25210 - RNA, 19 nt, Homo sapiens
gaacacuaugcauuuugaa

SEQ ID NO: 25211 - RNA, 22 nt, Homo sapiens
ucccuuuuucccgucugacccc

SEQ ID NO: 25212 - RNA, 20 nt, Homo sapiens
accaucugauaagucagaga

SEQ ID NO: 25213 - RNA, 20 nt, Homo sapiens
gcagacuuuaaccaucugau

SEQ ID NO: 25214 - RNA, 19 nt, Homo sapiens
ggagcucaguggaaaucuc

SEQ ID NO: 25215 - RNA, 18 nt, Homo sapiens
ugaggauuuugauucaga

SEQ ID NO: 25216 - RNA, 23 nt, Homo sapiens
uuugaaauguggaggauuuugaa

SEQ ID NO: 25217 - RNA, 23 nt, Homo sapiens
agugcuugaccaguaaugugguu

SEQ ID NO: 25218 - RNA, 24 nt, Homo sapiens
ccugagccuccugaaguugcugcu

SEQ ID NO: 25219 - RNA, 15 nt, Homo sapiens
cugagcagggcugga

SEQ ID NO: 25220 - RNA, 18 nt, Homo sapiens
uccgccucccggguucaa

SEQ ID NO: 25221 - RNA, 17 nt, Homo sapiens
ugcuguguggacuucau

SEQ ID NO: 25222 - RNA, 23 nt, Homo sapiens
caugggggagaacauacagccca

SEQ ID NO: 25223 - RNA, 19 nt, Homo sapiens
cauuaacaaaacaaucacu

SEQ ID NO: 25224 - RNA, 20 nt, Homo sapiens
ccaaggcugcuaggcccacc

SEQ ID NO: 25225 - RNA, 19 nt, Homo sapiens
gcaaauuaggaucacuuga

SEQ ID NO: 25226 - RNA, 21 nt, Homo sapiens
gcggaggaggaagcuguggcu

SEQ ID NO: 25227 - RNA, 23 nt, Homo sapiens
uccuuuaaaaauuccaaagcuca

SEQ ID NO: 25228 - RNA, 24 nt, Homo sapiens
cagaagaauggcguaaacccagga

SEQ ID NO: 25229 - RNA, 23 nt, Homo sapiens
agacccaauauacaggguuuuga

SEQ ID NO: 25230 - RNA, 25 nt, Homo sapiens
uuuggcaguaauccagauugcuuuu

SEQ ID NO: 25231 - RNA, 22 nt, Homo sapiens
gcccccaaaaggagcccgguga

SEQ ID NO: 25232 - RNA, 20 nt, Homo sapiens
ucugaagagcacaucuccac

SEQ ID NO: 25233 - RNA, 21 nt, Homo sapiens
aucucggcucaccccaaccuc

SEQ ID NO: 25234 - RNA, 19 nt, Homo sapiens
ugcauucauccagcucacc

SEQ ID NO: 25235 - RNA, 22 nt, Homo sapiens
aucuuggcucacugcaaccucu

SEQ ID NO: 25236 - RNA, 19 nt, Homo sapiens
cccaccacccuacuugaca

SEQ ID NO: 25237 - RNA, 20 nt, Homo sapiens
ccucugccuccuggguucaa

SEQ ID NO: 25238 - RNA, 21 nt, Homo sapiens
cuccauuuccccuccuccucu

SEQ ID NO: 25239 - RNA, 21 nt, Homo sapiens
cuguccccaccuccacccucc

SEQ ID NO: 25240 - RNA, 16 nt, Homo sapiens
gagccccaggaucuca

SEQ ID NO: 25241 - RNA, 17 nt, Homo sapiens
ucaagugauucucuugc

SEQ ID NO: 25242 - RNA, 19 nt, Homo sapiens
cauccucuuccacgcucag

SEQ ID NO: 25243 - RNA, 18 nt, Homo sapiens
gagaucgagcuuaccuca

SEQ ID NO: 25244 - RNA, 18 nt, Homo sapiens
ucuuccgccuuccauugu

SEQ ID NO: 25245 - RNA, 24 nt, Homo sapiens
uccagggcccugggcuggaccuca

SEQ ID NO: 25246 - RNA, 25 nt, Homo sapiens
aggaauaaaguugcugauucauucc

SEQ ID NO: 25247 - RNA, 17 nt, Homo sapiens
ugaagcuuguguaucca

SEQ ID NO: 25248 - RNA, 19 nt, Homo sapiens
uggcagggccuagcugcua

SEQ ID NO: 25249 - RNA, 19 nt, Homo sapiens
aggucuuauagauuccuga

SEQ ID NO: 25250 - RNA, 19 nt, Homo sapiens
ugaggaauacagugagcag

SEQ ID NO: 25251 - RNA, 21 nt, Homo sapiens
caucucggacuugcugaauca

SEQ ID NO: 25252 - RNA, 16 nt, Homo sapiens
cuguuuuggagacugc

SEQ ID NO: 25253 - RNA, 24 nt, Homo sapiens
guuuuggagacugccuauaaguua

SEQ ID NO: 25254 - RNA, 16 nt, Homo sapiens
acugguggcaggugau

SEQ ID NO: 25255 - RNA, 17 nt, Homo sapiens
ccuauggaggcccauga

SEQ ID NO: 25256 - RNA, 17 nt, Homo sapiens
gucuacagccugaccca

SEQ ID NO: 25257 - RNA, 20 nt, Homo sapiens
uguguuggaggcccucugga

SEQ ID NO: 25258 - RNA, 26 nt, Homo sapiens
gcuuggaccgcgauggggcugggccc

SEQ ID NO: 25259 - RNA, 16 nt, Homo sapiens
aguagaagaaaccaca

SEQ ID NO: 25260 - RNA, 20 nt, Homo sapiens
ucuugaguuguuuuaauuuu

SEQ ID NO: 25261 - RNA, 24 nt, Homo sapiens
uguaaagggaucuugaguuguuuu

SEQ ID NO: 25262 - RNA, 21 nt, Homo sapiens
uugcauuuuagcacuugcacu

SEQ ID NO: 25263 - RNA, 22 nt, Homo sapiens
aagaaauaaaaauagccauuga

SEQ ID NO: 25264 - RNA, 22 nt, Homo sapiens
agccacacucauccacauccug

SEQ ID NO: 25265 - RNA, 17 nt, Homo sapiens
augacucaguuucaguu

SEQ ID NO: 25266 - RNA, 17 nt, Homo sapiens
cacucauccacauccug

SEQ ID NO: 25267 - RNA, 18 nt, Homo sapiens
cauuucccaagugcuuca

SEQ ID NO: 25268 - RNA, 18 nt, Homo sapiens
aagaacguggucagagua

SEQ ID NO: 25269 - RNA, 21 nt, Homo sapiens
aagagauaacuguaaauguga

SEQ ID NO: 25270 - RNA, 19 nt, Homo sapiens
ccaggcuacaagagaaaaa

SEQ ID NO: 25271 - RNA, 18 nt, Homo sapiens
cguauccauaaagacccg

SEQ ID NO: 25272 - RNA, 20 nt, Homo sapiens
ucauccccuuauccuucucc

SEQ ID NO: 25273 - RNA, 17 nt, Homo sapiens
uuccaaacaccacuuua

SEQ ID NO: 25274 - RNA, 18 nt, Homo sapiens
augggauuccuugccacc

SEQ ID NO: 25275 - RNA, 20 nt, Homo sapiens
ccacaacacucaucugucaa

SEQ ID NO: 25276 - RNA, 24 nt, Homo sapiens
ggauccgcugcaccgucugccaca

SEQ ID NO: 25277 - RNA, 21 nt, Homo sapiens
ugcgcugcccccagugccaga

SEQ ID NO: 25278 - RNA, 17 nt, Homo sapiens
ugcccucaucccaccca

SEQ ID NO: 25279 - RNA, 21 nt, Homo sapiens
ggacauaggcaaaauaacuug

SEQ ID NO: 25280 - RNA, 17 nt, Homo sapiens
gguaugaguauauacca

SEQ ID NO: 25281 - RNA, 18 nt, Homo sapiens
ugguggcugaauuuccca

SEQ ID NO: 25282 - RNA, 22 nt, Homo sapiens
uucauagguguucugcauuuga

SEQ ID NO: 25283 - RNA, 21 nt, Homo sapiens
gcaccccccggcccugccucc

SEQ ID NO: 25284 - RNA, 19 nt, Homo sapiens
gggagcccgccccgcuucc

SEQ ID NO: 25285 - RNA, 23 nt, Homo sapiens
auguauugauguacagccuugaa

SEQ ID NO: 25286 - RNA, 20 nt, Homo sapiens
aaauccaaggucuccccauc

SEQ ID NO: 25287 - RNA, 21 nt, Homo sapiens
accugaaccaacaucugguuc

SEQ ID NO: 25288 - RNA, 18 nt, Homo sapiens
cacuucacucugccuuuu

SEQ ID NO: 25289 - RNA, 22 nt, Homo sapiens
cagaaggaaaaaaauacucucu

SEQ ID NO: 25290 - RNA, 25 nt, Homo sapiens
cuacaaaaaauuagcugggcacugu

SEQ ID NO: 25291 - RNA, 20 nt, Homo sapiens
gcuauuaggaauauuuaccu

SEQ ID NO: 25292 - RNA, 22 nt, Homo sapiens
ugaagaaagccaagaaaaccca

SEQ ID NO: 25293 - RNA, 17 nt, Homo sapiens
uuuucacuucacucugc

SEQ ID NO: 25294 - RNA, 22 nt, Homo sapiens
aucguuuaucauauugaaacau

SEQ ID NO: 25295 - RNA, 25 nt, Homo sapiens
gccucuuuauacucacuuaaaccaa

SEQ ID NO: 25296 - RNA, 20 nt, Homo sapiens
cccagaaugauaacugcaca

SEQ ID NO: 25297 - RNA, 18 nt, Homo sapiens
cugcucaugugucagugu

SEQ ID NO: 25298 - RNA, 17 nt, Homo sapiens
uccaacugcuguuucag

SEQ ID NO: 25299 - RNA, 18 nt, Homo sapiens
ucuccugcucauguguca

SEQ ID NO: 25300 - RNA, 18 nt, Homo sapiens
ugauaacugcacaguggc

SEQ ID NO: 25301 - RNA, 16 nt, Homo sapiens
aagaaauaggaagcca

SEQ ID NO: 25302 - RNA, 18 nt, Homo sapiens
cugcacaggcacugugca

SEQ ID NO: 25303 - RNA, 17 nt, Homo sapiens
ucacuggagacucacuu

SEQ ID NO: 25304 - RNA, 19 nt, Homo sapiens
ugcacagcuuacacuguca

SEQ ID NO: 25305 - RNA, 21 nt, Homo sapiens
uuuuggugaauugggauuugc

SEQ ID NO: 25306 - RNA, 18 nt, Homo sapiens
cuucucucucuuaccucu

SEQ ID NO: 25307 - RNA, 20 nt, Homo sapiens
ugguuuccucccaacccccg

SEQ ID NO: 25308 - RNA, 17 nt, Homo sapiens
ccuggcgcuggccgugg

SEQ ID NO: 25309 - RNA, 22 nt, Homo sapiens
cgcccccgggacccgucucccc

SEQ ID NO: 25310 - RNA, 19 nt, Homo sapiens
cucacggcucccuuugcca

SEQ ID NO: 25311 - RNA, 21 nt, Homo sapiens
cuugucucagaaagucccuca

SEQ ID NO: 25312 - RNA, 18 nt, Homo sapiens
ugguuugacuuggaacua

SEQ ID NO: 25313 - RNA, 18 nt, Homo sapiens
ucugcugauguuuaucuu

SEQ ID NO: 25314 - RNA, 18 nt, Homo sapiens
acuugaugguaaaauaug

SEQ ID NO: 25315 - RNA, 23 nt, Homo sapiens
gcauguuaacauugccuaccuca

SEQ ID NO: 25316 - RNA, 20 nt, Homo sapiens
uuauaaaucauccuucacca

SEQ ID NO: 25317 - RNA, 17 nt, Homo sapiens
aaggacaaguuugucau

SEQ ID NO: 25318 - RNA, 20 nt, Homo sapiens
aggagagaaagggcagcucc

SEQ ID NO: 25319 - RNA, 20 nt, Homo sapiens
ccaacaccauucuuccccca

SEQ ID NO: 25320 - RNA, 24 nt, Homo sapiens
cccuggucagaaaaagcuugcgga

SEQ ID NO: 25321 - RNA, 21 nt, Homo sapiens
cuauggccucacucuaccucu

SEQ ID NO: 25322 - RNA, 20 nt, Homo sapiens
cuguuuugugugcguuccca

SEQ ID NO: 25323 - RNA, 17 nt, Homo sapiens
ggaggcugggagucuga

SEQ ID NO: 25324 - RNA, 18 nt, Homo sapiens
uccguugacaguugugua

SEQ ID NO: 25325 - RNA, 21 nt, Homo sapiens
uccguugacaguuguguaaaa

SEQ ID NO: 25326 - RNA, 19 nt, Homo sapiens
cggcagcaaaacuaacuuc

SEQ ID NO: 25327 - RNA, 17 nt, Homo sapiens
ucucccacuuugcaacc

SEQ ID NO: 25328 - RNA, 16 nt, Homo sapiens
acaggaaaaguugguu

SEQ ID NO: 25329 - RNA, 19 nt, Homo sapiens
cugcaaccuccgccuccca

SEQ ID NO: 25330 - RNA, 17 nt, Homo sapiens
ucaagugauucuccugc

SEQ ID NO: 25331 - RNA, 18 nt, Homo sapiens
uccgccucccagguucaa

SEQ ID NO: 25332 - RNA, 18 nt, Homo sapiens
ucuugaccucaugaucca

SEQ ID NO: 25333 - RNA, 19 nt, Homo sapiens
ugguuuucaggugagauug

SEQ ID NO: 25334 - RNA, 18 nt, Homo sapiens
caaaaaaaugcaaaaacc

SEQ ID NO: 25335 - RNA, 18 nt, Homo sapiens
ccaaaaagagaaauguaa

SEQ ID NO: 25336 - RNA, 19 nt, Homo sapiens
cccacucaaaccucuccca

SEQ ID NO: 25337 - RNA, 18 nt, Homo sapiens
ucaggggacuuuuuguca

SEQ ID NO: 25338 - RNA, 16 nt, Homo sapiens
ucuuuccucuugcaca

SEQ ID NO: 25339 - RNA, 24 nt, Homo sapiens
ugaaagaaaucuaucaugcacuga

SEQ ID NO: 25340 - RNA, 22 nt, Homo sapiens
uguuucccucugagugaaacug

SEQ ID NO: 25341 - RNA, 18 nt, Homo sapiens
caaagcuuugggaagcca

SEQ ID NO: 25342 - RNA, 22 nt, Homo sapiens
cgcaguccugacgagcggguca

SEQ ID NO: 25343 - RNA, 22 nt, Homo sapiens
gagccaagaucgcaccacugca

SEQ ID NO: 25344 - RNA, 18 nt, Homo sapiens
uaaucccugaguucuuuu

SEQ ID NO: 25345 - RNA, 17 nt, Homo sapiens
cccaccccuucccaagc

SEQ ID NO: 25346 - RNA, 17 nt, Homo sapiens
ggggccucccccagcca

SEQ ID NO: 25347 - RNA, 25 nt, Homo sapiens
acuuaauaaauauuaguaaauccuu

SEQ ID NO: 25348 - RNA, 18 nt, Homo sapiens
acuuggcaugacgucaca

SEQ ID NO: 25349 - RNA, 20 nt, Homo sapiens
cacacccgcacccgcgccuc

SEQ ID NO: 25350 - RNA, 19 nt, Homo sapiens
caguucaacacaaauguaa

SEQ ID NO: 25351 - RNA, 20 nt, Homo sapiens
aaggccugauggaacacaga

SEQ ID NO: 25352 - RNA, 22 nt, Homo sapiens
acaaaacauuaaacuaguguua

SEQ ID NO: 25353 - RNA, 21 nt, Homo sapiens
agcauauaaaauuuucccccu

SEQ ID NO: 25354 - RNA, 20 nt, Homo sapiens
cucuuaccaguauuuaacuu

SEQ ID NO: 25355 - RNA, 23 nt, Homo sapiens
cuguaugguuuuguuuuguuuug

SEQ ID NO: 25356 - RNA, 19 nt, Homo sapiens
ggcuacugcuucaaucuca

SEQ ID NO: 25357 - RNA, 20 nt, Homo sapiens
aaggccugauggaacacaga

SEQ ID NO: 25358 - RNA, 22 nt, Homo sapiens
acaaaacauuaaacuaguguua

SEQ ID NO: 25359 - RNA, 21 nt, Homo sapiens
agcauauaaaauuuucccccu

SEQ ID NO: 25360 - RNA, 20 nt, Homo sapiens
cucuuaccaguauuuaacuu

SEQ ID NO: 25361 - RNA, 23 nt, Homo sapiens
cuguaugguuuuguuuuguuuug

SEQ ID NO: 25362 - RNA, 19 nt, Homo sapiens
ggcuacugcuucaaucuca

SEQ ID NO: 25363 - RNA, 23 nt, Homo sapiens
aacaaaucuggauaaaugugcaa

SEQ ID NO: 25364 - RNA, 22 nt, Homo sapiens
caguauuguagagcaagucuug

SEQ ID NO: 25365 - RNA, 19 nt, Homo sapiens
gccugcccccugacacaca

SEQ ID NO: 25366 - RNA, 19 nt, Homo sapiens
aauggaagccaacacauca

SEQ ID NO: 25367 - RNA, 20 nt, Homo sapiens
acauacuuuauuucuucuua

SEQ ID NO: 25368 - RNA, 17 nt, Homo sapiens
augccucucuuuuucuu

SEQ ID NO: 25369 - RNA, 15 nt, Homo sapiens
gauuuuaacagcucu

SEQ ID NO: 25370 - RNA, 17 nt, Homo sapiens
gcugaagacuuuuguua

SEQ ID NO: 25371 - RNA, 18 nt, Homo sapiens
gguacaaacucauugcug

SEQ ID NO: 25372 - RNA, 18 nt, Homo sapiens
ucucuacuaaaaauacaa

SEQ ID NO: 25373 - RNA, 20 nt, Homo sapiens
ucucuuccugagccuuaacu

SEQ ID NO: 25374 - RNA, 17 nt, Homo sapiens
ugaugugaucuaugaag

SEQ ID NO: 25375 - RNA, 21 nt, Homo sapiens
ugcaaauugaaaaccaugcaa

SEQ ID NO: 25376 - RNA, 20 nt, Homo sapiens
uggggcccggagugaggcug

SEQ ID NO: 25377 - RNA, 18 nt, Homo sapiens
uggguggaucacuugagg

SEQ ID NO: 25378 - RNA, 24 nt, Homo sapiens
uuugggcaaauaggcguuacuuuu

SEQ ID NO: 25379 - RNA, 21 nt, Homo sapiens
aaucuuacuaacaccuaugau

SEQ ID NO: 25380 - RNA, 18 nt, Homo sapiens
auggaaacaagccacuua

SEQ ID NO: 25381 - RNA, 18 nt, Homo sapiens
auuuuauuuaugguccag

SEQ ID NO: 25382 - RNA, 24 nt, Homo sapiens
cagaaugcuuugaaauucuaaugg

SEQ ID NO: 25383 - RNA, 20 nt, Homo sapiens
cccgacaccucaccuuucgc

SEQ ID NO: 25384 - RNA, 17 nt, Homo sapiens
ccucaccuuucgcuguu

SEQ ID NO: 25385 - RNA, 21 nt, Homo sapiens
cucuuucucucucucucucuc

SEQ ID NO: 25386 - RNA, 18 nt, Homo sapiens
uaaggauaaaacacguca

SEQ ID NO: 25387 - RNA, 22 nt, Homo sapiens
uaucggccaccugccaaucaca

SEQ ID NO: 25388 - RNA, 16 nt, Homo sapiens
ucucucucucuuuucu

SEQ ID NO: 25389 - RNA, 21 nt, Homo sapiens
ccaaaagagacccacuguaau

SEQ ID NO: 25390 - RNA, 18 nt, Homo sapiens
ccccgaacccccccugca

SEQ ID NO: 25391 - RNA, 19 nt, Homo sapiens
gggggaaauguguguguca

SEQ ID NO: 25392 - RNA, 17 nt, Homo sapiens
uggcaguccagcagcaa

SEQ ID NO: 25393 - RNA, 21 nt, Homo sapiens
gccccuccgccccuagcccca

SEQ ID NO: 25394 - RNA, 20 nt, Homo sapiens
ccucugccucccggguucaa

SEQ ID NO: 25395 - RNA, 17 nt, Homo sapiens
uccagacuuacucuucu

SEQ ID NO: 25396 - RNA, 23 nt, Homo sapiens
cucaccugcagccuguugcccaa

SEQ ID NO: 25397 - RNA, 25 nt, Homo sapiens
aaccccgcucaacgcccaccccuca

SEQ ID NO: 25398 - RNA, 20 nt, Homo sapiens
caaaacaaggaaaucacaca

SEQ ID NO: 25399 - RNA, 26 nt, Homo sapiens
caaccccgcucaacgcccaccccuca

SEQ ID NO: 25400 - RNA, 20 nt, Homo sapiens
ccuuagcacaaucuauugua

SEQ ID NO: 25401 - RNA, 16 nt, Homo sapiens
gucugagucugugcac

SEQ ID NO: 25402 - RNA, 19 nt, Homo sapiens
uugucccuuugcaccuuga

SEQ ID NO: 25403 - RNA, 28 nt, Homo sapiens
uuuguugcucugaucuuaaguuucuuuu

SEQ ID NO: 25404 - RNA, 21 nt, Homo sapiens
auacccuuuggauugaucaca

SEQ ID NO: 25405 - RNA, 21 nt, Homo sapiens
aucugggaucuagacaucuga

SEQ ID NO: 25406 - RNA, 20 nt, Homo sapiens
cccuccuccccucccccaau

SEQ ID NO: 25407 - RNA, 18 nt, Homo sapiens
uagucucgaguuuuuuuu

SEQ ID NO: 25408 - RNA, 21 nt, Homo sapiens
uguggggcugcauuugcggug

SEQ ID NO: 25409 - RNA, 17 nt, Homo sapiens
ccccaaauuugacacca

SEQ ID NO: 25410 - RNA, 22 nt, Homo sapiens
cucuuucuccccgcugugccuc

SEQ ID NO: 25411 - RNA, 23 nt, Homo sapiens
cugggggcuccucuaacaucuca

SEQ ID NO: 25412 - RNA, 20 nt, Homo sapiens
gauccagaccagcgucuggc

SEQ ID NO: 25413 - RNA, 18 nt, Homo sapiens
gccuggcugagggccggg

SEQ ID NO: 25414 - RNA, 22 nt, Homo sapiens
gcuucucccugacccccgcccu

SEQ ID NO: 25415 - RNA, 19 nt, Homo sapiens
accagucaggcuuauuuca

SEQ ID NO: 25416 - RNA, 19 nt, Homo sapiens
auccuacuucuacccccac

SEQ ID NO: 25417 - RNA, 17 nt, Homo sapiens
cucccgaucuugcugcc

SEQ ID NO: 25418 - RNA, 21 nt, Homo sapiens
gcagaagagaggguuuucuca

SEQ ID NO: 25419 - RNA, 19 nt, Homo sapiens
gguggaugaaguaugugug

SEQ ID NO: 25420 - RNA, 20 nt, Homo sapiens
uauggcuuugucccuaugac

SEQ ID NO: 25421 - RNA, 18 nt, Homo sapiens
uucacucauugacucacu

SEQ ID NO: 25422 - RNA, 22 nt, Homo sapiens
uucagguuguggcucuugguuc

SEQ ID NO: 25423 - RNA, 21 nt, Homo sapiens
gaggccaucugaagccaaaga

SEQ ID NO: 25424 - RNA, 19 nt, Homo sapiens
auuuuuccugcugcacuga

SEQ ID NO: 25425 - RNA, 19 nt, Homo sapiens
aaggaugacaaacacuauc

SEQ ID NO: 25426 - RNA, 23 nt, Homo sapiens
agugcugacugcagaaugaaaua

SEQ ID NO: 25427 - RNA, 19 nt, Homo sapiens
gaugugucacucagacuca

SEQ ID NO: 25428 - RNA, 18 nt, Homo sapiens
ggcauguguguucaggga

SEQ ID NO: 25429 - RNA, 22 nt, Homo sapiens
ugcuuccucucggcgcacccca

SEQ ID NO: 25430 - RNA, 15 nt, Homo sapiens
acccucccugcuccu

SEQ ID NO: 25431 - RNA, 21 nt, Homo sapiens
acauuacugaauuugugaaga

SEQ ID NO: 25432 - RNA, 17 nt, Homo sapiens
agcuugcuuuuuaucuc

SEQ ID NO: 25433 - RNA, 21 nt, Homo sapiens
auccuuguuaaugcaauuuau

SEQ ID NO: 25434 - RNA, 28 nt, Homo sapiens
ccuuuuuauaaucaaaugcuuuugucuu

SEQ ID NO: 25435 - RNA, 21 nt, Homo sapiens
gggcauuuacugugugccaac

SEQ ID NO: 25436 - RNA, 21 nt, Homo sapiens
gugcuguccugacaacaugcu

SEQ ID NO: 25437 - RNA, 25 nt, Homo sapiens
ucuagugugguuucaaauaacuuuu

SEQ ID NO: 25438 - RNA, 20 nt, Homo sapiens
ugaacauagauuuucugcca

SEQ ID NO: 25439 - RNA, 21 nt, Homo sapiens
aagagauaaggguguuuauga

SEQ ID NO: 25440 - RNA, 24 nt, Homo sapiens
acaaauuugaauuuaauguuguca

SEQ ID NO: 25441 - RNA, 18 nt, Homo sapiens
caucaucgucauguguuu

SEQ ID NO: 25442 - RNA, 23 nt, Homo sapiens
cgcccccaggcugugccccacca

SEQ ID NO: 25443 - RNA, 22 nt, Homo sapiens
ucgucaccaaacuggaaccuca

SEQ ID NO: 25444 - RNA, 16 nt, Homo sapiens
uggcuccugcugcaac

SEQ ID NO: 25445 - RNA, 17 nt, Homo sapiens
ugugugguacuuaguca

SEQ ID NO: 25446 - RNA, 24 nt, Homo sapiens
agugaucucaauaccacacccuca

SEQ ID NO: 25447 - RNA, 17 nt, Homo sapiens
caagauucucugcuuuu

SEQ ID NO: 25448 - RNA, 18 nt, Homo sapiens
gaaaugaaucaaaguaau

SEQ ID NO: 25449 - RNA, 17 nt, Homo sapiens
gagcaucuugaaauuca

SEQ ID NO: 25450 - RNA, 19 nt, Homo sapiens
agaaaaugggauugaguua

SEQ ID NO: 25451 - RNA, 18 nt, Homo sapiens
gcuaacuauaucacagaa

SEQ ID NO: 25452 - RNA, 24 nt, Homo sapiens
gucugaacugcggccccagagccu

SEQ ID NO: 25453 - RNA, 22 nt, Homo sapiens
aaauuuggauagcuuaauuaua

SEQ ID NO: 25454 - RNA, 17 nt, Homo sapiens
aaucuguuaagagcagg

SEQ ID NO: 25455 - RNA, 17 nt, Homo sapiens
ccacauacauuugccua

SEQ ID NO: 25456 - RNA, 18 nt, Homo sapiens
cucaguugauuuaaucuu

SEQ ID NO: 25457 - RNA, 19 nt, Homo sapiens
gguuuuggcccucuugcag

SEQ ID NO: 25458 - RNA, 19 nt, Homo sapiens
guguuugaauauaaaugau

SEQ ID NO: 25459 - RNA, 19 nt, Homo sapiens
ucugguuaucaccuggucc

SEQ ID NO: 25460 - RNA, 22 nt, Homo sapiens
uuuuggcugucaauaucauaac

SEQ ID NO: 25461 - RNA, 19 nt, Homo sapiens
gcaucuucagaauccccca

SEQ ID NO: 25462 - RNA, 20 nt, Homo sapiens
aaguuccccugcucugugaa

SEQ ID NO: 25463 - RNA, 17 nt, Homo sapiens
caacaacuccuccacug

SEQ ID NO: 25464 - RNA, 22 nt, Homo sapiens
ucccaaguuccccugcucugug

SEQ ID NO: 25465 - RNA, 18 nt, Homo sapiens
cuuaaaagagccaaugcc

SEQ ID NO: 25466 - RNA, 18 nt, Homo sapiens
cuaugguacuuugugauu

SEQ ID NO: 25467 - RNA, 20 nt, Homo sapiens
cuguggauuauauugcuuga

SEQ ID NO: 25468 - RNA, 18 nt, Homo sapiens
ugcuugacuucuaccuca

SEQ ID NO: 25469 - RNA, 18 nt, Homo sapiens
agaagguacauccugucc

SEQ ID NO: 25470 - RNA, 21 nt, Homo sapiens
aucuggguggaugccuugccu

SEQ ID NO: 25471 - RNA, 18 nt, Homo sapiens
ggcauucuaaugugaaau

SEQ ID NO: 25472 - RNA, 20 nt, Homo sapiens
ucugagcaguuuugugcuuu

SEQ ID NO: 25473 - RNA, 21 nt, Homo sapiens
ugaaauggauuauuuaucuca

SEQ ID NO: 25474 - RNA, 21 nt, Homo sapiens
acgugcuuagccuuuauuuca

SEQ ID NO: 25475 - RNA, 16 nt, Homo sapiens
acuuguccuuacguca

SEQ ID NO: 25476 - RNA, 20 nt, Homo sapiens
cagccauuccaaucucuucu

SEQ ID NO: 25477 - RNA, 23 nt, Homo sapiens
ggaaccugcuggcaccucacugg

SEQ ID NO: 25478 - RNA, 20 nt, Homo sapiens
ucuuacguugcuugagucuu

SEQ ID NO: 25479 - RNA, 24 nt, Homo sapiens
ugagugggucccagcugugugauu

SEQ ID NO: 25480 - RNA, 18 nt, Homo sapiens
auuaccuccuacuugcca

SEQ ID NO: 25481 - RNA, 18 nt, Homo sapiens
caggaccugggcccgguu

SEQ ID NO: 25482 - RNA, 21 nt, Homo sapiens
gcaccccacucuccugccucc

SEQ ID NO: 25483 - RNA, 16 nt, Homo sapiens
aaggugccaaaugcau

SEQ ID NO: 25484 - RNA, 17 nt, Homo sapiens
cuauuccaaaugcaaua

SEQ ID NO: 25485 - RNA, 23 nt, Homo sapiens
uaaaauaauccuuuaauauccaa

SEQ ID NO: 25486 - RNA, 18 nt, Homo sapiens
ucugauauugcacuucuu

SEQ ID NO: 25487 - RNA, 27 nt, Homo sapiens
accagggucauagugaaacgcagguga

SEQ ID NO: 25488 - RNA, 24 nt, Homo sapiens
accuggcguggagcugccugguuu

SEQ ID NO: 25489 - RNA, 21 nt, Homo sapiens
acgggacagaaccacaugcua

SEQ ID NO: 25490 - RNA, 20 nt, Homo sapiens
ccaggaugaugguuucacuu

SEQ ID NO: 25491 - RNA, 21 nt, Homo sapiens
ggaggagaggggaaagagaca

SEQ ID NO: 25492 - RNA, 18 nt, Homo sapiens
ugcugaggccugaugaca

SEQ ID NO: 25493 - RNA, 22 nt, Homo sapiens
ugugucagaaagcacuucugaa

SEQ ID NO: 25494 - RNA, 19 nt, Homo sapiens
uucugucccggugagcucu

SEQ ID NO: 25495 - RNA, 20 nt, Homo sapiens
gccacauacugcugacggcc

SEQ ID NO: 25496 - RNA, 17 nt, Homo sapiens
gccucugacccauuuua

SEQ ID NO: 25497 - RNA, 19 nt, Homo sapiens
guguggugccuuugagcaa

SEQ ID NO: 25498 - RNA, 17 nt, Homo sapiens
uuaucuccuguguuuca

SEQ ID NO: 25499 - RNA, 19 nt, Homo sapiens
uuuauuuaugguuaccaua

SEQ ID NO: 25500 - RNA, 18 nt, Homo sapiens
gaccagaccccucacuca

SEQ ID NO: 25501 - RNA, 21 nt, Homo sapiens
gguccacgugccuggcucuga

SEQ ID NO: 25502 - RNA, 17 nt, Homo sapiens
ucagaccagaccccuca

SEQ ID NO: 25503 - RNA, 20 nt, Homo sapiens
agaaaauucagcgcuacagc

SEQ ID NO: 25504 - RNA, 19 nt, Homo sapiens
cagcagagggaccucccuc

SEQ ID NO: 25505 - RNA, 20 nt, Homo sapiens
ccacgccccuuccuacacug

SEQ ID NO: 25506 - RNA, 20 nt, Homo sapiens
ccucccccagaccccuccca

SEQ ID NO: 25507 - RNA, 23 nt, Homo sapiens
gaaggauauuacaggaaucucuc

SEQ ID NO: 25508 - RNA, 18 nt, Homo sapiens
ucaccaccaauggcauca

SEQ ID NO: 25509 - RNA, 20 nt, Homo sapiens
aaacacgugaacuuugguga

SEQ ID NO: 25510 - RNA, 19 nt, Homo sapiens
aaggaauaaauuccgcaca

SEQ ID NO: 25511 - RNA, 21 nt, Homo sapiens
aguggagacccccccaaggca

SEQ ID NO: 25512 - RNA, 20 nt, Homo sapiens
caacccuugcauuccacccu

SEQ ID NO: 25513 - RNA, 18 nt, Homo sapiens
ccuggucucccaugccca

SEQ ID NO: 25514 - RNA, 20 nt, Homo sapiens
cucugcaagugcuacuggca

SEQ ID NO: 25515 - RNA, 20 nt, Homo sapiens
cugcccugucucaaaucuca

SEQ ID NO: 25516 - RNA, 25 nt, Homo sapiens
gcagaucuugaagggauauacuuuc

SEQ ID NO: 25517 - RNA, 20 nt, Homo sapiens
gcccuguucacacaaauuuu

SEQ ID NO: 25518 - RNA, 18 nt, Homo sapiens
ucaauaccugcccugucu

SEQ ID NO: 25519 - RNA, 21 nt, Homo sapiens
ugcagcucaccgcgcaugugc

SEQ ID NO: 25520 - RNA, 20 nt, Homo sapiens
uggagcuaagaguccguaac

SEQ ID NO: 25521 - RNA, 15 nt, Homo sapiens
ugggcuggccuggcc

SEQ ID NO: 25522 - RNA, 18 nt, Homo sapiens
uuaccugcccugcugccu

SEQ ID NO: 25523 - RNA, 17 nt, Homo sapiens
acugguuaguugucauu

SEQ ID NO: 25524 - RNA, 22 nt, Homo sapiens
auauaauauauaugcuaaagua

SEQ ID NO: 25525 - RNA, 16 nt, Homo sapiens
auggaaacucuuaccu

SEQ ID NO: 25526 - RNA, 22 nt, Homo sapiens
cagaagaauuacagcccuguca

SEQ ID NO: 25527 - RNA, 18 nt, Homo sapiens
ccaccuuauugccuuucc

SEQ ID NO: 25528 - RNA, 20 nt, Homo sapiens
ccccugguacucagcacaca

SEQ ID NO: 25529 - RNA, 19 nt, Homo sapiens
ccuggauugcaccuuugaa

SEQ ID NO: 25530 - RNA, 24 nt, Homo sapiens
cuucuuucuguuguguuugauuuu

SEQ ID NO: 25531 - RNA, 20 nt, Homo sapiens
gcaaagaaauacaggagacc

SEQ ID NO: 25532 - RNA, 22 nt, Homo sapiens
ucugacgaguaucugaaggcau

SEQ ID NO: 25533 - RNA, 18 nt, Homo sapiens
ugagaaaggaaaaucuca

SEQ ID NO: 25534 - RNA, 21 nt, Homo sapiens
uugaauuuuuaaaaaauuuca

SEQ ID NO: 25535 - RNA, 19 nt, Homo sapiens
aguacuacagcuucuucga

SEQ ID NO: 25536 - RNA, 19 nt, Homo sapiens
cccgagacccaccugcagc

SEQ ID NO: 25537 - RNA, 18 nt, Homo sapiens
cuccucagcauccggcac

SEQ ID NO: 25538 - RNA, 18 nt, Homo sapiens
ugccgccuccucagcauc

SEQ ID NO: 25539 - RNA, 18 nt, Homo sapiens
aauagucaaccugaaaca

SEQ ID NO: 25540 - RNA, 20 nt, Homo sapiens
ccugacaccccauugcuagu

SEQ ID NO: 25541 - RNA, 19 nt, Homo sapiens
gauguucuggcugagauug

SEQ ID NO: 25542 - RNA, 23 nt, Homo sapiens
ugaguuucuucaggaugaaacug

SEQ ID NO: 25543 - RNA, 20 nt, Homo sapiens
auacuucugcuauuaacgcu

SEQ ID NO: 25544 - RNA, 18 nt, Homo sapiens
gaacuauccaccucauua

SEQ ID NO: 25545 - RNA, 23 nt, Homo sapiens
gaugcaaggagcugccugugaca

SEQ ID NO: 25546 - RNA, 24 nt, Homo sapiens
uggggugccugcuugggcuggguc

SEQ ID NO: 25547 - RNA, 18 nt, Homo sapiens
uggguggaucacuugagg

SEQ ID NO: 25548 - RNA, 19 nt, Homo sapiens
agaaacaugaaaacugccu

SEQ ID NO: 25549 - RNA, 19 nt, Homo sapiens
gcccuccgccccagcccca

SEQ ID NO: 25550 - RNA, 19 nt, Homo sapiens
uguggcccccgggacccca

SEQ ID NO: 25551 - RNA, 28 nt, Homo sapiens
accuguuuucugccgugaccuuuggucc

SEQ ID NO: 25552 - RNA, 23 nt, Homo sapiens
aguuucacucuguugcccaaggu

SEQ ID NO: 25553 - RNA, 23 nt, Homo sapiens
uccuuugacugauguucaguguc

SEQ ID NO: 25554 - RNA, 19 nt, Homo sapiens
ugcucugcugcuggacuuu

SEQ ID NO: 25555 - RNA, 26 nt, Homo sapiens
cccacugagggcaggagggcuugugg

SEQ ID NO: 25556 - RNA, 23 nt, Homo sapiens
gcgcccagucccucaccaucggc

SEQ ID NO: 25557 - RNA, 21 nt, Homo sapiens
aucuuggcucacugcaaccuc

SEQ ID NO: 25558 - RNA, 17 nt, Homo sapiens
ucaagugauucuucugc

SEQ ID NO: 25559 - RNA, 18 nt, Homo sapiens
uccgucuccuggguucaa

SEQ ID NO: 25560 - RNA, 21 nt, Homo sapiens
uuucuuuguacacaccagaga

SEQ ID NO: 25561 - RNA, 17 nt, Homo sapiens
caggcucuugcacaccc

SEQ ID NO: 25562 - RNA, 17 nt, Homo sapiens
cucccuguaaccaagga

SEQ ID NO: 25563 - RNA, 22 nt, Homo sapiens
cugugauuccuucauuguuuua

SEQ ID NO: 25564 - RNA, 18 nt, Homo sapiens
uuccagaaaucaggucug

SEQ ID NO: 25565 - RNA, 20 nt, Homo sapiens
auuccagagcucacugcccu

SEQ ID NO: 25566 - RNA, 20 nt, Homo sapiens
cacgugccuguagcauucca

SEQ ID NO: 25567 - RNA, 19 nt, Homo sapiens
ccacacucacccucccuca

SEQ ID NO: 25568 - RNA, 18 nt, Homo sapiens
ccccuggcucaggagccg

SEQ ID NO: 25569 - RNA, 17 nt, Homo sapiens
gaagagcacucccuucc

SEQ ID NO: 25570 - RNA, 19 nt, Homo sapiens
gcuuaucaaagacugagaa

SEQ ID NO: 25571 - RNA, 19 nt, Homo sapiens
ggcucccaaauuggaacca

SEQ ID NO: 25572 - RNA, 24 nt, Homo sapiens
ugcccccagaacuuuuggauacug

SEQ ID NO: 25573 - RNA, 21 nt, Homo sapiens
uguccuggccucuccgugaca

SEQ ID NO: 25574 - RNA, 20 nt, Homo sapiens
uucuguuugaagauuugggg

SEQ ID NO: 25575 - RNA, 18 nt, Homo sapiens
accgcguccggcucagga

SEQ ID NO: 25576 - RNA, 21 nt, Homo sapiens
aucuuggcucacugcaaccuc

SEQ ID NO: 25577 - RNA, 19 nt, Homo sapiens
ccugggccguggucuccug

SEQ ID NO: 25578 - RNA, 16 nt, Homo sapiens
aacuaggaggcucaaa

SEQ ID NO: 25579 - RNA, 20 nt, Homo sapiens
aagagaaccucagcauugug

SEQ ID NO: 25580 - RNA, 19 nt, Homo sapiens
ucagcauugugcacgauaa

SEQ ID NO: 25581 - RNA, 19 nt, Homo sapiens
auuugagcugugguugagg

SEQ ID NO: 25582 - RNA, 19 nt, Homo sapiens
ucugcucuguuuugcaugg

SEQ ID NO: 25583 - RNA, 21 nt, Homo sapiens
aaucuuacuaacaccuaugau

SEQ ID NO: 25584 - RNA, 18 nt, Homo sapiens
auggaaacaagccacuua

SEQ ID NO: 25585 - RNA, 18 nt, Homo sapiens
auuuuauuuaugguccag

SEQ ID NO: 25586 - RNA, 24 nt, Homo sapiens
cagaaugcuuugaaauucuaaugg

SEQ ID NO: 25587 - RNA, 20 nt, Homo sapiens
cccgacaccucaccuuucgc

SEQ ID NO: 25588 - RNA, 17 nt, Homo sapiens
ccucaccuuucgcuguu

SEQ ID NO: 25589 - RNA, 21 nt, Homo sapiens
cucuuucucucucucucucuc

SEQ ID NO: 25590 - RNA, 18 nt, Homo sapiens
uaaggauaaaacacguca

SEQ ID NO: 25591 - RNA, 22 nt, Homo sapiens
uaucggccaccugccaaucaca

SEQ ID NO: 25592 - RNA, 16 nt, Homo sapiens
ucucucucucuuuucu

SEQ ID NO: 25593 - RNA, 19 nt, Homo sapiens
agagaacauuccucugcag

SEQ ID NO: 25594 - RNA, 18 nt, Homo sapiens
gauuguucuguccaguuu

SEQ ID NO: 25595 - RNA, 21 nt, Homo sapiens
uuagcuacuuuucagaauuga

SEQ ID NO: 25596 - RNA, 21 nt, Homo sapiens
aaucuuacuaacaccuaugau

SEQ ID NO: 25597 - RNA, 18 nt, Homo sapiens
auggaaacaagccacuua

SEQ ID NO: 25598 - RNA, 18 nt, Homo sapiens
auuuuauuuaugguccag

SEQ ID NO: 25599 - RNA, 24 nt, Homo sapiens
cagaaugcuuugaaauucuaaugg

SEQ ID NO: 25600 - RNA, 20 nt, Homo sapiens
cccgacaccucaccuuucgc

SEQ ID NO: 25601 - RNA, 17 nt, Homo sapiens
ccucaccuuucgcuguu

SEQ ID NO: 25602 - RNA, 18 nt, Homo sapiens
cucuuacacuagaauccu

SEQ ID NO: 25603 - RNA, 21 nt, Homo sapiens
cucuuucucucucucucucuc

SEQ ID NO: 25604 - RNA, 18 nt, Homo sapiens
uaaggauaaaacacguca

SEQ ID NO: 25605 - RNA, 22 nt, Homo sapiens
uaucggccaccugccaaucaca

SEQ ID NO: 25606 - RNA, 16 nt, Homo sapiens
ucucucucucuuuucu

SEQ ID NO: 25607 - RNA, 21 nt, Homo sapiens
uucuguuucaacaaucauuac

SEQ ID NO: 25608 - RNA, 16 nt, Homo sapiens
ccaaaaaaagauaccu

SEQ ID NO: 25609 - RNA, 19 nt, Homo sapiens
uaacacccagagcaugaua

SEQ ID NO: 25610 - RNA, 18 nt, Homo sapiens
uuccgcccuaauggaggu

SEQ ID NO: 25611 - RNA, 21 nt, Homo sapiens
aaucuuacuaacaccuaugau

SEQ ID NO: 25612 - RNA, 18 nt, Homo sapiens
auggaaacaagccacuua

SEQ ID NO: 25613 - RNA, 18 nt, Homo sapiens
auuuuauuuaugguccag

SEQ ID NO: 25614 - RNA, 24 nt, Homo sapiens
cagaaugcuuugaaauucuaaugg

SEQ ID NO: 25615 - RNA, 20 nt, Homo sapiens
cccgacaccucaccuuucgc

SEQ ID NO: 25616 - RNA, 17 nt, Homo sapiens
ccucaccuuucgcuguu

SEQ ID NO: 25617 - RNA, 21 nt, Homo sapiens
cucuuucucucucucucucuc

SEQ ID NO: 25618 - RNA, 18 nt, Homo sapiens
uaaggauaaaacacguca

SEQ ID NO: 25619 - RNA, 22 nt, Homo sapiens
uaucggccaccugccaaucaca

SEQ ID NO: 25620 - RNA, 16 nt, Homo sapiens
ucucucucucuuuucu

SEQ ID NO: 25621 - RNA, 21 nt, Homo sapiens
cugaaacugaagaaucuggua

SEQ ID NO: 25622 - RNA, 19 nt, Homo sapiens
uaacacccagagcaugaua

SEQ ID NO: 25623 - RNA, 23 nt, Homo sapiens
cuuaggcauggagaaaauuacuu

SEQ ID NO: 25624 - RNA, 19 nt, Homo sapiens
gacauuuucuggcuuguca

SEQ ID NO: 25625 - RNA, 19 nt, Homo sapiens
ggaggaggggugaccgcca

SEQ ID NO: 25626 - RNA, 18 nt, Homo sapiens
aaagaucccuugacccug

SEQ ID NO: 25627 - RNA, 18 nt, Homo sapiens
aagagcuagguuaaguca

SEQ ID NO: 25628 - RNA, 18 nt, Homo sapiens
aggaaguuggguugaguu

SEQ ID NO: 25629 - RNA, 23 nt, Homo sapiens
uagggccauguugggucaaguua

SEQ ID NO: 25630 - RNA, 22 nt, Homo sapiens
uaggucaguguuggguuugguu

SEQ ID NO: 25631 - RNA, 17 nt, Homo sapiens
ucaaaaauuaagcaugu

SEQ ID NO: 25632 - RNA, 18 nt, Homo sapiens
ugaacaaugcuuaacaua

SEQ ID NO: 25633 - RNA, 21 nt, Homo sapiens
ucauagaauuucagcguuaga

SEQ ID NO: 25634 - RNA, 22 nt, Homo sapiens
uucuuacauauuaaauuagcua

SEQ ID NO: 25635 - RNA, 21 nt, Homo sapiens
uuuuuugcuuguguugaucuu

SEQ ID NO: 25636 - RNA, 19 nt, Homo sapiens
cauugucccaugccuugaa

SEQ ID NO: 25637 - RNA, 16 nt, Homo sapiens
cugacuccucuccucu

SEQ ID NO: 25638 - RNA, 20 nt, Homo sapiens
ggcugcagaacuuucccucu

SEQ ID NO: 25639 - RNA, 24 nt, Homo sapiens
gccccucggagcucccccugccuc

SEQ ID NO: 25640 - RNA, 23 nt, Homo sapiens
gcucccccugccuccuccuccuc

SEQ ID NO: 25641 - RNA, 20 nt, Homo sapiens
ugccuuuuagggggcucuug

SEQ ID NO: 25642 - RNA, 20 nt, Homo sapiens
gucccuuccuggguacccca

SEQ ID NO: 25643 - RNA, 20 nt, Homo sapiens
aaugucugcucuggggggca

SEQ ID NO: 25644 - RNA, 24 nt, Homo sapiens
auacaaggcaucuacccagcccca

SEQ ID NO: 25645 - RNA, 23 nt, Homo sapiens
caggaggcagcagggucugguca

SEQ ID NO: 25646 - RNA, 21 nt, Homo sapiens
caucuguacuggaagggaccc

SEQ ID NO: 25647 - RNA, 22 nt, Homo sapiens
ggggaggaagcuguucucccca

SEQ ID NO: 25648 - RNA, 18 nt, Homo sapiens
cucucaggaccauccgau

SEQ ID NO: 25649 - RNA, 19 nt, Homo sapiens
ugaccgucucgucuuccuc

SEQ ID NO: 25650 - RNA, 24 nt, Homo sapiens
acagagcaagaccccacaacugua

SEQ ID NO: 25651 - RNA, 18 nt, Homo sapiens
cucaccuccuccgccucu

SEQ ID NO: 25652 - RNA, 19 nt, Homo sapiens
ugaaugagauacaccagga

SEQ ID NO: 25653 - RNA, 20 nt, Homo sapiens
uucaagaccagccugaccaa

SEQ ID NO: 25654 - RNA, 17 nt, Homo sapiens
uguccgcugccgccuca

SEQ ID NO: 25655 - RNA, 24 nt, Homo sapiens
cccuucccccucuucucuugcuca

SEQ ID NO: 25656 - RNA, 20 nt, Homo sapiens
ccucugccucccggguucaa

SEQ ID NO: 25657 - RNA, 19 nt, Homo sapiens
cgcccauuggugcucaugc

SEQ ID NO: 25658 - RNA, 17 nt, Homo sapiens
gcuucuaucuuggcugc

SEQ ID NO: 25659 - RNA, 26 nt, Homo sapiens
ucuagaauucucccaacauuauuuuu

SEQ ID NO: 25660 - RNA, 20 nt, Homo sapiens
uggccaggcuggucuugaac

SEQ ID NO: 25661 - RNA, 22 nt, Homo sapiens
acaucacauacaagguuuccac

SEQ ID NO: 25662 - RNA, 19 nt, Homo sapiens
auggugcggcggcuggcca

SEQ ID NO: 25663 - RNA, 20 nt, Homo sapiens
auguuuguauauauucacuc

SEQ ID NO: 25664 - RNA, 22 nt, Homo sapiens
cuauuaaaugcccugagugaua

SEQ ID NO: 25665 - RNA, 20 nt, Homo sapiens
gcuuacagauaacagccaaa

SEQ ID NO: 25666 - RNA, 25 nt, Homo sapiens
ggacauguguacaggagaccaagaa

SEQ ID NO: 25667 - RNA, 16 nt, Homo sapiens
gugauaaaaccaguug

SEQ ID NO: 25668 - RNA, 21 nt, Homo sapiens
ucccugugguaaacacucuga

SEQ ID NO: 25669 - RNA, 18 nt, Homo sapiens
gaagacgaaaacagcaaa

SEQ ID NO: 25670 - RNA, 21 nt, Homo sapiens
gcuugaaaugcuaugaaggca

SEQ ID NO: 25671 - RNA, 22 nt, Homo sapiens
aacagagcugggagccuggcug

SEQ ID NO: 25672 - RNA, 18 nt, Homo sapiens
cacacgcucacauuggua

SEQ ID NO: 25673 - RNA, 18 nt, Homo sapiens
guccugaaguuggauugu

SEQ ID NO: 25674 - RNA, 17 nt, Homo sapiens
uuucccccaucaugaaa

SEQ ID NO: 25675 - RNA, 19 nt, Homo sapiens
acucaucuuuuaaauaucc

SEQ ID NO: 25676 - RNA, 17 nt, Homo sapiens
aguacaauauugccugu

SEQ ID NO: 25677 - RNA, 18 nt, Homo sapiens
auuagagaccuuauaaaa

SEQ ID NO: 25678 - RNA, 21 nt, Homo sapiens
ccuccuuuacaauugaucuca

SEQ ID NO: 25679 - RNA, 19 nt, Homo sapiens
cuauuagugccuugaucuu

SEQ ID NO: 25680 - RNA, 17 nt, Homo sapiens
guuucauaaguuaccca

SEQ ID NO: 25681 - RNA, 23 nt, Homo sapiens
ugaagaagaggacaacaagccca

SEQ ID NO: 25682 - RNA, 22 nt, Homo sapiens
gccgcgggugaucgucgggucu

SEQ ID NO: 25683 - RNA, 19 nt, Homo sapiens
guuccccuguuuuaucuca

SEQ ID NO: 25684 - RNA, 24 nt, Homo sapiens
uaaguauacauuuuuauuaauuua

SEQ ID NO: 25685 - RNA, 20 nt, Homo sapiens
uccucuacuaagcccaguua

SEQ ID NO: 25686 - RNA, 18 nt, Homo sapiens
aguccagugccaugccuu

SEQ ID NO: 25687 - RNA, 19 nt, Homo sapiens
caggcacaagguucaaguu

SEQ ID NO: 25688 - RNA, 21 nt, Homo sapiens
aggaucacauugcauugaccc

SEQ ID NO: 25689 - RNA, 18 nt, Homo sapiens
ccuccuacaguuucugaa

SEQ ID NO: 25690 - RNA, 16 nt, Homo sapiens
cuccuccuaaaugaca

SEQ ID NO: 25691 - RNA, 18 nt, Homo sapiens
gacccaaagaacugccug

SEQ ID NO: 25692 - RNA, 22 nt, Homo sapiens
ugaaagagugaggaucaagacc

SEQ ID NO: 25693 - RNA, 20 nt, Homo sapiens
augucuaagaagcucccaug

SEQ ID NO: 25694 - RNA, 19 nt, Homo sapiens
cuccaggaaggccaucuga

SEQ ID NO: 25695 - RNA, 18 nt, Homo sapiens
guaugaaugagugugaag

SEQ ID NO: 25696 - RNA, 23 nt, Homo sapiens
guguaugugagaacuuuuguuug

SEQ ID NO: 25697 - RNA, 21 nt, Homo sapiens
aucugauccaucccuugguuu

SEQ ID NO: 25698 - RNA, 25 nt, Homo sapiens
ccucuggaccacuaacaaguucuca

SEQ ID NO: 25699 - RNA, 21 nt, Homo sapiens
aaaaggugcuacgguagugau

SEQ ID NO: 25700 - RNA, 21 nt, Homo sapiens
agcaaguucacuacagcauca

SEQ ID NO: 25701 - RNA, 19 nt, Homo sapiens
ccaauuuucuuuuuacucc

SEQ ID NO: 25702 - RNA, 19 nt, Homo sapiens
ccugggugaucaccacauc

SEQ ID NO: 25703 - RNA, 18 nt, Homo sapiens
gccucaaguucaauaugg

SEQ ID NO: 25704 - RNA, 22 nt, Homo sapiens
cccuccacacccggggccagac

SEQ ID NO: 25705 - RNA, 19 nt, Homo sapiens
cucuccuuccuuccaccug

SEQ ID NO: 25706 - RNA, 18 nt, Homo sapiens
guugggcugcggugcugc

SEQ ID NO: 25707 - RNA, 18 nt, Homo sapiens
ucuagaaucuggcacuuu

SEQ ID NO: 25708 - RNA, 18 nt, Homo sapiens
ugggucuagaaucuggca

SEQ ID NO: 25709 - RNA, 21 nt, Homo sapiens
uguugguauucagcugugaug

SEQ ID NO: 25710 - RNA, 21 nt, Homo sapiens
uucuccugcuccuuguuuucc

SEQ ID NO: 25711 - RNA, 19 nt, Homo sapiens
aggcaguaggcauucuuua

SEQ ID NO: 25712 - RNA, 17 nt, Homo sapiens
gccuuucacagcuucuu

SEQ ID NO: 25713 - RNA, 16 nt, Homo sapiens
ugcguguugaauccca

SEQ ID NO: 25714 - RNA, 22 nt, Homo sapiens
gagccaagauggcgccacugca

SEQ ID NO: 25715 - RNA, 19 nt, Homo sapiens
ggacuucuaagaguuuuga

SEQ ID NO: 25716 - RNA, 18 nt, Homo sapiens
guuuguuuccuuacugua

SEQ ID NO: 25717 - RNA, 22 nt, Homo sapiens
ucaggccuauccucugcuccca

SEQ ID NO: 25718 - RNA, 20 nt, Homo sapiens
uguaguauuuucccaucucu

SEQ ID NO: 25719 - RNA, 19 nt, Homo sapiens
aaacuccugaccucaggug

SEQ ID NO: 25720 - RNA, 20 nt, Homo sapiens
acuguaacauuccaacaucu

SEQ ID NO: 25721 - RNA, 15 nt, Homo sapiens
agaacccauuucuca

SEQ ID NO: 25722 - RNA, 26 nt, Homo sapiens
aguccauccuucaaaugaccacucca

SEQ ID NO: 25723 - RNA, 20 nt, Homo sapiens
gugguuuuagacacgcuuuc

SEQ ID NO: 25724 - RNA, 20 nt, Homo sapiens
uaagauucuuugaucccgac

SEQ ID NO: 25725 - RNA, 22 nt, Homo sapiens
ugaaccaucgcugagguucuga

SEQ ID NO: 25726 - RNA, 22 nt, Homo sapiens
ugagacuacaggcaccugccac

SEQ ID NO: 25727 - RNA, 20 nt, Homo sapiens
cagcauuaacaccucaucuc

SEQ ID NO: 25728 - RNA, 18 nt, Homo sapiens
cuguggcaccccagcuca

SEQ ID NO: 25729 - RNA, 19 nt, Homo sapiens
cuuacccacuucuuccuca

SEQ ID NO: 25730 - RNA, 26 nt, Homo sapiens
acagacguugcaccauauccaugcac

SEQ ID NO: 25731 - RNA, 16 nt, Homo sapiens
agguuucaaagucuca

SEQ ID NO: 25732 - RNA, 19 nt, Homo sapiens
ccuuguccaguggagccca

SEQ ID NO: 25733 - RNA, 18 nt, Homo sapiens
cuuguucuggucacuguu

SEQ ID NO: 25734 - RNA, 18 nt, Homo sapiens
uaacagcauguaacauaa

SEQ ID NO: 25735 - RNA, 22 nt, Homo sapiens
aggcacagauuccccguccaca

SEQ ID NO: 25736 - RNA, 20 nt, Homo sapiens
cucugucccccaaggaguca

SEQ ID NO: 25737 - RNA, 19 nt, Homo sapiens
cuguagaguccauuccccu

SEQ ID NO: 25738 - RNA, 19 nt, Homo sapiens
uuugaccagguccugugag

SEQ ID NO: 25739 - RNA, 21 nt, Homo sapiens
cuggaccgucuuugucugcga

SEQ ID NO: 25740 - RNA, 20 nt, Homo sapiens
gccgucccccgacugccuca

SEQ ID NO: 25741 - RNA, 21 nt, Homo sapiens
aacauguaugacaggggacca

SEQ ID NO: 25742 - RNA, 20 nt, Homo sapiens
aagggaggcccaaauucuca

SEQ ID NO: 25743 - RNA, 19 nt, Homo sapiens
acccucuggggugaggcua

SEQ ID NO: 25744 - RNA, 19 nt, Homo sapiens
cugaguugcuguuuggucu

SEQ ID NO: 25745 - RNA, 20 nt, Homo sapiens
uaaaaccagccugugauguu

SEQ ID NO: 25746 - RNA, 22 nt, Homo sapiens
ugcccagagccccagugugcuu

SEQ ID NO: 25747 - RNA, 15 nt, Homo sapiens
uucuaagcugugaac

SEQ ID NO: 25748 - RNA, 16 nt, Homo sapiens
uugccaaacaauauca

SEQ ID NO: 25749 - RNA, 19 nt, Homo sapiens
uuuucugagcagaucaaua

SEQ ID NO: 25750 - RNA, 16 nt, Homo sapiens
cccgcacgccuccuca

SEQ ID NO: 25751 - RNA, 20 nt, Homo sapiens
cuugugaaucugagcuguag

SEQ ID NO: 25752 - RNA, 19 nt, Homo sapiens
cuuuuuaaacacauaaugu

SEQ ID NO: 25753 - RNA, 22 nt, Homo sapiens
uccuuuugccagcuaauuguga

SEQ ID NO: 25754 - RNA, 22 nt, Homo sapiens
cuugaguuuuuggguuucuuuu

SEQ ID NO: 25755 - RNA, 22 nt, Homo sapiens
gugaucugcccuucucugccuc

SEQ ID NO: 25756 - RNA, 17 nt, Homo sapiens
ucaagugauucuccugc

SEQ ID NO: 25757 - RNA, 17 nt, Homo sapiens
uucaccuccagguucaa

SEQ ID NO: 25758 - RNA, 18 nt, Homo sapiens
uucuccugccucagccuu

SEQ ID NO: 25759 - RNA, 18 nt, Homo sapiens
ccaguugcaccuuucuca

SEQ ID NO: 25760 - RNA, 22 nt, Homo sapiens
agcccagugugggcagaugcca

SEQ ID NO: 25761 - RNA, 25 nt, Homo sapiens
gauaccagcaucuggagccccuagg

SEQ ID NO: 25762 - RNA, 19 nt, Homo sapiens
ugaagagacuggacaaagu

SEQ ID NO: 25763 - RNA, 20 nt, Homo sapiens
aaaguucaugaaucugguaa

SEQ ID NO: 25764 - RNA, 18 nt, Homo sapiens
auuaaacaucaaaguuau

SEQ ID NO: 25765 - RNA, 21 nt, Homo sapiens
uggugcuccaguguagggcua

SEQ ID NO: 25766 - RNA, 17 nt, Homo sapiens
cacggugaacauggcca

SEQ ID NO: 25767 - RNA, 25 nt, Homo sapiens
guuugggcuguuccacgcuuggcuc

SEQ ID NO: 25768 - RNA, 19 nt, Homo sapiens
agagaacauuccucugcag

SEQ ID NO: 25769 - RNA, 18 nt, Homo sapiens
gauuguucuguccaguuu

SEQ ID NO: 25770 - RNA, 21 nt, Homo sapiens
uuagcuacuuuucagaauuga

SEQ ID NO: 25771 - RNA, 22 nt, Homo sapiens
agcucagcuguugaggacaccc

SEQ ID NO: 25772 - RNA, 22 nt, Homo sapiens
agugaccccaauccuauaccca

SEQ ID NO: 25773 - RNA, 20 nt, Homo sapiens
caggggcagaaaacacuaca

SEQ ID NO: 25774 - RNA, 22 nt, Homo sapiens
ccccacuccaacuccuucucca

SEQ ID NO: 25775 - RNA, 19 nt, Homo sapiens
ggaagccagaagcauccca

SEQ ID NO: 25776 - RNA, 17 nt, Homo sapiens
uccuucuccaccaccca

SEQ ID NO: 25777 - RNA, 23 nt, Homo sapiens
ccuuccccuggcaucacuuccca

SEQ ID NO: 25778 - RNA, 17 nt, Homo sapiens
ggggccuggccaccccu

SEQ ID NO: 25779 - RNA, 22 nt, Homo sapiens
accugggcccugcccuuggcuc

SEQ ID NO: 25780 - RNA, 22 nt, Homo sapiens
agcucagcuguugaggacaccc

SEQ ID NO: 25781 - RNA, 22 nt, Homo sapiens
agugaccccaauccuauaccca

SEQ ID NO: 25782 - RNA, 20 nt, Homo sapiens
caggggcagaaaacacuaca

SEQ ID NO: 25783 - RNA, 22 nt, Homo sapiens
ccaaaaacaaaauggagucuga

SEQ ID NO: 25784 - RNA, 22 nt, Homo sapiens
ccccacuccaacuccuucucca

SEQ ID NO: 25785 - RNA, 19 nt, Homo sapiens
ggaagccagaagcauccca

SEQ ID NO: 25786 - RNA, 17 nt, Homo sapiens
uccuucuccaccaccca

SEQ ID NO: 25787 - RNA, 19 nt, Homo sapiens
cugaagccucaguccuuca

SEQ ID NO: 25788 - RNA, 18 nt, Homo sapiens
ccgcggaauaucggcuua

SEQ ID NO: 25789 - RNA, 18 nt, Homo sapiens
ccgcggaauaucggcuua

SEQ ID NO: 25790 - RNA, 19 nt, Homo sapiens
cugaagccucaguccuuca

SEQ ID NO: 25791 - RNA, 18 nt, Homo sapiens
gcuccgccgcccgccucu

SEQ ID NO: 25792 - RNA, 23 nt, Homo sapiens
uaagauuacguuauuggguuugg

SEQ ID NO: 25793 - RNA, 22 nt, Homo sapiens
uggaguauuuggccugaaauug

SEQ ID NO: 25794 - RNA, 20 nt, Homo sapiens
gagacuaccacaaacacuac

SEQ ID NO: 25795 - RNA, 19 nt, Homo sapiens
agagucaucagcaaacugu

SEQ ID NO: 25796 - RNA, 20 nt, Homo sapiens
gagacuaccacaaacacuac

SEQ ID NO: 25797 - RNA, 20 nt, Homo sapiens
ucacccucuucagucaccuc

SEQ ID NO: 25798 - RNA, 21 nt, Homo sapiens
ucuacauuuucucugcacuuu

SEQ ID NO: 25799 - RNA, 21 nt, Homo sapiens
ccucccccagcccccucccca

SEQ ID NO: 25800 - RNA, 20 nt, Homo sapiens
cuccccaucaauaaaacucu

SEQ ID NO: 25801 - RNA, 21 nt, Homo sapiens
gcaguuuugguuucuuuugcg

SEQ ID NO: 25802 - RNA, 15 nt, Homo sapiens
cugucuuucuuuccu

SEQ ID NO: 25803 - RNA, 18 nt, Homo sapiens
uguaaaagcaaaagccac

SEQ ID NO: 25804 - RNA, 18 nt, Homo sapiens
ccugcaaccuccaccucc

SEQ ID NO: 25805 - RNA, 18 nt, Homo sapiens
uccaccucccggguucaa

SEQ ID NO: 25806 - RNA, 17 nt, Homo sapiens
cccacauaugccuguua

SEQ ID NO: 25807 - RNA, 21 nt, Homo sapiens
guaucucuaaauacaggauua

SEQ ID NO: 25808 - RNA, 23 nt, Homo sapiens
uaagagaaaaauaggcucaguua

SEQ ID NO: 25809 - RNA, 24 nt, Homo sapiens
ucaugcuggugauggcuccccugg

SEQ ID NO: 25810 - RNA, 23 nt, Homo sapiens
uccagauuuuuuucuccucaccc

SEQ ID NO: 25811 - RNA, 22 nt, Homo sapiens
ugcaccggguacacuuaacgug

SEQ ID NO: 25812 - RNA, 21 nt, Homo sapiens
gccugguauaaccucuggcuc

SEQ ID NO: 25813 - RNA, 22 nt, Homo sapiens
acacagugcuacacagcuuuua

SEQ ID NO: 25814 - RNA, 18 nt, Homo sapiens
uaguguuaauucuacaca

SEQ ID NO: 25815 - RNA, 21 nt, Homo sapiens
uguugaaucuuuucaugugcc

SEQ ID NO: 25816 - RNA, 18 nt, Homo sapiens
ccagagccugguccugca

SEQ ID NO: 25817 - RNA, 19 nt, Homo sapiens
guuuugguuagugccacaa

SEQ ID NO: 25818 - RNA, 23 nt, Homo sapiens
uucuaaguuaaauguaguuugua

SEQ ID NO: 25819 - RNA, 21 nt, Homo sapiens
caccaccaucucucuccucuu

SEQ ID NO: 25820 - RNA, 19 nt, Homo sapiens
gcaucagaccuguuccaca

SEQ ID NO: 25821 - RNA, 24 nt, Homo sapiens
guagaggccaggcugaaaugucau

SEQ ID NO: 25822 - RNA, 18 nt, Homo sapiens
ugaugcugagcgugaaca

SEQ ID NO: 25823 - RNA, 22 nt, Homo sapiens
ggaaccugcugcguaaaaccau

SEQ ID NO: 25824 - RNA, 19 nt, Homo sapiens
cagaacauagugugcuuca

SEQ ID NO: 25825 - RNA, 18 nt, Homo sapiens
cuuaaagucaaucugcga

SEQ ID NO: 25826 - RNA, 18 nt, Homo sapiens
gagagccauucuauguca

SEQ ID NO: 25827 - RNA, 21 nt, Homo sapiens
ggcggcucgcccgccuccgga

SEQ ID NO: 25828 - RNA, 19 nt, Homo sapiens
uagugugcuucaaaacauu

SEQ ID NO: 25829 - RNA, 19 nt, Homo sapiens
ucagaggcuucugcucgca

SEQ ID NO: 25830 - RNA, 23 nt, Homo sapiens
uuauccacaaaacagucaauguu

SEQ ID NO: 25831 - RNA, 25 nt, Homo sapiens
uagguaucaagucaacaugaaauug

SEQ ID NO: 25832 - RNA, 17 nt, Homo sapiens
agcaguccgaccaagcc

SEQ ID NO: 25833 - RNA, 22 nt, Homo sapiens
caaagcagcaguccgaccaagc

SEQ ID NO: 25834 - RNA, 20 nt, Homo sapiens
guaugaguauggcuugguua

SEQ ID NO: 25835 - RNA, 21 nt, Homo sapiens
ucuuuacuaguuauugugaga

SEQ ID NO: 25836 - RNA, 19 nt, Homo sapiens
uuacagaagaaccagugga

SEQ ID NO: 25837 - RNA, 19 nt, Homo sapiens
uucucaccucucccuuacc

SEQ ID NO: 25838 - RNA, 17 nt, Homo sapiens
gugugaaauuuuuggaa

SEQ ID NO: 25839 - RNA, 21 nt, Homo sapiens
ugccuuuuaaaguuuugcuga

SEQ ID NO: 25840 - RNA, 18 nt, Homo sapiens
gugaugacaauaugacua

SEQ ID NO: 25841 - RNA, 21 nt, Homo sapiens
aucuuggcucacugcagucuc

SEQ ID NO: 25842 - RNA, 20 nt, Homo sapiens
augaaguugcuaguuaacac

SEQ ID NO: 25843 - RNA, 19 nt, Homo sapiens
auggucauauauacuuguu

SEQ ID NO: 25844 - RNA, 21 nt, Homo sapiens
cauuuucucuugggguauuca

SEQ ID NO: 25845 - RNA, 17 nt, Homo sapiens
cucuccccggcuaucug

SEQ ID NO: 25846 - RNA, 18 nt, Homo sapiens
cugauugguguugcugua

SEQ ID NO: 25847 - RNA, 20 nt, Homo sapiens
cuuccagguguuuuccagug

SEQ ID NO: 25848 - RNA, 21 nt, Homo sapiens
guguaugggugauuauuugau

SEQ ID NO: 25849 - RNA, 16 nt, Homo sapiens
uauaaccucaccaucc

SEQ ID NO: 25850 - RNA, 21 nt, Homo sapiens
uccugaacuccugggcucaag

SEQ ID NO: 25851 - RNA, 19 nt, Homo sapiens
ugagacguuaggggcauau

SEQ ID NO: 25852 - RNA, 16 nt, Homo sapiens
uguuugucuuuggugu

SEQ ID NO: 25853 - RNA, 16 nt, Homo sapiens
ccagccguccuuugaa

SEQ ID NO: 25854 - RNA, 22 nt, Homo sapiens
aaacccagcgcacuuucaccuc

SEQ ID NO: 25855 - RNA, 16 nt, Homo sapiens
aacugggauuucagau

SEQ ID NO: 25856 - RNA, 22 nt, Homo sapiens
cuucuucccuuccuccucagcc

SEQ ID NO: 25857 - RNA, 18 nt, Homo sapiens
ggcagggcaggggcucca

SEQ ID NO: 25858 - RNA, 20 nt, Homo sapiens
ugcccuugaacacucuuaca

SEQ ID NO: 25859 - RNA, 20 nt, Homo sapiens
ccucugccuccuggguucaa

SEQ ID NO: 25860 - RNA, 23 nt, Homo sapiens
cuccacaucugugggauaucuca

SEQ ID NO: 25861 - RNA, 18 nt, Homo sapiens
uucuccugcuucagccuu

SEQ ID NO: 25862 - RNA, 22 nt, Homo sapiens
cacaauugucucucacagugua

SEQ ID NO: 25863 - RNA, 21 nt, Homo sapiens
cccuccccagcuuccugccca

SEQ ID NO: 25864 - RNA, 19 nt, Homo sapiens
aaacuccugaccucaggug

SEQ ID NO: 25865 - RNA, 21 nt, Homo sapiens
caccacgcccagccuucccuu

SEQ ID NO: 25866 - RNA, 18 nt, Homo sapiens
ccugcaaccuccaccucc

SEQ ID NO: 25867 - RNA, 22 nt, Homo sapiens
cugggauuacaggcaccuguca

SEQ ID NO: 25868 - RNA, 19 nt, Homo sapiens
gacugugccuguuauuguu

SEQ ID NO: 25869 - RNA, 18 nt, Homo sapiens
gccuuaacaguggaguug

SEQ ID NO: 25870 - RNA, 18 nt, Homo sapiens
uggguggaucaccugagg

SEQ ID NO: 25871 - RNA, 24 nt, Homo sapiens
uucucuacguauaaaaaaauacaa

SEQ ID NO: 25872 - RNA, 26 nt, Homo sapiens
cucgaaaaguugugauuuagaagaca

SEQ ID NO: 25873 - RNA, 17 nt, Homo sapiens
cuuucaguacuguacua

SEQ ID NO: 25874 - RNA, 20 nt, Homo sapiens
guucuacuuuuggccaagga

SEQ ID NO: 25875 - RNA, 23 nt, Homo sapiens
ucacacaggguuaaguucaguaa

SEQ ID NO: 25876 - RNA, 20 nt, Homo sapiens
ugggugaccgagugagacug

SEQ ID NO: 25877 - RNA, 22 nt, Homo sapiens
uuaaaaaugaaacaaguguggu

SEQ ID NO: 25878 - RNA, 18 nt, Homo sapiens
cccuguaaauacaugaua

SEQ ID NO: 25879 - RNA, 21 nt, Homo sapiens
cugaacucugacccuccgggc

SEQ ID NO: 25880 - RNA, 17 nt, Homo sapiens
gucuaguuuucacuuga

SEQ ID NO: 25881 - RNA, 22 nt, Homo sapiens
uggcuuuaacucucagcuccuu

SEQ ID NO: 25882 - RNA, 19 nt, Homo sapiens
uggcuuuuaauaugaacug

SEQ ID NO: 25883 - RNA, 21 nt, Homo sapiens
aucuuuggucccagcauuuuc

SEQ ID NO: 25884 - RNA, 23 nt, Homo sapiens
caucccagagccucccaaggcug

SEQ ID NO: 25885 - RNA, 21 nt, Homo sapiens
cccugaacuauuccucaguga

SEQ ID NO: 25886 - RNA, 24 nt, Homo sapiens
gaacuggcuuugaccaugaaacug

SEQ ID NO: 25887 - RNA, 22 nt, Homo sapiens
ugguuaauccugcaugggauua

SEQ ID NO: 25888 - RNA, 17 nt, Homo sapiens
uucuuuaccucuuagcc

SEQ ID NO: 25889 - RNA, 18 nt, Homo sapiens
caugcccugcuucagcug

SEQ ID NO: 25890 - RNA, 21 nt, Homo sapiens
uauuauuuuuuuauaaagaga

SEQ ID NO: 25891 - RNA, 18 nt, Homo sapiens
uccaucucccagguucaa

SEQ ID NO: 25892 - RNA, 18 nt, Homo sapiens
ucugcccaccucugccuc

SEQ ID NO: 25893 - RNA, 20 nt, Homo sapiens
ucuccaggcugucuugccuu

SEQ ID NO: 25894 - RNA, 15 nt, Homo sapiens
aacuucucugcuccu

SEQ ID NO: 25895 - RNA, 17 nt, Homo sapiens
aauaaaugcaauuuccu

SEQ ID NO: 25896 - RNA, 19 nt, Homo sapiens
agauaaucaaauuguccua

SEQ ID NO: 25897 - RNA, 22 nt, Homo sapiens
aucuacaauguauaucugacaa

SEQ ID NO: 25898 - RNA, 16 nt, Homo sapiens
gacacuuuaucugcaa

SEQ ID NO: 25899 - RNA, 20 nt, Homo sapiens
ggaauaauugcaguaugugu

SEQ ID NO: 25900 - RNA, 18 nt, Homo sapiens
agaagaagcaccuccaca

SEQ ID NO: 25901 - RNA, 19 nt, Homo sapiens
caucuuaaugucccaaggc

SEQ ID NO: 25902 - RNA, 19 nt, Homo sapiens
ccuauggucacuucugaua

SEQ ID NO: 25903 - RNA, 17 nt, Homo sapiens
agagaugacacagaccc

SEQ ID NO: 25904 - RNA, 20 nt, Homo sapiens
cuguacugccauccuauugc

SEQ ID NO: 25905 - RNA, 16 nt, Homo sapiens
gccgccacauuuccuu

SEQ ID NO: 25906 - RNA, 20 nt, Homo sapiens
uugccugauccuccuagugc

SEQ ID NO: 25907 - RNA, 24 nt, Homo sapiens
ccucuuuguugcguuuugugcuuu

SEQ ID NO: 25908 - RNA, 22 nt, Homo sapiens
ugagguacccuuagauccuuuu

SEQ ID NO: 25909 - RNA, 22 nt, Homo sapiens
aucuacacauauuuauaucaca

SEQ ID NO: 25910 - RNA, 22 nt, Homo sapiens
ccuuuuugcggccuuauauuuu

SEQ ID NO: 25911 - RNA, 23 nt, Homo sapiens
cugucuucucagcaguugaucca

SEQ ID NO: 25912 - RNA, 23 nt, Homo sapiens
acacggcauuccgugugugacca

SEQ ID NO: 25913 - RNA, 21 nt, Homo sapiens
cuggugcccacgcccuugcca

SEQ ID NO: 25914 - RNA, 18 nt, Homo sapiens
ugcucccagccuucacug

SEQ ID NO: 25915 - RNA, 21 nt, Homo sapiens
aaauccauuaaagaacaggaa

SEQ ID NO: 25916 - RNA, 19 nt, Homo sapiens
caggggccagaauaucuca

SEQ ID NO: 25917 - RNA, 18 nt, Homo sapiens
cuuucuucuuucugugau

SEQ ID NO: 25918 - RNA, 20 nt, Homo sapiens
gccuauucaaaauuaucucu

SEQ ID NO: 25919 - RNA, 23 nt, Homo sapiens
ucagcacaucagucauaugccca

SEQ ID NO: 25920 - RNA, 17 nt, Homo sapiens
uccuaaaauuccugucc

SEQ ID NO: 25921 - RNA, 24 nt, Homo sapiens
ugggcaaaaccuguacaaugacaa

SEQ ID NO: 25922 - RNA, 23 nt, Homo sapiens
ccaccauucucacuacaggcccc

SEQ ID NO: 25923 - RNA, 20 nt, Homo sapiens
gaggcagaagaaccccuuga

SEQ ID NO: 25924 - RNA, 22 nt, Homo sapiens
gucacugcgcccaccugucaca

SEQ ID NO: 25925 - RNA, 19 nt, Homo sapiens
uuucuucuauacugccuua

SEQ ID NO: 25926 - RNA, 19 nt, Homo sapiens
aggacugacacccuaaugc

SEQ ID NO: 25927 - RNA, 23 nt, Homo sapiens
aggaguauaggacagaggaccaa

SEQ ID NO: 25928 - RNA, 21 nt, Homo sapiens
agucaucccugaaucuugcca

SEQ ID NO: 25929 - RNA, 23 nt, Homo sapiens
ccagucaucccugaaucuugcca

SEQ ID NO: 25930 - RNA, 20 nt, Homo sapiens
gucaucccugaaucuugcca

SEQ ID NO: 25931 - RNA, 17 nt, Homo sapiens
acgguguuagaacucuc

SEQ ID NO: 25932 - RNA, 24 nt, Homo sapiens
ccugucuugaagacccugaccuca

SEQ ID NO: 25933 - RNA, 20 nt, Homo sapiens
cuccugccccuuuguuuuuu

SEQ ID NO: 25934 - RNA, 24 nt, Homo sapiens
gccacguugaaguaaaaacaaaca

SEQ ID NO: 25935 - RNA, 24 nt, Homo sapiens
gcuuuuugguugcuguugaguuuu

SEQ ID NO: 25936 - RNA, 21 nt, Homo sapiens
ucauauagugggaucaugcaa

SEQ ID NO: 25937 - RNA, 20 nt, Homo sapiens
ugaacaucaaagugaaacug

SEQ ID NO: 25938 - RNA, 18 nt, Homo sapiens
aaggggccugaggccuca

SEQ ID NO: 25939 - RNA, 18 nt, Homo sapiens
cucccuucaaggaucuca

SEQ ID NO: 25940 - RNA, 20 nt, Homo sapiens
uaggaagcuccugggcuuag

SEQ ID NO: 25941 - RNA, 21 nt, Homo sapiens
ccauuaaccaggccccaccca

SEQ ID NO: 25942 - RNA, 18 nt, Homo sapiens
cccacaagguagaaacaa

SEQ ID NO: 25943 - RNA, 17 nt, Homo sapiens
gccuccugggcacccca

SEQ ID NO: 25944 - RNA, 24 nt, Homo sapiens
ugcaaccuccaucuccuggauuca

SEQ ID NO: 25945 - RNA, 22 nt, Homo sapiens
accucccccgcccgccuggccu

SEQ ID NO: 25946 - RNA, 20 nt, Homo sapiens
gggccagaccgccuccaccu

SEQ ID NO: 25947 - RNA, 16 nt, Homo sapiens
uguggcaucugauauu

SEQ ID NO: 25948 - RNA, 21 nt, Homo sapiens
uuccgccugcgacaguuccag

SEQ ID NO: 25949 - RNA, 26 nt, Homo sapiens
cccuggugucuggagggggguugugg

SEQ ID NO: 25950 - RNA, 24 nt, Homo sapiens
gcagcaggcuuaggauuuuuguca

SEQ ID NO: 25951 - RNA, 20 nt, Homo sapiens
gccccucuuccccuaccccu

SEQ ID NO: 25952 - RNA, 16 nt, Homo sapiens
gggcaacccucugggc

SEQ ID NO: 25953 - RNA, 17 nt, Homo sapiens
gugggcacagcucccca

SEQ ID NO: 25954 - RNA, 21 nt, Homo sapiens
ucugggcaaaauguuugguuu

SEQ ID NO: 25955 - RNA, 21 nt, Homo sapiens
ggugggugggagggggcaagu

SEQ ID NO: 25956 - RNA, 19 nt, Homo sapiens
aagcaauucucccaccuca

SEQ ID NO: 25957 - RNA, 22 nt, Homo sapiens
aucuuggcucacugcagccucu

SEQ ID NO: 25958 - RNA, 20 nt, Homo sapiens
ccucugccucccagguucaa

SEQ ID NO: 25959 - RNA, 26 nt, Homo sapiens
aaacgcuucugcaaacauuuguuuuu

SEQ ID NO: 25960 - RNA, 17 nt, Homo sapiens
caggcucccugcuccuc

SEQ ID NO: 25961 - RNA, 19 nt, Homo sapiens
aagaaccaaaagccauuga

SEQ ID NO: 25962 - RNA, 15 nt, Homo sapiens
agcacuuauucugaa

SEQ ID NO: 25963 - RNA, 17 nt, Homo sapiens
agcuuucuuaaagaauc

SEQ ID NO: 25964 - RNA, 20 nt, Homo sapiens
aguaauguauuuugaucuca

SEQ ID NO: 25965 - RNA, 19 nt, Homo sapiens
ccuagguuacaagauccua

SEQ ID NO: 25966 - RNA, 17 nt, Homo sapiens
gcacuucaaaugcuuca

SEQ ID NO: 25967 - RNA, 18 nt, Homo sapiens
uccucugucagcacuuca

SEQ ID NO: 25968 - RNA, 18 nt, Homo sapiens
ugaucucagauuucuuuu

SEQ ID NO: 25969 - RNA, 20 nt, Homo sapiens
uucuuaaagaagauauagua

SEQ ID NO: 25970 - RNA, 22 nt, Homo sapiens
uuuggggaaaaucuucuggugu

SEQ ID NO: 25971 - RNA, 20 nt, Homo sapiens
aggcgcccgucaccacacca

SEQ ID NO: 25972 - RNA, 21 nt, Homo sapiens
aguaugaauucugugcagcua

SEQ ID NO: 25973 - RNA, 23 nt, Homo sapiens
aguccccaggccagugcuuggca

SEQ ID NO: 25974 - RNA, 21 nt, Homo sapiens
cacgagggcaggacacagcuu

SEQ ID NO: 25975 - RNA, 18 nt, Homo sapiens
ccaccccuccccgcauug

SEQ ID NO: 25976 - RNA, 19 nt, Homo sapiens
cugcaagcuccgccuccca

SEQ ID NO: 25977 - RNA, 16 nt, Homo sapiens
ugccauucuccugucu

SEQ ID NO: 25978 - RNA, 21 nt, Homo sapiens
ugguccuguguaccugcggac

SEQ ID NO: 25979 - RNA, 19 nt, Homo sapiens
gcuguccuuuaacaccgca

SEQ ID NO: 25980 - RNA, 18 nt, Homo sapiens
auaauaggaacggcgaca

SEQ ID NO: 25981 - RNA, 25 nt, Homo sapiens
cacuguacuuaauaggaagcuucca

SEQ ID NO: 25982 - RNA, 19 nt, Homo sapiens
cccuccccauccucuuucc

SEQ ID NO: 25983 - RNA, 21 nt, Homo sapiens
acacagagccaaaccauauca

SEQ ID NO: 25984 - RNA, 23 nt, Homo sapiens
ugaugugcuuugaugugagucug

SEQ ID NO: 25985 - RNA, 19 nt, Homo sapiens
uuucacuugcuuggugcac

SEQ ID NO: 25986 - RNA, 25 nt, Homo sapiens
acuuugaccgugggcugucuggccc

SEQ ID NO: 25987 - RNA, 18 nt, Homo sapiens
agauccuguacaaccuca

SEQ ID NO: 25988 - RNA, 21 nt, Homo sapiens
caacuuucuuaucaggcucaa

SEQ ID NO: 25989 - RNA, 21 nt, Homo sapiens
cuaguagaucuguaccuacua

SEQ ID NO: 25990 - RNA, 18 nt, Homo sapiens
ucugaagcuacguggcca

SEQ ID NO: 25991 - RNA, 18 nt, Homo sapiens
aacaggcccagcuccugc

SEQ ID NO: 25992 - RNA, 21 nt, Homo sapiens
acaggccuagcuccucccuca

SEQ ID NO: 25993 - RNA, 17 nt, Homo sapiens
agcuccugccuuuuggu

SEQ ID NO: 25994 - RNA, 18 nt, Homo sapiens
ccugccugacaauggccu

SEQ ID NO: 25995 - RNA, 20 nt, Homo sapiens
uacgcccaucuccuaccuca

SEQ ID NO: 25996 - RNA, 23 nt, Homo sapiens
ucugaagacccaaaucguccucc

SEQ ID NO: 25997 - RNA, 21 nt, Homo sapiens
uuaggccccgcucauuccuua

SEQ ID NO: 25998 - RNA, 21 nt, Homo sapiens
uucacaguggccucacuacgc

SEQ ID NO: 25999 - RNA, 17 nt, Homo sapiens
cugcccuucaccuuugg

SEQ ID NO: 26000 - RNA, 20 nt, Homo sapiens
ucagguagagaagccgugca

SEQ ID NO: 26001 - RNA, 19 nt, Homo sapiens
ugagcaagggaacuccuca

SEQ ID NO: 26002 - RNA, 19 nt, Homo sapiens
uaagggaagcuaggaaguc

SEQ ID NO: 26003 - RNA, 21 nt, Homo sapiens
uggaagucagacaugaaacug

SEQ ID NO: 26004 - RNA, 20 nt, Homo sapiens
ccacagacacaacuggccac

SEQ ID NO: 26005 - RNA, 20 nt, Homo sapiens
gccaccgaggcaccgacagg

SEQ ID NO: 26006 - RNA, 19 nt, Homo sapiens
auuuauggguucuuuucca

SEQ ID NO: 26007 - RNA, 18 nt, Homo sapiens
accagauaucucugggua

SEQ ID NO: 26008 - RNA, 20 nt, Homo sapiens
ccaaaguuauuuuaaucuau

SEQ ID NO: 26009 - RNA, 20 nt, Homo sapiens
ucagcauuaucaugauauca

SEQ ID NO: 26010 - RNA, 25 nt, Homo sapiens
ucuuuuuguuguugucauugauuuu

SEQ ID NO: 26011 - RNA, 20 nt, Homo sapiens
uuccagugaucauccucuaa

SEQ ID NO: 26012 - RNA, 23 nt, Homo sapiens
auuuggacccagguugccugcuc

SEQ ID NO: 26013 - RNA, 22 nt, Homo sapiens
cuauucacagcaccuccugcuu

SEQ ID NO: 26014 - RNA, 20 nt, Homo sapiens
gacgacuccaccgccucucu

SEQ ID NO: 26015 - RNA, 18 nt, Homo sapiens
uaucuugacuucauugcc

SEQ ID NO: 26016 - RNA, 22 nt, Homo sapiens
cagagcgcguguuucuggucgc

SEQ ID NO: 26017 - RNA, 22 nt, Homo sapiens
agaagcguccgugggaacucca

SEQ ID NO: 26018 - RNA, 23 nt, Homo sapiens
agcccguggccuggccugcuaca

SEQ ID NO: 26019 - RNA, 23 nt, Homo sapiens
agccucccucuacucggcacugu

SEQ ID NO: 26020 - RNA, 19 nt, Homo sapiens
cagccuuccaccugugcua

SEQ ID NO: 26021 - RNA, 22 nt, Homo sapiens
cccgccuuuucagccgucacca

SEQ ID NO: 26022 - RNA, 17 nt, Homo sapiens
cccggcagagcacccgc

SEQ ID NO: 26023 - RNA, 17 nt, Homo sapiens
cucagaggagcugcaag

SEQ ID NO: 26024 - RNA, 20 nt, Homo sapiens
cucugaggagaggccugggg

SEQ ID NO: 26025 - RNA, 21 nt, Homo sapiens
cuggagagggggccaggcaca

SEQ ID NO: 26026 - RNA, 20 nt, Homo sapiens
gacccgccuuuucagccguc

SEQ ID NO: 26027 - RNA, 19 nt, Homo sapiens
gcaccuacaagcagcacug

SEQ ID NO: 26028 - RNA, 22 nt, Homo sapiens
gccaccuccgccagccgccucc

SEQ ID NO: 26029 - RNA, 27 nt, Homo sapiens
gggauaccagcacggaggagcccccgg

SEQ ID NO: 26030 - RNA, 20 nt, Homo sapiens
ugagugggggggcauggggc

SEQ ID NO: 26031 - RNA, 19 nt, Homo sapiens
cccuauuauuaacugugca

SEQ ID NO: 26032 - RNA, 22 nt, Homo sapiens
uuccuggugcuuguguuccaug

SEQ ID NO: 26033 - RNA, 20 nt, Homo sapiens
cagcuccauuauaaucaucu

SEQ ID NO: 26034 - RNA, 18 nt, Homo sapiens
caugaguaauguguuaca

SEQ ID NO: 26035 - RNA, 20 nt, Homo sapiens
cauguaacaaucccauugga

SEQ ID NO: 26036 - RNA, 21 nt, Homo sapiens
gagccaagaucgcccacugca

SEQ ID NO: 26037 - RNA, 24 nt, Homo sapiens
gccugugggugggccgcuuggcuc

SEQ ID NO: 26038 - RNA, 18 nt, Homo sapiens
uucucuacuaaaauacaa

SEQ ID NO: 26039 - RNA, 20 nt, Homo sapiens
acaaccacgcagacagucac

SEQ ID NO: 26040 - RNA, 20 nt, Homo sapiens
ccacgcagacagucacacca

SEQ ID NO: 26041 - RNA, 16 nt, Homo sapiens
cuagcuuguucuugau

SEQ ID NO: 26042 - RNA, 21 nt, Homo sapiens
agcugagcaacuggagccucg

SEQ ID NO: 26043 - RNA, 18 nt, Homo sapiens
aacccagcuccucacuuc

SEQ ID NO: 26044 - RNA, 19 nt, Homo sapiens
aagggcccaugcugcagcc

SEQ ID NO: 26045 - RNA, 21 nt, Homo sapiens
auacauuaaacuuuuauucuu

SEQ ID NO: 26046 - RNA, 22 nt, Homo sapiens
caucaccuuugcccguguuuua

SEQ ID NO: 26047 - RNA, 24 nt, Homo sapiens
uaaaaaaugacaguuuguguuuaa

SEQ ID NO: 26048 - RNA, 20 nt, Homo sapiens
acaucacaauaaucugggac

SEQ ID NO: 26049 - RNA, 19 nt, Homo sapiens
ccaggcuugugcccuuuca

SEQ ID NO: 26050 - RNA, 22 nt, Homo sapiens
cuucacuucccgagggcgggug

SEQ ID NO: 26051 - RNA, 24 nt, Homo sapiens
ucagaggaaguaaauguucacuua

SEQ ID NO: 26052 - RNA, 21 nt, Homo sapiens
uggagagauguagugauuuaa

SEQ ID NO: 26053 - RNA, 20 nt, Homo sapiens
uggcccccuggcauuccuga

SEQ ID NO: 26054 - RNA, 21 nt, Homo sapiens
acaaaccaauaucugcacuug

SEQ ID NO: 26055 - RNA, 18 nt, Homo sapiens
gaauuauccagcauauga

SEQ ID NO: 26056 - RNA, 21 nt, Homo sapiens
guaaauuguacucucauucca

SEQ ID NO: 26057 - RNA, 25 nt, Homo sapiens
guuaccacuuuuuaaaaagcuuuuu

SEQ ID NO: 26058 - RNA, 17 nt, Homo sapiens
uccuacaguauuuacuu

SEQ ID NO: 26059 - RNA, 21 nt, Homo sapiens
ucuggcccugccauaugaaca

SEQ ID NO: 26060 - RNA, 23 nt, Homo sapiens
ugagauugugacuggcaauuguu

SEQ ID NO: 26061 - RNA, 16 nt, Homo sapiens
gacagagagggcagcc

SEQ ID NO: 26062 - RNA, 23 nt, Homo sapiens
aaacccggaucccgcugcaucuc

SEQ ID NO: 26063 - RNA, 20 nt, Homo sapiens
agcucacucguauguccugc

SEQ ID NO: 26064 - RNA, 20 nt, Homo sapiens
agcucacucguauguccugc

SEQ ID NO: 26065 - RNA, 23 nt, Homo sapiens
cacagcucacucguauguccugc

SEQ ID NO: 26066 - RNA, 20 nt, Homo sapiens
cagcucacucguauguccug

SEQ ID NO: 26067 - RNA, 21 nt, Homo sapiens
cagcucacucguauguccugc

SEQ ID NO: 26068 - RNA, 21 nt, Homo sapiens
cagcucacucguauguccugc

SEQ ID NO: 26069 - RNA, 16 nt, Homo sapiens
ccuggggguucgggga

SEQ ID NO: 26070 - RNA, 22 nt, Homo sapiens
cuuuuuuguugucuuuuacuuu

SEQ ID NO: 26071 - RNA, 20 nt, Homo sapiens
aacucacagccgaagcacuc

SEQ ID NO: 26072 - RNA, 19 nt, Homo sapiens
accauuucacaccauugua

SEQ ID NO: 26073 - RNA, 19 nt, Homo sapiens
caguugggcagaaucaucu

SEQ ID NO: 26074 - RNA, 22 nt, Homo sapiens
ccuaaauguacucagaacacuu

SEQ ID NO: 26075 - RNA, 16 nt, Homo sapiens
gggguuaugucccagu

SEQ ID NO: 26076 - RNA, 22 nt, Homo sapiens
acggaacccaccaugcacugca

SEQ ID NO: 26077 - RNA, 16 nt, Homo sapiens
ugccccgcauaggcca

SEQ ID NO: 26078 - RNA, 17 nt, Homo sapiens
uuugacugcugcggcaa

SEQ ID NO: 26079 - RNA, 22 nt, Homo sapiens
ccuuccccggcuccccugccca

SEQ ID NO: 26080 - RNA, 23 nt, Homo sapiens
agcgcaggaccaccgcgugugcu

SEQ ID NO: 26081 - RNA, 18 nt, Homo sapiens
gaccccagagccggccca

SEQ ID NO: 26082 - RNA, 18 nt, Homo sapiens
guccugucgcgggugugc

SEQ ID NO: 26083 - RNA, 21 nt, Homo sapiens
gugaagcucugggacauggca

SEQ ID NO: 26084 - RNA, 19 nt, Homo sapiens
uuaaagcugccacugcaga

SEQ ID NO: 26085 - RNA, 16 nt, Homo sapiens
gaacuccaagaucuca

SEQ ID NO: 26086 - RNA, 22 nt, Homo sapiens
ccugaaggggcaccgugggcug

SEQ ID NO: 26087 - RNA, 21 nt, Homo sapiens
aagagaggcaucggauucuca

SEQ ID NO: 26088 - RNA, 16 nt, Homo sapiens
agauggagaccuuguc

SEQ ID NO: 26089 - RNA, 21 nt, Homo sapiens
aggcugcagugagccacaguc

SEQ ID NO: 26090 - RNA, 21 nt, Homo sapiens
cagucacgccacugcauucua

SEQ ID NO: 26091 - RNA, 24 nt, Homo sapiens
acccagggccucaccugccacuca

SEQ ID NO: 26092 - RNA, 17 nt, Homo sapiens
agcaccuucuguggcuc

SEQ ID NO: 26093 - RNA, 18 nt, Homo sapiens
cguugacuaacuaugcuc

SEQ ID NO: 26094 - RNA, 21 nt, Homo sapiens
cucccucucucucccucucuc

SEQ ID NO: 26095 - RNA, 20 nt, Homo sapiens
cucccucucucuuuacccuc

SEQ ID NO: 26096 - RNA, 21 nt, Homo sapiens
gcggcuugucccaggcugcug

SEQ ID NO: 26097 - RNA, 24 nt, Homo sapiens
ggccugggccuugcugugggacug

SEQ ID NO: 26098 - RNA, 17 nt, Homo sapiens
ggucccagcuggaauua

SEQ ID NO: 26099 - RNA, 22 nt, Homo sapiens
uccuguacugcuauccgccaga

SEQ ID NO: 26100 - RNA, 22 nt, Homo sapiens
aaggacccaggauuugaaccca

SEQ ID NO: 26101 - RNA, 20 nt, Homo sapiens
agcggaugaagguugagcca

SEQ ID NO: 26102 - RNA, 22 nt, Homo sapiens
agucucacucuguugccaaggc

SEQ ID NO: 26103 - RNA, 15 nt, Homo sapiens
caagagagcauccag

SEQ ID NO: 26104 - RNA, 24 nt, Homo sapiens
ccagacucaagugauccucccacc

SEQ ID NO: 26105 - RNA, 17 nt, Homo sapiens
cugcagccacguggcca

SEQ ID NO: 26106 - RNA, 16 nt, Homo sapiens
cugcuucagccucuca

SEQ ID NO: 26107 - RNA, 20 nt, Homo sapiens
gcccagaggaaguucuccag

SEQ ID NO: 26108 - RNA, 19 nt, Homo sapiens
ggacgguaucccgagccca

SEQ ID NO: 26109 - RNA, 17 nt, Homo sapiens
gggcggggcaggcgcua

SEQ ID NO: 26110 - RNA, 25 nt, Homo sapiens
gugcuacgcaggugaggggauccgg

SEQ ID NO: 26111 - RNA, 17 nt, Homo sapiens
ucucuacguuaacguuu

SEQ ID NO: 26112 - RNA, 20 nt, Homo sapiens
ugagugggauaguguggggc

SEQ ID NO: 26113 - RNA, 19 nt, Homo sapiens
uggaggcugaugugagcug

SEQ ID NO: 26114 - RNA, 20 nt, Homo sapiens
uuuguuauuccuaccuuuga

SEQ ID NO: 26115 - RNA, 19 nt, Homo sapiens
aaauguuuucuccagcauc

SEQ ID NO: 26116 - RNA, 22 nt, Homo sapiens
cucacaaaauauauuucugaua

SEQ ID NO: 26117 - RNA, 23 nt, Homo sapiens
ccugaucugccugccuuggccuu

SEQ ID NO: 26118 - RNA, 21 nt, Homo sapiens
gccugacccgcaggccgccgc

SEQ ID NO: 26119 - RNA, 23 nt, Homo sapiens
acucuucuucauugugagaugca

SEQ ID NO: 26120 - RNA, 18 nt, Homo sapiens
caguuccucucguccaag

SEQ ID NO: 26121 - RNA, 19 nt, Homo sapiens
gcuacgcgcagccgccuca

SEQ ID NO: 26122 - RNA, 20 nt, Homo sapiens
uaacaauguuuaggauauug

SEQ ID NO: 26123 - RNA, 20 nt, Homo sapiens
uaugaugguaacuccaguga

SEQ ID NO: 26124 - RNA, 19 nt, Homo sapiens
cgccagcaagccccccucc

SEQ ID NO: 26125 - RNA, 26 nt, Homo sapiens
gaccccacggcuguccggacgugcca

SEQ ID NO: 26126 - RNA, 19 nt, Homo sapiens
gcuccgggagcuucggaga

SEQ ID NO: 26127 - RNA, 18 nt, Homo sapiens
cuuuccugcagccuggag

SEQ ID NO: 26128 - RNA, 24 nt, Homo sapiens
gauguuugaacccuggacauucca

SEQ ID NO: 26129 - RNA, 22 nt, Homo sapiens
guagccacacaucauugcuggg

SEQ ID NO: 26130 - RNA, 21 nt, Homo sapiens
uggaaggggacuagccagcuc

SEQ ID NO: 26131 - RNA, 20 nt, Homo sapiens
uggacacuaggaauugcagc

SEQ ID NO: 26132 - RNA, 23 nt, Homo sapiens
ugugucucaccgcccacaacccu

SEQ ID NO: 26133 - RNA, 25 nt, Homo sapiens
ccaacagggacuccaaucaaucgga

SEQ ID NO: 26134 - RNA, 16 nt, Homo sapiens
uuuggggcccgagaca

SEQ ID NO: 26135 - RNA, 17 nt, Homo sapiens
uggauugagccgggccc

SEQ ID NO: 26136 - RNA, 17 nt, Homo sapiens
gcagcucgcgggucaca

SEQ ID NO: 26137 - RNA, 16 nt, Homo sapiens
augccagcccuugcuc

SEQ ID NO: 26138 - RNA, 25 nt, Homo sapiens
ugcaccucuccugucugugcuccuc

SEQ ID NO: 26139 - RNA, 20 nt, Homo sapiens
ccagcagggcagcggcugag

SEQ ID NO: 26140 - RNA, 18 nt, Homo sapiens
ucuauuuuucuaccggga

SEQ ID NO: 26141 - RNA, 18 nt, Homo sapiens
ggaaagcgacggcgcggc

SEQ ID NO: 26142 - RNA, 21 nt, Homo sapiens
cacuacuuugaaaccauucua

SEQ ID NO: 26143 - RNA, 26 nt, Homo sapiens
uucuccgacauggcuacgugaucuca

SEQ ID NO: 26144 - RNA, 15 nt, Homo sapiens
agagagagaagcacu

SEQ ID NO: 26145 - RNA, 21 nt, Homo sapiens
ccugagcagagccugaauuac

SEQ ID NO: 26146 - RNA, 25 nt, Homo sapiens
ucuguauugaccgguuuuuguuuuu

SEQ ID NO: 26147 - RNA, 19 nt, Homo sapiens
aagcaauucucccaucuca

SEQ ID NO: 26148 - RNA, 20 nt, Homo sapiens
ccucugucucccggguucaa

SEQ ID NO: 26149 - RNA, 19 nt, Homo sapiens
cuaggaacugaaucuuuuu

SEQ ID NO: 26150 - RNA, 18 nt, Homo sapiens
ugucuuuugacaauacca

SEQ ID NO: 26151 - RNA, 21 nt, Homo sapiens
cccuccuggaggaccugggaa

SEQ ID NO: 26152 - RNA, 25 nt, Homo sapiens
cccugcgcugcacggaggucugugg

SEQ ID NO: 26153 - RNA, 17 nt, Homo sapiens
gcccagggccugaccaa

SEQ ID NO: 26154 - RNA, 25 nt, Homo sapiens
ugcccaccaggcuggccuuggcuga

SEQ ID NO: 26155 - RNA, 19 nt, Homo sapiens
uggacgugacguggggcug

SEQ ID NO: 26156 - RNA, 18 nt, Homo sapiens
auaauuucauuuuccuca

SEQ ID NO: 26157 - RNA, 16 nt, Homo sapiens
auuugagaucuuuucc

SEQ ID NO: 26158 - RNA, 18 nt, Homo sapiens
caccaugcccggccuucu

SEQ ID NO: 26159 - RNA, 19 nt, Homo sapiens
uuguuuuauugcauugacu

SEQ ID NO: 26160 - RNA, 19 nt, Homo sapiens
agaccuccccagcaaugug

SEQ ID NO: 26161 - RNA, 18 nt, Homo sapiens
augccucaggacauccua

SEQ ID NO: 26162 - RNA, 19 nt, Homo sapiens
agccaagauccuaccacua

SEQ ID NO: 26163 - RNA, 23 nt, Homo sapiens
gacagagcaauacucccgucuca

SEQ ID NO: 26164 - RNA, 22 nt, Homo sapiens
gagccaagauugcgccacugca

SEQ ID NO: 26165 - RNA, 22 nt, Homo sapiens
uucaagaucagucuggacaaca

SEQ ID NO: 26166 - RNA, 19 nt, Homo sapiens
caccguccgcuuuuccuga

SEQ ID NO: 26167 - RNA, 19 nt, Homo sapiens
gcaacugcgcggacgugac

SEQ ID NO: 26168 - RNA, 21 nt, Homo sapiens
gccccuguggccgccaucuug

SEQ ID NO: 26169 - RNA, 18 nt, Homo sapiens
cuccccaugguaaccagg

SEQ ID NO: 26170 - RNA, 24 nt, Homo sapiens
gccugaacugaucucacuuggcuc

SEQ ID NO: 26171 - RNA, 19 nt, Homo sapiens
ggggccugaacugaucuca

SEQ ID NO: 26172 - RNA, 19 nt, Homo sapiens
gugagugugggugugugug

SEQ ID NO: 26173 - RNA, 22 nt, Homo sapiens
gacgggguuucaacguguuggc

SEQ ID NO: 26174 - RNA, 18 nt, Homo sapiens
ccuaaggaauacuacaca

SEQ ID NO: 26175 - RNA, 17 nt, Homo sapiens
gcaggaccuuuguaggu

SEQ ID NO: 26176 - RNA, 17 nt, Homo sapiens
aaagauuucaaaccuca

SEQ ID NO: 26177 - RNA, 17 nt, Homo sapiens
acaagggaaggggucaa

SEQ ID NO: 26178 - RNA, 19 nt, Homo sapiens
acuggaggcugccuggcuc

SEQ ID NO: 26179 - RNA, 19 nt, Homo sapiens
ccaggcuccuucaccaccc

SEQ ID NO: 26180 - RNA, 20 nt, Homo sapiens
gagaugcauugguagcaacu

SEQ ID NO: 26181 - RNA, 19 nt, Homo sapiens
gaggauggagugagagaca

SEQ ID NO: 26182 - RNA, 18 nt, Homo sapiens
gcgcucaucaccucuucc

SEQ ID NO: 26183 - RNA, 22 nt, Homo sapiens
ucaucaucaccaccaucuccca

SEQ ID NO: 26184 - RNA, 20 nt, Homo sapiens
ucaugacauaccagaugcca

SEQ ID NO: 26185 - RNA, 18 nt, Homo sapiens
ucuacaagaaaauccaca

SEQ ID NO: 26186 - RNA, 22 nt, Homo sapiens
uucugaaauuggguccuccucc

SEQ ID NO: 26187 - RNA, 18 nt, Homo sapiens
cgauccuccccuggacuc

SEQ ID NO: 26188 - RNA, 19 nt, Homo sapiens
cugaagccucaguccuuca

SEQ ID NO: 26189 - RNA, 18 nt, Homo sapiens
cgauccuccccuggacuc

SEQ ID NO: 26190 - RNA, 19 nt, Homo sapiens
agcacccaagcucuucugu

SEQ ID NO: 26191 - RNA, 21 nt, Homo sapiens
agugagaauccuguguuccca

SEQ ID NO: 26192 - RNA, 18 nt, Homo sapiens
auaaccccaccaccgcca

SEQ ID NO: 26193 - RNA, 19 nt, Homo sapiens
cucugcuuccuccguccuc

SEQ ID NO: 26194 - RNA, 24 nt, Homo sapiens
cucugugucgugauggucugugaa

SEQ ID NO: 26195 - RNA, 22 nt, Homo sapiens
aaacccagcucccaugacucuc

SEQ ID NO: 26196 - RNA, 22 nt, Homo sapiens
agaaaggacauucccccucccc

SEQ ID NO: 26197 - RNA, 25 nt, Homo sapiens
ccaucaugacaugguccccaggcug

SEQ ID NO: 26198 - RNA, 21 nt, Homo sapiens
ccuucacgugaggucugugag

SEQ ID NO: 26199 - RNA, 21 nt, Homo sapiens
ccuucacgugaggucugugag

SEQ ID NO: 26200 - RNA, 19 nt, Homo sapiens
cuuaaacaacuccuuucca

SEQ ID NO: 26201 - RNA, 21 nt, Homo sapiens
uuaggccccaccuaacucuuc

SEQ ID NO: 26202 - RNA, 21 nt, Homo sapiens
aacucugucucaaaaauaaua

SEQ ID NO: 26203 - RNA, 23 nt, Homo sapiens
ugagauuugcuauuaggucuggu

SEQ ID NO: 26204 - RNA, 19 nt, Homo sapiens
acuuugggcaauaaucaga

SEQ ID NO: 26205 - RNA, 20 nt, Homo sapiens
ccaucaaauuacaacagcca

SEQ ID NO: 26206 - RNA, 22 nt, Homo sapiens
uauagguaagcagcuuaccuca

SEQ ID NO: 26207 - RNA, 20 nt, Homo sapiens
aagucaauacacaaaugugc

SEQ ID NO: 26208 - RNA, 21 nt, Homo sapiens
aaugcuuucaguguugaaaua

SEQ ID NO: 26209 - RNA, 22 nt, Homo sapiens
agucaauacacaaaugugccag

SEQ ID NO: 26210 - RNA, 17 nt, Homo sapiens
auaguauaguaaccaca

SEQ ID NO: 26211 - RNA, 19 nt, Homo sapiens
augguggucaaagcaguaa

SEQ ID NO: 26212 - RNA, 21 nt, Homo sapiens
caugaaagugggaaucacuga

SEQ ID NO: 26213 - RNA, 18 nt, Homo sapiens
ggaaugaccuggaacagg

SEQ ID NO: 26214 - RNA, 17 nt, Homo sapiens
uuuuggacccuauaacu

SEQ ID NO: 26215 - RNA, 15 nt, Homo sapiens
gauuagcacccauug

SEQ ID NO: 26216 - RNA, 23 nt, Homo sapiens
guuuccagaauaaauaugugugu

SEQ ID NO: 26217 - RNA, 19 nt, Homo sapiens
uacugcgacugaacggcgg

SEQ ID NO: 26218 - RNA, 20 nt, Homo sapiens
ugaaagaaguauucagagua

SEQ ID NO: 26219 - RNA, 15 nt, Homo sapiens
gauuagcacccauug

SEQ ID NO: 26220 - RNA, 19 nt, Homo sapiens
uacugcgacugaacggcgg

SEQ ID NO: 26221 - RNA, 16 nt, Homo sapiens
aauuaauauuucagug

SEQ ID NO: 26222 - RNA, 21 nt, Homo sapiens
auauuggugauguagcagcaa

SEQ ID NO: 26223 - RNA, 23 nt, Homo sapiens
gcuauuaagaguacuuuguguua

SEQ ID NO: 26224 - RNA, 21 nt, Homo sapiens
uaucacuauagaucauaguua

SEQ ID NO: 26225 - RNA, 19 nt, Homo sapiens
ugcaacaucgguggauuuu

SEQ ID NO: 26226 - RNA, 16 nt, Homo sapiens
aauuaauauuucagug

SEQ ID NO: 26227 - RNA, 21 nt, Homo sapiens
auauuggugauguagcagcaa

SEQ ID NO: 26228 - RNA, 21 nt, Homo sapiens
uaucacuauagaucauaguua

SEQ ID NO: 26229 - RNA, 19 nt, Homo sapiens
ccugucucagaaauaacaa

SEQ ID NO: 26230 - RNA, 19 nt, Homo sapiens
gaugcuacucacuuugauu

SEQ ID NO: 26231 - RNA, 21 nt, Homo sapiens
gugcagcccacuaaauugcuc

SEQ ID NO: 26232 - RNA, 20 nt, Homo sapiens
ugcagcccacuaaauugcuc

SEQ ID NO: 26233 - RNA, 20 nt, Homo sapiens
accacacaauuacuuuuaua

SEQ ID NO: 26234 - RNA, 20 nt, Homo sapiens
accaccaaaauacauagcuu

SEQ ID NO: 26235 - RNA, 21 nt, Homo sapiens
aggacaaagcaucagcugucc

SEQ ID NO: 26236 - RNA, 23 nt, Homo sapiens
auguggaugcauuagucaggugg

SEQ ID NO: 26237 - RNA, 19 nt, Homo sapiens
caucuaccacccuccuccu

SEQ ID NO: 26238 - RNA, 21 nt, Homo sapiens
gccacaugauuaauccagucu

SEQ ID NO: 26239 - RNA, 17 nt, Homo sapiens
gcgccucucacacaggu

SEQ ID NO: 26240 - RNA, 17 nt, Homo sapiens
ugggaaagguguuugug

SEQ ID NO: 26241 - RNA, 22 nt, Homo sapiens
cauugauaacagaacuaacuuc

SEQ ID NO: 26242 - RNA, 19 nt, Homo sapiens
ucagcaaaaggcaggagag

SEQ ID NO: 26243 - RNA, 23 nt, Homo sapiens
uucugucauacccacaucuguca

SEQ ID NO: 26244 - RNA, 20 nt, Homo sapiens
caggggacacaccugccaaa

SEQ ID NO: 26245 - RNA, 19 nt, Homo sapiens
aauacagaagggguguuug

SEQ ID NO: 26246 - RNA, 17 nt, Homo sapiens
uuccuuggaauauagcu

SEQ ID NO: 26247 - RNA, 18 nt, Homo sapiens
acccagaaagccucacau

SEQ ID NO: 26248 - RNA, 17 nt, Homo sapiens
ucaagugauucuugugc

SEQ ID NO: 26249 - RNA, 18 nt, Homo sapiens
cacaugccaaacaucaua

SEQ ID NO: 26250 - RNA, 24 nt, Homo sapiens
ccuggcauguucuaaacuguuuuu

SEQ ID NO: 26251 - RNA, 23 nt, Homo sapiens
uacggcuuccugacuucugugac

SEQ ID NO: 26252 - RNA, 16 nt, Homo sapiens
gggaauguuuucugaa

SEQ ID NO: 26253 - RNA, 21 nt, Homo sapiens
ucuagguacuaaagcauuuuu

SEQ ID NO: 26254 - RNA, 17 nt, Homo sapiens
ugugaaguuuuauaccu

SEQ ID NO: 26255 - RNA, 19 nt, Homo sapiens
aggcagucuguggccuccu

SEQ ID NO: 26256 - RNA, 19 nt, Homo sapiens
auuuauauagcucucaugu

SEQ ID NO: 26257 - RNA, 22 nt, Homo sapiens
auuuauauguauuuuuaccaca

SEQ ID NO: 26258 - RNA, 21 nt, Homo sapiens
caugaaacagcagaauuccag

SEQ ID NO: 26259 - RNA, 24 nt, Homo sapiens
cuacuauaagcaacagcuccuuca

SEQ ID NO: 26260 - RNA, 16 nt, Homo sapiens
cugaacuguacacuuu

SEQ ID NO: 26261 - RNA, 20 nt, Homo sapiens
gacuuggucaggcacauaca

SEQ ID NO: 26262 - RNA, 22 nt, Homo sapiens
gucaguggggcaagaaaucugg

SEQ ID NO: 26263 - RNA, 24 nt, Homo sapiens
ucuuuucaugcuaccuucaaucuu

SEQ ID NO: 26264 - RNA, 22 nt, Homo sapiens
uuccagacuuggucaggcacau

SEQ ID NO: 26265 - RNA, 19 nt, Homo sapiens
cccggccugcgcgcccagc

SEQ ID NO: 26266 - RNA, 17 nt, Homo sapiens
gcgaagccgagacggcc

SEQ ID NO: 26267 - RNA, 20 nt, Homo sapiens
gcgccucggccguugcccuc

SEQ ID NO: 26268 - RNA, 19 nt, Homo sapiens
agugccgacgguagcgaaa

SEQ ID NO: 26269 - RNA, 19 nt, Homo sapiens
accacacgauuguuccacu

SEQ ID NO: 26270 - RNA, 20 nt, Homo sapiens
gcaaggucaaagacauauca

SEQ ID NO: 26271 - RNA, 15 nt, Homo sapiens
gcaucccuuuuguga

SEQ ID NO: 26272 - RNA, 18 nt, Homo sapiens
aggucguucggcucgggu

SEQ ID NO: 26273 - RNA, 18 nt, Homo sapiens
cgaggucguucggcucgg

SEQ ID NO: 26274 - RNA, 20 nt, Homo sapiens
acaaaagcccgcuugcucgc

SEQ ID NO: 26275 - RNA, 18 nt, Homo sapiens
gcuuuuccugccggucug

SEQ ID NO: 26276 - RNA, 16 nt, Homo sapiens
ggcugaaggagucucg

SEQ ID NO: 26277 - RNA, 21 nt, Homo sapiens
aaacagaaaccgggcucaguc

SEQ ID NO: 26278 - RNA, 19 nt, Homo sapiens
aagcaauucuccugccuca

SEQ ID NO: 26279 - RNA, 22 nt, Homo sapiens
aguaaauggguauauguguuug

SEQ ID NO: 26280 - RNA, 16 nt, Homo sapiens
auuuccuauccucuga

SEQ ID NO: 26281 - RNA, 20 nt, Homo sapiens
ccucugccucccggguucaa

SEQ ID NO: 26282 - RNA, 19 nt, Homo sapiens
ccuuaauuuauacucucuc

SEQ ID NO: 26283 - RNA, 15 nt, Homo sapiens
ugcccuucucuccuc

SEQ ID NO: 26284 - RNA, 20 nt, Homo sapiens
uggaagccuugguggauucu

SEQ ID NO: 26285 - RNA, 21 nt, Homo sapiens
ccaccgccaucauucugcuca

SEQ ID NO: 26286 - RNA, 18 nt, Homo sapiens
uucugcucauccuccucc

SEQ ID NO: 26287 - RNA, 17 nt, Homo sapiens
caaugauuaacuggcca

SEQ ID NO: 26288 - RNA, 24 nt, Homo sapiens
aucuggguggcucagcuaaccucu

SEQ ID NO: 26289 - RNA, 18 nt, Homo sapiens
caugcaccauugcaggga

SEQ ID NO: 26290 - RNA, 18 nt, Homo sapiens
ccuggaggaaccagcugc

SEQ ID NO: 26291 - RNA, 20 nt, Homo sapiens
gcuuuucacaguuugcuuuu

SEQ ID NO: 26292 - RNA, 20 nt, Homo sapiens
ggacaucucgucacucugua

SEQ ID NO: 26293 - RNA, 19 nt, Homo sapiens
ucuguuaucucuugaugag

SEQ ID NO: 26294 - RNA, 21 nt, Homo sapiens
uuccagcuugcccuguucuag

SEQ ID NO: 26295 - RNA, 20 nt, Homo sapiens
agaaggugaagacauauaga

SEQ ID NO: 26296 - RNA, 21 nt, Homo sapiens
aucucacucacaaacaucaca

SEQ ID NO: 26297 - RNA, 18 nt, Homo sapiens
cauguaucaggacagaga

SEQ ID NO: 26298 - RNA, 16 nt, Homo sapiens
cgcucccaugcugcug

SEQ ID NO: 26299 - RNA, 18 nt, Homo sapiens
cuggcucuccucuaccuc

SEQ ID NO: 26300 - RNA, 17 nt, Homo sapiens
uggcaguccagcagcaa

SEQ ID NO: 26301 - RNA, 18 nt, Homo sapiens
ccaucagccauuuacuaa

SEQ ID NO: 26302 - RNA, 20 nt, Homo sapiens
aaaagacuucucuguaaaga

SEQ ID NO: 26303 - RNA, 23 nt, Homo sapiens
gcgcccagacugguauccgggga

SEQ ID NO: 26304 - RNA, 22 nt, Homo sapiens
auuaugcuucuagguuacuuuu

SEQ ID NO: 26305 - RNA, 20 nt, Homo sapiens
aaaguugggagaaaggggaa

SEQ ID NO: 26306 - RNA, 21 nt, Homo sapiens
aggagaaaggcggacagguca

SEQ ID NO: 26307 - RNA, 22 nt, Homo sapiens
agggcgugaagaauuucccucu

SEQ ID NO: 26308 - RNA, 21 nt, Homo sapiens
caaagcauggccuuaccagcu

SEQ ID NO: 26309 - RNA, 20 nt, Homo sapiens
ggcgugaagaauuucccucu

SEQ ID NO: 26310 - RNA, 19 nt, Homo sapiens
uaagguuaacuccucacuc

SEQ ID NO: 26311 - RNA, 16 nt, Homo sapiens
uugauauugcacagug

SEQ ID NO: 26312 - RNA, 16 nt, Homo sapiens
uugcacagugcacuua

SEQ ID NO: 26313 - RNA, 19 nt, Homo sapiens
caaacccccacuucccuca

SEQ ID NO: 26314 - RNA, 22 nt, Homo sapiens
aaaaacuaauuuggcauuuuaa

SEQ ID NO: 26315 - RNA, 22 nt, Homo sapiens
accuggaaauacaacuuugcuu

SEQ ID NO: 26316 - RNA, 22 nt, Homo sapiens
gugaaccuggaaauacaacuuu

SEQ ID NO: 26317 - RNA, 20 nt, Homo sapiens
ucuuuuucacugugacugca

SEQ ID NO: 26318 - RNA, 17 nt, Homo sapiens
auguacugugugugaca

SEQ ID NO: 26319 - RNA, 22 nt, Homo sapiens
uccugaagcucuuacucuaaga

SEQ ID NO: 26320 - RNA, 20 nt, Homo sapiens
uucaagaccagccugaccaa

SEQ ID NO: 26321 - RNA, 24 nt, Homo sapiens
ccacagugcccagcccgaauugga

SEQ ID NO: 26322 - RNA, 21 nt, Homo sapiens
uaucauauaguaagcagaaga

SEQ ID NO: 26323 - RNA, 20 nt, Homo sapiens
uggucaggcuggucuugaac

SEQ ID NO: 26324 - RNA, 18 nt, Homo sapiens
ugcgcgguagccgcccca

SEQ ID NO: 26325 - RNA, 21 nt, Homo sapiens
agcucuucuaguucaucugcu

SEQ ID NO: 26326 - RNA, 16 nt, Homo sapiens
aggaagagcuacuuca

SEQ ID NO: 26327 - RNA, 18 nt, Homo sapiens
uacuaauucccuacuagc

SEQ ID NO: 26328 - RNA, 21 nt, Homo sapiens
agacugugcguugauaccaaa

SEQ ID NO: 26329 - RNA, 21 nt, Homo sapiens
cugagggcgaaaguugugugu

SEQ ID NO: 26330 - RNA, 21 nt, Homo sapiens
ggaggaggaagccgccgagac

SEQ ID NO: 26331 - RNA, 23 nt, Homo sapiens
ccuucucuauggccuugcuaccu

SEQ ID NO: 26332 - RNA, 22 nt, Homo sapiens
uccuccaugcucccuuaauccc

SEQ ID NO: 26333 - RNA, 21 nt, Homo sapiens
ccuuccccuacccuucccucc

SEQ ID NO: 26334 - RNA, 17 nt, Homo sapiens
ucaagugauucuccugc

SEQ ID NO: 26335 - RNA, 18 nt, Homo sapiens
uccaccucccggguucaa

SEQ ID NO: 26336 - RNA, 20 nt, Homo sapiens
uguuugucuuguguaucaua

SEQ ID NO: 26337 - RNA, 23 nt, Homo sapiens
aagcaagagugucacagcaguaa

SEQ ID NO: 26338 - RNA, 18 nt, Homo sapiens
aucaaacaagaauaaaua

SEQ ID NO: 26339 - RNA, 18 nt, Homo sapiens
uucuuugugaucuacuga

SEQ ID NO: 26340 - RNA, 22 nt, Homo sapiens
auuugaguccugaggcuggccc

SEQ ID NO: 26341 - RNA, 18 nt, Homo sapiens
cgccuuauggcuguggug

SEQ ID NO: 26342 - RNA, 28 nt, Homo sapiens
gccuggcgucguccgugacuccuggccc

SEQ ID NO: 26343 - RNA, 18 nt, Homo sapiens
guucuuccuccuccgcgu

SEQ ID NO: 26344 - RNA, 20 nt, Homo sapiens
uccuggcccuucucugugga

SEQ ID NO: 26345 - RNA, 23 nt, Homo sapiens
uucugacgaaccccugcuugugg

SEQ ID NO: 26346 - RNA, 25 nt, Homo sapiens
uucugaguaucggggggucucugga

SEQ ID NO: 26347 - RNA, 20 nt, Homo sapiens
uccuugacuaugccccucuc

SEQ ID NO: 26348 - RNA, 20 nt, Homo sapiens
uuugguaugggagguguuag

SEQ ID NO: 26349 - RNA, 19 nt, Homo sapiens
aaggccgacaccacuccug

SEQ ID NO: 26350 - RNA, 22 nt, Homo sapiens
acccccucgccuccuacucuga

SEQ ID NO: 26351 - RNA, 18 nt, Homo sapiens
ccgcugagaggcugccuc

SEQ ID NO: 26352 - RNA, 20 nt, Homo sapiens
cucugggggcagauuugugg

SEQ ID NO: 26353 - RNA, 18 nt, Homo sapiens
cugcacccucuucucuuc

SEQ ID NO: 26354 - RNA, 24 nt, Homo sapiens
gcuuuacuguggcugucuggaucc

SEQ ID NO: 26355 - RNA, 18 nt, Homo sapiens
guugauuguacguagcca

SEQ ID NO: 26356 - RNA, 21 nt, Homo sapiens
uagccgaacuccaggcugggc

SEQ ID NO: 26357 - RNA, 26 nt, Homo sapiens
ucuguaaaaaauguaugcuauccucu

SEQ ID NO: 26358 - RNA, 23 nt, Homo sapiens
augucaggaaagcccuaaacuga

SEQ ID NO: 26359 - RNA, 21 nt, Homo sapiens
caaggucaucucuggcccagu

SEQ ID NO: 26360 - RNA, 21 nt, Homo sapiens
cucccggccccccugcacucu

SEQ ID NO: 26361 - RNA, 21 nt, Homo sapiens
uagauggguuccguaagaggc

SEQ ID NO: 26362 - RNA, 18 nt, Homo sapiens
ugcaccucccggacuuca

SEQ ID NO: 26363 - RNA, 25 nt, Homo sapiens
accugggccucucuguguuugguuc

SEQ ID NO: 26364 - RNA, 18 nt, Homo sapiens
acggguguguuugcuaua

SEQ ID NO: 26365 - RNA, 24 nt, Homo sapiens
caggagguuugucucaacacuucc

SEQ ID NO: 26366 - RNA, 18 nt, Homo sapiens
cauugcuucaacacagca

SEQ ID NO: 26367 - RNA, 19 nt, Homo sapiens
ccaagcacuucccaccuca

SEQ ID NO: 26368 - RNA, 19 nt, Homo sapiens
cuuuuuagaccuucuuuca

SEQ ID NO: 26369 - RNA, 21 nt, Homo sapiens
gaccauguaacaaauaccuca

SEQ ID NO: 26370 - RNA, 19 nt, Homo sapiens
gauucauugcuucaacaca

SEQ ID NO: 26371 - RNA, 17 nt, Homo sapiens
gccaaguggccauccua

SEQ ID NO: 26372 - RNA, 19 nt, Homo sapiens
gcuguguuuuguuuuguuu

SEQ ID NO: 26373 - RNA, 17 nt, Homo sapiens
gguuuuucauuuucuca

SEQ ID NO: 26374 - RNA, 22 nt, Homo sapiens
ucaguauuauuuccuaaaauga

SEQ ID NO: 26375 - RNA, 18 nt, Homo sapiens
uuaaauaacaaaaccacu

SEQ ID NO: 26376 - RNA, 21 nt, Homo sapiens
aacagauuugcagcucauucc

SEQ ID NO: 26377 - RNA, 21 nt, Homo sapiens
ccugagcuggcugccuggccc

SEQ ID NO: 26378 - RNA, 17 nt, Homo sapiens
cucuguccucguucccu

SEQ ID NO: 26379 - RNA, 22 nt, Homo sapiens
uccugccuccuuuuuccguucu

SEQ ID NO: 26380 - RNA, 20 nt, Homo sapiens
uuccagaaucaaugcugcag

SEQ ID NO: 26381 - RNA, 22 nt, Homo sapiens
ccauggugcuucccuccaucuc

SEQ ID NO: 26382 - RNA, 22 nt, Homo sapiens
gggugucugcugggcccacuua

SEQ ID NO: 26383 - RNA, 20 nt, Homo sapiens
uaaguggauuucaaacugug

SEQ ID NO: 26384 - RNA, 20 nt, Homo sapiens
uauugugacgcucucccuga

SEQ ID NO: 26385 - RNA, 19 nt, Homo sapiens
ugagaucaggcucuuugag

SEQ ID NO: 26386 - RNA, 18 nt, Homo sapiens
uucuguguaacaggccac

SEQ ID NO: 26387 - RNA, 19 nt, Homo sapiens
agugcuuggagguccgugu

SEQ ID NO: 26388 - RNA, 21 nt, Homo sapiens
uaaaaugcugagucgauccca

SEQ ID NO: 26389 - RNA, 20 nt, Homo sapiens
cuggccucacagccguccca

SEQ ID NO: 26390 - RNA, 21 nt, Homo sapiens
gacguuggcugugcuugguca

SEQ ID NO: 26391 - RNA, 23 nt, Homo sapiens
gugagauguuaccacuuaccccu

SEQ ID NO: 26392 - RNA, 21 nt, Homo sapiens
uacccugagccaccucucuca

SEQ ID NO: 26393 - RNA, 27 nt, Homo sapiens
uuacugccuuuuguggaaauucaccua

SEQ ID NO: 26394 - RNA, 18 nt, Homo sapiens
uuucuagguugccuuaau

SEQ ID NO: 26395 - RNA, 20 nt, Homo sapiens
ggaagaagcccgggaucccg

SEQ ID NO: 26396 - RNA, 18 nt, Homo sapiens
uggguggaucaccugagg

SEQ ID NO: 26397 - RNA, 23 nt, Homo sapiens
cauccagaacaccagauguugua

SEQ ID NO: 26398 - RNA, 18 nt, Homo sapiens
ccucccacugccauggua

SEQ ID NO: 26399 - RNA, 20 nt, Homo sapiens
aguguugcaccaaacuaaca

SEQ ID NO: 26400 - RNA, 23 nt, Homo sapiens
ggcaacauagcgagacuaccucu

SEQ ID NO: 26401 - RNA, 21 nt, Homo sapiens
ucagcaggagugccaggagaa

SEQ ID NO: 26402 - RNA, 17 nt, Homo sapiens
agcuugugaaaaucuca

SEQ ID NO: 26403 - RNA, 26 nt, Homo sapiens
caccaacccaguaucacaaaaacuca

SEQ ID NO: 26404 - RNA, 20 nt, Homo sapiens
gugucccagaagcuuuuguu

SEQ ID NO: 26405 - RNA, 20 nt, Homo sapiens
gccacgucccagcaccacuu

SEQ ID NO: 26406 - RNA, 19 nt, Homo sapiens
aggaaguaggguugaaaua

SEQ ID NO: 26407 - RNA, 19 nt, Homo sapiens
acagaaugucaacaucaca

SEQ ID NO: 26408 - RNA, 20 nt, Homo sapiens
acaucaccugccugccggca

SEQ ID NO: 26409 - RNA, 21 nt, Homo sapiens
ugaaugaagacaauguggaau

SEQ ID NO: 26410 - RNA, 20 nt, Homo sapiens
gaaagcucauuaucugagaa

SEQ ID NO: 26411 - RNA, 24 nt, Homo sapiens
aacuagagcuagucuucggauuga

SEQ ID NO: 26412 - RNA, 24 nt, Homo sapiens
guuacaaucacaccaagugacuca

SEQ ID NO: 26413 - RNA, 19 nt, Homo sapiens
agugggaaaagguguuaag

SEQ ID NO: 26414 - RNA, 25 nt, Homo sapiens
agccucguccuggaccccuaccucg

SEQ ID NO: 26415 - RNA, 17 nt, Homo sapiens
cccaccccugccccagc

SEQ ID NO: 26416 - RNA, 17 nt, Homo sapiens
gaccccugagccacccc

SEQ ID NO: 26417 - RNA, 19 nt, Homo sapiens
gcacgaggagcggaugaga

SEQ ID NO: 26418 - RNA, 21 nt, Homo sapiens
auguguuaaauugugcuuuaa

SEQ ID NO: 26419 - RNA, 21 nt, Homo sapiens
ccuguacccuaaaauuuuuca

SEQ ID NO: 26420 - RNA, 24 nt, Homo sapiens
ugugcagcccuuagguuccugcug

SEQ ID NO: 26421 - RNA, 16 nt, Homo sapiens
uuuuggucugcagcaa

SEQ ID NO: 26422 - RNA, 20 nt, Homo sapiens
augaaccggguggguucuga

SEQ ID NO: 26423 - RNA, 21 nt, Homo sapiens
cucucucucucuuucucucuc

SEQ ID NO: 26424 - RNA, 18 nt, Homo sapiens
ucuuucucucucucucuc

SEQ ID NO: 26425 - RNA, 17 nt, Homo sapiens
ugcagccuuccuggacu

SEQ ID NO: 26426 - RNA, 23 nt, Homo sapiens
cuuccuguuggcugucuggccuu

SEQ ID NO: 26427 - RNA, 24 nt, Homo sapiens
gccuuccuguuggcugucuggccu

SEQ ID NO: 26428 - RNA, 23 nt, Homo sapiens
gcgcaguauuuauugcuaaauua

SEQ ID NO: 26429 - RNA, 24 nt, Homo sapiens
ucugggaucuugugaguuacuuuu

SEQ ID NO: 26430 - RNA, 20 nt, Homo sapiens
caaccucguccucugccccu

SEQ ID NO: 26431 - RNA, 19 nt, Homo sapiens
ccuccucaaccucguccuc

SEQ ID NO: 26432 - RNA, 19 nt, Homo sapiens
ccugggccagagcugguuc

SEQ ID NO: 26433 - RNA, 24 nt, Homo sapiens
gccauggcuaggaaagcgcugcca

SEQ ID NO: 26434 - RNA, 19 nt, Homo sapiens
uccagacacucugcuguuu

SEQ ID NO: 26435 - RNA, 21 nt, Homo sapiens
cuuuggcucccagccaccuca

SEQ ID NO: 26436 - RNA, 19 nt, Homo sapiens
gagaguugaaaaacuaccu

SEQ ID NO: 26437 - RNA, 17 nt, Homo sapiens
gcugcgcgcuccucaug

SEQ ID NO: 26438 - RNA, 21 nt, Homo sapiens
cugucucaaaauauugcccaa

SEQ ID NO: 26439 - RNA, 22 nt, Homo sapiens
cuugaguaagaacaauccuuuu

SEQ ID NO: 26440 - RNA, 23 nt, Homo sapiens
ggcaagaagguauccucuuccca

SEQ ID NO: 26441 - RNA, 20 nt, Homo sapiens
uccaaugaugggacaggccu

SEQ ID NO: 26442 - RNA, 26 nt, Homo sapiens
ucuuaaguacugacugcuuugacuuu

SEQ ID NO: 26443 - RNA, 20 nt, Homo sapiens
ugaccacucaggccagccca

SEQ ID NO: 26444 - RNA, 20 nt, Homo sapiens
ugaugauggcugccugguuu

SEQ ID NO: 26445 - RNA, 21 nt, Homo sapiens
ggggacagggacugcuguggc

SEQ ID NO: 26446 - RNA, 26 nt, Homo sapiens
aucugaaucaucaguauugucugcuu

SEQ ID NO: 26447 - RNA, 20 nt, Homo sapiens
cauagacaacuagagcagcu

SEQ ID NO: 26448 - RNA, 26 nt, Homo sapiens
ccugccgucguagggaggcuugcgga

SEQ ID NO: 26449 - RNA, 20 nt, Homo sapiens
ccuggucacccuccaucucu

SEQ ID NO: 26450 - RNA, 22 nt, Homo sapiens
gcugagccgcgccacgcugcaa

SEQ ID NO: 26451 - RNA, 18 nt, Homo sapiens
uccuuuugugccucggaa

SEQ ID NO: 26452 - RNA, 19 nt, Homo sapiens
ccuccuuagccccacuggu

SEQ ID NO: 26453 - RNA, 21 nt, Homo sapiens
cuuuuucauccccuuacccuu

SEQ ID NO: 26454 - RNA, 19 nt, Homo sapiens
ucaggugcagaggaaguac

SEQ ID NO: 26455 - RNA, 22 nt, Homo sapiens
agcuacuuccaucccccgggga

SEQ ID NO: 26456 - RNA, 19 nt, Homo sapiens
gcggcuucaagagagagcg

SEQ ID NO: 26457 - RNA, 26 nt, Homo sapiens
cggcuggggcugcggccgcguggcuc

SEQ ID NO: 26458 - RNA, 18 nt, Homo sapiens
gaagcaugugaaaauuca

SEQ ID NO: 26459 - RNA, 22 nt, Homo sapiens
ucugggcuuccagcgcuggccu

SEQ ID NO: 26460 - RNA, 17 nt, Homo sapiens
auggcuugaaguccuga

SEQ ID NO: 26461 - RNA, 21 nt, Homo sapiens
acaaccugcaaaaacggagcu

SEQ ID NO: 26462 - RNA, 23 nt, Homo sapiens
cccaggagccgggaggccugcgg

SEQ ID NO: 26463 - RNA, 22 nt, Homo sapiens
ccccggggauacccucugccag

SEQ ID NO: 26464 - RNA, 20 nt, Homo sapiens
uugagaauugagucuuugga

SEQ ID NO: 26465 - RNA, 20 nt, Homo sapiens
aauaaaauucuguuguuugu

SEQ ID NO: 26466 - RNA, 18 nt, Homo sapiens
accgacucugucguugcc

SEQ ID NO: 26467 - RNA, 22 nt, Homo sapiens
guucuaguuuguauccccucaa

SEQ ID NO: 26468 - RNA, 20 nt, Homo sapiens
ucugucguugccuugaucuu

SEQ ID NO: 26469 - RNA, 18 nt, Homo sapiens
aguaacaagccugucaaa

SEQ ID NO: 26470 - RNA, 21 nt, Homo sapiens
aaaugcaguaucuucagaaug

SEQ ID NO: 26471 - RNA, 18 nt, Homo sapiens
agaacacugccuuguucc

SEQ ID NO: 26472 - RNA, 21 nt, Homo sapiens
ccccacccagcccccugcagc

SEQ ID NO: 26473 - RNA, 17 nt, Homo sapiens
gcccugcugcaccaucu

SEQ ID NO: 26474 - RNA, 23 nt, Homo sapiens
uucuuuggaacaaauccccccca

SEQ ID NO: 26475 - RNA, 20 nt, Homo sapiens
agagaaggaugcugaggacc

SEQ ID NO: 26476 - RNA, 27 nt, Homo sapiens
ccuagcuacugguccugggccauuuuu

SEQ ID NO: 26477 - RNA, 18 nt, Homo sapiens
cuugagaacucuugguuu

SEQ ID NO: 26478 - RNA, 23 nt, Homo sapiens
gguugcucauccauuuuuuucag

SEQ ID NO: 26479 - RNA, 20 nt, Homo sapiens
acuggaugauguucacaaca

SEQ ID NO: 26480 - RNA, 18 nt, Homo sapiens
aguauuuccagaaucuca

SEQ ID NO: 26481 - RNA, 23 nt, Homo sapiens
gaaggacauugaaaaaauguaca

SEQ ID NO: 26482 - RNA, 19 nt, Homo sapiens
gagaaguaguugugagaca

SEQ ID NO: 26483 - RNA, 27 nt, Homo sapiens
uggaugauguucacaacaaagcugaca

SEQ ID NO: 26484 - RNA, 23 nt, Homo sapiens
gaccggaccucgaccggcucguc

SEQ ID NO: 26485 - RNA, 18 nt, Homo sapiens
gcuuguuuccugcucuga

SEQ ID NO: 26486 - RNA, 20 nt, Homo sapiens
uccugcucugaggcuugugg

SEQ ID NO: 26487 - RNA, 18 nt, Homo sapiens
uuguuuccaaauaugacc

SEQ ID NO: 26488 - RNA, 19 nt, Homo sapiens
acagagccagacccugacu

SEQ ID NO: 26489 - RNA, 23 nt, Homo sapiens
acuggugcacaccugucauccca

SEQ ID NO: 26490 - RNA, 20 nt, Homo sapiens
aggcccugugcaugucccca

SEQ ID NO: 26491 - RNA, 19 nt, Homo sapiens
cccaacccgagaaccgggg

SEQ ID NO: 26492 - RNA, 19 nt, Homo sapiens
ccgugugcucgccauguga

SEQ ID NO: 26493 - RNA, 18 nt, Homo sapiens
ccugaggcaugggauggg

SEQ ID NO: 26494 - RNA, 21 nt, Homo sapiens
cgaggcugcagggagcuguga

SEQ ID NO: 26495 - RNA, 19 nt, Homo sapiens
ucucaccgugugcucgcca

SEQ ID NO: 26496 - RNA, 22 nt, Homo sapiens
cauuuacaaaugcaaaaaugga

SEQ ID NO: 26497 - RNA, 19 nt, Homo sapiens
uuccuguaagcuaccugaa

SEQ ID NO: 26498 - RNA, 16 nt, Homo sapiens
aacacaucuugggcca

SEQ ID NO: 26499 - RNA, 17 nt, Homo sapiens
aucucaggcugggaaga

SEQ ID NO: 26500 - RNA, 17 nt, Homo sapiens
ccacaugagccauguga

SEQ ID NO: 26501 - RNA, 21 nt, Homo sapiens
acuacuaccagcagaaaggga

SEQ ID NO: 26502 - RNA, 17 nt, Homo sapiens
gugggguacaguagcug

SEQ ID NO: 26503 - RNA, 23 nt, Homo sapiens
aacaggaagccuguggaggacug

SEQ ID NO: 26504 - RNA, 21 nt, Homo sapiens
ccuuuucauauauuuugccuu

SEQ ID NO: 26505 - RNA, 18 nt, Homo sapiens
agaagucuuuacaccucu

SEQ ID NO: 26506 - RNA, 19 nt, Homo sapiens
auccuaagcaguuacucug

SEQ ID NO: 26507 - RNA, 22 nt, Homo sapiens
cugccuuuuacacauugcuuuu

SEQ ID NO: 26508 - RNA, 20 nt, Homo sapiens
guucuuguauaccauguuug

SEQ ID NO: 26509 - RNA, 19 nt, Homo sapiens
ucuguugcaugacaaacgu

SEQ ID NO: 26510 - RNA, 19 nt, Homo sapiens
ggugaggcaaucugugagc

SEQ ID NO: 26511 - RNA, 20 nt, Homo sapiens
agacacuugugaaaccuugc

SEQ ID NO: 26512 - RNA, 15 nt, Homo sapiens
gaggaagaagagcaa

SEQ ID NO: 26513 - RNA, 25 nt, Homo sapiens
ucaaguauauacucauguuauuuug

SEQ ID NO: 26514 - RNA, 25 nt, Homo sapiens
ugagacagcacuguuuggugccaga

SEQ ID NO: 26515 - RNA, 19 nt, Homo sapiens
agaucuuugcaugagguaa

SEQ ID NO: 26516 - RNA, 18 nt, Homo sapiens
aguuuugagguuaugcac

SEQ ID NO: 26517 - RNA, 18 nt, Homo sapiens
ggcugcccauauaaguca

SEQ ID NO: 26518 - RNA, 23 nt, Homo sapiens
uuucccaccuccuuccccccacc

SEQ ID NO: 26519 - RNA, 19 nt, Homo sapiens
cgccagcuccuccuccucc

SEQ ID NO: 26520 - RNA, 22 nt, Homo sapiens
gcccacaggcggauguucccca

SEQ ID NO: 26521 - RNA, 16 nt, Homo sapiens
uaaagcuaguccugua

SEQ ID NO: 26522 - RNA, 20 nt, Homo sapiens
gcacuccagccugggugaca

SEQ ID NO: 26523 - RNA, 19 nt, Homo sapiens
ccaacugucagugccagug

SEQ ID NO: 26524 - RNA, 25 nt, Homo sapiens
gaauucuugacguggggucucugga

SEQ ID NO: 26525 - RNA, 17 nt, Homo sapiens
gcucaaacgggcuuuua

SEQ ID NO: 26526 - RNA, 21 nt, Homo sapiens
ucuugacguggggucucugga

SEQ ID NO: 26527 - RNA, 25 nt, Homo sapiens
gggaaucacauuucaacaugagauu

SEQ ID NO: 26528 - RNA, 23 nt, Homo sapiens
ucccgcuaggcccaccuccaaca

SEQ ID NO: 26529 - RNA, 18 nt, Homo sapiens
acaaauguggaagaaauc

SEQ ID NO: 26530 - RNA, 18 nt, Homo sapiens
acaagagugcauaccaga

SEQ ID NO: 26531 - RNA, 17 nt, Homo sapiens
auauaacauguuugcaa

SEQ ID NO: 26532 - RNA, 18 nt, Homo sapiens
cuacauauauuuuaaaaa

SEQ ID NO: 26533 - RNA, 22 nt, Homo sapiens
agucucacucuguuacccaggc

SEQ ID NO: 26534 - RNA, 20 nt, Homo sapiens
caccagccaacugcaacuua

SEQ ID NO: 26535 - RNA, 22 nt, Homo sapiens
ccgaguguugauuuuaauauca

SEQ ID NO: 26536 - RNA, 22 nt, Homo sapiens
cucugaggaagagggucugugg

SEQ ID NO: 26537 - RNA, 19 nt, Homo sapiens
cuucuuuuucccccuccuc

SEQ ID NO: 26538 - RNA, 17 nt, Homo sapiens
gcgauuccccugccuca

SEQ ID NO: 26539 - RNA, 21 nt, Homo sapiens
auuuggguccuaguugcuugg

SEQ ID NO: 26540 - RNA, 17 nt, Homo sapiens
cccacaggagccccgga

SEQ ID NO: 26541 - RNA, 16 nt, Homo sapiens
agaaaauucauaccug

SEQ ID NO: 26542 - RNA, 21 nt, Homo sapiens
caccucuaugcacuucuuucu

SEQ ID NO: 26543 - RNA, 17 nt, Homo sapiens
uccagagagauucccag

SEQ ID NO: 26544 - RNA, 19 nt, Homo sapiens
cuuccagugcuuuggccuu

SEQ ID NO: 26545 - RNA, 19 nt, Homo sapiens
cuggaaaggagcagugccu

SEQ ID NO: 26546 - RNA, 22 nt, Homo sapiens
ugggagccugggcugggcucag

SEQ ID NO: 26547 - RNA, 19 nt, Homo sapiens
caagaaaucagcaaccagc

SEQ ID NO: 26548 - RNA, 20 nt, Homo sapiens
caugcuggcugugaccccgg

SEQ ID NO: 26549 - RNA, 21 nt, Homo sapiens
ccucagggcuaacggcacugu

SEQ ID NO: 26550 - RNA, 20 nt, Homo sapiens
gauuaucaacaauggggcua

SEQ ID NO: 26551 - RNA, 21 nt, Homo sapiens
ucuaauaauguuucuuaaugg

SEQ ID NO: 26552 - RNA, 18 nt, Homo sapiens
agggaacucauacugucu

SEQ ID NO: 26553 - RNA, 15 nt, Homo sapiens
cccagaagcccucag

SEQ ID NO: 26554 - RNA, 22 nt, Homo sapiens
cuuuuuggaucagcauuuugua

SEQ ID NO: 26555 - RNA, 18 nt, Homo sapiens
guucccuccaucauugcc

SEQ ID NO: 26556 - RNA, 20 nt, Homo sapiens
ugggcccugugaagccagca

SEQ ID NO: 26557 - RNA, 21 nt, Homo sapiens
uuuggcauuuguuuaaccuca

SEQ ID NO: 26558 - RNA, 17 nt, Homo sapiens
acuuagagcuuaucuuc

SEQ ID NO: 26559 - RNA, 23 nt, Homo sapiens
cgaagacgugcccuacccuacca

SEQ ID NO: 26560 - RNA, 17 nt, Homo sapiens
gugguuuucuugcuccc

SEQ ID NO: 26561 - RNA, 21 nt, Homo sapiens
uacuaagugguuuucuugcuc

SEQ ID NO: 26562 - RNA, 18 nt, Homo sapiens
uuuacuuccaauauuuua

SEQ ID NO: 26563 - RNA, 21 nt, Homo sapiens
agccagccccagcacugagga

SEQ ID NO: 26564 - RNA, 17 nt, Homo sapiens
cacauggugugcacggg

SEQ ID NO: 26565 - RNA, 19 nt, Homo sapiens
caccaccugcccuccuucu

SEQ ID NO: 26566 - RNA, 20 nt, Homo sapiens
cucuuucucccucccgccuc

SEQ ID NO: 26567 - RNA, 18 nt, Homo sapiens
gccgacgaaccgacacgc

SEQ ID NO: 26568 - RNA, 19 nt, Homo sapiens
uucccaccuccucccuacc

SEQ ID NO: 26569 - RNA, 24 nt, Homo sapiens
accucugucaccaccaaagacggg

SEQ ID NO: 26570 - RNA, 18 nt, Homo sapiens
ccagggccccucuccccu

SEQ ID NO: 26571 - RNA, 22 nt, Homo sapiens
gaaaggauacuccagccggaga

SEQ ID NO: 26572 - RNA, 17 nt, Homo sapiens
ugaugcuggguguggcc

SEQ ID NO: 26573 - RNA, 18 nt, Homo sapiens
aucuuuauucauguguca

SEQ ID NO: 26574 - RNA, 20 nt, Homo sapiens
caaucuugaggugccuucug

SEQ ID NO: 26575 - RNA, 17 nt, Homo sapiens
gugaacaauggauaaca

SEQ ID NO: 26576 - RNA, 21 nt, Homo sapiens
uuauuaaccuucagccuucga

SEQ ID NO: 26577 - RNA, 17 nt, Homo sapiens
aagaaggcagcaauuca

SEQ ID NO: 26578 - RNA, 22 nt, Homo sapiens
cccgaagaagagccagaaugag

SEQ ID NO: 26579 - RNA, 20 nt, Homo sapiens
cuauuacagccugaguaaua

SEQ ID NO: 26580 - RNA, 18 nt, Homo sapiens
gcggccaaggccacggug

SEQ ID NO: 26581 - RNA, 19 nt, Homo sapiens
ggcagcaguguuuagagca

SEQ ID NO: 26582 - RNA, 21 nt, Homo sapiens
guaaaagaaacaaacuuugua

SEQ ID NO: 26583 - RNA, 20 nt, Homo sapiens
ucuuuaaccucuuuaaccuu

SEQ ID NO: 26584 - RNA, 24 nt, Homo sapiens
uugaggaaaaauuucuuaaagcaa

SEQ ID NO: 26585 - RNA, 20 nt, Homo sapiens
ccagaaagaaugagauauaa

SEQ ID NO: 26586 - RNA, 17 nt, Homo sapiens
uccuuugaaacacugga

SEQ ID NO: 26587 - RNA, 22 nt, Homo sapiens
gagccaagaucacgccacugca

SEQ ID NO: 26588 - RNA, 20 nt, Homo sapiens
ucugggcaaucauuuauuuu

SEQ ID NO: 26589 - RNA, 22 nt, Homo sapiens
ucuuggaauugggaccuuugga

SEQ ID NO: 26590 - RNA, 17 nt, Homo sapiens
ugacagagccaaacucc

SEQ ID NO: 26591 - RNA, 20 nt, Homo sapiens
ugcagaaaugaggacguuau

SEQ ID NO: 26592 - RNA, 20 nt, Homo sapiens
uuaggaaaucuaggacuucc

SEQ ID NO: 26593 - RNA, 19 nt, Homo sapiens
auccuagucuaucuagcuc

SEQ ID NO: 26594 - RNA, 19 nt, Homo sapiens
cagcacagacuucugcuaa

SEQ ID NO: 26595 - RNA, 22 nt, Homo sapiens
uaucuucucugcugucacacug

SEQ ID NO: 26596 - RNA, 19 nt, Homo sapiens
uugccuggaccaagcuacu

SEQ ID NO: 26597 - RNA, 22 nt, Homo sapiens
cugauagguggcaggccugugg

SEQ ID NO: 26598 - RNA, 18 nt, Homo sapiens
aaaaaauguuaagucaua

SEQ ID NO: 26599 - RNA, 24 nt, Homo sapiens
aguaauaacuaguuggccaacuga

SEQ ID NO: 26600 - RNA, 16 nt, Homo sapiens
ccagggacuugcccca

SEQ ID NO: 26601 - RNA, 21 nt, Homo sapiens
ugcccaggccacuggccccag

SEQ ID NO: 26602 - RNA, 19 nt, Homo sapiens
cugcaaccucugccuccca

SEQ ID NO: 26603 - RNA, 20 nt, Homo sapiens
uuuugagucagugguuuaug

SEQ ID NO: 26604 - RNA, 19 nt, Homo sapiens
cccagaccaacuccuuucc

SEQ ID NO: 26605 - RNA, 24 nt, Homo sapiens
agccagggcaggguuuugcguuca

SEQ ID NO: 26606 - RNA, 18 nt, Homo sapiens
gcuuguacaaccaaacac

SEQ ID NO: 26607 - RNA, 21 nt, Homo sapiens
ccaguauucuuuuucuuuucc

SEQ ID NO: 26608 - RNA, 19 nt, Homo sapiens
cugaccuuugggagaaaaa

SEQ ID NO: 26609 - RNA, 18 nt, Homo sapiens
gcuuuuaaaggcaaauca

SEQ ID NO: 26610 - RNA, 17 nt, Homo sapiens
guugguuauuguuuaca

SEQ ID NO: 26611 - RNA, 20 nt, Homo sapiens
uagguggaaaacauggaauu

SEQ ID NO: 26612 - RNA, 19 nt, Homo sapiens
ugagaaacaaaguggcauu

SEQ ID NO: 26613 - RNA, 18 nt, Homo sapiens
uugugguuuuugccauug

SEQ ID NO: 26614 - RNA, 20 nt, Homo sapiens
agcuggggcaggggagccca

SEQ ID NO: 26615 - RNA, 18 nt, Homo sapiens
gucuuucucuccaucucu

SEQ ID NO: 26616 - RNA, 16 nt, Homo sapiens
uucuuuauccugugaa

SEQ ID NO: 26617 - RNA, 19 nt, Homo sapiens
gccugagcccuccugccca

SEQ ID NO: 26618 - RNA, 21 nt, Homo sapiens
uccaauucagacugucaguga

SEQ ID NO: 26619 - RNA, 18 nt, Homo sapiens
uguauauuuucuacauuu

SEQ ID NO: 26620 - RNA, 19 nt, Homo sapiens
caccaagcccucuaucucc

SEQ ID NO: 26621 - RNA, 20 nt, Homo sapiens
cccuggcccccuccccguaa

SEQ ID NO: 26622 - RNA, 20 nt, Homo sapiens
gaguagacagcccccucccc

SEQ ID NO: 26623 - RNA, 16 nt, Homo sapiens
gccucagcuugcugcu

SEQ ID NO: 26624 - RNA, 19 nt, Homo sapiens
aagcaauucuccugccuca

SEQ ID NO: 26625 - RNA, 19 nt, Homo sapiens
gaaaauaucaaacauguua

SEQ ID NO: 26626 - RNA, 23 nt, Homo sapiens
gcuauuucaaaaguuacugagga

SEQ ID NO: 26627 - RNA, 25 nt, Homo sapiens
guaguuuuaauuuggguuuuaguua

SEQ ID NO: 26628 - RNA, 17 nt, Homo sapiens
uaauuaguaaauuccaa

SEQ ID NO: 26629 - RNA, 18 nt, Homo sapiens
uaauuuuauaucgcuuuu

SEQ ID NO: 26630 - RNA, 21 nt, Homo sapiens
accuggacccaggccaggccc

SEQ ID NO: 26631 - RNA, 18 nt, Homo sapiens
caccugcucucugucuca

SEQ ID NO: 26632 - RNA, 22 nt, Homo sapiens
caggaugguggagucugcccca

SEQ ID NO: 26633 - RNA, 20 nt, Homo sapiens
ccaggcacccucugcccugc

SEQ ID NO: 26634 - RNA, 20 nt, Homo sapiens
ccucauugacccgcgcugcc

SEQ ID NO: 26635 - RNA, 22 nt, Homo sapiens
gacccgcgcugccccgaccuca

SEQ ID NO: 26636 - RNA, 24 nt, Homo sapiens
ggcacccucugcccugcccggcca

SEQ ID NO: 26637 - RNA, 19 nt, Homo sapiens
cccccaugaggccuccuca

SEQ ID NO: 26638 - RNA, 18 nt, Homo sapiens
ccuggagggcagcaaugg

SEQ ID NO: 26639 - RNA, 25 nt, Homo sapiens
cucugacccccaagaggccugugag

SEQ ID NO: 26640 - RNA, 21 nt, Homo sapiens
gcccuuccuucggaccgugag

SEQ ID NO: 26641 - RNA, 22 nt, Homo sapiens
cccuucuuaacuagaccuagac

SEQ ID NO: 26642 - RNA, 20 nt, Homo sapiens
gcagagcacaccugcuguca

SEQ ID NO: 26643 - RNA, 16 nt, Homo sapiens
ggcagggcgcccggcc

SEQ ID NO: 26644 - RNA, 24 nt, Homo sapiens
caagaucagccuuccucgccaccg

SEQ ID NO: 26645 - RNA, 18 nt, Homo sapiens
aagagugauuuuugagcu

SEQ ID NO: 26646 - RNA, 24 nt, Homo sapiens
acaaauuuaaagauuauguuauua

SEQ ID NO: 26647 - RNA, 19 nt, Homo sapiens
acauuuuuacaguucucca

SEQ ID NO: 26648 - RNA, 20 nt, Homo sapiens
gaaagaugucacuagauucu

SEQ ID NO: 26649 - RNA, 20 nt, Homo sapiens
ggccaccuguaaggcaaauc

SEQ ID NO: 26650 - RNA, 22 nt, Homo sapiens
uaguuucaaaauucucaguuug

SEQ ID NO: 26651 - RNA, 21 nt, Homo sapiens
uugcuguugaaccuuuuauga

SEQ ID NO: 26652 - RNA, 24 nt, Homo sapiens
gcaaccgacuggcaucacgggaga

SEQ ID NO: 26653 - RNA, 19 nt, Homo sapiens
ugggacucggcuggagcug

SEQ ID NO: 26654 - RNA, 21 nt, Homo sapiens
gugacgcugaugguuuggggc

SEQ ID NO: 26655 - RNA, 20 nt, Homo sapiens
uguuuugaagaagagacuga

SEQ ID NO: 26656 - RNA, 20 nt, Homo sapiens
ugagugggucucaugggaac

SEQ ID NO: 26657 - RNA, 17 nt, Homo sapiens
uugcgaagguuagaaga

SEQ ID NO: 26658 - RNA, 22 nt, Homo sapiens
uaaaacauguuuauaaaguaca

SEQ ID NO: 26659 - RNA, 18 nt, Homo sapiens
ucucuacuaaaaaugcaa

SEQ ID NO: 26660 - RNA, 18 nt, Homo sapiens
uggguggaucaccugagg

SEQ ID NO: 26661 - RNA, 21 nt, Homo sapiens
cuuuuugauuauugcauugua

SEQ ID NO: 26662 - RNA, 21 nt, Homo sapiens
gucuggaucauggcauguaga

SEQ ID NO: 26663 - RNA, 16 nt, Homo sapiens
uccaacaacaacaaca

SEQ ID NO: 26664 - RNA, 25 nt, Homo sapiens
uuaugccgguauuuagaaaaaauaa

SEQ ID NO: 26665 - RNA, 19 nt, Homo sapiens
agcgcuguaaagcaccaac

SEQ ID NO: 26666 - RNA, 18 nt, Homo sapiens
caguucuaccuuuuaucu

SEQ ID NO: 26667 - RNA, 19 nt, Homo sapiens
ccugcgccaccacaaccag

SEQ ID NO: 26668 - RNA, 16 nt, Homo sapiens
cagagagcagcacuua

SEQ ID NO: 26669 - RNA, 20 nt, Homo sapiens
gcacacaacagaaccauagg

SEQ ID NO: 26670 - RNA, 20 nt, Homo sapiens
caaauucccccagcaucuca

SEQ ID NO: 26671 - RNA, 21 nt, Homo sapiens
ccucccccaacccacgcucca

SEQ ID NO: 26672 - RNA, 18 nt, Homo sapiens
ccugcaaccuccaccucc

SEQ ID NO: 26673 - RNA, 19 nt, Homo sapiens
cugcaaccuccaccuccca

SEQ ID NO: 26674 - RNA, 21 nt, Homo sapiens
gcuggaaccauuucucccgca

SEQ ID NO: 26675 - RNA, 18 nt, Homo sapiens
uccaccucccagguucaa

SEQ ID NO: 26676 - RNA, 23 nt, Homo sapiens
uccagccccucugucaccccgcc

SEQ ID NO: 26677 - RNA, 23 nt, Homo sapiens
uccauaucuguuccucuguuccu

SEQ ID NO: 26678 - RNA, 20 nt, Homo sapiens
uggccaggcuggucuugaac

SEQ ID NO: 26679 - RNA, 19 nt, Homo sapiens
caucugucugccacugaga

SEQ ID NO: 26680 - RNA, 20 nt, Homo sapiens
ccaaagugggaggcagggag

SEQ ID NO: 26681 - RNA, 23 nt, Homo sapiens
cccaauagggugggggccugugg

SEQ ID NO: 26682 - RNA, 17 nt, Homo sapiens
gccugcugagagaagcc

SEQ ID NO: 26683 - RNA, 17 nt, Homo sapiens
ucaagugauucuccugc

SEQ ID NO: 26684 - RNA, 24 nt, Homo sapiens
ucuugaaagcugggggaugugugg

SEQ ID NO: 26685 - RNA, 20 nt, Homo sapiens
uggucaggcuggucuugaac

SEQ ID NO: 26686 - RNA, 21 nt, Homo sapiens
uuugggagugugugucuguuu

SEQ ID NO: 26687 - RNA, 20 nt, Homo sapiens
ggcgccuuccgcgcaccggc

SEQ ID NO: 26688 - RNA, 18 nt, Homo sapiens
gagcaaagaacuugcaaa

SEQ ID NO: 26689 - RNA, 24 nt, Homo sapiens
gcgcagagcugggggcagccgggg

SEQ ID NO: 26690 - RNA, 18 nt, Homo sapiens
gcucuccaaagcacuuuu

SEQ ID NO: 26691 - RNA, 19 nt, Homo sapiens
uuugcuugucuuugccccu

SEQ ID NO: 26692 - RNA, 19 nt, Homo sapiens
agaaacggauuauguugaa

SEQ ID NO: 26693 - RNA, 20 nt, Homo sapiens
gaacagaaacggauuauguu

SEQ ID NO: 26694 - RNA, 19 nt, Homo sapiens
gcagcuucaaguccguuga

SEQ ID NO: 26695 - RNA, 18 nt, Homo sapiens
acacauacauacacauac

SEQ ID NO: 26696 - RNA, 20 nt, Homo sapiens
cuguugaggugcccauaaga

SEQ ID NO: 26697 - RNA, 20 nt, Homo sapiens
gccgcagcgcccggcccggg

SEQ ID NO: 26698 - RNA, 18 nt, Homo sapiens
aggauuuauaucuauuca

SEQ ID NO: 26699 - RNA, 18 nt, Homo sapiens
gacccaaagaucaugaua

SEQ ID NO: 26700 - RNA, 19 nt, Homo sapiens
ccgccaccgccuccacccc

SEQ ID NO: 26701 - RNA, 17 nt, Homo sapiens
ccgccgccccgccaccg

SEQ ID NO: 26702 - RNA, 23 nt, Homo sapiens
gcccaccaccaccuucccgguga

SEQ ID NO: 26703 - RNA, 18 nt, Homo sapiens
uucucuucaacgguuuca

SEQ ID NO: 26704 - RNA, 18 nt, Homo sapiens
ggguuuugggguuucguu

SEQ ID NO: 26705 - RNA, 19 nt, Homo sapiens
ucuggcugagagcugugga

SEQ ID NO: 26706 - RNA, 23 nt, Homo sapiens
ucaccaaagagcacucgauccug

SEQ ID NO: 26707 - RNA, 16 nt, Homo sapiens
gcauccaccucugugg

SEQ ID NO: 26708 - RNA, 17 nt, Homo sapiens
cccagaaaacagcucca

SEQ ID NO: 26709 - RNA, 20 nt, Homo sapiens
cucuggugacugccugcggg

SEQ ID NO: 26710 - RNA, 21 nt, Homo sapiens
gcccugcacccccgggaguca

SEQ ID NO: 26711 - RNA, 23 nt, Homo sapiens
gguugcagugagcaguuaucaca

SEQ ID NO: 26712 - RNA, 19 nt, Homo sapiens
ucccuaccaagccuucggc

SEQ ID NO: 26713 - RNA, 22 nt, Homo sapiens
gucaguugccgcuguugcuacu

SEQ ID NO: 26714 - RNA, 20 nt, Homo sapiens
gaguugauccaucugagaaa

SEQ ID NO: 26715 - RNA, 19 nt, Homo sapiens
auagauguauauuauuuug

SEQ ID NO: 26716 - RNA, 27 nt, Homo sapiens
aucuggacaauggggacuguuuaguuu

SEQ ID NO: 26717 - RNA, 18 nt, Homo sapiens
auucaaguggucuaaugg

SEQ ID NO: 26718 - RNA, 17 nt, Homo sapiens
cagcugcaccgugcggc

SEQ ID NO: 26719 - RNA, 19 nt, Homo sapiens
cauguaaggacgugucagg

SEQ ID NO: 26720 - RNA, 19 nt, Homo sapiens
ccaaggaacccggcuaccc

SEQ ID NO: 26721 - RNA, 27 nt, Homo sapiens
cucuaccauggccgacuccucuguaaa

SEQ ID NO: 26722 - RNA, 19 nt, Homo sapiens
ccgcccuacuuccaccucc

SEQ ID NO: 26723 - RNA, 18 nt, Homo sapiens
cauucugaggucauuuuu

SEQ ID NO: 26724 - RNA, 18 nt, Homo sapiens
gacaggaccuagaucuaa

SEQ ID NO: 26725 - RNA, 20 nt, Homo sapiens
gcggcugucccugugugaca

SEQ ID NO: 26726 - RNA, 24 nt, Homo sapiens
cuaauaacaucuugaguuauuuuu

SEQ ID NO: 26727 - RNA, 18 nt, Homo sapiens
aggagugauguuggaaua

SEQ ID NO: 26728 - RNA, 22 nt, Homo sapiens
gagccaagacugugccacugca

SEQ ID NO: 26729 - RNA, 24 nt, Homo sapiens
gcuugaagcaaagaccucugguuu

SEQ ID NO: 26730 - RNA, 19 nt, Homo sapiens
uggguggaucacuugaggc

SEQ ID NO: 26731 - RNA, 17 nt, Homo sapiens
ccuccaacuugacauca

SEQ ID NO: 26732 - RNA, 19 nt, Homo sapiens
gccucuggcccaggaguua

SEQ ID NO: 26733 - RNA, 22 nt, Homo sapiens
ggcccgcggguaaccaccuccu

SEQ ID NO: 26734 - RNA, 18 nt, Homo sapiens
ucacaggccuugccaucu

SEQ ID NO: 26735 - RNA, 21 nt, Homo sapiens
agguguuuuuggaugagacua

SEQ ID NO: 26736 - RNA, 20 nt, Homo sapiens
aagauucacaaugauauggu

SEQ ID NO: 26737 - RNA, 24 nt, Homo sapiens
acaucugauuuguuuaucaccuua

SEQ ID NO: 26738 - RNA, 18 nt, Homo sapiens
cauauguauguauuuaua

SEQ ID NO: 26739 - RNA, 20 nt, Homo sapiens
gcuuuaguuuuaacaacagu

SEQ ID NO: 26740 - RNA, 23 nt, Homo sapiens
ucuuuucaccaaacccugacuuu

SEQ ID NO: 26741 - RNA, 24 nt, Homo sapiens
cccuggugacaccuggaccuugga

SEQ ID NO: 26742 - RNA, 20 nt, Homo sapiens
gaguuggacacaagauccaa

SEQ ID NO: 26743 - RNA, 22 nt, Homo sapiens
ggcagaggccucaggaaccagc

SEQ ID NO: 26744 - RNA, 23 nt, Homo sapiens
ugggugggcccugauccaagcug

SEQ ID NO: 26745 - RNA, 28 nt, Homo sapiens
uuaugcccucuguuucgauaggaagcug

SEQ ID NO: 26746 - RNA, 17 nt, Homo sapiens
agaaaugaaccaccgca

SEQ ID NO: 26747 - RNA, 26 nt, Homo sapiens
agaccagcgcccgaaggccgacacgc

SEQ ID NO: 26748 - RNA, 21 nt, Homo sapiens
ccuggcacacagcaggagcca

SEQ ID NO: 26749 - RNA, 19 nt, Homo sapiens
gguuauccagaugaggcua

SEQ ID NO: 26750 - RNA, 18 nt, Homo sapiens
agaauaaauuauauuuca

SEQ ID NO: 26751 - RNA, 20 nt, Homo sapiens
auuauguacauuacuggguu

SEQ ID NO: 26752 - RNA, 26 nt, Homo sapiens
ccuaaugugaaguuuuaaucacuuuu

SEQ ID NO: 26753 - RNA, 22 nt, Homo sapiens
uguugcccaggcugucuuugaa

SEQ ID NO: 26754 - RNA, 17 nt, Homo sapiens
gaaccgaggcgcaggga

SEQ ID NO: 26755 - RNA, 25 nt, Homo sapiens
gugggaucgguuaucggugcgcucu

SEQ ID NO: 26756 - RNA, 24 nt, Homo sapiens
cugcacccaucaaccugucaccua

SEQ ID NO: 26757 - RNA, 19 nt, Homo sapiens
aggaauacagcauccuucu

SEQ ID NO: 26758 - RNA, 18 nt, Homo sapiens
ccuaaggaauacuacaca

SEQ ID NO: 26759 - RNA, 17 nt, Homo sapiens
gcaggaccuuuguaggu

SEQ ID NO: 26760 - RNA, 20 nt, Homo sapiens
uuuuuguguguuuuaaucuu

SEQ ID NO: 26761 - RNA, 18 nt, Homo sapiens
uccggccugaaugaucuc

SEQ ID NO: 26762 - RNA, 19 nt, Homo sapiens
uccccacgggccugcagca

SEQ ID NO: 26763 - RNA, 18 nt, Homo sapiens
ggggcagaaccccucuua

SEQ ID NO: 26764 - RNA, 25 nt, Homo sapiens
ggccgucccaaaagcggccgcuucc

SEQ ID NO: 26765 - RNA, 21 nt, Homo sapiens
aaaugucaagaagaacaucca

SEQ ID NO: 26766 - RNA, 17 nt, Homo sapiens
aacugggugucuguaca

SEQ ID NO: 26767 - RNA, 18 nt, Homo sapiens
auguuuaacggugccaac

SEQ ID NO: 26768 - RNA, 19 nt, Homo sapiens
cgaggacagucuugaaaua

SEQ ID NO: 26769 - RNA, 17 nt, Homo sapiens
gcacuaucuaucuuucu

SEQ ID NO: 26770 - RNA, 19 nt, Homo sapiens
gccguucugugcuuuuccg

SEQ ID NO: 26771 - RNA, 20 nt, Homo sapiens
uaguuuugugacuuaauuac

SEQ ID NO: 26772 - RNA, 20 nt, Homo sapiens
uuuaugucaacaauauuaau

SEQ ID NO: 26773 - RNA, 21 nt, Homo sapiens
cccaccuccaacaccuccuga

SEQ ID NO: 26774 - RNA, 26 nt, Homo sapiens
ccccauuucuagaacaucccugccag

SEQ ID NO: 26775 - RNA, 24 nt, Homo sapiens
cccuugcaguucugggaacuggac

SEQ ID NO: 26776 - RNA, 23 nt, Homo sapiens
gggaaguguaagaaacacacuga

SEQ ID NO: 26777 - RNA, 21 nt, Homo sapiens
ggggaaggaggcuggcuuguc

SEQ ID NO: 26778 - RNA, 22 nt, Homo sapiens
uccaggggaugggagguugugg

SEQ ID NO: 26779 - RNA, 25 nt, Homo sapiens
uggaugcuccuuccaacaggagcug

SEQ ID NO: 26780 - RNA, 25 nt, Homo sapiens
ccugugguacucaugcuguuccacu

SEQ ID NO: 26781 - RNA, 21 nt, Homo sapiens
cggugaaaccccaucuccacu

SEQ ID NO: 26782 - RNA, 18 nt, Homo sapiens
uggguggaucaccugagg

SEQ ID NO: 26783 - RNA, 18 nt, Homo sapiens
aaaugguuagugcuauug

SEQ ID NO: 26784 - RNA, 18 nt, Homo sapiens
aagcaguucaaguugaca

SEQ ID NO: 26785 - RNA, 19 nt, Homo sapiens
aauaacaacaagaauauca

SEQ ID NO: 26786 - RNA, 22 nt, Homo sapiens
accaaaaaauugcaauuuguuu

SEQ ID NO: 26787 - RNA, 24 nt, Homo sapiens
agaaauaaagcuguaucugccauu

SEQ ID NO: 26788 - RNA, 20 nt, Homo sapiens
caaccuauuucucuacucuu

SEQ ID NO: 26789 - RNA, 21 nt, Homo sapiens
caagggguauuagcccaguua

SEQ ID NO: 26790 - RNA, 16 nt, Homo sapiens
ccgggaaaacauggga

SEQ ID NO: 26791 - RNA, 20 nt, Homo sapiens
gcauacugguuuuccaggug

SEQ ID NO: 26792 - RNA, 19 nt, Homo sapiens
guauuuuuuguuguuuuua

SEQ ID NO: 26793 - RNA, 20 nt, Homo sapiens
ucaaacagaauuuuaaggaa

SEQ ID NO: 26794 - RNA, 22 nt, Homo sapiens
uccucugugauaucauacagca

SEQ ID NO: 26795 - RNA, 19 nt, Homo sapiens
uucugauuaucagauuugu

SEQ ID NO: 26796 - RNA, 21 nt, Homo sapiens
uuguuugugucucucugcugu

SEQ ID NO: 26797 - RNA, 19 nt, Homo sapiens
uuucuuacacuaaccguca

SEQ ID NO: 26798 - RNA, 18 nt, Homo sapiens
aaaugguuagugcuauug

SEQ ID NO: 26799 - RNA, 18 nt, Homo sapiens
aagcaguucaaguugaca

SEQ ID NO: 26800 - RNA, 19 nt, Homo sapiens
aauaacaacaagaauauca

SEQ ID NO: 26801 - RNA, 22 nt, Homo sapiens
accaaaaaauugcaauuuguuu

SEQ ID NO: 26802 - RNA, 24 nt, Homo sapiens
agaaauaaagcuguaucugccauu

SEQ ID NO: 26803 - RNA, 20 nt, Homo sapiens
caaccuauuucucuacucuu

SEQ ID NO: 26804 - RNA, 21 nt, Homo sapiens
caagggguauuagcccaguua

SEQ ID NO: 26805 - RNA, 16 nt, Homo sapiens
ccgggaaaacauggga

SEQ ID NO: 26806 - RNA, 20 nt, Homo sapiens
gcauacugguuuuccaggug

SEQ ID NO: 26807 - RNA, 19 nt, Homo sapiens
guauuuuuuguuguuuuua

SEQ ID NO: 26808 - RNA, 20 nt, Homo sapiens
ucaaacagaauuuuaaggaa

SEQ ID NO: 26809 - RNA, 22 nt, Homo sapiens
uccucugugauaucauacagca

SEQ ID NO: 26810 - RNA, 19 nt, Homo sapiens
uucugauuaucagauuugu

SEQ ID NO: 26811 - RNA, 21 nt, Homo sapiens
uuguuugugucucucugcugu

SEQ ID NO: 26812 - RNA, 19 nt, Homo sapiens
uuucuuacacuaaccguca

SEQ ID NO: 26813 - RNA, 25 nt, Homo sapiens
ccugugguacucaugcuguuccacu

SEQ ID NO: 26814 - RNA, 21 nt, Homo sapiens
uggugaaaccccaucuccacu

SEQ ID NO: 26815 - RNA, 25 nt, Homo sapiens
ccugugguacucaugcuguuccacu

SEQ ID NO: 26816 - RNA, 21 nt, Homo sapiens
uggugaaaccccaucuccacu

SEQ ID NO: 26817 - RNA, 18 nt, Homo sapiens
aaaugguuagugcuauug

SEQ ID NO: 26818 - RNA, 18 nt, Homo sapiens
aagcaguucaaguugaca

SEQ ID NO: 26819 - RNA, 19 nt, Homo sapiens
aauaacaacaagaauauca

SEQ ID NO: 26820 - RNA, 22 nt, Homo sapiens
accaaaaaauugcaauuuguuu

SEQ ID NO: 26821 - RNA, 24 nt, Homo sapiens
agaaauaaaacuguaucugacauu

SEQ ID NO: 26822 - RNA, 20 nt, Homo sapiens
caaccuauuucucuacucuu

SEQ ID NO: 26823 - RNA, 21 nt, Homo sapiens
caagggguauuagcccaguua

SEQ ID NO: 26824 - RNA, 20 nt, Homo sapiens
gcauacugguuuuccaggug

SEQ ID NO: 26825 - RNA, 19 nt, Homo sapiens
guauuuuuuguuguuuuua

SEQ ID NO: 26826 - RNA, 20 nt, Homo sapiens
ucaaacagaauuuuaaggaa

SEQ ID NO: 26827 - RNA, 24 nt, Homo sapiens
uccucauaucuggaaacuugugaa

SEQ ID NO: 26828 - RNA, 22 nt, Homo sapiens
uccucugugauaucauacagca

SEQ ID NO: 26829 - RNA, 19 nt, Homo sapiens
uucugauuaucagauuugu

SEQ ID NO: 26830 - RNA, 21 nt, Homo sapiens
uuguuugugucucucugcugu

SEQ ID NO: 26831 - RNA, 19 nt, Homo sapiens
uuucuuacacuaaccguca

SEQ ID NO: 26832 - RNA, 17 nt, Homo sapiens
aaaaugucaaggaauga

SEQ ID NO: 26833 - RNA, 19 nt, Homo sapiens
uauugccucuuucacauug

SEQ ID NO: 26834 - RNA, 24 nt, Homo sapiens
uucugacccaugggagauuuggag

SEQ ID NO: 26835 - RNA, 17 nt, Homo sapiens
aaaaugucaaggaauga

SEQ ID NO: 26836 - RNA, 19 nt, Homo sapiens
uauugccucuuucacauug

SEQ ID NO: 26837 - RNA, 24 nt, Homo sapiens
aaguuguugaucagacccuucucu

SEQ ID NO: 26838 - RNA, 18 nt, Homo sapiens
cacucagaagcuaaccuc

SEQ ID NO: 26839 - RNA, 20 nt, Homo sapiens
cugaaccuguggucaggcuc

SEQ ID NO: 26840 - RNA, 17 nt, Homo sapiens
gggagacgagaggguca

SEQ ID NO: 26841 - RNA, 18 nt, Homo sapiens
uucaaguuguugaucaga

SEQ ID NO: 26842 - RNA, 24 nt, Homo sapiens
aaguuguugaucagacccuucucu

SEQ ID NO: 26843 - RNA, 18 nt, Homo sapiens
cacucagaagcuaaccuc

SEQ ID NO: 26844 - RNA, 20 nt, Homo sapiens
cugaaccuguggucaggcuc

SEQ ID NO: 26845 - RNA, 17 nt, Homo sapiens
gggagacgagaggguca

SEQ ID NO: 26846 - RNA, 18 nt, Homo sapiens
uucaaguuguugaucaga

SEQ ID NO: 26847 - RNA, 24 nt, Homo sapiens
aaguuguugaucagacccuucucu

SEQ ID NO: 26848 - RNA, 18 nt, Homo sapiens
cacucagaagcuaaccuc

SEQ ID NO: 26849 - RNA, 20 nt, Homo sapiens
cugaaccuguggucaggcuc

SEQ ID NO: 26850 - RNA, 17 nt, Homo sapiens
gggagacgagaggguca

SEQ ID NO: 26851 - RNA, 18 nt, Homo sapiens
uucaaguuguugaucaga

SEQ ID NO: 26852 - RNA, 19 nt, Homo sapiens
auguuauuguuuucaaccu

SEQ ID NO: 26853 - RNA, 17 nt, Homo sapiens
gugaaguuguaaacaca

SEQ ID NO: 26854 - RNA, 18 nt, Homo sapiens
uccccaucauccacgcca

SEQ ID NO: 26855 - RNA, 18 nt, Homo sapiens
uccugaccucaugaucca

SEQ ID NO: 26856 - RNA, 18 nt, Homo sapiens
uucuccugccucagccuu

SEQ ID NO: 26857 - RNA, 19 nt, Homo sapiens
auguuauuguuuucaaccu

SEQ ID NO: 26858 - RNA, 17 nt, Homo sapiens
gugaaguuguaaacaca

SEQ ID NO: 26859 - RNA, 18 nt, Homo sapiens
uccccaucauccacgcca

SEQ ID NO: 26860 - RNA, 18 nt, Homo sapiens
uccugaccucaugaucca

SEQ ID NO: 26861 - RNA, 18 nt, Homo sapiens
uucuccugccucagccuu

SEQ ID NO: 26862 - RNA, 19 nt, Homo sapiens
auguuauuguuuucaaccu

SEQ ID NO: 26863 - RNA, 17 nt, Homo sapiens
gugaaguuguaaacaca

SEQ ID NO: 26864 - RNA, 18 nt, Homo sapiens
uccccaucauccacgcca

SEQ ID NO: 26865 - RNA, 18 nt, Homo sapiens
uccugaccucaugaucca

SEQ ID NO: 26866 - RNA, 18 nt, Homo sapiens
uucuccugccucagccuu

SEQ ID NO: 26867 - RNA, 18 nt, Homo sapiens
gagaaugugauuuuuggc

SEQ ID NO: 26868 - RNA, 22 nt, Homo sapiens
gccgcgccgugccgccuggccc

SEQ ID NO: 26869 - RNA, 25 nt, Homo sapiens
gcgggaggaugggggcuacaccuuc

SEQ ID NO: 26870 - RNA, 20 nt, Homo sapiens
gucuggcuggccaacgggga

SEQ ID NO: 26871 - RNA, 18 nt, Homo sapiens
uccaacgagagcacccgc

SEQ ID NO: 26872 - RNA, 17 nt, Homo sapiens
gaaccacuaugaagcua

SEQ ID NO: 26873 - RNA, 20 nt, Homo sapiens
ucuguauugaaaauggcuuu

SEQ ID NO: 26874 - RNA, 23 nt, Homo sapiens
gcuugggcacagugcccuggcuc

SEQ ID NO: 26875 - RNA, 19 nt, Homo sapiens
ugucucucccuguucagcu

SEQ ID NO: 26876 - RNA, 19 nt, Homo sapiens
ucaguuguguauuuguuca

SEQ ID NO: 26877 - RNA, 20 nt, Homo sapiens
uccuagaaaaggucagaccc

SEQ ID NO: 26878 - RNA, 17 nt, Homo sapiens
caucacccaccucugga

SEQ ID NO: 26879 - RNA, 16 nt, Homo sapiens
cccaccccucccugca

SEQ ID NO: 26880 - RNA, 17 nt, Homo sapiens
gcccucagcagaacuuc

SEQ ID NO: 26881 - RNA, 20 nt, Homo sapiens
gguggauggagaagagguug

SEQ ID NO: 26882 - RNA, 21 nt, Homo sapiens
uugaaaauuaaucgccacccu

SEQ ID NO: 26883 - RNA, 25 nt, Homo sapiens
ccacuuuuacuuuucguccaaauaa

SEQ ID NO: 26884 - RNA, 21 nt, Homo sapiens
cuacaagaagcuaggcucugu

SEQ ID NO: 26885 - RNA, 21 nt, Homo sapiens
cugugaauuaaagagcagagu

SEQ ID NO: 26886 - RNA, 20 nt, Homo sapiens
gccucugucccccagugauc

SEQ ID NO: 26887 - RNA, 25 nt, Homo sapiens
ccacuuuuacuuuucguccaaauaa

SEQ ID NO: 26888 - RNA, 21 nt, Homo sapiens
cuacaagaagcuaggcucugu

SEQ ID NO: 26889 - RNA, 21 nt, Homo sapiens
cugugaauuaaagagcagagu

SEQ ID NO: 26890 - RNA, 20 nt, Homo sapiens
gccucugucccccagugauc

SEQ ID NO: 26891 - RNA, 21 nt, Homo sapiens
aaggaauaagaaguuaccuac

SEQ ID NO: 26892 - RNA, 21 nt, Homo sapiens
aaggaauaagaaguuaccuac

SEQ ID NO: 26893 - RNA, 25 nt, Homo sapiens
aaggagacuccacccugggguccca

SEQ ID NO: 26894 - RNA, 18 nt, Homo sapiens
ugcagauuucuugcugcu

SEQ ID NO: 26895 - RNA, 25 nt, Homo sapiens
aaggagacuccacccugggguccca

SEQ ID NO: 26896 - RNA, 18 nt, Homo sapiens
ugcagauuucuugcugcu

SEQ ID NO: 26897 - RNA, 23 nt, Homo sapiens
guuuuuacuuucuguugccacaa

SEQ ID NO: 26898 - RNA, 26 nt, Homo sapiens
ggauguuggccaccaggugccuuuca

SEQ ID NO: 26899 - RNA, 18 nt, Homo sapiens
gugcacacuaccuuccca

SEQ ID NO: 26900 - RNA, 17 nt, Homo sapiens
ucacuuguaccccacua

SEQ ID NO: 26901 - RNA, 20 nt, Homo sapiens
aucccgcaguauaggcuuaa

SEQ ID NO: 26902 - RNA, 26 nt, Homo sapiens
ccgcaguauaggcuuaagucacuuuu

SEQ ID NO: 26903 - RNA, 24 nt, Homo sapiens
gaaaauugugggaauccccccuca

SEQ ID NO: 26904 - RNA, 23 nt, Homo sapiens
guagaagaaacagaguuuuuguu

SEQ ID NO: 26905 - RNA, 19 nt, Homo sapiens
ucugccuauguugcacucu

SEQ ID NO: 26906 - RNA, 23 nt, Homo sapiens
cagccagggguccagagcuagcc

SEQ ID NO: 26907 - RNA, 22 nt, Homo sapiens
cucuuucucuccugcagucccg

SEQ ID NO: 26908 - RNA, 21 nt, Homo sapiens
cugccugccccaccugccuca

SEQ ID NO: 26909 - RNA, 16 nt, Homo sapiens
gacggguccuuuggua

SEQ ID NO: 26910 - RNA, 19 nt, Homo sapiens
gccucuccucgaaaaguca

SEQ ID NO: 26911 - RNA, 23 nt, Homo sapiens
ugccuuccuccccaagcaccuca

SEQ ID NO: 26912 - RNA, 23 nt, Homo sapiens
cagccagggguccagagcuagcc

SEQ ID NO: 26913 - RNA, 22 nt, Homo sapiens
cucuuucucuccugcagucccg

SEQ ID NO: 26914 - RNA, 21 nt, Homo sapiens
cugccugccccaccugccuca

SEQ ID NO: 26915 - RNA, 21 nt, Homo sapiens
agcuuugagcacugcacuguu

SEQ ID NO: 26916 - RNA, 21 nt, Homo sapiens
aacaggaagcccagagagggc

SEQ ID NO: 26917 - RNA, 19 nt, Homo sapiens
acccacagcuugcucuucu

SEQ ID NO: 26918 - RNA, 22 nt, Homo sapiens
aucuaugucugcugccuggcuc

SEQ ID NO: 26919 - RNA, 18 nt, Homo sapiens
ccugcccccuccacuucc

SEQ ID NO: 26920 - RNA, 22 nt, Homo sapiens
gcgcagagcgaggggcggcugg

SEQ ID NO: 26921 - RNA, 18 nt, Homo sapiens
uccagaacaagucccucc

SEQ ID NO: 26922 - RNA, 21 nt, Homo sapiens
gccacugcugcuggcggauuu

SEQ ID NO: 26923 - RNA, 25 nt, Homo sapiens
acaggcucacacugcccuuacuuua

SEQ ID NO: 26924 - RNA, 22 nt, Homo sapiens
uagauggaggaggugugggcug

SEQ ID NO: 26925 - RNA, 21 nt, Homo sapiens
uuugggcaguagauuuacuuu

SEQ ID NO: 26926 - RNA, 19 nt, Homo sapiens
aagcaauucuccugccuca

SEQ ID NO: 26927 - RNA, 16 nt, Homo sapiens
uuugggacaaaacugu

SEQ ID NO: 26928 - RNA, 19 nt, Homo sapiens
acuaaaaauuuacaagaga

SEQ ID NO: 26929 - RNA, 24 nt, Homo sapiens
ugggaagaguuuagugugaaacug

SEQ ID NO: 26930 - RNA, 21 nt, Homo sapiens
ccuccugguggccuugccgcc

SEQ ID NO: 26931 - RNA, 21 nt, Homo sapiens
ccuuggcgcuggaccagugag

SEQ ID NO: 26932 - RNA, 21 nt, Homo sapiens
ugagaucacuucaccgugguc

SEQ ID NO: 26933 - RNA, 23 nt, Homo sapiens
aaaacaaagggcaugcccaaagc

SEQ ID NO: 26934 - RNA, 18 nt, Homo sapiens
ccuccaauguggacauuu

SEQ ID NO: 26935 - RNA, 16 nt, Homo sapiens
gucuguggaacugaga

SEQ ID NO: 26936 - RNA, 16 nt, Homo sapiens
uuugggacaaaacugu

SEQ ID NO: 26937 - RNA, 16 nt, Homo sapiens
uuugggacaaaacugu

SEQ ID NO: 26938 - RNA, 23 nt, Homo sapiens
aguacuuuccagccuguguuuca

SEQ ID NO: 26939 - RNA, 21 nt, Homo sapiens
auccuuggcacuacuacaaug

SEQ ID NO: 26940 - RNA, 22 nt, Homo sapiens
caagcgccccagcaggcacugu

SEQ ID NO: 26941 - RNA, 25 nt, Homo sapiens
caccucuacuucuguucuucccuca

SEQ ID NO: 26942 - RNA, 18 nt, Homo sapiens
cacugacuagaaucugga

SEQ ID NO: 26943 - RNA, 23 nt, Homo sapiens
cccggcaagggcaggaauuggga

SEQ ID NO: 26944 - RNA, 19 nt, Homo sapiens
cuccccuuccucugcuccu

SEQ ID NO: 26945 - RNA, 18 nt, Homo sapiens
ugaagagacaauucaggg

SEQ ID NO: 26946 - RNA, 21 nt, Homo sapiens
uggaggagaccccgccagugg

SEQ ID NO: 26947 - RNA, 17 nt, Homo sapiens
cccgcccagccagagcu

SEQ ID NO: 26948 - RNA, 20 nt, Homo sapiens
caugcacuggaaugcgggga

SEQ ID NO: 26949 - RNA, 21 nt, Homo sapiens
ccuacccccaacuuuccccua

SEQ ID NO: 26950 - RNA, 17 nt, Homo sapiens
ccugguuucccaucucu

SEQ ID NO: 26951 - RNA, 25 nt, Homo sapiens
cuggucauugggcugaucauugcca

SEQ ID NO: 26952 - RNA, 21 nt, Homo sapiens
gcgguuucccaagccuuuguc

SEQ ID NO: 26953 - RNA, 18 nt, Homo sapiens
uaauuccaaaugcuguua

SEQ ID NO: 26954 - RNA, 20 nt, Homo sapiens
uugccaucacagagacacag

SEQ ID NO: 26955 - RNA, 24 nt, Homo sapiens
aaacauuauaauuaaauuucugaa

SEQ ID NO: 26956 - RNA, 16 nt, Homo sapiens
acaaaaguaggcuaga

SEQ ID NO: 26957 - RNA, 19 nt, Homo sapiens
caagaaaaucacaacuuga

SEQ ID NO: 26958 - RNA, 25 nt, Homo sapiens
gaaacuauagaaccaaaaaauaaca

SEQ ID NO: 26959 - RNA, 21 nt, Homo sapiens
ugaagaaauuaagaaaaccua

SEQ ID NO: 26960 - RNA, 22 nt, Homo sapiens
guaaauuacaccugcagugcaa

SEQ ID NO: 26961 - RNA, 18 nt, Homo sapiens
aaagauauuugaaauuuc

SEQ ID NO: 26962 - RNA, 20 nt, Homo sapiens
cuaucauguuaauacuauua

SEQ ID NO: 26963 - RNA, 19 nt, Homo sapiens
accuuggcugacuuggcuc

SEQ ID NO: 26964 - RNA, 19 nt, Homo sapiens
ccggggcugaagccacaca

SEQ ID NO: 26965 - RNA, 19 nt, Homo sapiens
gcccccaucuuggggguca

SEQ ID NO: 26966 - RNA, 15 nt, Homo sapiens
uccugcuagcaccuc

SEQ ID NO: 26967 - RNA, 23 nt, Homo sapiens
aggagaaacggcucuacagguca

SEQ ID NO: 26968 - RNA, 20 nt, Homo sapiens
auuuaucgaauuaucacgca

SEQ ID NO: 26969 - RNA, 21 nt, Homo sapiens
ugagaugguuuuugucaaaga

SEQ ID NO: 26970 - RNA, 21 nt, Homo sapiens
ucaugguaacuacugaaccua

SEQ ID NO: 26971 - RNA, 19 nt, Homo sapiens
ugguccuaguuuugugcac

SEQ ID NO: 26972 - RNA, 18 nt, Homo sapiens
ucugaaggcaaaccaggu

SEQ ID NO: 26973 - RNA, 17 nt, Homo sapiens
ccccaaccccaagacca

SEQ ID NO: 26974 - RNA, 21 nt, Homo sapiens
ggcggggcgccccaagagccc

SEQ ID NO: 26975 - RNA, 22 nt, Homo sapiens
gggagguuuggggggcaucaac

SEQ ID NO: 26976 - RNA, 18 nt, Homo sapiens
aacacaaggugggcaggg

SEQ ID NO: 26977 - RNA, 24 nt, Homo sapiens
cucugagaaggggaggaccucugg

SEQ ID NO: 26978 - RNA, 23 nt, Homo sapiens
ugggccuccucuaacaggggcug

SEQ ID NO: 26979 - RNA, 22 nt, Homo sapiens
auuugauaggauccauaucuaa

SEQ ID NO: 26980 - RNA, 19 nt, Homo sapiens
auuuuuucuuauugccuug

SEQ ID NO: 26981 - RNA, 21 nt, Homo sapiens
ccaaacuacaccaauuaauuu

SEQ ID NO: 26982 - RNA, 18 nt, Homo sapiens
gcccuaucugcacuuuuu

SEQ ID NO: 26983 - RNA, 17 nt, Homo sapiens
guugucaauugugguaa

SEQ ID NO: 26984 - RNA, 20 nt, Homo sapiens
ucuauuguucaauucucuaa

SEQ ID NO: 26985 - RNA, 22 nt, Homo sapiens
uggccguacaaauuacauuuca

SEQ ID NO: 26986 - RNA, 24 nt, Homo sapiens
aaagaaauccccccuucagaacag

SEQ ID NO: 26987 - RNA, 20 nt, Homo sapiens
cugggucuggguuuggaucu

SEQ ID NO: 26988 - RNA, 24 nt, Homo sapiens
aaagaaauccccccuucagaacag

SEQ ID NO: 26989 - RNA, 20 nt, Homo sapiens
cugggucuggguuuggaucu

SEQ ID NO: 26990 - RNA, 19 nt, Homo sapiens
aaaaucaucaucacuauaa

SEQ ID NO: 26991 - RNA, 24 nt, Homo sapiens
aucaauauguuuucaaugccugau

SEQ ID NO: 26992 - RNA, 21 nt, Homo sapiens
gguuguuuuguggauuucuuu

SEQ ID NO: 26993 - RNA, 19 nt, Homo sapiens
ccaggcaggggacgcacca

SEQ ID NO: 26994 - RNA, 21 nt, Homo sapiens
ccuccugguggccuugacgcc

SEQ ID NO: 26995 - RNA, 17 nt, Homo sapiens
aaauagcuauaauaccu

SEQ ID NO: 26996 - RNA, 22 nt, Homo sapiens
acuaguaaacauauguuccuaa

SEQ ID NO: 26997 - RNA, 23 nt, Homo sapiens
aucaaugguuuaacaguuaucca

SEQ ID NO: 26998 - RNA, 20 nt, Homo sapiens
caauccaacuguacuggcca

SEQ ID NO: 26999 - RNA, 19 nt, Homo sapiens
cacaugcacacaugugcca

SEQ ID NO: 27000 - RNA, 18 nt, Homo sapiens
caucaguauaguguuuua

SEQ ID NO: 27001 - RNA, 20 nt, Homo sapiens
cugcacccaccaaccuguca

SEQ ID NO: 27002 - RNA, 19 nt, Homo sapiens
gucugucacacaugcacac

SEQ ID NO: 27003 - RNA, 20 nt, Homo sapiens
uaugacucucugcuauccca

SEQ ID NO: 27004 - RNA, 23 nt, Homo sapiens
ucugcauugagcauauuuucuua

SEQ ID NO: 27005 - RNA, 17 nt, Homo sapiens
aaaaacaaacaaacaaa

SEQ ID NO: 27006 - RNA, 18 nt, Homo sapiens
aauuccagucugugcauc

SEQ ID NO: 27007 - RNA, 18 nt, Homo sapiens
aauuccagucugugcauc

SEQ ID NO: 27008 - RNA, 19 nt, Homo sapiens
aaaaucaucaucacuauaa

SEQ ID NO: 27009 - RNA, 24 nt, Homo sapiens
aucaauauguuuucaaugccugau

SEQ ID NO: 27010 - RNA, 21 nt, Homo sapiens
gguuguuuuguggauuucuuu

SEQ ID NO: 27011 - RNA, 17 nt, Homo sapiens
acacaccacuuuccuga

SEQ ID NO: 27012 - RNA, 17 nt, Homo sapiens
cugggugcugcuggccu

SEQ ID NO: 27013 - RNA, 23 nt, Homo sapiens
gaaacacaucaaaauaaauaaug

SEQ ID NO: 27014 - RNA, 23 nt, Homo sapiens
ucuggcgucugacccuucagugc

SEQ ID NO: 27015 - RNA, 19 nt, Homo sapiens
aaagaaauuaauaggacca

SEQ ID NO: 27016 - RNA, 17 nt, Homo sapiens
aagaaauuaauaggacc

SEQ ID NO: 27017 - RNA, 18 nt, Homo sapiens
auuuuaccuguuuuuggu

SEQ ID NO: 27018 - RNA, 19 nt, Homo sapiens
aaagaaauuaauaggacca

SEQ ID NO: 27019 - RNA, 17 nt, Homo sapiens
aagaaauuaauaggacc

SEQ ID NO: 27020 - RNA, 18 nt, Homo sapiens
auuuuaccuguuuuuggu

SEQ ID NO: 27021 - RNA, 15 nt, Homo sapiens
agagggggcgggaca

SEQ ID NO: 27022 - RNA, 20 nt, Homo sapiens
caugaagucacugauuaguu

SEQ ID NO: 27023 - RNA, 18 nt, Homo sapiens
gucccuuguuuuugauca

SEQ ID NO: 27024 - RNA, 17 nt, Homo sapiens
ucgacuugaaccacucc

SEQ ID NO: 27025 - RNA, 15 nt, Homo sapiens
agagggggcgggaca

SEQ ID NO: 27026 - RNA, 19 nt, Homo sapiens
agccacacuccuggcaucc

SEQ ID NO: 27027 - RNA, 20 nt, Homo sapiens
caugaagucacugauuaguu

SEQ ID NO: 27028 - RNA, 18 nt, Homo sapiens
gucccuuguuuuugauca

SEQ ID NO: 27029 - RNA, 17 nt, Homo sapiens
ucgacuugaaccacucc

SEQ ID NO: 27030 - RNA, 15 nt, Homo sapiens
agagggggcgggaca

SEQ ID NO: 27031 - RNA, 19 nt, Homo sapiens
agccacacuccuggcaucc

SEQ ID NO: 27032 - RNA, 20 nt, Homo sapiens
caugaagucacugauuaguu

SEQ ID NO: 27033 - RNA, 18 nt, Homo sapiens
gucccuuguuuuugauca

SEQ ID NO: 27034 - RNA, 17 nt, Homo sapiens
ucgacuugaaccacucc

SEQ ID NO: 27035 - RNA, 15 nt, Homo sapiens
agagggggcgggaca

SEQ ID NO: 27036 - RNA, 19 nt, Homo sapiens
agccacacuccuggcaucc

SEQ ID NO: 27037 - RNA, 20 nt, Homo sapiens
caugaagucacugauuaguu

SEQ ID NO: 27038 - RNA, 18 nt, Homo sapiens
gucccuuguuuuugauca

SEQ ID NO: 27039 - RNA, 17 nt, Homo sapiens
ucgacuugaaccacucc

SEQ ID NO: 27040 - RNA, 20 nt, Homo sapiens
cgcaugcgucuucgugccgu

SEQ ID NO: 27041 - RNA, 21 nt, Homo sapiens
gguagauggggagcaggauug

SEQ ID NO: 27042 - RNA, 18 nt, Homo sapiens
ggugggguuagguuccca

SEQ ID NO: 27043 - RNA, 23 nt, Homo sapiens
uagauggguaccaggugggguua

SEQ ID NO: 27044 - RNA, 21 nt, Homo sapiens
ugcucccagucucucgcucug

SEQ ID NO: 27045 - RNA, 21 nt, Homo sapiens
ccuccugguggccuugccgcc

SEQ ID NO: 27046 - RNA, 21 nt, Homo sapiens
ccuuggcgcuggaccagugag

SEQ ID NO: 27047 - RNA, 19 nt, Homo sapiens
cagggaagcaccuggcuca

SEQ ID NO: 27048 - RNA, 21 nt, Homo sapiens
ccuuccuccuaccucuuccca

SEQ ID NO: 27049 - RNA, 17 nt, Homo sapiens
cuggcucaaucauguca

SEQ ID NO: 27050 - RNA, 18 nt, Homo sapiens
gugguguuggcccauuga

SEQ ID NO: 27051 - RNA, 15 nt, Homo sapiens
ugggguccuuagauc

SEQ ID NO: 27052 - RNA, 19 nt, Homo sapiens
caauuugagcaccauucuc

SEQ ID NO: 27053 - RNA, 22 nt, Homo sapiens
gcaagagccagacaggacuuug

SEQ ID NO: 27054 - RNA, 21 nt, Homo sapiens
ggaaggggagaagccacauug

SEQ ID NO: 27055 - RNA, 19 nt, Homo sapiens
ugcuccaucccuccucucu

SEQ ID NO: 27056 - RNA, 16 nt, Homo sapiens
uuacucugucauugcc

SEQ ID NO: 27057 - RNA, 23 nt, Homo sapiens
aacaggaagccugcaugugacug

SEQ ID NO: 27058 - RNA, 16 nt, Homo sapiens
cauguucuuaacugcu

SEQ ID NO: 27059 - RNA, 19 nt, Homo sapiens
cccagaaauugagcuucag

SEQ ID NO: 27060 - RNA, 17 nt, Homo sapiens
uaacccugccuguacua

SEQ ID NO: 27061 - RNA, 22 nt, Homo sapiens
aauaauguuauugagcaaugaa

SEQ ID NO: 27062 - RNA, 17 nt, Homo sapiens
auugaaugauuaaacua

SEQ ID NO: 27063 - RNA, 23 nt, Homo sapiens
gcgccucucccgccccugucucc

SEQ ID NO: 27064 - RNA, 22 nt, Homo sapiens
ucuggauugugcagacuggugc

SEQ ID NO: 27065 - RNA, 21 nt, Homo sapiens
aaaacaccucugucaauguaa

SEQ ID NO: 27066 - RNA, 21 nt, Homo sapiens
aucauggagcugagaauuuca

SEQ ID NO: 27067 - RNA, 20 nt, Homo sapiens
cgcccgcauccccgcgccgc

SEQ ID NO: 27068 - RNA, 21 nt, Homo sapiens
gcgcagcuacggcggcggcag

SEQ ID NO: 27069 - RNA, 23 nt, Homo sapiens
cggagcagcucagcccugcagug

SEQ ID NO: 27070 - RNA, 23 nt, Homo sapiens
gcccucgggugauuauuuggcuc

SEQ ID NO: 27071 - RNA, 20 nt, Homo sapiens
uccgcgcucggagcagcuca

SEQ ID NO: 27072 - RNA, 18 nt, Homo sapiens
ccaccccagugccugaga

SEQ ID NO: 27073 - RNA, 17 nt, Homo sapiens
uggccacacuccccuac

SEQ ID NO: 27074 - RNA, 21 nt, Homo sapiens
cucucucucucuuucucucuc

SEQ ID NO: 27075 - RNA, 21 nt, Homo sapiens
cucuuucucucucucugucuc

SEQ ID NO: 27076 - RNA, 21 nt, Homo sapiens
ccauacugcagccccauccca

SEQ ID NO: 27077 - RNA, 22 nt, Homo sapiens
cucuaguguccccaucuguaaa

SEQ ID NO: 27078 - RNA, 19 nt, Homo sapiens
ggugaugcuggcuacagcc

SEQ ID NO: 27079 - RNA, 21 nt, Homo sapiens
agccucacagcgagccuccug

SEQ ID NO: 27080 - RNA, 19 nt, Homo sapiens
gcugcaugccuggaccacc

SEQ ID NO: 27081 - RNA, 20 nt, Homo sapiens
uucugucacccuugcacucu

SEQ ID NO: 27082 - RNA, 16 nt, Homo sapiens
uugcccuccccuucuc

SEQ ID NO: 27083 - RNA, 21 nt, Homo sapiens
agccucacagcgagccuccug

SEQ ID NO: 27084 - RNA, 19 nt, Homo sapiens
gcugcaugccuggaccacc

SEQ ID NO: 27085 - RNA, 20 nt, Homo sapiens
uucugucacccuugcacucu

SEQ ID NO: 27086 - RNA, 16 nt, Homo sapiens
uugcccuccccuucuc

SEQ ID NO: 27087 - RNA, 22 nt, Homo sapiens
uugguuuccuggugguaucaua

SEQ ID NO: 27088 - RNA, 22 nt, Homo sapiens
cggggccaggcuggguccagca

SEQ ID NO: 27089 - RNA, 17 nt, Homo sapiens
aagcaguacggaagaug

SEQ ID NO: 27090 - RNA, 17 nt, Homo sapiens
agacauacuugcuuuaa

SEQ ID NO: 27091 - RNA, 20 nt, Homo sapiens
gauccugaaagucuugggga

SEQ ID NO: 27092 - RNA, 23 nt, Homo sapiens
gcugauccugaaagucuugggga

SEQ ID NO: 27093 - RNA, 22 nt, Homo sapiens
accaguuccaaagucaguaauu

SEQ ID NO: 27094 - RNA, 22 nt, Homo sapiens
ccccuuuucuuuccagugccca

SEQ ID NO: 27095 - RNA, 19 nt, Homo sapiens
ccucaggguggcugugaua

SEQ ID NO: 27096 - RNA, 23 nt, Homo sapiens
ccuuccccaggggagccugcgaa

SEQ ID NO: 27097 - RNA, 19 nt, Homo sapiens
gcaaacccucagcaguccu

SEQ ID NO: 27098 - RNA, 24 nt, Homo sapiens
gcaauacgccuuuccaaucuuuau

SEQ ID NO: 27099 - RNA, 17 nt, Homo sapiens
cagguacgcgccgccgc

SEQ ID NO: 27100 - RNA, 19 nt, Homo sapiens
uggccucaguguggcauug

SEQ ID NO: 27101 - RNA, 16 nt, Homo sapiens
aaacaugaaggacucc

SEQ ID NO: 27102 - RNA, 22 nt, Homo sapiens
agcuacagaaguucagccauga

SEQ ID NO: 27103 - RNA, 20 nt, Homo sapiens
agguugggauuaccacacca

SEQ ID NO: 27104 - RNA, 17 nt, Homo sapiens
agugagaaauaagaccu

SEQ ID NO: 27105 - RNA, 23 nt, Homo sapiens
caaaacauuuuauaauauauauc

SEQ ID NO: 27106 - RNA, 17 nt, Homo sapiens
ccuuccccgcgcacccc

SEQ ID NO: 27107 - RNA, 17 nt, Homo sapiens
cuuuuucauacauugca

SEQ ID NO: 27108 - RNA, 21 nt, Homo sapiens
gcgcaccccgcacggcccggg

SEQ ID NO: 27109 - RNA, 19 nt, Homo sapiens
uauuucuggaaacauauca

SEQ ID NO: 27110 - RNA, 20 nt, Homo sapiens
ucuggccucuguuuccccca

SEQ ID NO: 27111 - RNA, 24 nt, Homo sapiens
ugugguuucugccuaaaauuggca

SEQ ID NO: 27112 - RNA, 22 nt, Homo sapiens
uguucuucuacuggcugugaug

SEQ ID NO: 27113 - RNA, 21 nt, Homo sapiens
uucagguacauuaagcuuuag

SEQ ID NO: 27114 - RNA, 18 nt, Homo sapiens
auguagugacaguggcca

SEQ ID NO: 27115 - RNA, 17 nt, Homo sapiens
caagaacaaaacuccau

SEQ ID NO: 27116 - RNA, 19 nt, Homo sapiens
cacugcccccugacgaccu

SEQ ID NO: 27117 - RNA, 18 nt, Homo sapiens
cguuucaaugugaacuuu

SEQ ID NO: 27118 - RNA, 22 nt, Homo sapiens
gagccaagaucaugccacugca

SEQ ID NO: 27119 - RNA, 20 nt, Homo sapiens
gucucaguaggauacuccau

SEQ ID NO: 27120 - RNA, 18 nt, Homo sapiens
guuuuggaaaccuauaac

SEQ ID NO: 27121 - RNA, 17 nt, Homo sapiens
uaccuguuguuuagcaa

SEQ ID NO: 27122 - RNA, 21 nt, Homo sapiens
ugaaacgaaacaaauguaaua

SEQ ID NO: 27123 - RNA, 18 nt, Homo sapiens
cuagaagaggcaucuuca

SEQ ID NO: 27124 - RNA, 19 nt, Homo sapiens
ggaugacaguauggaacug

SEQ ID NO: 27125 - RNA, 22 nt, Homo sapiens
uugaugaccucaauaugaguuu

SEQ ID NO: 27126 - RNA, 17 nt, Homo sapiens
gggaaacaaguaaacca

SEQ ID NO: 27127 - RNA, 21 nt, Homo sapiens
gugucucagccuccugagcag

SEQ ID NO: 27128 - RNA, 17 nt, Homo sapiens
auguggggaaacauuuu

SEQ ID NO: 27129 - RNA, 23 nt, Homo sapiens
ccuaccagggcuuucuuggcuuu

SEQ ID NO: 27130 - RNA, 19 nt, Homo sapiens
ccuucgugccucauggaau

SEQ ID NO: 27131 - RNA, 27 nt, Homo sapiens
cucuguguguguauguguguguuuaua

SEQ ID NO: 27132 - RNA, 18 nt, Homo sapiens
cuucuucaauuucuuuca

SEQ ID NO: 27133 - RNA, 26 nt, Homo sapiens
ugaauggguuucuauauaugggucug

SEQ ID NO: 27134 - RNA, 20 nt, Homo sapiens
uccagccgagaccuuuugau

SEQ ID NO: 27135 - RNA, 20 nt, Homo sapiens
uccagccgagaccuuuugau

SEQ ID NO: 27136 - RNA, 20 nt, Homo sapiens
uccagccgagaccuuuugau

SEQ ID NO: 27137 - RNA, 19 nt, Homo sapiens
aaaaacaaaaacaaacaaa

SEQ ID NO: 27138 - RNA, 19 nt, Homo sapiens
aauaaguauccuacucaaa

SEQ ID NO: 27139 - RNA, 20 nt, Homo sapiens
ccaaaaccuguuugggaagc

SEQ ID NO: 27140 - RNA, 19 nt, Homo sapiens
cuugguuuacccaagucau

SEQ ID NO: 27141 - RNA, 18 nt, Homo sapiens
ugcuauugauuucucucu

SEQ ID NO: 27142 - RNA, 20 nt, Homo sapiens
ccuauggcagaaggcaacca

SEQ ID NO: 27143 - RNA, 21 nt, Homo sapiens
acaaaagucgggagcgccaca

SEQ ID NO: 27144 - RNA, 22 nt, Homo sapiens
acaaaauugucaucuauguauc

SEQ ID NO: 27145 - RNA, 23 nt, Homo sapiens
agccaaggaaugucuuccccuga

SEQ ID NO: 27146 - RNA, 22 nt, Homo sapiens
aguagcacagagguguguucug

SEQ ID NO: 27147 - RNA, 27 nt, Homo sapiens
cagggcguccggggcugcgccacuucc

SEQ ID NO: 27148 - RNA, 19 nt, Homo sapiens
ucacaaguugcuagaccaa

SEQ ID NO: 27149 - RNA, 19 nt, Homo sapiens
uccugaacucacacaacaa

SEQ ID NO: 27150 - RNA, 19 nt, Homo sapiens
aaggcuggccccugcugca

SEQ ID NO: 27151 - RNA, 22 nt, Homo sapiens
ggagccccccgcccggccccuc

SEQ ID NO: 27152 - RNA, 22 nt, Homo sapiens
ggagccccccgcccggccccuc

SEQ ID NO: 27153 - RNA, 18 nt, Homo sapiens
aaacgaucacucuggugc

SEQ ID NO: 27154 - RNA, 21 nt, Homo sapiens
ucuggugcggguguuugguuu

SEQ ID NO: 27155 - RNA, 18 nt, Homo sapiens
cggaauaacuuccugcag

SEQ ID NO: 27156 - RNA, 22 nt, Homo sapiens
cuuguuggacuuccccacucca

SEQ ID NO: 27157 - RNA, 21 nt, Homo sapiens
gugcuguccacuaagcacugc

SEQ ID NO: 27158 - RNA, 18 nt, Homo sapiens
uucaaucaucccuaucca

SEQ ID NO: 27159 - RNA, 19 nt, Homo sapiens
agugcgugaugugguauga

SEQ ID NO: 27160 - RNA, 19 nt, Homo sapiens
aucacauuuaaacacuguu

SEQ ID NO: 27161 - RNA, 18 nt, Homo sapiens
augaaacugugugucaga

SEQ ID NO: 27162 - RNA, 19 nt, Homo sapiens
caaaauugcaaaagccuua

SEQ ID NO: 27163 - RNA, 24 nt, Homo sapiens
cagaagaauugaggaucugaugga

SEQ ID NO: 27164 - RNA, 19 nt, Homo sapiens
gcagcccuacuggaacaca

SEQ ID NO: 27165 - RNA, 21 nt, Homo sapiens
guccuucccuguaacauugga

SEQ ID NO: 27166 - RNA, 23 nt, Homo sapiens
cccccaaccccaaacuuucacca

SEQ ID NO: 27167 - RNA, 22 nt, Homo sapiens
cccuccuaggcccacuuccucc

SEQ ID NO: 27168 - RNA, 19 nt, Homo sapiens
cggaggagucuauacuauc

SEQ ID NO: 27169 - RNA, 21 nt, Homo sapiens
cucugacucuaguucugcgga

SEQ ID NO: 27170 - RNA, 21 nt, Homo sapiens
ggaaggaggcuggcuggcuca

SEQ ID NO: 27171 - RNA, 19 nt, Homo sapiens
uaaaaaccacccaaacacu

SEQ ID NO: 27172 - RNA, 23 nt, Homo sapiens
uaguuauuuacaacuuuugcuca

SEQ ID NO: 27173 - RNA, 20 nt, Homo sapiens
ucaugagcaacauuaggcua

SEQ ID NO: 27174 - RNA, 18 nt, Homo sapiens
uccuucucccagguucaa

SEQ ID NO: 27175 - RNA, 22 nt, Homo sapiens
ugcccagggugcccugccucag

SEQ ID NO: 27176 - RNA, 21 nt, Homo sapiens
ugggauuauaggcgucugcca

SEQ ID NO: 27177 - RNA, 18 nt, Homo sapiens
uuaguacucagauaauaa

SEQ ID NO: 27178 - RNA, 17 nt, Homo sapiens
accaccaucauugucua

SEQ ID NO: 27179 - RNA, 23 nt, Homo sapiens
agaagaauuucuguucucacacc

SEQ ID NO: 27180 - RNA, 18 nt, Homo sapiens
cacagacaaagagcccau

SEQ ID NO: 27181 - RNA, 18 nt, Homo sapiens
gcccggcugcuaccucug

SEQ ID NO: 27182 - RNA, 19 nt, Homo sapiens
ucagcugccccuuacuuca

SEQ ID NO: 27183 - RNA, 21 nt, Homo sapiens
ugcugucuccucaacucaacc

SEQ ID NO: 27184 - RNA, 17 nt, Homo sapiens
accaccaucauugucua

SEQ ID NO: 27185 - RNA, 23 nt, Homo sapiens
agaagaauuucuguucucacacc

SEQ ID NO: 27186 - RNA, 18 nt, Homo sapiens
cacagacaaagagcccau

SEQ ID NO: 27187 - RNA, 18 nt, Homo sapiens
gcccggcugcuaccucug

SEQ ID NO: 27188 - RNA, 19 nt, Homo sapiens
ucagcugccccuuacuuca

SEQ ID NO: 27189 - RNA, 21 nt, Homo sapiens
ugcugucuccucaacucaacc

SEQ ID NO: 27190 - RNA, 16 nt, Homo sapiens
acagggagaguugguu

SEQ ID NO: 27191 - RNA, 21 nt, Homo sapiens
aaacagaaaccauucuaggug

SEQ ID NO: 27192 - RNA, 21 nt, Homo sapiens
aaacagaaaccauucuaggug

SEQ ID NO: 27193 - RNA, 21 nt, Homo sapiens
aaacagaaaccauucuaggug

SEQ ID NO: 27194 - RNA, 16 nt, Homo sapiens
acugaaaaacugggaa

SEQ ID NO: 27195 - RNA, 18 nt, Homo sapiens
ccccgagagagcuggcca

SEQ ID NO: 27196 - RNA, 17 nt, Homo sapiens
cucugggaaguggcugc

SEQ ID NO: 27197 - RNA, 18 nt, Homo sapiens
guguauaaaacacagugc

SEQ ID NO: 27198 - RNA, 17 nt, Homo sapiens
uccagaaauuccugcag

SEQ ID NO: 27199 - RNA, 21 nt, Homo sapiens
gccaguucccacagcacccca

SEQ ID NO: 27200 - RNA, 21 nt, Homo sapiens
gccaguucccacagcacccca

SEQ ID NO: 27201 - RNA, 16 nt, Homo sapiens
aauaacacugucuccu

SEQ ID NO: 27202 - RNA, 19 nt, Homo sapiens
ccacccccuucccugcuga

SEQ ID NO: 27203 - RNA, 16 nt, Homo sapiens
aauaacacugucuccu

SEQ ID NO: 27204 - RNA, 16 nt, Homo sapiens
aauaacacugucuccu

SEQ ID NO: 27205 - RNA, 18 nt, Homo sapiens
acugugaauaacuguguu

SEQ ID NO: 27206 - RNA, 19 nt, Homo sapiens
ccacccccuucccugcuga

SEQ ID NO: 27207 - RNA, 17 nt, Homo sapiens
ugaagugaacuaugaag

SEQ ID NO: 27208 - RNA, 18 nt, Homo sapiens
uggagacaaaggcaucau

SEQ ID NO: 27209 - RNA, 21 nt, Homo sapiens
uugagaucaagccccacgaug

SEQ ID NO: 27210 - RNA, 19 nt, Homo sapiens
gccuuggccgccugagccc

SEQ ID NO: 27211 - RNA, 18 nt, Homo sapiens
auaaagguguuaagcuua

SEQ ID NO: 27212 - RNA, 21 nt, Homo sapiens
caagauuaugucaauugguua

SEQ ID NO: 27213 - RNA, 22 nt, Homo sapiens
ucuauuauuuuucuacuaaaga

SEQ ID NO: 27214 - RNA, 18 nt, Homo sapiens
auaaagguguuaagcuua

SEQ ID NO: 27215 - RNA, 21 nt, Homo sapiens
caagauuaugucaauugguua

SEQ ID NO: 27216 - RNA, 22 nt, Homo sapiens
ucuauuauuuuucuacuaaaga

SEQ ID NO: 27217 - RNA, 28 nt, Homo sapiens
agugauccucucucaaaccacaccccca

SEQ ID NO: 27218 - RNA, 27 nt, Homo sapiens
ccagcccugccaccugggcccaccucc

SEQ ID NO: 27219 - RNA, 24 nt, Homo sapiens
ccucugagagaccacgggaaccca

SEQ ID NO: 27220 - RNA, 19 nt, Homo sapiens
cuccgggaggcgggcugcg

SEQ ID NO: 27221 - RNA, 17 nt, Homo sapiens
gagaggcugggcagagg

SEQ ID NO: 27222 - RNA, 25 nt, Homo sapiens
ucuugguggcgucccuuucugugag

SEQ ID NO: 27223 - RNA, 18 nt, Homo sapiens
uguauuuucaguguuuua

SEQ ID NO: 27224 - RNA, 18 nt, Homo sapiens
cucauaccucucugccuc

SEQ ID NO: 27225 - RNA, 22 nt, Homo sapiens
gugcugcggauugaggucccgg

SEQ ID NO: 27226 - RNA, 18 nt, Homo sapiens
aaaggugcauauaccacu

SEQ ID NO: 27227 - RNA, 21 nt, Homo sapiens
aucugagaaagccucuggccc

SEQ ID NO: 27228 - RNA, 18 nt, Homo sapiens
gacaggccgcuugcugca

SEQ ID NO: 27229 - RNA, 17 nt, Homo sapiens
ggaggcaacagagguga

SEQ ID NO: 27230 - RNA, 21 nt, Homo sapiens
aacaguggucuguagcacuca

SEQ ID NO: 27231 - RNA, 15 nt, Homo sapiens
aagcaauucuccuuc

SEQ ID NO: 27232 - RNA, 20 nt, Homo sapiens
gugggcuccugaccaagcac

SEQ ID NO: 27233 - RNA, 23 nt, Homo sapiens
uggagugcaauagcgcaaucuca

SEQ ID NO: 27234 - RNA, 17 nt, Homo sapiens
uggcauugacaaaccca

SEQ ID NO: 27235 - RNA, 18 nt, Homo sapiens
gaagaaauugggaacauu

SEQ ID NO: 27236 - RNA, 21 nt, Homo sapiens
uaucaacugaauagaccuucu

SEQ ID NO: 27237 - RNA, 17 nt, Homo sapiens
uucuccugccuuagccu

SEQ ID NO: 27238 - RNA, 26 nt, Homo sapiens
aacuccagacccuucacaucaauuua

SEQ ID NO: 27239 - RNA, 22 nt, Homo sapiens
ccagagggucuuacuguuccag

SEQ ID NO: 27240 - RNA, 18 nt, Homo sapiens
ccagggacacugaccuca

SEQ ID NO: 27241 - RNA, 27 nt, Homo sapiens
ccuucccagagggucuuacuguuccag

SEQ ID NO: 27242 - RNA, 18 nt, Homo sapiens
gcggcugccucacgugcg

SEQ ID NO: 27243 - RNA, 26 nt, Homo sapiens
guguaugugggucaccguugggcucu

SEQ ID NO: 27244 - RNA, 16 nt, Homo sapiens
ucacuuccgcucccgc

SEQ ID NO: 27245 - RNA, 15 nt, Homo sapiens
uccagaaacuuucca

SEQ ID NO: 27246 - RNA, 18 nt, Homo sapiens
uuauggcugggucugguu

SEQ ID NO: 27247 - RNA, 16 nt, Homo sapiens
acaaaauuguguuugu

SEQ ID NO: 27248 - RNA, 27 nt, Homo sapiens
auggagcuagugucccagcugaagcua

SEQ ID NO: 27249 - RNA, 22 nt, Homo sapiens
gagccaagaucacgccacugca

SEQ ID NO: 27250 - RNA, 20 nt, Homo sapiens
aguuuuaaucaagauguuca

SEQ ID NO: 27251 - RNA, 17 nt, Homo sapiens
ugauggaaaccugugag

SEQ ID NO: 27252 - RNA, 20 nt, Homo sapiens
gaaaagcaggcacuguucac

SEQ ID NO: 27253 - RNA, 22 nt, Homo sapiens
ugcucccauacaccuggcacug

SEQ ID NO: 27254 - RNA, 21 nt, Homo sapiens
gccaguucccacagcacccca

SEQ ID NO: 27255 - RNA, 18 nt, Homo sapiens
agcauuuuauuucccgca

SEQ ID NO: 27256 - RNA, 19 nt, Homo sapiens
agggcugacgcuccggugc

SEQ ID NO: 27257 - RNA, 22 nt, Homo sapiens
caagaucgugccauuccacucc

SEQ ID NO: 27258 - RNA, 19 nt, Homo sapiens
caguccuauuaguguuuaa

SEQ ID NO: 27259 - RNA, 17 nt, Homo sapiens
ggaguccccccugccca

SEQ ID NO: 27260 - RNA, 18 nt, Homo sapiens
uuucacuguuuuccugca

SEQ ID NO: 27261 - RNA, 21 nt, Homo sapiens
acacuauucauauauucugaa

SEQ ID NO: 27262 - RNA, 19 nt, Homo sapiens
auuuauuuuccccugugau

SEQ ID NO: 27263 - RNA, 21 nt, Homo sapiens
caaauaguaaagagaugugau

SEQ ID NO: 27264 - RNA, 22 nt, Homo sapiens
uacauacauacacauacacaca

SEQ ID NO: 27265 - RNA, 19 nt, Homo sapiens
uugcuguugagguaacuug

SEQ ID NO: 27266 - RNA, 19 nt, Homo sapiens
accagcagacacugccggg

SEQ ID NO: 27267 - RNA, 19 nt, Homo sapiens
accagcagacacugccggg

SEQ ID NO: 27268 - RNA, 17 nt, Homo sapiens
augcaacaaggacuuca

SEQ ID NO: 27269 - RNA, 20 nt, Homo sapiens
caccuacccacaccugcuuu

SEQ ID NO: 27270 - RNA, 19 nt, Homo sapiens
accagcagacacugccggg

SEQ ID NO: 27271 - RNA, 17 nt, Homo sapiens
augcaacaaggacuuca

SEQ ID NO: 27272 - RNA, 20 nt, Homo sapiens
caccuacccacaccugcuuu

SEQ ID NO: 27273 - RNA, 19 nt, Homo sapiens
accagcagacacugccggg

SEQ ID NO: 27274 - RNA, 17 nt, Homo sapiens
augcaacaaggacuuca

SEQ ID NO: 27275 - RNA, 20 nt, Homo sapiens
caccuacccacaccugcuuu

SEQ ID NO: 27276 - RNA, 15 nt, Homo sapiens
ccgaccuccaccccc

SEQ ID NO: 27277 - RNA, 20 nt, Homo sapiens
ccuucuuccccaccaacaaa

SEQ ID NO: 27278 - RNA, 23 nt, Homo sapiens
cugcacaagggcaccugcagcua

SEQ ID NO: 27279 - RNA, 20 nt, Homo sapiens
cuguggaugggggccgugau

SEQ ID NO: 27280 - RNA, 18 nt, Homo sapiens
gacuccaucccccacccc

SEQ ID NO: 27281 - RNA, 18 nt, Homo sapiens
ugaggaaucuaccaguug

SEQ ID NO: 27282 - RNA, 18 nt, Homo sapiens
ugcuagccuucuacccca

SEQ ID NO: 27283 - RNA, 20 nt, Homo sapiens
uggaacccagcaggaucaca

SEQ ID NO: 27284 - RNA, 21 nt, Homo sapiens
uuuuucauaccuagugggaua

SEQ ID NO: 27285 - RNA, 17 nt, Homo sapiens
gccccuuggcuggcaga

SEQ ID NO: 27286 - RNA, 18 nt, Homo sapiens
uuggaacaaaucgccccu

SEQ ID NO: 27287 - RNA, 20 nt, Homo sapiens
caaacgguguucaugauacu

SEQ ID NO: 27288 - RNA, 24 nt, Homo sapiens
guccugaauaagucuacuggaaga

SEQ ID NO: 27289 - RNA, 23 nt, Homo sapiens
ucauauauacuguaauauaugcu

SEQ ID NO: 27290 - RNA, 17 nt, Homo sapiens
ucucaccucuauuaccu

SEQ ID NO: 27291 - RNA, 21 nt, Homo sapiens
uuaggaaaaacuacacauucu

SEQ ID NO: 27292 - RNA, 19 nt, Homo sapiens
uucugucuacuguacucuu

SEQ ID NO: 27293 - RNA, 21 nt, Homo sapiens
ucagucucaaagucaccuuga

SEQ ID NO: 27294 - RNA, 19 nt, Homo sapiens
ucuccacuuucuggaacca

SEQ ID NO: 27295 - RNA, 20 nt, Homo sapiens
caaccacucucucugccccu

SEQ ID NO: 27296 - RNA, 20 nt, Homo sapiens
ccaucugucuuucugucccu

SEQ ID NO: 27297 - RNA, 19 nt, Homo sapiens
cugaguugcggccacuuca

SEQ ID NO: 27298 - RNA, 24 nt, Homo sapiens
gccucucugccugaaucugccucu

SEQ ID NO: 27299 - RNA, 19 nt, Homo sapiens
uuggggagcugucuggcuc

SEQ ID NO: 27300 - RNA, 20 nt, Homo sapiens
ggaggaggaagggagcacca

SEQ ID NO: 27301 - RNA, 19 nt, Homo sapiens
gggagcagaaggagcgcga

SEQ ID NO: 27302 - RNA, 23 nt, Homo sapiens
agaauguugguaaugccauguca

SEQ ID NO: 27303 - RNA, 18 nt, Homo sapiens
gauacaggcauaugucau

SEQ ID NO: 27304 - RNA, 20 nt, Homo sapiens
ggagaggcggcggccgcggc

SEQ ID NO: 27305 - RNA, 17 nt, Homo sapiens
uugguuugcuucaacaa

SEQ ID NO: 27306 - RNA, 19 nt, Homo sapiens
cccccgggcccgccgcagc

SEQ ID NO: 27307 - RNA, 19 nt, Homo sapiens
ugucccacuagcgggcucu

SEQ ID NO: 27308 - RNA, 16 nt, Homo sapiens
cccuucccuuuuccag

SEQ ID NO: 27309 - RNA, 21 nt, Homo sapiens
aaauaccuuucuuccuuguaa

SEQ ID NO: 27310 - RNA, 19 nt, Homo sapiens
ccgaagcgagccgaagcau

SEQ ID NO: 27311 - RNA, 21 nt, Homo sapiens
acuggagaggaaaacuuguca

SEQ ID NO: 27312 - RNA, 17 nt, Homo sapiens
agaguaucugcuuucca

SEQ ID NO: 27313 - RNA, 20 nt, Homo sapiens
aguugguucaaacuguugga

SEQ ID NO: 27314 - RNA, 23 nt, Homo sapiens
caacagccugcccagaucccucu

SEQ ID NO: 27315 - RNA, 20 nt, Homo sapiens
cccuccugaauggaacccca

SEQ ID NO: 27316 - RNA, 22 nt, Homo sapiens
cccuuccccaccuuugcccucc

SEQ ID NO: 27317 - RNA, 23 nt, Homo sapiens
ggacaaaaaaauguaaaauacuu

SEQ ID NO: 27318 - RNA, 23 nt, Homo sapiens
ugcccagucuggugccugcccca

SEQ ID NO: 27319 - RNA, 20 nt, Homo sapiens
acccuuuggaaacccugggg

SEQ ID NO: 27320 - RNA, 18 nt, Homo sapiens
agcuaaucuugucauuaa

SEQ ID NO: 27321 - RNA, 19 nt, Homo sapiens
caucuuagagauggagaca

SEQ ID NO: 27322 - RNA, 20 nt, Homo sapiens
cugugugucuuuuuacccug

SEQ ID NO: 27323 - RNA, 21 nt, Homo sapiens
gcaccugucuguccaucugca

SEQ ID NO: 27324 - RNA, 20 nt, Homo sapiens
ggguuucacaccucuuguua

SEQ ID NO: 27325 - RNA, 20 nt, Homo sapiens
guugguauuugggcacuuua

SEQ ID NO: 27326 - RNA, 21 nt, Homo sapiens
uccuuuuuucuuagacacauc

SEQ ID NO: 27327 - RNA, 18 nt, Homo sapiens
augcccaaccagguucca

SEQ ID NO: 27328 - RNA, 18 nt, Homo sapiens
ccacaggaggggcacccg

SEQ ID NO: 27329 - RNA, 18 nt, Homo sapiens
ccacaggaggggcacccg

SEQ ID NO: 27330 - RNA, 18 nt, Homo sapiens
uccuggcguuaagcuuuu

SEQ ID NO: 27331 - RNA, 21 nt, Homo sapiens
uccugguggaggggaucuugg

SEQ ID NO: 27332 - RNA, 19 nt, Homo sapiens
ucuugggcacugguagcag

SEQ ID NO: 27333 - RNA, 20 nt, Homo sapiens
uggccaggcuggucuugaac

SEQ ID NO: 27334 - RNA, 19 nt, Homo sapiens
aaggacaagcucuucauga

SEQ ID NO: 27335 - RNA, 21 nt, Homo sapiens
ccacgaccagcuggcaccuca

SEQ ID NO: 27336 - RNA, 19 nt, Homo sapiens
ccgccacugcugccagcga

SEQ ID NO: 27337 - RNA, 20 nt, Homo sapiens
cucagcagcagguacguacc

SEQ ID NO: 27338 - RNA, 23 nt, Homo sapiens
gagcuugacacccucgcgucaca

SEQ ID NO: 27339 - RNA, 21 nt, Homo sapiens
ucacauuuucuucuugagcaa

SEQ ID NO: 27340 - RNA, 18 nt, Homo sapiens
ucacggugauguugcaca

SEQ ID NO: 27341 - RNA, 22 nt, Homo sapiens
uccugaugugacggacugugaa

SEQ ID NO: 27342 - RNA, 22 nt, Homo sapiens
ucuggcaccacugcccuggucc

SEQ ID NO: 27343 - RNA, 19 nt, Homo sapiens
aaggacaagcucuucauga

SEQ ID NO: 27344 - RNA, 21 nt, Homo sapiens
ccacgaccagcuggcaccuca

SEQ ID NO: 27345 - RNA, 19 nt, Homo sapiens
ccgccacugcugccagcga

SEQ ID NO: 27346 - RNA, 20 nt, Homo sapiens
cucagcagcagguacguacc

SEQ ID NO: 27347 - RNA, 18 nt, Homo sapiens
ucacggugauguugcaca

SEQ ID NO: 27348 - RNA, 22 nt, Homo sapiens
uccugaugugacggacugugaa

SEQ ID NO: 27349 - RNA, 22 nt, Homo sapiens
ucuggcaccacugcccuggucc

SEQ ID NO: 27350 - RNA, 18 nt, Homo sapiens
agaagauugugguugcca

SEQ ID NO: 27351 - RNA, 16 nt, Homo sapiens
agcugcagcugauggg

SEQ ID NO: 27352 - RNA, 19 nt, Homo sapiens
aucuggagaagccccuggg

SEQ ID NO: 27353 - RNA, 27 nt, Homo sapiens
ccuuuuccaauuuguugucuucauuuu

SEQ ID NO: 27354 - RNA, 15 nt, Homo sapiens
gccugggggcagaua

SEQ ID NO: 27355 - RNA, 21 nt, Homo sapiens
cacaccaggcaccagugucuu

SEQ ID NO: 27356 - RNA, 17 nt, Homo sapiens
agcuaucaaaggaaaug

SEQ ID NO: 27357 - RNA, 19 nt, Homo sapiens
cacaacugucuuagacugc

SEQ ID NO: 27358 - RNA, 19 nt, Homo sapiens
cacuuaaauucucuaaccg

SEQ ID NO: 27359 - RNA, 20 nt, Homo sapiens
cuccaagcaucagcagagcc

SEQ ID NO: 27360 - RNA, 20 nt, Homo sapiens
ucuccugagugcugcaaguu

SEQ ID NO: 27361 - RNA, 18 nt, Homo sapiens
aaaguuggguucuuggca

SEQ ID NO: 27362 - RNA, 20 nt, Homo sapiens
acguggcuaccaaaugccua

SEQ ID NO: 27363 - RNA, 19 nt, Homo sapiens
caaagaucaaggaauguca

SEQ ID NO: 27364 - RNA, 17 nt, Homo sapiens
ccguggaagcacacucu

SEQ ID NO: 27365 - RNA, 20 nt, Homo sapiens
ggaccaauaaacagccuccu

SEQ ID NO: 27366 - RNA, 17 nt, Homo sapiens
gucaucucuggugucag

SEQ ID NO: 27367 - RNA, 24 nt, Homo sapiens
gucauugcgugugugugguuugug

SEQ ID NO: 27368 - RNA, 17 nt, Homo sapiens
uggguauuaugcagugc

SEQ ID NO: 27369 - RNA, 18 nt, Homo sapiens
uguaccaauuucuuuuaa

SEQ ID NO: 27370 - RNA, 18 nt, Homo sapiens
uucaaauguaaauuguuc

SEQ ID NO: 27371 - RNA, 20 nt, Homo sapiens
uugcgugugugugguuugug

SEQ ID NO: 27372 - RNA, 20 nt, Homo sapiens
acguggcuaccaaaugccua

SEQ ID NO: 27373 - RNA, 19 nt, Homo sapiens
caaagaucaaggaauguca

SEQ ID NO: 27374 - RNA, 17 nt, Homo sapiens
ccguggaagcacacucu

SEQ ID NO: 27375 - RNA, 20 nt, Homo sapiens
ggaccaauaaacagccuccu

SEQ ID NO: 27376 - RNA, 17 nt, Homo sapiens
gucaucucuggugucag

SEQ ID NO: 27377 - RNA, 24 nt, Homo sapiens
gucauugcgugugugugguuugug

SEQ ID NO: 27378 - RNA, 17 nt, Homo sapiens
uggguauuaugcagugc

SEQ ID NO: 27379 - RNA, 18 nt, Homo sapiens
uguaccaauuucuuuuaa

SEQ ID NO: 27380 - RNA, 18 nt, Homo sapiens
uucaaauguaaauuguuc

SEQ ID NO: 27381 - RNA, 20 nt, Homo sapiens
uugcgugugugugguuugug

SEQ ID NO: 27382 - RNA, 18 nt, Homo sapiens
ccuggccccacgcagcuc

SEQ ID NO: 27383 - RNA, 21 nt, Homo sapiens
cgagcuuccccgcaccggcca

SEQ ID NO: 27384 - RNA, 19 nt, Homo sapiens
auggcuauaaagcuguggc

SEQ ID NO: 27385 - RNA, 21 nt, Homo sapiens
caagaaaugcuucuuggacua

SEQ ID NO: 27386 - RNA, 20 nt, Homo sapiens
gaugugcaaaacgcagucca

SEQ ID NO: 27387 - RNA, 17 nt, Homo sapiens
gccuggaaacacuacca

SEQ ID NO: 27388 - RNA, 20 nt, Homo sapiens
ugaaccugccgccuccgugc

SEQ ID NO: 27389 - RNA, 21 nt, Homo sapiens
cagcauucagcacaggugcca

SEQ ID NO: 27390 - RNA, 22 nt, Homo sapiens
cuaaaugucauucuccaucucu

SEQ ID NO: 27391 - RNA, 17 nt, Homo sapiens
caguggugucucucacc

SEQ ID NO: 27392 - RNA, 20 nt, Homo sapiens
cacucauugucuuugaggaa

SEQ ID NO: 27393 - RNA, 16 nt, Homo sapiens
ccaaaaguuucuuacu

SEQ ID NO: 27394 - RNA, 21 nt, Homo sapiens
gucagagggugggguaaccaa

SEQ ID NO: 27395 - RNA, 20 nt, Homo sapiens
guucuucuucuugccagugu

SEQ ID NO: 27396 - RNA, 23 nt, Homo sapiens
augaaagaaaaaauauugucaua

SEQ ID NO: 27397 - RNA, 17 nt, Homo sapiens
accugccuccucuucgg

SEQ ID NO: 27398 - RNA, 20 nt, Homo sapiens
guccgugcagcacuaacgua

SEQ ID NO: 27399 - RNA, 22 nt, Homo sapiens
cccgccgcccggcuccucucgg

SEQ ID NO: 27400 - RNA, 15 nt, Homo sapiens
uccuccagcaucuca

SEQ ID NO: 27401 - RNA, 21 nt, Homo sapiens
ggaugauuuuuucuucaggga

SEQ ID NO: 27402 - RNA, 17 nt, Homo sapiens
uaaaaaugugagaugug

SEQ ID NO: 27403 - RNA, 19 nt, Homo sapiens
uccuggaggaagcucauga

SEQ ID NO: 27404 - RNA, 18 nt, Homo sapiens
ucuuuauuuuaaugaugu

SEQ ID NO: 27405 - RNA, 18 nt, Homo sapiens
ugauacugauuuuccuuu

SEQ ID NO: 27406 - RNA, 23 nt, Homo sapiens
uguuaaaaaugcugucaaauccu

SEQ ID NO: 27407 - RNA, 19 nt, Homo sapiens
cugcacacagacugcaagu

SEQ ID NO: 27408 - RNA, 18 nt, Homo sapiens
guuuagaaccaaaccaca

SEQ ID NO: 27409 - RNA, 21 nt, Homo sapiens
acuacaaugcucugucaucuc

SEQ ID NO: 27410 - RNA, 17 nt, Homo sapiens
agaaauaaaacugcuca

SEQ ID NO: 27411 - RNA, 18 nt, Homo sapiens
aguaagaugugaaauuca

SEQ ID NO: 27412 - RNA, 19 nt, Homo sapiens
caacuuaacacugaaccca

SEQ ID NO: 27413 - RNA, 18 nt, Homo sapiens
cugagcaguuauauuuua

SEQ ID NO: 27414 - RNA, 22 nt, Homo sapiens
gcacuuucuaauuuauuagaga

SEQ ID NO: 27415 - RNA, 26 nt, Homo sapiens
guuuucauaaucgaaagaaacgggua

SEQ ID NO: 27416 - RNA, 17 nt, Homo sapiens
uccauuucugaaguauu

SEQ ID NO: 27417 - RNA, 18 nt, Homo sapiens
uuauuuuauuuuaccaua

SEQ ID NO: 27418 - RNA, 22 nt, Homo sapiens
ggacgcguccgacggcggccgg

SEQ ID NO: 27419 - RNA, 21 nt, Homo sapiens
ggccggacgcugagguggucg

SEQ ID NO: 27420 - RNA, 24 nt, Homo sapiens
cccgccccuuuccugcccgcccca

SEQ ID NO: 27421 - RNA, 19 nt, Homo sapiens
ggcuccgcccccucccccu

SEQ ID NO: 27422 - RNA, 22 nt, Homo sapiens
cggggcggccagggccgcugca

SEQ ID NO: 27423 - RNA, 18 nt, Homo sapiens
ggccagcauugccacugc

SEQ ID NO: 27424 - RNA, 21 nt, Homo sapiens
caagauuuggaaguuuaguca

SEQ ID NO: 27425 - RNA, 20 nt, Homo sapiens
uaccuucuuagucacgugca

SEQ ID NO: 27426 - RNA, 22 nt, Homo sapiens
uguaauugugauuuaccugugc

SEQ ID NO: 27427 - RNA, 21 nt, Homo sapiens
cccacaacccacacacaccac

SEQ ID NO: 27428 - RNA, 23 nt, Homo sapiens
cgccugccccauccccaucccca

SEQ ID NO: 27429 - RNA, 18 nt, Homo sapiens
ucucuaggccucugcucu

SEQ ID NO: 27430 - RNA, 19 nt, Homo sapiens
ucugucuuucuuggugucu

SEQ ID NO: 27431 - RNA, 19 nt, Homo sapiens
uucugucucucucccuacc

SEQ ID NO: 27432 - RNA, 21 nt, Homo sapiens
ucuguuaucagcaaugugcaa

SEQ ID NO: 27433 - RNA, 19 nt, Homo sapiens
ugaauucaacuccagacac

SEQ ID NO: 27434 - RNA, 24 nt, Homo sapiens
uuuugaaaaugacggugucugacu

SEQ ID NO: 27435 - RNA, 24 nt, Homo sapiens
uuuuuugcauuauaugcauuuaug

SEQ ID NO: 27436 - RNA, 17 nt, Homo sapiens
cugaggcccggcgaggu

SEQ ID NO: 27437 - RNA, 15 nt, Homo sapiens
cuccccauggccggg

SEQ ID NO: 27438 - RNA, 24 nt, Homo sapiens
ugaguauuaugacagugugcauca

SEQ ID NO: 27439 - RNA, 19 nt, Homo sapiens
gacugaggaaaauuuacca

SEQ ID NO: 27440 - RNA, 21 nt, Homo sapiens
gcccccacguccucugaaaua

SEQ ID NO: 27441 - RNA, 20 nt, Homo sapiens
ugaggaaaauuuaccaguca

SEQ ID NO: 27442 - RNA, 22 nt, Homo sapiens
accuccagucuuuccccuguga

SEQ ID NO: 27443 - RNA, 20 nt, Homo sapiens
agggccaaccuauuacuuca

SEQ ID NO: 27444 - RNA, 24 nt, Homo sapiens
cccaucgucacucuccauggccuc

SEQ ID NO: 27445 - RNA, 21 nt, Homo sapiens
gcuucaugcgacuccauguca

SEQ ID NO: 27446 - RNA, 20 nt, Homo sapiens
uggucaggcuggucuugaac

SEQ ID NO: 27447 - RNA, 18 nt, Homo sapiens
ccugaauaaugcuggcuc

SEQ ID NO: 27448 - RNA, 19 nt, Homo sapiens
cuccugcugaaaaauguua

SEQ ID NO: 27449 - RNA, 20 nt, Homo sapiens
cccccagaacccgcgccauc

SEQ ID NO: 27450 - RNA, 18 nt, Homo sapiens
cgaggcugcuaggcccag

SEQ ID NO: 27451 - RNA, 17 nt, Homo sapiens
cuguaaguccuugugug

SEQ ID NO: 27452 - RNA, 23 nt, Homo sapiens
gccucagggcccaucaggaguca

SEQ ID NO: 27453 - RNA, 20 nt, Homo sapiens
guguauugugauuauuugau

SEQ ID NO: 27454 - RNA, 22 nt, Homo sapiens
ccccccccacccuucucucucc

SEQ ID NO: 27455 - RNA, 22 nt, Homo sapiens
ccccuucaccggggcuguugug

SEQ ID NO: 27456 - RNA, 20 nt, Homo sapiens
ugucuuuguuaccccagggg

SEQ ID NO: 27457 - RNA, 21 nt, Homo sapiens
uucuggacagcugaacacucu

SEQ ID NO: 27458 - RNA, 22 nt, Homo sapiens
aggaucugcuccgccuuuggcc

SEQ ID NO: 27459 - RNA, 18 nt, Homo sapiens
auugcacugagcauucca

SEQ ID NO: 27460 - RNA, 20 nt, Homo sapiens
ccuaccacucccccgcuuuu

SEQ ID NO: 27461 - RNA, 19 nt, Homo sapiens
uggcaaugaugugccuuga

SEQ ID NO: 27462 - RNA, 16 nt, Homo sapiens
uggccaggcguggugg

SEQ ID NO: 27463 - RNA, 22 nt, Homo sapiens
caaugaagagcuugaguuugaa

SEQ ID NO: 27464 - RNA, 22 nt, Homo sapiens
gcaaucugcccgccucugccuc

SEQ ID NO: 27465 - RNA, 23 nt, Homo sapiens
gcaaucugcccgccucugccucc

SEQ ID NO: 27466 - RNA, 21 nt, Homo sapiens
gugccagaucuuuaacuguau

SEQ ID NO: 27467 - RNA, 21 nt, Homo sapiens
aucugguaacuccaugaugaa

SEQ ID NO: 27468 - RNA, 22 nt, Homo sapiens
ccccagagaccauuaaccaaua

SEQ ID NO: 27469 - RNA, 23 nt, Homo sapiens
gcaguugaacaaaaauuauggca

SEQ ID NO: 27470 - RNA, 19 nt, Homo sapiens
gugaauacuuagauuugua

SEQ ID NO: 27471 - RNA, 21 nt, Homo sapiens
aaaagccuguuaguauuuuca

SEQ ID NO: 27472 - RNA, 19 nt, Homo sapiens
accuggauuuuuuguuugg

SEQ ID NO: 27473 - RNA, 22 nt, Homo sapiens
agaacaguuccucagcugguca

SEQ ID NO: 27474 - RNA, 17 nt, Homo sapiens
auucuuuuuucuauuua

SEQ ID NO: 27475 - RNA, 19 nt, Homo sapiens
ccauauaaauuguuuauuc

SEQ ID NO: 27476 - RNA, 21 nt, Homo sapiens
cuaaagaagugacucaccuga

SEQ ID NO: 27477 - RNA, 24 nt, Homo sapiens
cucaggaaguccuccccuacaucu

SEQ ID NO: 27478 - RNA, 18 nt, Homo sapiens
ucacacuacucuguuccu

SEQ ID NO: 27479 - RNA, 26 nt, Homo sapiens
uuccucagcuggucaugcugagcuca

SEQ ID NO: 27480 - RNA, 20 nt, Homo sapiens
acaaccacccccaagccuca

SEQ ID NO: 27481 - RNA, 21 nt, Homo sapiens
auucuaccugcauuucaauua

SEQ ID NO: 27482 - RNA, 17 nt, Homo sapiens
cacuccccucucccucu

SEQ ID NO: 27483 - RNA, 19 nt, Homo sapiens
ccaagcaugccagcuucug

SEQ ID NO: 27484 - RNA, 19 nt, Homo sapiens
ccuguucaccucuuuccac

SEQ ID NO: 27485 - RNA, 18 nt, Homo sapiens
cugggcaaagcccacuau

SEQ ID NO: 27486 - RNA, 17 nt, Homo sapiens
gcucccucccaucugua

SEQ ID NO: 27487 - RNA, 20 nt, Homo sapiens
uaucauuaaaguaaagauuu

SEQ ID NO: 27488 - RNA, 21 nt, Homo sapiens
cccucuccaacccacucucca

SEQ ID NO: 27489 - RNA, 22 nt, Homo sapiens
aacaucaacauuuuuugugcuu

SEQ ID NO: 27490 - RNA, 21 nt, Homo sapiens
aagagguauguagucacagua

SEQ ID NO: 27491 - RNA, 18 nt, Homo sapiens
caaggguuuggguuuuga

SEQ ID NO: 27492 - RNA, 22 nt, Homo sapiens
cgccgccccggcugcgcacgcg

SEQ ID NO: 27493 - RNA, 16 nt, Homo sapiens
ccgugcccagcacccg

SEQ ID NO: 27494 - RNA, 16 nt, Homo sapiens
gguggaaguccuccag

SEQ ID NO: 27495 - RNA, 20 nt, Homo sapiens
uaaaggaugagccugggguc

SEQ ID NO: 27496 - RNA, 18 nt, Homo sapiens
aaaccauccaugacccca

SEQ ID NO: 27497 - RNA, 19 nt, Homo sapiens
aaauuuuugaaaucguggu

SEQ ID NO: 27498 - RNA, 19 nt, Homo sapiens
agcacagaacuccagcccc

SEQ ID NO: 27499 - RNA, 19 nt, Homo sapiens
cugcaacgccugccucuca

SEQ ID NO: 27500 - RNA, 20 nt, Homo sapiens
ucuauuuauuuugagucacu

SEQ ID NO: 27501 - RNA, 19 nt, Homo sapiens
cugagguguucccuggcuu

SEQ ID NO: 27502 - RNA, 20 nt, Homo sapiens
uccuccuccccuuaaccacc

SEQ ID NO: 27503 - RNA, 19 nt, Homo sapiens
gcaaagaacuuugaggguc

SEQ ID NO: 27504 - RNA, 23 nt, Homo sapiens
gcagucacagggggccuguguca

SEQ ID NO: 27505 - RNA, 21 nt, Homo sapiens
gguggguggggaggggcaguu

SEQ ID NO: 27506 - RNA, 18 nt, Homo sapiens
ucucaggaggacuuugag

SEQ ID NO: 27507 - RNA, 25 nt, Homo sapiens
ccuccccucuugcacuuucucucca

SEQ ID NO: 27508 - RNA, 20 nt, Homo sapiens
ccuuuauucguuuguacuca

SEQ ID NO: 27509 - RNA, 25 nt, Homo sapiens
aaauaaugaagagacacauguguua

SEQ ID NO: 27510 - RNA, 19 nt, Homo sapiens
ugauuaugcugacauucca

SEQ ID NO: 27511 - RNA, 21 nt, Homo sapiens
aaugaaguucagauucccuuc

SEQ ID NO: 27512 - RNA, 24 nt, Homo sapiens
aucuggaguauuaauguuugguuc

SEQ ID NO: 27513 - RNA, 20 nt, Homo sapiens
gauugcuuugugaagcucuu

SEQ ID NO: 27514 - RNA, 23 nt, Homo sapiens
gcaaauuuuaugaagugccuacc

SEQ ID NO: 27515 - RNA, 19 nt, Homo sapiens
uacuuuuuggggucagaua

SEQ ID NO: 27516 - RNA, 21 nt, Homo sapiens
ucagcagaaauaggguuuucu

SEQ ID NO: 27517 - RNA, 19 nt, Homo sapiens
aucaaaaaauaaaaguuuu

SEQ ID NO: 27518 - RNA, 20 nt, Homo sapiens
guugaugguauugauugaaa

SEQ ID NO: 27519 - RNA, 19 nt, Homo sapiens
ucugauuuuuugagcacua

SEQ ID NO: 27520 - RNA, 25 nt, Homo sapiens
acagaaagcugccuucuucacuuga

SEQ ID NO: 27521 - RNA, 22 nt, Homo sapiens
aucuucuucaugguguuaggga

SEQ ID NO: 27522 - RNA, 22 nt, Homo sapiens
gaagaacuuaucuuuauucuca

SEQ ID NO: 27523 - RNA, 23 nt, Homo sapiens
uacagcaaaauaaaaauuuaaca

SEQ ID NO: 27524 - RNA, 19 nt, Homo sapiens
ucaaguucucuccaccucu

SEQ ID NO: 27525 - RNA, 18 nt, Homo sapiens
aaacauagcaagaucuca

SEQ ID NO: 27526 - RNA, 21 nt, Homo sapiens
aacuagagugcauuuaaaaua

SEQ ID NO: 27527 - RNA, 23 nt, Homo sapiens
aaugugggaacuggacacccaga

SEQ ID NO: 27528 - RNA, 28 nt, Homo sapiens
auauaaucaaagaauuuucuguacauau

SEQ ID NO: 27529 - RNA, 21 nt, Homo sapiens
aucugugggacugucugggcc

SEQ ID NO: 27530 - RNA, 21 nt, Homo sapiens
ccugccuccuugagucacuuu

SEQ ID NO: 27531 - RNA, 22 nt, Homo sapiens
ccuggguaagacugaaagcauu

SEQ ID NO: 27532 - RNA, 20 nt, Homo sapiens
cuuuaaggcuuuuuaauuuu

SEQ ID NO: 27533 - RNA, 22 nt, Homo sapiens
gacugugcaaagggcuuagcua

SEQ ID NO: 27534 - RNA, 24 nt, Homo sapiens
ggcaacaugugccuucacacuuua

SEQ ID NO: 27535 - RNA, 25 nt, Homo sapiens
uaagugcuuguucuagcauaaauua

SEQ ID NO: 27536 - RNA, 17 nt, Homo sapiens
ugcauaucaccaugagu

SEQ ID NO: 27537 - RNA, 19 nt, Homo sapiens
ugccuacuucaccaucucu

SEQ ID NO: 27538 - RNA, 16 nt, Homo sapiens
caccaggcuuugcaaa

SEQ ID NO: 27539 - RNA, 19 nt, Homo sapiens
gcugucuccugcauaucca

SEQ ID NO: 27540 - RNA, 17 nt, Homo sapiens
ucuccugcauauccagc

SEQ ID NO: 27541 - RNA, 19 nt, Homo sapiens
gaucucuaauguggaggug

SEQ ID NO: 27542 - RNA, 24 nt, Homo sapiens
uggcacaguccugguguggugcug

SEQ ID NO: 27543 - RNA, 24 nt, Homo sapiens
aacuuugcccccaucucacccagu

SEQ ID NO: 27544 - RNA, 25 nt, Homo sapiens
agaucuuguuaccuccucaucuaca

SEQ ID NO: 27545 - RNA, 21 nt, Homo sapiens
uccaaucaaucuccuuacuca

SEQ ID NO: 27546 - RNA, 22 nt, Homo sapiens
gagccaagaucgugccacugca

SEQ ID NO: 27547 - RNA, 21 nt, Homo sapiens
uccuagaacacacgaugggcu

SEQ ID NO: 27548 - RNA, 24 nt, Homo sapiens
aucaaagacaaguaaugugucuca

SEQ ID NO: 27549 - RNA, 18 nt, Homo sapiens
gaaaagccuaucaucaua

SEQ ID NO: 27550 - RNA, 18 nt, Homo sapiens
uaagugaugcuauuccaa

SEQ ID NO: 27551 - RNA, 19 nt, Homo sapiens
ugcccacaugaccuguucc

SEQ ID NO: 27552 - RNA, 18 nt, Homo sapiens
ugcuucacaugguuaaaa

SEQ ID NO: 27553 - RNA, 23 nt, Homo sapiens
acaaccugaagcacaaguuccca

SEQ ID NO: 27554 - RNA, 19 nt, Homo sapiens
ccuuuccccaccaccgcaa

SEQ ID NO: 27555 - RNA, 17 nt, Homo sapiens
gcaucgugcugcaggug

SEQ ID NO: 27556 - RNA, 23 nt, Homo sapiens
uccuggugauggguuacugugag

SEQ ID NO: 27557 - RNA, 19 nt, Homo sapiens
ugugcaaccacugcuucuu

SEQ ID NO: 27558 - RNA, 15 nt, Homo sapiens
uuccccaccaccgca

SEQ ID NO: 27559 - RNA, 17 nt, Homo sapiens
accuggagcagcugcug

SEQ ID NO: 27560 - RNA, 18 nt, Homo sapiens
ccaaucguucucuguucc

SEQ ID NO: 27561 - RNA, 20 nt, Homo sapiens
cugagaaauaacuugcucug

SEQ ID NO: 27562 - RNA, 24 nt, Homo sapiens
gcacacgagugaacgagugcagga

SEQ ID NO: 27563 - RNA, 21 nt, Homo sapiens
ggacucccaacagggguaccc

SEQ ID NO: 27564 - RNA, 23 nt, Homo sapiens
gugaacgagugcaggaaccagcu

SEQ ID NO: 27565 - RNA, 21 nt, Homo sapiens
ucacuuuccugaccaugccca

SEQ ID NO: 27566 - RNA, 20 nt, Homo sapiens
accacacacuugcacacccc

SEQ ID NO: 27567 - RNA, 18 nt, Homo sapiens
cagcgaaagucugcuaac

SEQ ID NO: 27568 - RNA, 19 nt, Homo sapiens
cuuggaguccaucugguuu

SEQ ID NO: 27569 - RNA, 18 nt, Homo sapiens
cuuggcucccccugucuc

SEQ ID NO: 27570 - RNA, 19 nt, Homo sapiens
ccccacccccauccugcgc

SEQ ID NO: 27571 - RNA, 19 nt, Homo sapiens
aucgaaggcuuacccuauu

SEQ ID NO: 27572 - RNA, 19 nt, Homo sapiens
caacccuccauauggcucu

SEQ ID NO: 27573 - RNA, 25 nt, Homo sapiens
ccuauauaauaauugcuuuggcuuu

SEQ ID NO: 27574 - RNA, 24 nt, Homo sapiens
cuuccagggagcucuuuuaaucuu

SEQ ID NO: 27575 - RNA, 23 nt, Homo sapiens
cuuuuuguuucuugcuuugcuuu

SEQ ID NO: 27576 - RNA, 19 nt, Homo sapiens
gcucuccaguggcuuuuaa

SEQ ID NO: 27577 - RNA, 21 nt, Homo sapiens
uaagauuauuauagucugguu

SEQ ID NO: 27578 - RNA, 21 nt, Homo sapiens
ucccccucccaacccuccaua

SEQ ID NO: 27579 - RNA, 23 nt, Homo sapiens
uccuauaccgcucucccaacaaa

SEQ ID NO: 27580 - RNA, 19 nt, Homo sapiens
caaaaagcacuuccuccca

SEQ ID NO: 27581 - RNA, 19 nt, Homo sapiens
uaaaauuguaaaaggcugc

SEQ ID NO: 27582 - RNA, 20 nt, Homo sapiens
uaugaacucgcuuuauaccu

SEQ ID NO: 27583 - RNA, 20 nt, Homo sapiens
ucuaccuagcaacugucuuc

SEQ ID NO: 27584 - RNA, 27 nt, Homo sapiens
ccaucaagacugagaaaaagcacacca

SEQ ID NO: 27585 - RNA, 23 nt, Homo sapiens
uucuggugaucgaggacuuccgg

SEQ ID NO: 27586 - RNA, 24 nt, Homo sapiens
caccaccaccgccuccuacccuuc

SEQ ID NO: 27587 - RNA, 16 nt, Homo sapiens
cagaagccuguuccag

SEQ ID NO: 27588 - RNA, 17 nt, Homo sapiens
cccagcuagagacccca

SEQ ID NO: 27589 - RNA, 17 nt, Homo sapiens
ugaaguuuugguaucgc

SEQ ID NO: 27590 - RNA, 21 nt, Homo sapiens
aacacucuucaguacauaaua

SEQ ID NO: 27591 - RNA, 20 nt, Homo sapiens
cccuccccauccccagccca

SEQ ID NO: 27592 - RNA, 23 nt, Homo sapiens
ggucuuaacucugauuguagcaa

SEQ ID NO: 27593 - RNA, 20 nt, Homo sapiens
aggguaaccagaugaucuca

SEQ ID NO: 27594 - RNA, 17 nt, Homo sapiens
gccacugccucuuaccu

SEQ ID NO: 27595 - RNA, 20 nt, Homo sapiens
gugauguuggaugccaguua

SEQ ID NO: 27596 - RNA, 24 nt, Homo sapiens
caaggcugaaguguauaguguaua

SEQ ID NO: 27597 - RNA, 17 nt, Homo sapiens
aagaaaaaaaccacaca

SEQ ID NO: 27598 - RNA, 19 nt, Homo sapiens
aagaagaaaaagguuugca

SEQ ID NO: 27599 - RNA, 18 nt, Homo sapiens
cuacaggggaguuuuguu

SEQ ID NO: 27600 - RNA, 20 nt, Homo sapiens
gcggagucuguccugugacg

SEQ ID NO: 27601 - RNA, 18 nt, Homo sapiens
guaaccggcauguuucca

SEQ ID NO: 27602 - RNA, 24 nt, Homo sapiens
uaaaaacauuuuaaaaacauagaa

SEQ ID NO: 27603 - RNA, 19 nt, Homo sapiens
uuugcuugcucauaugcau

SEQ ID NO: 27604 - RNA, 19 nt, Homo sapiens
aauugauuccuauacuaug

SEQ ID NO: 27605 - RNA, 25 nt, Homo sapiens
acuggugauaauaacagcaaccacu

SEQ ID NO: 27606 - RNA, 16 nt, Homo sapiens
agucuuccagucacgc

SEQ ID NO: 27607 - RNA, 23 nt, Homo sapiens
auccaaacaaacaacaaaccaaa

SEQ ID NO: 27608 - RNA, 17 nt, Homo sapiens
caaaugccuauucuuua

SEQ ID NO: 27609 - RNA, 25 nt, Homo sapiens
cugcgggccaacagcaaccacuucc

SEQ ID NO: 27610 - RNA, 18 nt, Homo sapiens
aaaagccagggucagcca

SEQ ID NO: 27611 - RNA, 16 nt, Homo sapiens
caaauuuagcaccuua

SEQ ID NO: 27612 - RNA, 24 nt, Homo sapiens
cccagagacagcccccacauccca

SEQ ID NO: 27613 - RNA, 24 nt, Homo sapiens
gccaccuugaggcagccuauccca

SEQ ID NO: 27614 - RNA, 19 nt, Homo sapiens
gcucuggagaggcccccac

SEQ ID NO: 27615 - RNA, 16 nt, Homo sapiens
ggaccugggaaugcac

SEQ ID NO: 27616 - RNA, 21 nt, Homo sapiens
gggcagcugcaggccacagug

SEQ ID NO: 27617 - RNA, 23 nt, Homo sapiens
guuucaucauauuggucagggug

SEQ ID NO: 27618 - RNA, 21 nt, Homo sapiens
uccugaaccacuggccccaac

SEQ ID NO: 27619 - RNA, 18 nt, Homo sapiens
ucuaccuccuggguucaa

SEQ ID NO: 27620 - RNA, 20 nt, Homo sapiens
ugucccauucccucucugua

SEQ ID NO: 27621 - RNA, 20 nt, Homo sapiens
ggcuccuggaacugcagcag

SEQ ID NO: 27622 - RNA, 16 nt, Homo sapiens
caaccuuuaaaacauc

SEQ ID NO: 27623 - RNA, 18 nt, Homo sapiens
caagaugucuaggcccgg

SEQ ID NO: 27624 - RNA, 19 nt, Homo sapiens
ccaaaaucacgccacugca

SEQ ID NO: 27625 - RNA, 25 nt, Homo sapiens
uucugguuccuaugaagauuuggaa

SEQ ID NO: 27626 - RNA, 20 nt, Homo sapiens
aagcgccuuuuccugcagcu

SEQ ID NO: 27627 - RNA, 22 nt, Homo sapiens
accagagagcagcccacgggca

SEQ ID NO: 27628 - RNA, 18 nt, Homo sapiens
accucggcugcuaggccc

SEQ ID NO: 27629 - RNA, 17 nt, Homo sapiens
ccacggccccacugucc

SEQ ID NO: 27630 - RNA, 20 nt, Homo sapiens
gcguaggggccguugcccgc

SEQ ID NO: 27631 - RNA, 20 nt, Homo sapiens
gggcagaugcuaggucaguu

SEQ ID NO: 27632 - RNA, 18 nt, Homo sapiens
gugcugguaagaccugcu

SEQ ID NO: 27633 - RNA, 21 nt, Homo sapiens
guggcaaagggguaggcucua

SEQ ID NO: 27634 - RNA, 18 nt, Homo sapiens
cuugugcccucacuaugc

SEQ ID NO: 27635 - RNA, 20 nt, Homo sapiens
cccugcuagagcagccgcgc

SEQ ID NO: 27636 - RNA, 27 nt, Homo sapiens
cuacuccacacaugcaggaggcgggug

SEQ ID NO: 27637 - RNA, 16 nt, Homo sapiens
gaaauaacgcauucga

SEQ ID NO: 27638 - RNA, 24 nt, Homo sapiens
ugagaagauuaaaaaaaaaucuca

SEQ ID NO: 27639 - RNA, 21 nt, Homo sapiens
cuccagaaaccuacuggauga

SEQ ID NO: 27640 - RNA, 17 nt, Homo sapiens
cuguggagaagucuccu

SEQ ID NO: 27641 - RNA, 19 nt, Homo sapiens
ggauggaggcagggggcug

SEQ ID NO: 27642 - RNA, 18 nt, Homo sapiens
cacugccucauggcauca

SEQ ID NO: 27643 - RNA, 20 nt, Homo sapiens
cugccucauggcaucaucca

SEQ ID NO: 27644 - RNA, 20 nt, Homo sapiens
cccuuccccacccucuggcc

SEQ ID NO: 27645 - RNA, 20 nt, Homo sapiens
cuucucugguccucugcauc

SEQ ID NO: 27646 - RNA, 18 nt, Homo sapiens
caagacacugccuaaggu

SEQ ID NO: 27647 - RNA, 21 nt, Homo sapiens
caauaaagcagacuauuccua

SEQ ID NO: 27648 - RNA, 20 nt, Homo sapiens
cugggcccuaggccuagccc

SEQ ID NO: 27649 - RNA, 19 nt, Homo sapiens
aaggauccauuguaccguu

SEQ ID NO: 27650 - RNA, 21 nt, Homo sapiens
ccugagcagaauggaaucauu

SEQ ID NO: 27651 - RNA, 18 nt, Homo sapiens
cucuauucccccugcccu

SEQ ID NO: 27652 - RNA, 20 nt, Homo sapiens
ugaaugggcuuucagaaggc

SEQ ID NO: 27653 - RNA, 18 nt, Homo sapiens
accuucuggaguacacug

SEQ ID NO: 27654 - RNA, 18 nt, Homo sapiens
aucucuuaaaaugaggaa

SEQ ID NO: 27655 - RNA, 21 nt, Homo sapiens
caagacugguggacaagugua

SEQ ID NO: 27656 - RNA, 18 nt, Homo sapiens
ccaggggcaauguuuaca

SEQ ID NO: 27657 - RNA, 23 nt, Homo sapiens
cccacaguacaaagguaccguca

SEQ ID NO: 27658 - RNA, 27 nt, Homo sapiens
gagagccaggagcccuucaaggucucc

SEQ ID NO: 27659 - RNA, 18 nt, Homo sapiens
uagcagacugugcaggga

SEQ ID NO: 27660 - RNA, 21 nt, Homo sapiens
ucugccgccaugguugugcaa

SEQ ID NO: 27661 - RNA, 18 nt, Homo sapiens
ggaccccgugcugccuca

SEQ ID NO: 27662 - RNA, 19 nt, Homo sapiens
acaaaacuguuaucugaug

SEQ ID NO: 27663 - RNA, 22 nt, Homo sapiens
guccuccugagcugugaucaga

SEQ ID NO: 27664 - RNA, 18 nt, Homo sapiens
aaaguugggacugagcag

SEQ ID NO: 27665 - RNA, 21 nt, Homo sapiens
agaaaggguggccacuuuccc

SEQ ID NO: 27666 - RNA, 18 nt, Homo sapiens
agggcgcgcggcauuucc

SEQ ID NO: 27667 - RNA, 17 nt, Homo sapiens
cuccccaaccuccucca

SEQ ID NO: 27668 - RNA, 17 nt, Homo sapiens
gcuagaacacagcaggg

SEQ ID NO: 27669 - RNA, 18 nt, Homo sapiens
gacaccuacagcaucagg

SEQ ID NO: 27670 - RNA, 23 nt, Homo sapiens
ccguucaguucuccugggcucca

SEQ ID NO: 27671 - RNA, 18 nt, Homo sapiens
cgggagggaacauccugc

SEQ ID NO: 27672 - RNA, 18 nt, Homo sapiens
cuguugcaggcaaaugua

SEQ ID NO: 27673 - RNA, 20 nt, Homo sapiens
agccuaagagcuaaggcagu

SEQ ID NO: 27674 - RNA, 18 nt, Homo sapiens
gauccugaaacaugcggg

SEQ ID NO: 27675 - RNA, 19 nt, Homo sapiens
guggucuuucuuguuuuua

SEQ ID NO: 27676 - RNA, 17 nt, Homo sapiens
uccugaaacaugcggga

SEQ ID NO: 27677 - RNA, 19 nt, Homo sapiens
aacuguugaguugaucaca

SEQ ID NO: 27678 - RNA, 21 nt, Homo sapiens
aacuguugaguugaucacaua

SEQ ID NO: 27679 - RNA, 17 nt, Homo sapiens
aaucgcaccuuaucuga

SEQ ID NO: 27680 - RNA, 19 nt, Homo sapiens
accacuuacagcuuucuca

SEQ ID NO: 27681 - RNA, 21 nt, Homo sapiens
aguuuucuuucuuuccuuguc

SEQ ID NO: 27682 - RNA, 20 nt, Homo sapiens
auguuugaggaccugcaaua

SEQ ID NO: 27683 - RNA, 21 nt, Homo sapiens
ccaaagaucaaacacagcauu

SEQ ID NO: 27684 - RNA, 19 nt, Homo sapiens
cgguggaaugacguggcca

SEQ ID NO: 27685 - RNA, 15 nt, Homo sapiens
cuccuuuaucuugca

SEQ ID NO: 27686 - RNA, 22 nt, Homo sapiens
ggaacauggggaccaacaaagc

SEQ ID NO: 27687 - RNA, 19 nt, Homo sapiens
ucugagaucuggugucaga

SEQ ID NO: 27688 - RNA, 18 nt, Homo sapiens
uuggcaaaucgcaccuua

SEQ ID NO: 27689 - RNA, 23 nt, Homo sapiens
uuugauuuuucaagagacaagaa

SEQ ID NO: 27690 - RNA, 19 nt, Homo sapiens
aacuguugaguugaucaca

SEQ ID NO: 27691 - RNA, 21 nt, Homo sapiens
aacuguugaguugaucacaua

SEQ ID NO: 27692 - RNA, 17 nt, Homo sapiens
aaucgcaccuuaucuga

SEQ ID NO: 27693 - RNA, 19 nt, Homo sapiens
accacuuacagcuuucuca

SEQ ID NO: 27694 - RNA, 21 nt, Homo sapiens
aguuuucuuucuuuccuuguc

SEQ ID NO: 27695 - RNA, 20 nt, Homo sapiens
auguuugaggaccugcaaua

SEQ ID NO: 27696 - RNA, 21 nt, Homo sapiens
ccaaagaucaaacacagcauu

SEQ ID NO: 27697 - RNA, 19 nt, Homo sapiens
cgguggaaugacguggcca

SEQ ID NO: 27698 - RNA, 15 nt, Homo sapiens
cuccuuuaucuugca

SEQ ID NO: 27699 - RNA, 22 nt, Homo sapiens
ggaacauggggaccaacaaagc

SEQ ID NO: 27700 - RNA, 19 nt, Homo sapiens
ucugagaucuggugucaga

SEQ ID NO: 27701 - RNA, 18 nt, Homo sapiens
uuggcaaaucgcaccuua

SEQ ID NO: 27702 - RNA, 23 nt, Homo sapiens
uuugauuuuucaagagacaagaa

SEQ ID NO: 27703 - RNA, 21 nt, Homo sapiens
aacugggacauauagauacca

SEQ ID NO: 27704 - RNA, 18 nt, Homo sapiens
aagaaccaaaugcacugu

SEQ ID NO: 27705 - RNA, 25 nt, Homo sapiens
cuuuuuguggaacauguaguuuaua

SEQ ID NO: 27706 - RNA, 20 nt, Homo sapiens
gaacacuaguccuaccucug

SEQ ID NO: 27707 - RNA, 19 nt, Homo sapiens
gcuuaauauucucauugca

SEQ ID NO: 27708 - RNA, 19 nt, Homo sapiens
uaucuugcucugaguagua

SEQ ID NO: 27709 - RNA, 18 nt, Homo sapiens
accacuaauuguguacau

SEQ ID NO: 27710 - RNA, 30 nt, Homo sapiens; identical to SEQ ID NO: 11049

SEQ ID NO: 27711 - RNA, 21 nt, Homo sapiens
cuaagcaaacaaguuggaauu

SEQ ID NO: 27712 - RNA, 20 nt, Homo sapiens
ccucugccuccuggguucaa

SEQ ID NO: 27713 - RNA, 22 nt, Homo sapiens
uguucucaucuauguuaaugaa

SEQ ID NO: 27714 - RNA, 16 nt, Homo sapiens
gccagcccgcacgcgc

SEQ ID NO: 27715 - RNA, 22 nt, Homo sapiens
gcccgcacgcgcucaucuuucu

SEQ ID NO: 27716 - RNA, 18 nt, Homo sapiens
accagccuccucagacaa

SEQ ID NO: 27717 - RNA, 19 nt, Homo sapiens
auguuuggcgggcauguga

SEQ ID NO: 27718 - RNA, 21 nt, Homo sapiens
cugcuuugaugugaacuggua

SEQ ID NO: 27719 - RNA, 19 nt, Homo sapiens
gaaacagaggaacccauca

SEQ ID NO: 27720 - RNA, 19 nt, Homo sapiens
gaagaaacagaggaaccca

SEQ ID NO: 27721 - RNA, 18 nt, Homo sapiens
gaugcgaaauggauauuc

SEQ ID NO: 27722 - RNA, 22 nt, Homo sapiens
gguuuuggccccuuugcugcaa

SEQ ID NO: 27723 - RNA, 18 nt, Homo sapiens
ucuagcuugaaacuuuug

SEQ ID NO: 27724 - RNA, 18 nt, Homo sapiens
acacccgcuccaccugca

SEQ ID NO: 27725 - RNA, 18 nt, Homo sapiens
accccgagaccgcgcugg

SEQ ID NO: 27726 - RNA, 16 nt, Homo sapiens
acccgcuccaccugca

SEQ ID NO: 27727 - RNA, 19 nt, Homo sapiens
cacacccgcuccaccugca

SEQ ID NO: 27728 - RNA, 21 nt, Homo sapiens
gcaggacugaggguuuuugca

SEQ ID NO: 27729 - RNA, 21 nt, Homo sapiens
gcaggacugaggguuuuugca

SEQ ID NO: 27730 - RNA, 21 nt, Homo sapiens
acgcucaaccccaaguccuuu

SEQ ID NO: 27731 - RNA, 24 nt, Homo sapiens
acuuggaccgcuucagccugggcu

SEQ ID NO: 27732 - RNA, 23 nt, Homo sapiens
aggugucccuccccugcuaguca

SEQ ID NO: 27733 - RNA, 22 nt, Homo sapiens
ccugcugagaccuagguugcca

SEQ ID NO: 27734 - RNA, 23 nt, Homo sapiens
gccacccagcuggacacgggaga

SEQ ID NO: 27735 - RNA, 18 nt, Homo sapiens
guucuucccccuccaugu

SEQ ID NO: 27736 - RNA, 19 nt, Homo sapiens
ucaucauacuggcacuguu

SEQ ID NO: 27737 - RNA, 16 nt, Homo sapiens
aggucaacauugacca

SEQ ID NO: 27738 - RNA, 19 nt, Homo sapiens
cauuggaggagugguuuaa

SEQ ID NO: 27739 - RNA, 24 nt, Homo sapiens
ccuagaaguucuugauucauuuuu

SEQ ID NO: 27740 - RNA, 17 nt, Homo sapiens
ucacugauauauguaga

SEQ ID NO: 27741 - RNA, 21 nt, Homo sapiens
uggggucuccuggguucagcg

SEQ ID NO: 27742 - RNA, 18 nt, Homo sapiens
aguaagauaaucucauca

SEQ ID NO: 27743 - RNA, 17 nt, Homo sapiens
aagucugacuagaauuc

SEQ ID NO: 27744 - RNA, 20 nt, Homo sapiens
aggcaucagaguaaucuuca

SEQ ID NO: 27745 - RNA, 23 nt, Homo sapiens
caaagaaggcaauaaggaaccca

SEQ ID NO: 27746 - RNA, 17 nt, Homo sapiens
caccaucuccccucaaa

SEQ ID NO: 27747 - RNA, 20 nt, Homo sapiens
uuuaaguggcuaacauccaa

SEQ ID NO: 27748 - RNA, 18 nt, Homo sapiens
agaaaacacccucaaagg

SEQ ID NO: 27749 - RNA, 20 nt, Homo sapiens
cagaagaacuccauucuugu

SEQ ID NO: 27750 - RNA, 24 nt, Homo sapiens
uguaugaacaaguguuuuuggaau

SEQ ID NO: 27751 - RNA, 22 nt, Homo sapiens
uuauuucaucuucccuauucca

SEQ ID NO: 27752 - RNA, 19 nt, Homo sapiens
uugagucucccugguggag

SEQ ID NO: 27753 - RNA, 20 nt, Homo sapiens
cacacagccaugcauuguca

SEQ ID NO: 27754 - RNA, 23 nt, Homo sapiens
cccuggaggggagggucuguggg

SEQ ID NO: 27755 - RNA, 22 nt, Homo sapiens
gccugggagacccaucuggucc

SEQ ID NO: 27756 - RNA, 19 nt, Homo sapiens
cgagaucuuggagguccgg

SEQ ID NO: 27757 - RNA, 20 nt, Homo sapiens
agucaugaugaugggcagcg

SEQ ID NO: 27758 - RNA, 17 nt, Homo sapiens
cggcuggacgugcgcga

SEQ ID NO: 27759 - RNA, 23 nt, Homo sapiens
ugaaagaaccagagaggcucuga

SEQ ID NO: 27760 - RNA, 19 nt, Homo sapiens
uguguuggaguuuucugga

SEQ ID NO: 27761 - RNA, 20 nt, Homo sapiens
cgccggccggccagcaccca

SEQ ID NO: 27762 - RNA, 19 nt, Homo sapiens
acagcauuuauuuguacua

SEQ ID NO: 27763 - RNA, 20 nt, Homo sapiens
agauauaccgugugaagcua

SEQ ID NO: 27764 - RNA, 17 nt, Homo sapiens
auauguaugugugguua

SEQ ID NO: 27765 - RNA, 17 nt, Homo sapiens
augcuuaagcuauguca

SEQ ID NO: 27766 - RNA, 24 nt, Homo sapiens
gagacauaaugacagcugauguua

SEQ ID NO: 27767 - RNA, 19 nt, Homo sapiens
ucaugcuuaagcuauguca

SEQ ID NO: 27768 - RNA, 22 nt, Homo sapiens
acuaccagaugugugcagugca

SEQ ID NO: 27769 - RNA, 22 nt, Homo sapiens
auaaggugguugugcuacugua

SEQ ID NO: 27770 - RNA, 21 nt, Homo sapiens
guauacugacaacuguuuaca

SEQ ID NO: 27771 - RNA, 19 nt, Homo sapiens
uuuguuacaaagccacuga

SEQ ID NO: 27772 - RNA, 19 nt, Homo sapiens
acacaggacaucguugcug

SEQ ID NO: 27773 - RNA, 21 nt, Homo sapiens
agaccccccgacccuccccca

SEQ ID NO: 27774 - RNA, 21 nt, Homo sapiens
agugccguggaggugugugug

SEQ ID NO: 27775 - RNA, 18 nt, Homo sapiens
cggacagacgucccgcca

SEQ ID NO: 27776 - RNA, 23 nt, Homo sapiens
cuccagacacaauggcacugcuu

SEQ ID NO: 27777 - RNA, 20 nt, Homo sapiens
gacagacgucccgccaccca

SEQ ID NO: 27778 - RNA, 18 nt, Homo sapiens
gggcgacuguccugcgug

SEQ ID NO: 27779 - RNA, 21 nt, Homo sapiens
cgaaauggacaaaguggcauc

SEQ ID NO: 27780 - RNA, 19 nt, Homo sapiens
ccucccccuuguccuuucc

SEQ ID NO: 27781 - RNA, 24 nt, Homo sapiens
gccuggacuguuuucucucggcuc

SEQ ID NO: 27782 - RNA, 18 nt, Homo sapiens
gcgaccuuccucauccac

SEQ ID NO: 27783 - RNA, 24 nt, Homo sapiens
ugggcauuuuuauuuuaugaaaua

SEQ ID NO: 27784 - RNA, 18 nt, Homo sapiens
ugggcucauauggggcug

SEQ ID NO: 27785 - RNA, 23 nt, Homo sapiens
aauuucaaauggauccgaucuaa

SEQ ID NO: 27786 - RNA, 26 nt, Homo sapiens
uacuggagagagacacacagaucuaa

SEQ ID NO: 27787 - RNA, 17 nt, Homo sapiens
cuaguuccucuuuugau

SEQ ID NO: 27788 - RNA, 18 nt, Homo sapiens
cuaguuccucuuuugaua

SEQ ID NO: 27789 - RNA, 18 nt, Homo sapiens
uccacuucccagguucaa

SEQ ID NO: 27790 - RNA, 22 nt, Homo sapiens
ugauaaggcuguuaacauuaca

SEQ ID NO: 27791 - RNA, 19 nt, Homo sapiens
uggaucaagaaugcauuaa

SEQ ID NO: 27792 - RNA, 20 nt, Homo sapiens
uggccgggcuggucuugaac

SEQ ID NO: 27793 - RNA, 18 nt, Homo sapiens
uucaagcgauucucaugc

SEQ ID NO: 27794 - RNA, 17 nt, Homo sapiens
uugacauaccaaguggu

SEQ ID NO: 27795 - RNA, 20 nt, Homo sapiens
uuucuuuaugaucuuaacuu

SEQ ID NO: 27796 - RNA, 19 nt, Homo sapiens
agcacguugaccucccucu

SEQ ID NO: 27797 - RNA, 17 nt, Homo sapiens
ccagcccccaccccacc

SEQ ID NO: 27798 - RNA, 18 nt, Homo sapiens
ccugcugguucuuggccc

SEQ ID NO: 27799 - RNA, 19 nt, Homo sapiens
cuccagcccccaccccacc

SEQ ID NO: 27800 - RNA, 18 nt, Homo sapiens
guauauaugaaaauuuga

SEQ ID NO: 27801 - RNA, 24 nt, Homo sapiens
cacacaauccccaggguuccugag

SEQ ID NO: 27802 - RNA, 16 nt, Homo sapiens
caccgcucaucccgau

SEQ ID NO: 27803 - RNA, 21 nt, Homo sapiens
gcaauaccgggccguguccuc

SEQ ID NO: 27804 - RNA, 21 nt, Homo sapiens
ggacuuggaaugaggccuaca

SEQ ID NO: 27805 - RNA, 24 nt, Homo sapiens
uugagacgccuuacaaaugaugga

SEQ ID NO: 27806 - RNA, 21 nt, Homo sapiens
aauggcacuguugcaaacuca

SEQ ID NO: 27807 - RNA, 17 nt, Homo sapiens
caaacuaaaggugcacu

SEQ ID NO: 27808 - RNA, 17 nt, Homo sapiens
cggcuggacgugcgcga

SEQ ID NO: 27809 - RNA, 22 nt, Homo sapiens
ggcggggcagugaggacuccgc

SEQ ID NO: 27810 - RNA, 20 nt, Homo sapiens
aacuccaucagaucuucuca

SEQ ID NO: 27811 - RNA, 22 nt, Homo sapiens
uaugaccugugcccuguucuuc

SEQ ID NO: 27812 - RNA, 19 nt, Homo sapiens
uucucaccuccucuuagcc

SEQ ID NO: 27813 - RNA, 21 nt, Homo sapiens
uuuuuuugaugaagccgagca

SEQ ID NO: 27814 - RNA, 21 nt, Homo sapiens
gcccccgcccgcccuccccca

SEQ ID NO: 27815 - RNA, 20 nt, Homo sapiens
gccccggagccucgcccucc

SEQ ID NO: 27816 - RNA, 21 nt, Homo sapiens
uuuuuuugaugaagccgagca

SEQ ID NO: 27817 - RNA, 18 nt, Homo sapiens
gugggguuauguaucaga

SEQ ID NO: 27818 - RNA, 20 nt, Homo sapiens
aguuucacucugucgcccag

SEQ ID NO: 27819 - RNA, 18 nt, Homo sapiens
caccgcccaccaccuccu

SEQ ID NO: 27820 - RNA, 20 nt, Homo sapiens
ccacaacuuuggacacccca

SEQ ID NO: 27821 - RNA, 19 nt, Homo sapiens
ccuggggaguuccuggucc

SEQ ID NO: 27822 - RNA, 20 nt, Homo sapiens
cguguggucacccgccgucc

SEQ ID NO: 27823 - RNA, 23 nt, Homo sapiens
aagugcuucaaauacuucucucu

SEQ ID NO: 27824 - RNA, 19 nt, Homo sapiens
aauguuuccuuuuacuuca

SEQ ID NO: 27825 - RNA, 22 nt, Homo sapiens
cccuguuaaugaacaggacaaa

SEQ ID NO: 27826 - RNA, 20 nt, Homo sapiens
aggagaaauaccugauguag

SEQ ID NO: 27827 - RNA, 21 nt, Homo sapiens
uacuauaaagacacaugcaca

SEQ ID NO: 27828 - RNA, 19 nt, Homo sapiens
ugaacaaugagaauacaug

SEQ ID NO: 27829 - RNA, 19 nt, Homo sapiens
auucaaguggauucuaaau

SEQ ID NO: 27830 - RNA, 23 nt, Homo sapiens
ggagacgcagcggcggccgcagc

SEQ ID NO: 27831 - RNA, 16 nt, Homo sapiens
gugccuaaauguagua

SEQ ID NO: 27832 - RNA, 21 nt, Homo sapiens
ucacuuuccccaucacacuca

SEQ ID NO: 27833 - RNA, 21 nt, Homo sapiens
aaagugguaccgacuucccca

SEQ ID NO: 27834 - RNA, 22 nt, Homo sapiens
ggacaaugcugguacguaccca

SEQ ID NO: 27835 - RNA, 21 nt, Homo sapiens
aaagugguaccgacuucccca

SEQ ID NO: 27836 - RNA, 18 nt, Homo sapiens
caaacuguggagaucacu

SEQ ID NO: 27837 - RNA, 17 nt, Homo sapiens
cuccccaaccaagucca

SEQ ID NO: 27838 - RNA, 22 nt, Homo sapiens
ggacaaugcugguacguaccca

SEQ ID NO: 27839 - RNA, 20 nt, Homo sapiens
gguuuuggggaugcagucaa

SEQ ID NO: 27840 - RNA, 18 nt, Homo sapiens
agcuaugauuaggacaac

SEQ ID NO: 27841 - RNA, 17 nt, Homo sapiens
ggguuuucugacccuca

SEQ ID NO: 27842 - RNA, 19 nt, Homo sapiens
acuaaggacacaagaauca

SEQ ID NO: 27843 - RNA, 20 nt, Homo sapiens
ccacuaccuccuccaacaaa

SEQ ID NO: 27844 - RNA, 19 nt, Homo sapiens
cccuccacccacuaccucc

SEQ ID NO: 27845 - RNA, 18 nt, Homo sapiens
cuccagagcuggcccuuc

SEQ ID NO: 27846 - RNA, 21 nt, Homo sapiens
cuuagggagguuggugucaga

SEQ ID NO: 27847 - RNA, 19 nt, Homo sapiens
gcucugagccagauuccac

SEQ ID NO: 27848 - RNA, 18 nt, Homo sapiens
ggaggagggcagggcuug

SEQ ID NO: 27849 - RNA, 22 nt, Homo sapiens
gggacagcuaccacuguccucu

SEQ ID NO: 27850 - RNA, 24 nt, Homo sapiens
uggaugggggugaugcagggacug

SEQ ID NO: 27851 - RNA, 16 nt, Homo sapiens
aucuccaaggugaggu

SEQ ID NO: 27852 - RNA, 18 nt, Homo sapiens
aucuugaccucuuggcuc

SEQ ID NO: 27853 - RNA, 18 nt, Homo sapiens
caucaccauuuuuccuga

SEQ ID NO: 27854 - RNA, 16 nt, Homo sapiens
aucuccaaggugaggu

SEQ ID NO: 27855 - RNA, 18 nt, Homo sapiens
aucuugaccucuuggcuc

SEQ ID NO: 27856 - RNA, 18 nt, Homo sapiens
caucaccauuuuuccuga

SEQ ID NO: 27857 - RNA, 16 nt, Homo sapiens
aucuccaaggugaggu

SEQ ID NO: 27858 - RNA, 18 nt, Homo sapiens
aucuugaccucuuggcuc

SEQ ID NO: 27859 - RNA, 18 nt, Homo sapiens
caucaccauuuuuccuga

SEQ ID NO: 27860 - RNA, 16 nt, Homo sapiens
aucuccaaggugaggu

SEQ ID NO: 27861 - RNA, 18 nt, Homo sapiens
aucuugaccucuuggcuc

SEQ ID NO: 27862 - RNA, 18 nt, Homo sapiens
caucaccauuuuuccuga

SEQ ID NO: 27863 - RNA, 16 nt, Homo sapiens
aucuccaaggugaggu

SEQ ID NO: 27864 - RNA, 18 nt, Homo sapiens
aucuugaccucuuggcuc

SEQ ID NO: 27865 - RNA, 18 nt, Homo sapiens
caucaccauuuuuccuga

SEQ ID NO: 27866 - RNA, 18 nt, Homo sapiens
acagggauuuaauaccuu

SEQ ID NO: 27867 - RNA, 19 nt, Homo sapiens
gauuuuggacuuucacaaa

SEQ ID NO: 27868 - RNA, 22 nt, Homo sapiens
guauuuuuguauaacuugauug

SEQ ID NO: 27869 - RNA, 26 nt, Homo sapiens
aaagacacgauuccucagaccaguga

SEQ ID NO: 27870 - RNA, 20 nt, Homo sapiens
cagagacuauaaagauuuca

SEQ ID NO: 27871 - RNA, 18 nt, Homo sapiens
ccuuagaucucccuucca

SEQ ID NO: 27872 - RNA, 21 nt, Homo sapiens
ccuucccuucacuucugucca

SEQ ID NO: 27873 - RNA, 16 nt, Homo sapiens
uucagagaccguucca

SEQ ID NO: 27874 - RNA, 21 nt, Homo sapiens
uuccagagaccaccuucccag

SEQ ID NO: 27875 - RNA, 26 nt, Homo sapiens
aaagacacgauuccucagaccaguga

SEQ ID NO: 27876 - RNA, 22 nt, Homo sapiens
acagauaaugucuuuuaaucca

SEQ ID NO: 27877 - RNA, 20 nt, Homo sapiens
cagagacuauaaagauuuca

SEQ ID NO: 27878 - RNA, 22 nt, Homo sapiens
cagccuggccaacacaaugaaa

SEQ ID NO: 27879 - RNA, 18 nt, Homo sapiens
ccuuagaucucccuucca

SEQ ID NO: 27880 - RNA, 18 nt, Homo sapiens
gcacauuagcuccgcuca

SEQ ID NO: 27881 - RNA, 21 nt, Homo sapiens
uucaaggugaguagcuuccaa

SEQ ID NO: 27882 - RNA, 21 nt, Homo sapiens
uuccagagaccaccuucccag

SEQ ID NO: 27883 - RNA, 21 nt, Homo sapiens
caagggcgagcccccgccgcg

SEQ ID NO: 27884 - RNA, 21 nt, Homo sapiens
ccaccgccgccgccgccgcuc

SEQ ID NO: 27885 - RNA, 22 nt, Homo sapiens
acagcuggagucaaacaacuua

SEQ ID NO: 27886 - RNA, 20 nt, Homo sapiens
aagaaagaagcccagguguc

SEQ ID NO: 27887 - RNA, 19 nt, Homo sapiens
ccccaucucagagcucaga

SEQ ID NO: 27888 - RNA, 18 nt, Homo sapiens
gcccacaccuccaccucc

SEQ ID NO: 27889 - RNA, 20 nt, Homo sapiens
aagaaagaagcccagguguc

SEQ ID NO: 27890 - RNA, 19 nt, Homo sapiens
ccccaucucagagcucaga

SEQ ID NO: 27891 - RNA, 18 nt, Homo sapiens
gcccacaccuccaccucc

SEQ ID NO: 27892 - RNA, 19 nt, Homo sapiens
agauauaacauucaguucc

SEQ ID NO: 27893 - RNA, 20 nt, Homo sapiens
ccaaauauguauuuuccuaa

SEQ ID NO: 27894 - RNA, 20 nt, Homo sapiens
cuucuaacccccucugcucu

SEQ ID NO: 27895 - RNA, 23 nt, Homo sapiens
gccugaucuugccugucuggcuc

SEQ ID NO: 27896 - RNA, 19 nt, Homo sapiens
gggauccuugggcccauca

SEQ ID NO: 27897 - RNA, 18 nt, Homo sapiens
guuuccuggaaaagaaga

SEQ ID NO: 27898 - RNA, 26 nt, Homo sapiens
uacaaucaguugacuuuaagugaaag

SEQ ID NO: 27899 - RNA, 22 nt, Homo sapiens
uccccucuucugcuaauaccuc

SEQ ID NO: 27900 - RNA, 18 nt, Homo sapiens
uccugguuugacucaguu

SEQ ID NO: 27901 - RNA, 26 nt, Homo sapiens
uucuggccaaggggugggccugugaa

SEQ ID NO: 27902 - RNA, 18 nt, Homo sapiens
agugaguggagagccagc

SEQ ID NO: 27903 - RNA, 20 nt, Homo sapiens
guccgugcaccgaugcacac

SEQ ID NO: 27904 - RNA, 22 nt, Homo sapiens
ucucuuuugaguuuuauaccuu

SEQ ID NO: 27905 - RNA, 23 nt, Homo sapiens
cuuagugcucugaauuuacuuuu

SEQ ID NO: 27906 - RNA, 19 nt, Homo sapiens
gauuuuaaucaccauuaca

SEQ ID NO: 27907 - RNA, 20 nt, Homo sapiens
uacgcgcucucccuguuuag

SEQ ID NO: 27908 - RNA, 17 nt, Homo sapiens
caacaccggaacaagcc

SEQ ID NO: 27909 - RNA, 18 nt, Homo sapiens
gaggcagaaacaccagcc

SEQ ID NO: 27910 - RNA, 19 nt, Homo sapiens
uuuuuuguuuucccccacu

SEQ ID NO: 27911 - RNA, 22 nt, Homo sapiens
ucugugcgcggccggcuggcuc

SEQ ID NO: 27912 - RNA, 23 nt, Homo sapiens
aucugggaaugauugucuagccu

SEQ ID NO: 27913 - RNA, 23 nt, Homo sapiens
ccacagcugagguccuucucuca

SEQ ID NO: 27914 - RNA, 18 nt, Homo sapiens
ccaccccaucugagaaac

SEQ ID NO: 27915 - RNA, 22 nt, Homo sapiens
cuuuggaaaaaagaucugggaa

SEQ ID NO: 27916 - RNA, 21 nt, Homo sapiens
gacaaugcugaaugggcuccu

SEQ ID NO: 27917 - RNA, 24 nt, Homo sapiens
gccugggcgagcuugcuguggucc

SEQ ID NO: 27918 - RNA, 20 nt, Homo sapiens
uccugguggauggaccucgg

SEQ ID NO: 27919 - RNA, 20 nt, Homo sapiens
ugagaaaguuguauacacuc

SEQ ID NO: 27920 - RNA, 23 nt, Homo sapiens
uggauggaccucgggugcagcug

SEQ ID NO: 27921 - RNA, 21 nt, Homo sapiens
ugguaccaccccaucugagaa

SEQ ID NO: 27922 - RNA, 16 nt, Homo sapiens
aaacaggaccagccgg

SEQ ID NO: 27923 - RNA, 19 nt, Homo sapiens
aggaaagacuuuuauguca

SEQ ID NO: 27924 - RNA, 21 nt, Homo sapiens
cacugaacccauuguuucuuu

SEQ ID NO: 27925 - RNA, 18 nt, Homo sapiens
cacccccuuccugucacc

SEQ ID NO: 27926 - RNA, 22 nt, Homo sapiens
aagacacgaagcgaccuaccca

SEQ ID NO: 27927 - RNA, 21 nt, Homo sapiens
agcucauuccucuaccucaua

SEQ ID NO: 27928 - RNA, 20 nt, Homo sapiens
ggccucuggagaccaucuug

SEQ ID NO: 27929 - RNA, 23 nt, Homo sapiens
guccugcauucugacugagauug

SEQ ID NO: 27930 - RNA, 23 nt, Homo sapiens
ugcaagcucauuccucuaccuca

SEQ ID NO: 27931 - RNA, 19 nt, Homo sapiens
gccacacuccaagcaccug

SEQ ID NO: 27932 - RNA, 21 nt, Homo sapiens
aucugggucccauucuggucu

SEQ ID NO: 27933 - RNA, 22 nt, Homo sapiens
gcuuugucccagaaguccagag

SEQ ID NO: 27934 - RNA, 20 nt, Homo sapiens
aauaggcauuuaaugaaaca

SEQ ID NO: 27935 - RNA, 23 nt, Homo sapiens
uuuggguggagcagagucgcuuu

SEQ ID NO: 27936 - RNA, 18 nt, Homo sapiens
gccacagaagaugucaug

SEQ ID NO: 27937 - RNA, 21 nt, Homo sapiens
ugaaugagacaaaagcagugg

SEQ ID NO: 27938 - RNA, 23 nt, Homo sapiens
cuccuucucucuuucuugcucca

SEQ ID NO: 27939 - RNA, 19 nt, Homo sapiens
uagugccaacuuucuugga

SEQ ID NO: 27940 - RNA, 19 nt, Homo sapiens
acgguguacgagcucccuc

SEQ ID NO: 27941 - RNA, 24 nt, Homo sapiens
ucugugugcagacucccaacgcca

SEQ ID NO: 27942 - RNA, 23 nt, Homo sapiens
cuucuuuggcuuguuuuguuuuu

SEQ ID NO: 27943 - RNA, 18 nt, Homo sapiens
uggaucacacacauucga

SEQ ID NO: 27944 - RNA, 24 nt, Homo sapiens
cagaagaacugcuugaaccuggga

SEQ ID NO: 27945 - RNA, 22 nt, Homo sapiens
cagccuggccaacacgaugaaa

SEQ ID NO: 27946 - RNA, 18 nt, Homo sapiens
agugaucaucccaccuca

SEQ ID NO: 27947 - RNA, 25 nt, Homo sapiens
gagacuaauccuagaguacuuugca

SEQ ID NO: 27948 - RNA, 21 nt, Homo sapiens
auucauuuugaccacgaggca

SEQ ID NO: 27949 - RNA, 22 nt, Homo sapiens
gaguuucuucuucaaggucuca

SEQ ID NO: 27950 - RNA, 16 nt, Homo sapiens
cauucaaauguuuuac

SEQ ID NO: 27951 - RNA, 18 nt, Homo sapiens
ccugcaaccuccaccucc

SEQ ID NO: 27952 - RNA, 21 nt, Homo sapiens
uaagaaucuuuacuugauaua

SEQ ID NO: 27953 - RNA, 24 nt, Homo sapiens
ugcaaccuccaccuccuggauuca

SEQ ID NO: 27954 - RNA, 21 nt, Homo sapiens
acuaacaguuuuagaaaguga

SEQ ID NO: 27955 - RNA, 24 nt, Homo sapiens
agcuauccuuuugccuuuaccuca

SEQ ID NO: 27956 - RNA, 19 nt, Homo sapiens
ccucaccacuauuacccua

SEQ ID NO: 27957 - RNA, 18 nt, Homo sapiens
cucccuggccaugcugaa

SEQ ID NO: 27958 - RNA, 20 nt, Homo sapiens
cacugccuggaugcaucuca

SEQ ID NO: 27959 - RNA, 19 nt, Homo sapiens
guggguuuccccuuugauu

SEQ ID NO: 27960 - RNA, 18 nt, Homo sapiens
ucacuggcugaugcagca

SEQ ID NO: 27961 - RNA, 19 nt, Homo sapiens
uuccagcccaaacugcaca

SEQ ID NO: 27962 - RNA, 17 nt, Homo sapiens
ccauuacccaaaccacu

SEQ ID NO: 27963 - RNA, 18 nt, Homo sapiens
cuguagcucaaucagugu

SEQ ID NO: 27964 - RNA, 23 nt, Homo sapiens
gaauuaagguaacaucaauaccu

SEQ ID NO: 27965 - RNA, 18 nt, Homo sapiens
uccucacccuuccacuuu

SEQ ID NO: 27966 - RNA, 22 nt, Homo sapiens
ugggcccuggcuuaagccgaca

SEQ ID NO: 27967 - RNA, 19 nt, Homo sapiens
aacccagcccauuugcaca

SEQ ID NO: 27968 - RNA, 21 nt, Homo sapiens
ugcggguggcuccaucagcca

SEQ ID NO: 27969 - RNA, 25 nt, Homo sapiens
uggggugggggacuaggcucagccg

SEQ ID NO: 27970 - RNA, 21 nt, Homo sapiens
ggagaccgcggcggcggcggc

SEQ ID NO: 27971 - RNA, 17 nt, Homo sapiens
gaagaccaucuucauga

SEQ ID NO: 27972 - RNA, 19 nt, Homo sapiens
ugaggccagagcuugcuuu

SEQ ID NO: 27973 - RNA, 24 nt, Homo sapiens
accaggcccaccuggaaucccaca

SEQ ID NO: 27974 - RNA, 20 nt, Homo sapiens
agguguuggcugccuggccc

SEQ ID NO: 27975 - RNA, 21 nt, Homo sapiens
cacugaguauguucauugcca

SEQ ID NO: 27976 - RNA, 20 nt, Homo sapiens
ccccuguccuccccugggca

SEQ ID NO: 27977 - RNA, 18 nt, Homo sapiens
ggcaccccucacuuuccc

SEQ ID NO: 27978 - RNA, 24 nt, Homo sapiens
accaggcccaccuggaaucccaca

SEQ ID NO: 27979 - RNA, 20 nt, Homo sapiens
agguguuggcugccuggccc

SEQ ID NO: 27980 - RNA, 21 nt, Homo sapiens
cacugaguauguucauugcca

SEQ ID NO: 27981 - RNA, 20 nt, Homo sapiens
ccccuguccuccccugggca

SEQ ID NO: 27982 - RNA, 18 nt, Homo sapiens
ggcaccccucacuuuccc

SEQ ID NO: 27983 - RNA, 18 nt, Homo sapiens
caacuuucccaauguggc

SEQ ID NO: 27984 - RNA, 22 nt, Homo sapiens
cuuucagguacuaaauaccuca

SEQ ID NO: 27985 - RNA, 18 nt, Homo sapiens
uauagacaaauaauaagc

SEQ ID NO: 27986 - RNA, 19 nt, Homo sapiens
gcuucaacuauugcccuuu

SEQ ID NO: 27987 - RNA, 20 nt, Homo sapiens
gggauaaacuagauauagca

SEQ ID NO: 27988 - RNA, 23 nt, Homo sapiens
gcgcgaaacauggcggggcagga

SEQ ID NO: 27989 - RNA, 21 nt, Homo sapiens
aaacuacagaaccacauccca

SEQ ID NO: 27990 - RNA, 22 nt, Homo sapiens
aucuuggcucacugcaaccucu

SEQ ID NO: 27991 - RNA, 21 nt, Homo sapiens
auggcacaugcuuccacucca

SEQ ID NO: 27992 - RNA, 20 nt, Homo sapiens
cacaccuggcuguuuucuuu

SEQ ID NO: 27993 - RNA, 21 nt, Homo sapiens
cagugcucugucagcagccug

SEQ ID NO: 27994 - RNA, 20 nt, Homo sapiens
ccucugccucccggguucaa

SEQ ID NO: 27995 - RNA, 22 nt, Homo sapiens
cuuugggaacaaacucuuccuu

SEQ ID NO: 27996 - RNA, 25 nt, Homo sapiens
ugcaaccuccgccuccuggauucca

SEQ ID NO: 27997 - RNA, 21 nt, Homo sapiens
aaacuacagaaccacauccca

SEQ ID NO: 27998 - RNA, 22 nt, Homo sapiens
aucuuggcucacugcaaccucu

SEQ ID NO: 27999 - RNA, 21 nt, Homo sapiens
auggcacaugcuuccacucca

SEQ ID NO: 28000 - RNA, 20 nt, Homo sapiens
cacaccuggcuguuuucuuu

SEQ ID NO: 28001 - RNA, 21 nt, Homo sapiens
cagugcucugucagcagccug

SEQ ID NO: 28002 - RNA, 20 nt, Homo sapiens
ccucugccucccggguucaa

SEQ ID NO: 28003 - RNA, 22 nt, Homo sapiens
cuuugggaacaaacucuuccuu

SEQ ID NO: 28004 - RNA, 25 nt, Homo sapiens
ugcaaccuccgccuccuggauucca

SEQ ID NO: 28005 - RNA, 21 nt, Homo sapiens
aaacuacagaaccacauccca

SEQ ID NO: 28006 - RNA, 22 nt, Homo sapiens
aucuuggcucacugcaaccucu

SEQ ID NO: 28007 - RNA, 21 nt, Homo sapiens
auggcacaugcuuccacucca

SEQ ID NO: 28008 - RNA, 20 nt, Homo sapiens
cacaccuggcuguuuucuuu

SEQ ID NO: 28009 - RNA, 21 nt, Homo sapiens
cagugcucugucagcagccug

SEQ ID NO: 28010 - RNA, 20 nt, Homo sapiens
ccucugccucccggguucaa

SEQ ID NO: 28011 - RNA, 22 nt, Homo sapiens
cuuugggaacaaacucuuccuu

SEQ ID NO: 28012 - RNA, 24 nt, Homo sapiens
guccacccucccaggccgacguca

SEQ ID NO: 28013 - RNA, 25 nt, Homo sapiens
ugcaaccuccgccuccuggauucca

SEQ ID NO: 28014 - RNA, 20 nt, Homo sapiens
ugccgcucacccuauuccag

SEQ ID NO: 28015 - RNA, 21 nt, Homo sapiens
uuugugucuuauguucaucac

SEQ ID NO: 28016 - RNA, 22 nt, Homo sapiens
auauccaaccccagcaauuuau

SEQ ID NO: 28017 - RNA, 17 nt, Homo sapiens
gcucacugucuuccaca

SEQ ID NO: 28018 - RNA, 18 nt, Homo sapiens
ugcuacuuccccaucuuu

SEQ ID NO: 28019 - RNA, 17 nt, Homo sapiens
gcucacugucuuccaca

SEQ ID NO: 28020 - RNA, 18 nt, Homo sapiens
ugcuacuuccccaucuuu

SEQ ID NO: 28021 - RNA, 18 nt, Homo sapiens
ccgucauccgccacugcg

SEQ ID NO: 28022 - RNA, 21 nt, Homo sapiens
uguggacgccgucauccgcca

SEQ ID NO: 28023 - RNA, 19 nt, Homo sapiens
agugaaagaggcguguugu

SEQ ID NO: 28024 - RNA, 19 nt, Homo sapiens
uggccagucagccacaggg

SEQ ID NO: 28025 - RNA, 24 nt, Homo sapiens
uuuaagcaguuuccaccuugcuuu

SEQ ID NO: 28026 - RNA, 19 nt, Homo sapiens
acccccguguccucagcac

SEQ ID NO: 28027 - RNA, 19 nt, Homo sapiens
ccguguccucagcacccca

SEQ ID NO: 28028 - RNA, 24 nt, Homo sapiens
gucccucugggaggucaacugcgg

SEQ ID NO: 28029 - RNA, 18 nt, Homo sapiens
gcucugcagaccaccucu

SEQ ID NO: 28030 - RNA, 20 nt, Homo sapiens
ucuuuuuauagcaccagacu

SEQ ID NO: 28031 - RNA, 19 nt, Homo sapiens
ugggcccucaggggcugca

SEQ ID NO: 28032 - RNA, 22 nt, Homo sapiens
ccucacucuggccuugcugcuu

SEQ ID NO: 28033 - RNA, 24 nt, Homo sapiens
caaaccuccuccuuuucaccuuca

SEQ ID NO: 28034 - RNA, 18 nt, Homo sapiens
ccaaaagcuuucacugaa

SEQ ID NO: 28035 - RNA, 17 nt, Homo sapiens
ccaccuuuuguuguuug

SEQ ID NO: 28036 - RNA, 25 nt, Homo sapiens
ccuuuucaccuucauccuuaacuuu

SEQ ID NO: 28037 - RNA, 20 nt, Homo sapiens
ccuuuuuuccccuuccccuc

SEQ ID NO: 28038 - RNA, 18 nt, Homo sapiens
cuguuggucagaaagaug

SEQ ID NO: 28039 - RNA, 19 nt, Homo sapiens
gagcgccucucgugcucgc

SEQ ID NO: 28040 - RNA, 24 nt, Homo sapiens
ucagaaaaaaauaaaguccuuuua

SEQ ID NO: 28041 - RNA, 19 nt, Homo sapiens
uccuuuucucccccuucuc

SEQ ID NO: 28042 - RNA, 22 nt, Homo sapiens
ucuggagucacaguauuaauga

SEQ ID NO: 28043 - RNA, 20 nt, Homo sapiens
ugucuaagaaaacuagcuua

SEQ ID NO: 28044 - RNA, 17 nt, Homo sapiens
ucccgaggcugcuccag

SEQ ID NO: 28045 - RNA, 18 nt, Homo sapiens
ucuucuaccgcaaugacu

SEQ ID NO: 28046 - RNA, 20 nt, Homo sapiens
uggcacucagcuuggggcug

SEQ ID NO: 28047 - RNA, 17 nt, Homo sapiens
ucccgaggcugcuccag

SEQ ID NO: 28048 - RNA, 18 nt, Homo sapiens
ucuucuaccgcaaugacu

SEQ ID NO: 28049 - RNA, 20 nt, Homo sapiens
uggcacucagcuuggggcug

SEQ ID NO: 28050 - RNA, 19 nt, Homo sapiens
caccaccaccaccaccacu

SEQ ID NO: 28051 - RNA, 19 nt, Homo sapiens
caccucucauaagcacuuu

SEQ ID NO: 28052 - RNA, 18 nt, Homo sapiens
ccgugaugagcacagcca

SEQ ID NO: 28053 - RNA, 19 nt, Homo sapiens
ccuccccugaccuccacca

SEQ ID NO: 28054 - RNA, 17 nt, Homo sapiens
cuggccucccccauccc

SEQ ID NO: 28055 - RNA, 17 nt, Homo sapiens
ggaggcugacguugcca

SEQ ID NO: 28056 - RNA, 17 nt, Homo sapiens
gggauggugcagcugug

SEQ ID NO: 28057 - RNA, 19 nt, Homo sapiens
ucagucugcucauccguaa

SEQ ID NO: 28058 - RNA, 20 nt, Homo sapiens
ugacguugccaaaccagcca

SEQ ID NO: 28059 - RNA, 22 nt, Homo sapiens
ugcugagggcugccucuugaca

SEQ ID NO: 28060 - RNA, 21 nt, Homo sapiens
uugagacgcuaauguucauga

SEQ ID NO: 28061 - RNA, 19 nt, Homo sapiens
acgcuacacacccacauga

SEQ ID NO: 28062 - RNA, 18 nt, Homo sapiens
acuggugaacguucaccu

SEQ ID NO: 28063 - RNA, 18 nt, Homo sapiens
ggccacacacuccugcuu

SEQ ID NO: 28064 - RNA, 18 nt, Homo sapiens
ucacaccuagaacacugu

SEQ ID NO: 28065 - RNA, 21 nt, Homo sapiens
agagccggucagauuccccua

SEQ ID NO: 28066 - RNA, 17 nt, Homo sapiens
cgacccaccucugccca

SEQ ID NO: 28067 - RNA, 21 nt, Homo sapiens
agagccggucagauuccccua

SEQ ID NO: 28068 - RNA, 17 nt, Homo sapiens
cgacccaccucugccca

SEQ ID NO: 28069 - RNA, 21 nt, Homo sapiens
agagccggucagauuccccua

SEQ ID NO: 28070 - RNA, 17 nt, Homo sapiens
cgacccaccucugccca

SEQ ID NO: 28071 - RNA, 21 nt, Homo sapiens
agagccggucagauuccccua

SEQ ID NO: 28072 - RNA, 17 nt, Homo sapiens
cgacccaccucugccca

SEQ ID NO: 28073 - RNA, 21 nt, Homo sapiens
agagccggucagauuccccua

SEQ ID NO: 28074 - RNA, 17 nt, Homo sapiens
cgacccaccucugccca

SEQ ID NO: 28075 - RNA, 21 nt, Homo sapiens
agagccggucagauuccccua

SEQ ID NO: 28076 - RNA, 17 nt, Homo sapiens
cgacccaccucugccca

SEQ ID NO: 28077 - RNA, 20 nt, Homo sapiens
aauguggggccccuuguuca

SEQ ID NO: 28078 - RNA, 20 nt, Homo sapiens
auaguuuuuaguuauuauuc

SEQ ID NO: 28079 - RNA, 22 nt, Homo sapiens
gcuucucuaucccccuucugcc

SEQ ID NO: 28080 - RNA, 22 nt, Homo sapiens
aacuuugccagcaaaaaucagg

SEQ ID NO: 28081 - RNA, 23 nt, Homo sapiens
cacaaacagcuaagacaaucuca

SEQ ID NO: 28082 - RNA, 19 nt, Homo sapiens
ccauuaggugaugcuuugg

SEQ ID NO: 28083 - RNA, 17 nt, Homo sapiens
ccugggccauucucuga

SEQ ID NO: 28084 - RNA, 20 nt, Homo sapiens
cuuuggcgagggucuguggg

SEQ ID NO: 28085 - RNA, 22 nt, Homo sapiens
gagccaagaucacaccacugca

SEQ ID NO: 28086 - RNA, 19 nt, Homo sapiens
gcaaccaugagauaauaca

SEQ ID NO: 28087 - RNA, 21 nt, Homo sapiens
ggacaauuucuccaccugcaa

SEQ ID NO: 28088 - RNA, 22 nt, Homo sapiens
guagcaguggcaucgcuugguu

SEQ ID NO: 28089 - RNA, 21 nt, Homo sapiens
uacccaugucaguuaucucca

SEQ ID NO: 28090 - RNA, 18 nt, Homo sapiens
aauggaaaugauaucauc

SEQ ID NO: 28091 - RNA, 19 nt, Homo sapiens
auccacagauauugggaca

SEQ ID NO: 28092 - RNA, 28 nt, Homo sapiens
aaguguggcugcccuucugagacccuca

SEQ ID NO: 28093 - RNA, 18 nt, Homo sapiens
cuggccucuuccacccca

SEQ ID NO: 28094 - RNA, 21 nt, Homo sapiens
gggcagcuuuggccagcagug

SEQ ID NO: 28095 - RNA, 18 nt, Homo sapiens
aauaaaguguauuccucc

SEQ ID NO: 28096 - RNA, 21 nt, Homo sapiens
ccuuuugccugccuuggcuuu

SEQ ID NO: 28097 - RNA, 21 nt, Homo sapiens
cgucagagcugacccacucac

SEQ ID NO: 28098 - RNA, 24 nt, Homo sapiens
uauacaaaucuucauuuucauaca

SEQ ID NO: 28099 - RNA, 18 nt, Homo sapiens
acacuccagggcggaguu

SEQ ID NO: 28100 - RNA, 21 nt, Homo sapiens
caucucuugcucccgaggcug

SEQ ID NO: 28101 - RNA, 23 nt, Homo sapiens
cccagccugggccucucuugcag

SEQ ID NO: 28102 - RNA, 22 nt, Homo sapiens
cccugagccccaggucuugugg

SEQ ID NO: 28103 - RNA, 19 nt, Homo sapiens
gacuuaaaggacugcaaua

SEQ ID NO: 28104 - RNA, 18 nt, Homo sapiens
uccccaggacacucaguu

SEQ ID NO: 28105 - RNA, 21 nt, Homo sapiens
ucuggaugcccagacaccucu

SEQ ID NO: 28106 - RNA, 21 nt, Homo sapiens
ugcugcugcugccuccgccgc

SEQ ID NO: 28107 - RNA, 20 nt, Homo sapiens
agucucacucuguugcccag

SEQ ID NO: 28108 - RNA, 17 nt, Homo sapiens
ucaagcgauucuugugc

SEQ ID NO: 28109 - RNA, 23 nt, Homo sapiens
ccuaaguaguuuuucauuauuuu

SEQ ID NO: 28110 - RNA, 20 nt, Homo sapiens
acccuuuugcuagugugcuu

SEQ ID NO: 28111 - RNA, 20 nt, Homo sapiens
caugagguggugugcagagg

SEQ ID NO: 28112 - RNA, 23 nt, Homo sapiens
cucuaacuaacaugugguaugua

SEQ ID NO: 28113 - RNA, 18 nt, Homo sapiens
gauuuacucaucuaucca

SEQ ID NO: 28114 - RNA, 24 nt, Homo sapiens
guucaaaaacacaugaacugcaga

SEQ ID NO: 28115 - RNA, 18 nt, Homo sapiens
uccugaacuacaagcaaa

SEQ ID NO: 28116 - RNA, 22 nt, Homo sapiens
ucucuugauaugcuuuuguuuu

SEQ ID NO: 28117 - RNA, 21 nt, Homo sapiens
ucuucaauuucuuagucccuc

SEQ ID NO: 28118 - RNA, 20 nt, Homo sapiens
ugaaugaccaccguuuccgu

SEQ ID NO: 28119 - RNA, 19 nt, Homo sapiens
accaaucaaauuucgccuu

SEQ ID NO: 28120 - RNA, 21 nt, Homo sapiens
acggagcuggacgacucaguc

SEQ ID NO: 28121 - RNA, 20 nt, Homo sapiens
ccuaggcgcgguucagguca

SEQ ID NO: 28122 - RNA, 16 nt, Homo sapiens
cuccccaacuccuucc

SEQ ID NO: 28123 - RNA, 22 nt, Homo sapiens
cucugaccugggggcuucugga

SEQ ID NO: 28124 - RNA, 19 nt, Homo sapiens
gagggaccccgcuugggcu

SEQ ID NO: 28125 - RNA, 20 nt, Homo sapiens
uggccccuccccaacuccuu

SEQ ID NO: 28126 - RNA, 18 nt, Homo sapiens
uugaggaaacugaggcaa

SEQ ID NO: 28127 - RNA, 21 nt, Homo sapiens
ucucuuuaucucccuugccuu

SEQ ID NO: 28128 - RNA, 18 nt, Homo sapiens
uuccagaaucuggcccag

SEQ ID NO: 28129 - RNA, 19 nt, Homo sapiens
auccuacccaggccaccac

SEQ ID NO: 28130 - RNA, 17 nt, Homo sapiens
ccucugccccagcccca

SEQ ID NO: 28131 - RNA, 21 nt, Homo sapiens
gccccuccuccacucuccucu

SEQ ID NO: 28132 - RNA, 21 nt, Homo sapiens
gccccuccuccacucuccucu

SEQ ID NO: 28133 - RNA, 20 nt, Homo sapiens
accaaaauugggccugcacu

SEQ ID NO: 28134 - RNA, 18 nt, Homo sapiens
accaccuuuccaucccca

SEQ ID NO: 28135 - RNA, 20 nt, Homo sapiens
cgaugguccuacacauucca

SEQ ID NO: 28136 - RNA, 19 nt, Homo sapiens
gaagccaguacagaucuuu

SEQ ID NO: 28137 - RNA, 22 nt, Homo sapiens
guaaccaaacaagaagaccuca

SEQ ID NO: 28138 - RNA, 18 nt, Homo sapiens
accaccuuuccaucccca

SEQ ID NO: 28139 - RNA, 19 nt, Homo sapiens
gaagccaguacagaucuuu

SEQ ID NO: 28140 - RNA, 22 nt, Homo sapiens
guaaccaaacaagaagaccuca

SEQ ID NO: 28141 - RNA, 21 nt, Homo sapiens
gcccccuccccacccucccuc

SEQ ID NO: 28142 - RNA, 26 nt, Homo sapiens
uccuggggagccacggaagguugugg

SEQ ID NO: 28143 - RNA, 16 nt, Homo sapiens
aagacauaaaugagga

SEQ ID NO: 28144 - RNA, 20 nt, Homo sapiens
ccauguuaaaucccauucau

SEQ ID NO: 28145 - RNA, 21 nt, Homo sapiens
cuaaauuaacauugggaaauc

SEQ ID NO: 28146 - RNA, 21 nt, Homo sapiens
cuguggaaaaauauuuaagau

SEQ ID NO: 28147 - RNA, 19 nt, Homo sapiens
uacuuuugacaacaaauua

SEQ ID NO: 28148 - RNA, 23 nt, Homo sapiens
caaacuugacaguaaaucacaca

SEQ ID NO: 28149 - RNA, 19 nt, Homo sapiens
cauguuauuaaauuuguau

SEQ ID NO: 28150 - RNA, 22 nt, Homo sapiens
cuaacguacauucaacagauca

SEQ ID NO: 28151 - RNA, 19 nt, Homo sapiens
aguuuuccauaaacuguua

SEQ ID NO: 28152 - RNA, 27 nt, Homo sapiens
ccuuuugugguaugguuuuuuggccuu

SEQ ID NO: 28153 - RNA, 20 nt, Homo sapiens
cuccucaauguguaaacagg

SEQ ID NO: 28154 - RNA, 23 nt, Homo sapiens
guauauaugucuugcucagauua

SEQ ID NO: 28155 - RNA, 18 nt, Homo sapiens
uguaaacaugacccacuu

SEQ ID NO: 28156 - RNA, 17 nt, Homo sapiens
uuuucuuguuuccauga

SEQ ID NO: 28157 - RNA, 17 nt, Homo sapiens
ugcaaaauuagcuuuuu

SEQ ID NO: 28158 - RNA, 17 nt, Homo sapiens
ugcaaaauuagcuuuuu

SEQ ID NO: 28159 - RNA, 20 nt, Homo sapiens
acaaccuuucauguagcccc

SEQ ID NO: 28160 - RNA, 22 nt, Homo sapiens
aucuucauggauagcucagagg

SEQ ID NO: 28161 - RNA, 19 nt, Homo sapiens
caccaccaccaccaccauc

SEQ ID NO: 28162 - RNA, 22 nt, Homo sapiens
ccacagucaccacuccaugaca

SEQ ID NO: 28163 - RNA, 20 nt, Homo sapiens
ccaucuucauggauagcuca

SEQ ID NO: 28164 - RNA, 20 nt, Homo sapiens
uaguuuugccgcuggacucu

SEQ ID NO: 28165 - RNA, 22 nt, Homo sapiens
ucuguucauccugaacauuuuu

SEQ ID NO: 28166 - RNA, 18 nt, Homo sapiens
ugcaucaucaccauggua

SEQ ID NO: 28167 - RNA, 22 nt, Homo sapiens
uucaagauuacaacaucuguua

SEQ ID NO: 28168 - RNA, 21 nt, Homo sapiens
ccagccccagcacagacccaa

SEQ ID NO: 28169 - RNA, 23 nt, Homo sapiens
ccccgaggccuucgucguccuca

SEQ ID NO: 28170 - RNA, 21 nt, Homo sapiens
cucuaucccuccucugccucu

SEQ ID NO: 28171 - RNA, 18 nt, Homo sapiens
uuccccuacccuaagcug

SEQ ID NO: 28172 - RNA, 24 nt, Homo sapiens
auauuuucagagaaaguuaccuaa

SEQ ID NO: 28173 - RNA, 21 nt, Homo sapiens
ccacccccaugaccaccacca

SEQ ID NO: 28174 - RNA, 24 nt, Homo sapiens
ccuaacuauuaagaucacugugua

SEQ ID NO: 28175 - RNA, 23 nt, Homo sapiens
gguucuuggaggguaugucagug

SEQ ID NO: 28176 - RNA, 24 nt, Homo sapiens
uauaaauugggauuuaagacugua

SEQ ID NO: 28177 - RNA, 26 nt, Homo sapiens
ucugcaacauucacaccauugcuucc

SEQ ID NO: 28178 - RNA, 21 nt, Homo sapiens
ggaggcagugauuccaagcug

SEQ ID NO: 28179 - RNA, 21 nt, Homo sapiens
ggaggcagugauuccaagcug

SEQ ID NO: 28180 - RNA, 21 nt, Homo sapiens
ggaggcagugauuccaagcug

SEQ ID NO: 28181 - RNA, 21 nt, Homo sapiens
aaggugucaacaggguaguua

SEQ ID NO: 28182 - RNA, 17 nt, Homo sapiens
agagccuuuagagcucu

SEQ ID NO: 28183 - RNA, 22 nt, Homo sapiens
cugagauauguacacagucauu

SEQ ID NO: 28184 - RNA, 19 nt, Homo sapiens
agagauuuauuugggcaaa

SEQ ID NO: 28185 - RNA, 22 nt, Homo sapiens
aucuucauggauagcucagagg

SEQ ID NO: 28186 - RNA, 20 nt, Homo sapiens
ccaucuucauggauagcuca

SEQ ID NO: 28187 - RNA, 20 nt, Homo sapiens
uaguuuugccgcuggacucu

SEQ ID NO: 28188 - RNA, 22 nt, Homo sapiens
ucagaacuuaauuuacaaauaa

SEQ ID NO: 28189 - RNA, 22 nt, Homo sapiens
ucuguucauccugaacauuuuu

SEQ ID NO: 28190 - RNA, 22 nt, Homo sapiens
uucaagauuacaacaucuguua

SEQ ID NO: 28191 - RNA, 20 nt, Homo sapiens
uuguaguuauguuagauauu

SEQ ID NO: 28192 - RNA, 18 nt, Homo sapiens
uuuucuucacacaguguu

SEQ ID NO: 28193 - RNA, 20 nt, Homo sapiens
acagcagcauuuuuauuuca

SEQ ID NO: 28194 - RNA, 25 nt, Homo sapiens
ccuuaccccuggcuguuuggacuuu

SEQ ID NO: 28195 - RNA, 24 nt, Homo sapiens
gucaaugcuauuuuuguuuuuaga

SEQ ID NO: 28196 - RNA, 19 nt, Homo sapiens
ugacaucuuuuuaaagcuu

SEQ ID NO: 28197 - RNA, 19 nt, Homo sapiens
ucaccaucguguuugcaaa

SEQ ID NO: 28198 - RNA, 18 nt, Homo sapiens
ucauaaaccaauguggca

SEQ ID NO: 28199 - RNA, 20 nt, Homo sapiens
uguccucagagcaggggcca

SEQ ID NO: 28200 - RNA, 21 nt, Homo sapiens
gugugccaccaugcuuggcua

SEQ ID NO: 28201 - RNA, 19 nt, Homo sapiens
aaguuccacaggaugguca

SEQ ID NO: 28202 - RNA, 19 nt, Homo sapiens
cucucccugcuuuugccuu

SEQ ID NO: 28203 - RNA, 19 nt, Homo sapiens
guccacuggugggacaaga

SEQ ID NO: 28204 - RNA, 17 nt, Homo sapiens
gucuaacauuuuuugcc

SEQ ID NO: 28205 - RNA, 19 nt, Homo sapiens
uccuccuuuccccucucuc

SEQ ID NO: 28206 - RNA, 21 nt, Homo sapiens
aaauaaaagugaccuuuuaca

SEQ ID NO: 28207 - RNA, 21 nt, Homo sapiens
aaauaaaagugaccuuuuaca

SEQ ID NO: 28208 - RNA, 19 nt, Homo sapiens
acccagagacaaagaaccc

SEQ ID NO: 28209 - RNA, 20 nt, Homo sapiens
agugaggaggcuggauccaa

SEQ ID NO: 28210 - RNA, 22 nt, Homo sapiens
gacccucagcguacccgccuca

SEQ ID NO: 28211 - RNA, 19 nt, Homo sapiens
gccugaccuugugaucugc

SEQ ID NO: 28212 - RNA, 20 nt, Homo sapiens
ggguucuguauaugaagcug

SEQ ID NO: 28213 - RNA, 20 nt, Homo sapiens
uacaaauaucacguucuuau

SEQ ID NO: 28214 - RNA, 17 nt, Homo sapiens
ucugugccaggcacuuc

SEQ ID NO: 28215 - RNA, 19 nt, Homo sapiens
uuccuuuuaucgguucauu

SEQ ID NO: 28216 - RNA, 18 nt, Homo sapiens
aggaacccagagcaccaa

SEQ ID NO: 28217 - RNA, 22 nt, Homo sapiens
aucugagucucagccugggucc

SEQ ID NO: 28218 - RNA, 17 nt, Homo sapiens
cccuccccaccuacccu

SEQ ID NO: 28219 - RNA, 18 nt, Homo sapiens
ccgggcggcuucacccca

SEQ ID NO: 28220 - RNA, 18 nt, Homo sapiens
cucccgcuccagcggcac

SEQ ID NO: 28221 - RNA, 22 nt, Homo sapiens
gccucucugagccucugucucu

SEQ ID NO: 28222 - RNA, 16 nt, Homo sapiens
aaugauacuguguucc

SEQ ID NO: 28223 - RNA, 17 nt, Homo sapiens
auaauuuuccugugaca

SEQ ID NO: 28224 - RNA, 18 nt, Homo sapiens
ucaaaacagcaucggcca

SEQ ID NO: 28225 - RNA, 16 nt, Homo sapiens
ugauacuguguucccu

SEQ ID NO: 28226 - RNA, 17 nt, Homo sapiens
caggauuaugcagucca

SEQ ID NO: 28227 - RNA, 21 nt, Homo sapiens
cucuggcucuggggcuugggg

SEQ ID NO: 28228 - RNA, 18 nt, Homo sapiens
gcaacacaucugaucuaa

SEQ ID NO: 28229 - RNA, 22 nt, Homo sapiens
ugagguugugacuguggcuggu

SEQ ID NO: 28230 - RNA, 17 nt, Homo sapiens
ggcggggugcauuucca

SEQ ID NO: 28231 - RNA, 20 nt, Homo sapiens
uggaacucagaaugaaacug

SEQ ID NO: 28232 - RNA, 16 nt, Homo sapiens
aaagaccuagaaccca

SEQ ID NO: 28233 - RNA, 22 nt, Homo sapiens
agaaaugacuguaaauauuuca

SEQ ID NO: 28234 - RNA, 20 nt, Homo sapiens
aguuucacucugugaggagu

SEQ ID NO: 28235 - RNA, 17 nt, Homo sapiens
cuauuuuguguccuuga

SEQ ID NO: 28236 - RNA, 19 nt, Homo sapiens
cucccagaagaccaaacug

SEQ ID NO: 28237 - RNA, 20 nt, Homo sapiens
gucccucugagugugucuug

SEQ ID NO: 28238 - RNA, 19 nt, Homo sapiens
uguagcaugccuugguuuu

SEQ ID NO: 28239 - RNA, 22 nt, Homo sapiens
agaaaugacuguaaauauuuca

SEQ ID NO: 28240 - RNA, 20 nt, Homo sapiens
aguuucacucugugaggagu

SEQ ID NO: 28241 - RNA, 17 nt, Homo sapiens
cuauuuuguguccuuga

SEQ ID NO: 28242 - RNA, 19 nt, Homo sapiens
cucccagaagaccaaacug

SEQ ID NO: 28243 - RNA, 20 nt, Homo sapiens
gucccucugagugugucuug

SEQ ID NO: 28244 - RNA, 22 nt, Homo sapiens
agaaaugacuguaaauauuuca

SEQ ID NO: 28245 - RNA, 20 nt, Homo sapiens
aguuucacucugugaggagu

SEQ ID NO: 28246 - RNA, 17 nt, Homo sapiens
cuauuuuguguccuuga

SEQ ID NO: 28247 - RNA, 19 nt, Homo sapiens
cucccagaagaccaaacug

SEQ ID NO: 28248 - RNA, 20 nt, Homo sapiens
gucccucugagugugucuug

SEQ ID NO: 28249 - RNA, 22 nt, Homo sapiens
agaaaugacuguaaauauuuca

SEQ ID NO: 28250 - RNA, 20 nt, Homo sapiens
aguuucacucugugaggagu

SEQ ID NO: 28251 - RNA, 17 nt, Homo sapiens
cuauuuuguguccuuga

SEQ ID NO: 28252 - RNA, 19 nt, Homo sapiens
cucccagaagaccaaacug

SEQ ID NO: 28253 - RNA, 20 nt, Homo sapiens
gucccucugagugugucuug

SEQ ID NO: 28254 - RNA, 22 nt, Homo sapiens
agaaaugacuguaaauauuuca

SEQ ID NO: 28255 - RNA, 20 nt, Homo sapiens
aguuucacucugugaggagu

SEQ ID NO: 28256 - RNA, 17 nt, Homo sapiens
cuauuuuguguccuuga

SEQ ID NO: 28257 - RNA, 19 nt, Homo sapiens
cucccagaagaccaaacug

SEQ ID NO: 28258 - RNA, 20 nt, Homo sapiens
gucccucugagugugucuug

SEQ ID NO: 28259 - RNA, 21 nt, Homo sapiens
acccucuaggggcuuugggga

SEQ ID NO: 28260 - RNA, 18 nt, Homo sapiens
caaccuuccucccuacuc

SEQ ID NO: 28261 - RNA, 20 nt, Homo sapiens
cccucuaggggcuuugggga

SEQ ID NO: 28262 - RNA, 22 nt, Homo sapiens
gcacaaccuuccucccuacuca

SEQ ID NO: 28263 - RNA, 22 nt, Homo sapiens
ucagauugagauaagauccuuu

SEQ ID NO: 28264 - RNA, 18 nt, Homo sapiens
ugaaaccagcuagugugu

SEQ ID NO: 28265 - RNA, 22 nt, Homo sapiens
uggccuguccccacauccagca

SEQ ID NO: 28266 - RNA, 18 nt, Homo sapiens
gaaagagcgagugccucu

SEQ ID NO: 28267 - RNA, 24 nt, Homo sapiens
ucaaauauaugauugcugauagua

SEQ ID NO: 28268 - RNA, 18 nt, Homo sapiens
ccuuugcccacgugguga

SEQ ID NO: 28269 - RNA, 19 nt, Homo sapiens
gauaaaaaaaaagugagca

SEQ ID NO: 28270 - RNA, 22 nt, Homo sapiens
uguuggucacagaaacaugacc

SEQ ID NO: 28271 - RNA, 18 nt, Homo sapiens
uuaccaaagcagcauaau

SEQ ID NO: 28272 - RNA, 21 nt, Homo sapiens
aacaccaggcccagcgcccuc

SEQ ID NO: 28273 - RNA, 21 nt, Homo sapiens
acccugggcccucucuccuca

SEQ ID NO: 28274 - RNA, 22 nt, Homo sapiens
ugagguuuggucugggcucagu

SEQ ID NO: 28275 - RNA, 22 nt, Homo sapiens
aucuuggcucacagcaaccucu

SEQ ID NO: 28276 - RNA, 17 nt, Homo sapiens
cucacuguguugcccaa

SEQ ID NO: 28277 - RNA, 16 nt, Homo sapiens
gaugaaaugucuguuu

SEQ ID NO: 28278 - RNA, 17 nt, Homo sapiens
ucaagugauucucgugc

SEQ ID NO: 28279 - RNA, 18 nt, Homo sapiens
ucuaccuccuggguucaa

SEQ ID NO: 28280 - RNA, 23 nt, Homo sapiens
uggucuugaacucuugggcucaa

SEQ ID NO: 28281 - RNA, 21 nt, Homo sapiens
aagagaggcccaggcuacugg

SEQ ID NO: 28282 - RNA, 21 nt, Homo sapiens
cccugcugcggagaccgcgga

SEQ ID NO: 28283 - RNA, 16 nt, Homo sapiens
acucacggccuccaug

SEQ ID NO: 28284 - RNA, 20 nt, Homo sapiens
gauccugaaaaguguuauga

SEQ ID NO: 28285 - RNA, 21 nt, Homo sapiens
gugugucaccacgcucggcua

SEQ ID NO: 28286 - RNA, 18 nt, Homo sapiens
uccugaaaaguguuauga

SEQ ID NO: 28287 - RNA, 25 nt, Homo sapiens
agcccggggagccuaggaccacuca

SEQ ID NO: 28288 - RNA, 16 nt, Homo sapiens
cccacgauuuucucca

SEQ ID NO: 28289 - RNA, 25 nt, Homo sapiens
agcccggggagccuaggaccacuca

SEQ ID NO: 28290 - RNA, 16 nt, Homo sapiens
cccacgauuuucucca

SEQ ID NO: 28291 - RNA, 25 nt, Homo sapiens
agcccggggagccuaggaccacuca

SEQ ID NO: 28292 - RNA, 16 nt, Homo sapiens
cccacgauuuucucca

SEQ ID NO: 28293 - RNA, 25 nt, Homo sapiens
agcccggggagccuaggaccacuca

SEQ ID NO: 28294 - RNA, 16 nt, Homo sapiens
cccacgauuuucucca

SEQ ID NO: 28295 - RNA, 18 nt, Homo sapiens
acagacacugauacccag

SEQ ID NO: 28296 - RNA, 25 nt, Homo sapiens
agcccggggagccuaggaccacuca

SEQ ID NO: 28297 - RNA, 16 nt, Homo sapiens
cccacgauuuucucca

SEQ ID NO: 28298 - RNA, 17 nt, Homo sapiens
gugggaaacgagugcug

SEQ ID NO: 28299 - RNA, 19 nt, Homo sapiens
gugucucaaaacaaacaaa

SEQ ID NO: 28300 - RNA, 25 nt, Homo sapiens
agcccggggagccuaggaccacuca

SEQ ID NO: 28301 - RNA, 16 nt, Homo sapiens
cccacgauuuucucca

SEQ ID NO: 28302 - RNA, 17 nt, Homo sapiens
gugggaaacgagugcug

SEQ ID NO: 28303 - RNA, 19 nt, Homo sapiens
gugucucaaaacaaacaaa

SEQ ID NO: 28304 - RNA, 16 nt, Homo sapiens
ccacaccucugucucc

SEQ ID NO: 28305 - RNA, 17 nt, Homo sapiens
cccggacggcagaugcc

SEQ ID NO: 28306 - RNA, 18 nt, Homo sapiens
cucccagccgagcccuca

SEQ ID NO: 28307 - RNA, 17 nt, Homo sapiens
cuccccaaucucuucca

SEQ ID NO: 28308 - RNA, 19 nt, Homo sapiens
cugcaagcuccgccuccca

SEQ ID NO: 28309 - RNA, 16 nt, Homo sapiens
ggcuucugacucauuu

SEQ ID NO: 28310 - RNA, 17 nt, Homo sapiens
uacagaaguccaggaga

SEQ ID NO: 28311 - RNA, 21 nt, Homo sapiens
ucauaaaggguuugauuuuua

SEQ ID NO: 28312 - RNA, 23 nt, Homo sapiens
ugucucucaagggcacccagcuu

SEQ ID NO: 28313 - RNA, 17 nt, Homo sapiens
uucuccugcuucagccu

SEQ ID NO: 28314 - RNA, 22 nt, Homo sapiens
cacaccaaccaccuccacuuca

SEQ ID NO: 28315 - RNA, 20 nt, Homo sapiens
uccacuccacucccucccuc

SEQ ID NO: 28316 - RNA, 18 nt, Homo sapiens
ucccucccucuuuucuca

SEQ ID NO: 28317 - RNA, 24 nt, Homo sapiens
cugucgggcaagauagcuccuuca

SEQ ID NO: 28318 - RNA, 17 nt, Homo sapiens
uguuguccugugucauc

SEQ ID NO: 28319 - RNA, 17 nt, Homo sapiens
auccuaagcaugcuuua

SEQ ID NO: 28320 - RNA, 22 nt, Homo sapiens
aucugaggaaagaaaucuggua

SEQ ID NO: 28321 - RNA, 20 nt, Homo sapiens
cacucucuauauccauuuga

SEQ ID NO: 28322 - RNA, 23 nt, Homo sapiens
ccuuuucacuaagccuuuacuuu

SEQ ID NO: 28323 - RNA, 21 nt, Homo sapiens
ucagaaaaaggcuuucuuuca

SEQ ID NO: 28324 - RNA, 20 nt, Homo sapiens
uuccagaaauacaaugcuag

SEQ ID NO: 28325 - RNA, 22 nt, Homo sapiens
uucuucuuuuuagcugaucuca

SEQ ID NO: 28326 - RNA, 19 nt, Homo sapiens
uuuuuuccgcagacuucuu

SEQ ID NO: 28327 - RNA, 17 nt, Homo sapiens
auccuaagcaugcuuua

SEQ ID NO: 28328 - RNA, 22 nt, Homo sapiens
aucugaggaaagaaaucuggua

SEQ ID NO: 28329 - RNA, 20 nt, Homo sapiens
cacucucuauauccauuuga

SEQ ID NO: 28330 - RNA, 23 nt, Homo sapiens
ccuuuucacuaagccuuuacuuu

SEQ ID NO: 28331 - RNA, 21 nt, Homo sapiens
ucagaaaaaggcuuucuuuca

SEQ ID NO: 28332 - RNA, 20 nt, Homo sapiens
uuccagaaauacaaugcuag

SEQ ID NO: 28333 - RNA, 22 nt, Homo sapiens
uucuucuuuuuagcugaucuca

SEQ ID NO: 28334 - RNA, 19 nt, Homo sapiens
uuuuuuccgcagacuucuu

SEQ ID NO: 28335 - RNA, 17 nt, Homo sapiens
auccuaagcaugcuuua

SEQ ID NO: 28336 - RNA, 22 nt, Homo sapiens
aucugaggaaagaaaucuggua

SEQ ID NO: 28337 - RNA, 20 nt, Homo sapiens
cacucucuauauccauuuga

SEQ ID NO: 28338 - RNA, 23 nt, Homo sapiens
ccuuuucacuaagccuuuacuuu

SEQ ID NO: 28339 - RNA, 21 nt, Homo sapiens
ucagaaaaaggcuuucuuuca

SEQ ID NO: 28340 - RNA, 20 nt, Homo sapiens
uuccagaaauacaaugcuag

SEQ ID NO: 28341 - RNA, 22 nt, Homo sapiens
uucuucuuuuuagcugaucuca

SEQ ID NO: 28342 - RNA, 19 nt, Homo sapiens
uuuuuuccgcagacuucuu

SEQ ID NO: 28343 - RNA, 17 nt, Homo sapiens
auccuaagcaugcuuua

SEQ ID NO: 28344 - RNA, 22 nt, Homo sapiens
aucugaggaaagaaaucuggua

SEQ ID NO: 28345 - RNA, 20 nt, Homo sapiens
cacucucuauauccauuuga

SEQ ID NO: 28346 - RNA, 23 nt, Homo sapiens
ccuuuucacuaagccuuuacuuu

SEQ ID NO: 28347 - RNA, 21 nt, Homo sapiens
ucagaaaaaggcuuucuuuca

SEQ ID NO: 28348 - RNA, 20 nt, Homo sapiens
uuccagaaauacaaugcuag

SEQ ID NO: 28349 - RNA, 22 nt, Homo sapiens
uucuucuuuuuagcugaucuca

SEQ ID NO: 28350 - RNA, 19 nt, Homo sapiens
uuuuuuccgcagacuucuu

SEQ ID NO: 28351 - RNA, 17 nt, Homo sapiens
auccuaagcaugcuuua

SEQ ID NO: 28352 - RNA, 22 nt, Homo sapiens
aucugaggaaagaaaucuggua

SEQ ID NO: 28353 - RNA, 20 nt, Homo sapiens
cacucucuauauccauuuga

SEQ ID NO: 28354 - RNA, 23 nt, Homo sapiens
ccuuuucacuaagccuuuacuuu

SEQ ID NO: 28355 - RNA, 21 nt, Homo sapiens
ucagaaaaaggcuuucuuuca

SEQ ID NO: 28356 - RNA, 20 nt, Homo sapiens
uuccagaaauacaaugcuag

SEQ ID NO: 28357 - RNA, 22 nt, Homo sapiens
uucuucuuuuuagcugaucuca

SEQ ID NO: 28358 - RNA, 19 nt, Homo sapiens
uuuuuuccgcagacuucuu

SEQ ID NO: 28359 - RNA, 20 nt, Homo sapiens
agaauuacauuguauagccc

SEQ ID NO: 28360 - RNA, 22 nt, Homo sapiens
auuacugcuguucuagccccca

SEQ ID NO: 28361 - RNA, 20 nt, Homo sapiens
cuguuaggguacauacgcua

SEQ ID NO: 28362 - RNA, 19 nt, Homo sapiens
ucguuguuguuuuaaguuu

SEQ ID NO: 28363 - RNA, 20 nt, Homo sapiens
agaauuacauuguauagccc

SEQ ID NO: 28364 - RNA, 22 nt, Homo sapiens
auuacugcuguucuagccccca

SEQ ID NO: 28365 - RNA, 20 nt, Homo sapiens
cuguuaggguacauacgcua

SEQ ID NO: 28366 - RNA, 19 nt, Homo sapiens
ucguuguuguuuuaaguuu

SEQ ID NO: 28367 - RNA, 20 nt, Homo sapiens
ccacagcauuccuccaucuu

SEQ ID NO: 28368 - RNA, 17 nt, Homo sapiens
gaaaacgcaccuccauc

SEQ ID NO: 28369 - RNA, 18 nt, Homo sapiens
gacauuucccuccuggga

SEQ ID NO: 28370 - RNA, 17 nt, Homo sapiens
guagagaugauucggau

SEQ ID NO: 28371 - RNA, 18 nt, Homo sapiens
ucagccacaccugucagc

SEQ ID NO: 28372 - RNA, 20 nt, Homo sapiens
ccacagcauuccuccaucuu

SEQ ID NO: 28373 - RNA, 17 nt, Homo sapiens
gaaaacgcaccuccauc

SEQ ID NO: 28374 - RNA, 18 nt, Homo sapiens
gacauuucccuccuggga

SEQ ID NO: 28375 - RNA, 17 nt, Homo sapiens
guagagaugauucggau

SEQ ID NO: 28376 - RNA, 18 nt, Homo sapiens
ucagccacaccugucagc

SEQ ID NO: 28377 - RNA, 19 nt, Homo sapiens
auauuguaccgcuaccccu

SEQ ID NO: 28378 - RNA, 21 nt, Homo sapiens
ccgagggagaacugaccaugg

SEQ ID NO: 28379 - RNA, 21 nt, Homo sapiens
ccucccuuggaucugaccuua

SEQ ID NO: 28380 - RNA, 24 nt, Homo sapiens
uuugaaaggcugaagaugucugcu

SEQ ID NO: 28381 - RNA, 19 nt, Homo sapiens
ggaaugauauaaucugucc

SEQ ID NO: 28382 - RNA, 19 nt, Homo sapiens
uuucuguuuugcuuuuaaa

SEQ ID NO: 28383 - RNA, 19 nt, Homo sapiens
uuuugaugauggagguaug

SEQ ID NO: 28384 - RNA, 18 nt, Homo sapiens
cuucuccagcucugcucu

SEQ ID NO: 28385 - RNA, 21 nt, Homo sapiens
gcagugaucugucacugacca

SEQ ID NO: 28386 - RNA, 26 nt, Homo sapiens
uaccccagagcacuacaauucucuga

SEQ ID NO: 28387 - RNA, 18 nt, Homo sapiens
cgcggagcccggcccgga

SEQ ID NO: 28388 - RNA, 22 nt, Homo sapiens
gcagcuucccugagccuuucca

SEQ ID NO: 28389 - RNA, 22 nt, Homo sapiens
gcagcuucccugagccuuucca

SEQ ID NO: 28390 - RNA, 26 nt, Homo sapiens
gcuccaugugacccucccucugccuc

SEQ ID NO: 28391 - RNA, 26 nt, Homo sapiens
gcuccaugugacccucccucugccuc

SEQ ID NO: 28392 - RNA, 26 nt, Homo sapiens
gcuccaugugacccucccucugccuc

SEQ ID NO: 28393 - RNA, 21 nt, Homo sapiens
agcauugcuugagguugccca

SEQ ID NO: 28394 - RNA, 21 nt, Homo sapiens
caguugugagccaagauugua

SEQ ID NO: 28395 - RNA, 20 nt, Homo sapiens
uuggcauucaguauuggugg

SEQ ID NO: 28396 - RNA, 20 nt, Homo sapiens
uggacaguuggcucuaccuc

SEQ ID NO: 28397 - RNA, 20 nt, Homo sapiens
uggacaguuggcucuaccuc

SEQ ID NO: 28398 - RNA, 20 nt, Homo sapiens
aaaauggggcaggccacacc

SEQ ID NO: 28399 - RNA, 19 nt, Homo sapiens
ccccacugcccccugcagc

SEQ ID NO: 28400 - RNA, 25 nt, Homo sapiens
gaaugaagucaccucgccccccucu

SEQ ID NO: 28401 - RNA, 19 nt, Homo sapiens
gccccuuggcaccauccug

SEQ ID NO: 28402 - RNA, 22 nt, Homo sapiens
ggacuuggcauuuaggauucca

SEQ ID NO: 28403 - RNA, 20 nt, Homo sapiens
aaaauggggcaggccacacc

SEQ ID NO: 28404 - RNA, 19 nt, Homo sapiens
ccccacugcccccugcagc

SEQ ID NO: 28405 - RNA, 25 nt, Homo sapiens
gaaugaagucaccucgccccccucu

SEQ ID NO: 28406 - RNA, 19 nt, Homo sapiens
gccccuuggcaccauccug

SEQ ID NO: 28407 - RNA, 22 nt, Homo sapiens
ggacuuggcauuuaggauucca

SEQ ID NO: 28408 - RNA, 18 nt, Homo sapiens
cagcagcagcagcaccau

SEQ ID NO: 28409 - RNA, 18 nt, Homo sapiens
cagcagcagcagcagcca

SEQ ID NO: 28410 - RNA, 17 nt, Homo sapiens
caucaucaccaucacca

SEQ ID NO: 28411 - RNA, 21 nt, Homo sapiens
ccaaucauuugcaaagugagg

SEQ ID NO: 28412 - RNA, 16 nt, Homo sapiens
cugaugccaauucauc

SEQ ID NO: 28413 - RNA, 17 nt, Homo sapiens
gaacacagcuugcuugc

SEQ ID NO: 28414 - RNA, 25 nt, Homo sapiens
gcagaagauagauacagccuuuuca

SEQ ID NO: 28415 - RNA, 21 nt, Homo sapiens
ggcuaauugccaccaauuuca

SEQ ID NO: 28416 - RNA, 22 nt, Homo sapiens
uaaaauaacauuguacauccaa

SEQ ID NO: 28417 - RNA, 18 nt, Homo sapiens
ucaguaggacaagugucg

SEQ ID NO: 28418 - RNA, 18 nt, Homo sapiens
ucaucaccaucaccacca

SEQ ID NO: 28419 - RNA, 19 nt, Homo sapiens
uccuccaucuccgcucucu

SEQ ID NO: 28420 - RNA, 17 nt, Homo sapiens
ugaauuucugucuugcc

SEQ ID NO: 28421 - RNA, 19 nt, Homo sapiens
ccucccccacccugcccug

SEQ ID NO: 28422 - RNA, 23 nt, Homo sapiens
cuuagugcucugaauuuacuuuu

SEQ ID NO: 28423 - RNA, 19 nt, Homo sapiens
gauuuuaaucaccauuaca

SEQ ID NO: 28424 - RNA, 17 nt, Homo sapiens
ucaagugauucuugugc

SEQ ID NO: 28425 - RNA, 19 nt, Homo sapiens
ugucguaagaauaucuguc

SEQ ID NO: 28426 - RNA, 17 nt, Homo sapiens
ucaagugauucuugugc

SEQ ID NO: 28427 - RNA, 19 nt, Homo sapiens
ugucguaagaauaucuguc

SEQ ID NO: 28428 - RNA, 17 nt, Homo sapiens
ucaagugauucuugugc

SEQ ID NO: 28429 - RNA, 19 nt, Homo sapiens
ugucguaagaauaucuguc

SEQ ID NO: 28430 - RNA, 17 nt, Homo sapiens
ucaagugauucuugugc

SEQ ID NO: 28431 - RNA, 19 nt, Homo sapiens
ugucguaagaauaucuguc

SEQ ID NO: 28432 - RNA, 19 nt, Homo sapiens
aagcaauucuccugccuca

SEQ ID NO: 28433 - RNA, 23 nt, Homo sapiens
uaggauuccaccuuguucuggug

SEQ ID NO: 28434 - RNA, 19 nt, Homo sapiens
ugucguaagaauaucuguc

SEQ ID NO: 28435 - RNA, 19 nt, Homo sapiens
ugucguaagaauaucuguc

SEQ ID NO: 28436 - RNA, 17 nt, Homo sapiens
augcuuuuauucaggga

SEQ ID NO: 28437 - RNA, 20 nt, Homo sapiens
ugcacagaggccccgccccc

SEQ ID NO: 28438 - RNA, 22 nt, Homo sapiens
aagaugcagucucugcugauca

SEQ ID NO: 28439 - RNA, 19 nt, Homo sapiens
aagugacaacuuagggagc

SEQ ID NO: 28440 - RNA, 18 nt, Homo sapiens
agccuccugcucugugaa

SEQ ID NO: 28441 - RNA, 20 nt, Homo sapiens
agugaauggggacacucgug

SEQ ID NO: 28442 - RNA, 17 nt, Homo sapiens
caacagcaucaucugca

SEQ ID NO: 28443 - RNA, 20 nt, Homo sapiens
ccacucuauuuuuuuagguu

SEQ ID NO: 28444 - RNA, 22 nt, Homo sapiens
cucuccugugagauuucacuuu

SEQ ID NO: 28445 - RNA, 18 nt, Homo sapiens
gaggagugcauggcgaga

SEQ ID NO: 28446 - RNA, 19 nt, Homo sapiens
gccaggcggccgcuuggcc

SEQ ID NO: 28447 - RNA, 20 nt, Homo sapiens
gcgucugcacugaugaccgu

SEQ ID NO: 28448 - RNA, 23 nt, Homo sapiens
gcguuccuggacaaacagccuca

SEQ ID NO: 28449 - RNA, 18 nt, Homo sapiens
gguccuacugcugugagc

SEQ ID NO: 28450 - RNA, 17 nt, Homo sapiens
ucgacuucauuuugcca

SEQ ID NO: 28451 - RNA, 19 nt, Homo sapiens
ucugcaccuaaacccauac

SEQ ID NO: 28452 - RNA, 21 nt, Homo sapiens
ugaccgucugagcccagcuca

SEQ ID NO: 28453 - RNA, 20 nt, Homo sapiens
ugccccguugccuaucacag

SEQ ID NO: 28454 - RNA, 19 nt, Homo sapiens
ugucccgcgggcgaguucu

SEQ ID NO: 28455 - RNA, 22 nt, Homo sapiens
aagaugcagucucugcugauca

SEQ ID NO: 28456 - RNA, 19 nt, Homo sapiens
aagugacaacuuagggagc

SEQ ID NO: 28457 - RNA, 18 nt, Homo sapiens
agccuccugcucugugaa

SEQ ID NO: 28458 - RNA, 20 nt, Homo sapiens
agugaauggggacacucgug

SEQ ID NO: 28459 - RNA, 17 nt, Homo sapiens
caacagcaucaucugca

SEQ ID NO: 28460 - RNA, 20 nt, Homo sapiens
ccacucuauuuuuuuagguu

SEQ ID NO: 28461 - RNA, 22 nt, Homo sapiens
cucuccugugagauuucacuuu

SEQ ID NO: 28462 - RNA, 18 nt, Homo sapiens
gaggagugcauggcgaga

SEQ ID NO: 28463 - RNA, 19 nt, Homo sapiens
gccaggcggccgcuuggcc

SEQ ID NO: 28464 - RNA, 20 nt, Homo sapiens
gcgucugcacugaugaccgu

SEQ ID NO: 28465 - RNA, 23 nt, Homo sapiens
gcguuccuggacaaacagccuca

SEQ ID NO: 28466 - RNA, 18 nt, Homo sapiens
gguccuacugcugugagc

SEQ ID NO: 28467 - RNA, 17 nt, Homo sapiens
ucgacuucauuuugcca

SEQ ID NO: 28468 - RNA, 19 nt, Homo sapiens
ucugcaccuaaacccauac

SEQ ID NO: 28469 - RNA, 21 nt, Homo sapiens
ugaccgucugagcccagcuca

SEQ ID NO: 28470 - RNA, 20 nt, Homo sapiens
ugccccguugccuaucacag

SEQ ID NO: 28471 - RNA, 19 nt, Homo sapiens
ugucccgcgggcgaguucu

SEQ ID NO: 28472 - RNA, 18 nt, Homo sapiens
agccuccugcucugugaa

SEQ ID NO: 28473 - RNA, 20 nt, Homo sapiens
ccacucuauuuuuuuagguu

SEQ ID NO: 28474 - RNA, 19 nt, Homo sapiens
gccaggcggccgcuuggcc

SEQ ID NO: 28475 - RNA, 20 nt, Homo sapiens
gcgucugcacugaugaccgu

SEQ ID NO: 28476 - RNA, 23 nt, Homo sapiens
gcguuccuggacaaacagccuca

SEQ ID NO: 28477 - RNA, 21 nt, Homo sapiens
ugaccgucugagcccagcuca

SEQ ID NO: 28478 - RNA, 18 nt, Homo sapiens
ugauagaaaguuaagcca

SEQ ID NO: 28479 - RNA, 19 nt, Homo sapiens
aagauuauaguaccaguca

SEQ ID NO: 28480 - RNA, 17 nt, Homo sapiens
auauagaggaaaggggc

SEQ ID NO: 28481 - RNA, 18 nt, Homo sapiens
ugugaauaacucaaguca

SEQ ID NO: 28482 - RNA, 20 nt, Homo sapiens
uucaaaagaauaucugucug

SEQ ID NO: 28483 - RNA, 19 nt, Homo sapiens
aagauuauaguaccaguca

SEQ ID NO: 28484 - RNA, 17 nt, Homo sapiens
auauagaggaaaggggc

SEQ ID NO: 28485 - RNA, 19 nt, Homo sapiens
aagauuauaguaccaguca

SEQ ID NO: 28486 - RNA, 17 nt, Homo sapiens
auauagaggaaaggggc

SEQ ID NO: 28487 - RNA, 19 nt, Homo sapiens
aagauuauaguaccaguca

SEQ ID NO: 28488 - RNA, 17 nt, Homo sapiens
auauagaggaaaggggc

SEQ ID NO: 28489 - RNA, 19 nt, Homo sapiens
aagauuauaguaccaguca

SEQ ID NO: 28490 - RNA, 17 nt, Homo sapiens
auauagaggaaaggggc

SEQ ID NO: 28491 - RNA, 17 nt, Homo sapiens
aggaaaugcuuggauuc

SEQ ID NO: 28492 - RNA, 17 nt, Homo sapiens
ccaucuauuuuuuacca

SEQ ID NO: 28493 - RNA, 19 nt, Homo sapiens
ggacccacaaaacuaaccu

SEQ ID NO: 28494 - RNA, 20 nt, Homo sapiens
uuguuaauggccugugacau

SEQ ID NO: 28495 - RNA, 20 nt, Homo sapiens
auuuauuuucagcugucugc

SEQ ID NO: 28496 - RNA, 15 nt, Homo sapiens
acucauuacgugauc

SEQ ID NO: 28497 - RNA, 20 nt, Homo sapiens
aguugcauuaaauaaaguau

SEQ ID NO: 28498 - RNA, 17 nt, Homo sapiens
gugaucccagacuggaa

SEQ ID NO: 28499 - RNA, 24 nt, Homo sapiens
accugggcucaaguggcuuggccu

SEQ ID NO: 28500 - RNA, 19 nt, Homo sapiens
gggagucucccuauguugc

SEQ ID NO: 28501 - RNA, 18 nt, Homo sapiens
agcaaaaaguaaagaaca

SEQ ID NO: 28502 - RNA, 19 nt, Homo sapiens
auaaagcaagcuaucugca

SEQ ID NO: 28503 - RNA, 17 nt, Homo sapiens
cuguguaguuuuguuuu

SEQ ID NO: 28504 - RNA, 18 nt, Homo sapiens
gccacagcaaaaaguaaa

SEQ ID NO: 28505 - RNA, 17 nt, Homo sapiens
cuguguaguuuuguuuu

SEQ ID NO: 28506 - RNA, 18 nt, Homo sapiens
agcaaaaaguaaagaaca

SEQ ID NO: 28507 - RNA, 19 nt, Homo sapiens
auaaagcaagcuaucugca

SEQ ID NO: 28508 - RNA, 17 nt, Homo sapiens
cuguguaguuuuguuuu

SEQ ID NO: 28509 - RNA, 18 nt, Homo sapiens
gccacagcaaaaaguaaa

SEQ ID NO: 28510 - RNA, 21 nt, Homo sapiens
aggcagaaaaacuugaaauac

SEQ ID NO: 28511 - RNA, 18 nt, Homo sapiens
ucuacgggaaauggguca

SEQ ID NO: 28512 - RNA, 23 nt, Homo sapiens
ucuuuagcuuagcccaguuucca

SEQ ID NO: 28513 - RNA, 21 nt, Homo sapiens
uggaugcauuggcugaaauug

SEQ ID NO: 28514 - RNA, 23 nt, Homo sapiens
uuugauauaaaaagaaacuauag

SEQ ID NO: 28515 - RNA, 20 nt, Homo sapiens
cugccccccuccucaccugg

SEQ ID NO: 28516 - RNA, 18 nt, Homo sapiens
agcaaaaaguaaagaaca

SEQ ID NO: 28517 - RNA, 19 nt, Homo sapiens
auaaagcaagcuaucugca

SEQ ID NO: 28518 - RNA, 17 nt, Homo sapiens
cuguguaguuuuguuuu

SEQ ID NO: 28519 - RNA, 18 nt, Homo sapiens
gccacagcaaaaaguaaa

SEQ ID NO: 28520 - RNA, 19 nt, Homo sapiens
uguguuggccgguucugaa

SEQ ID NO: 28521 - RNA, 18 nt, Homo sapiens
augagggguucccuugaa

SEQ ID NO: 28522 - RNA, 21 nt, Homo sapiens
cagggucgugagguuucuggu

SEQ ID NO: 28523 - RNA, 18 nt, Homo sapiens
ccugaccgagccugugag

SEQ ID NO: 28524 - RNA, 23 nt, Homo sapiens
gcuucucugccauuagcagcccu

SEQ ID NO: 28525 - RNA, 21 nt, Homo sapiens
ggaaacagaaacucccaacug

SEQ ID NO: 28526 - RNA, 21 nt, Homo sapiens
gucccaaaaugggauuggaga

SEQ ID NO: 28527 - RNA, 22 nt, Homo sapiens
agacuuccuuauuuaucaauua

SEQ ID NO: 28528 - RNA, 24 nt, Homo sapiens
agccacagggacccaagcagucga

SEQ ID NO: 28529 - RNA, 19 nt, Homo sapiens
agcucacucucuaggucuc

SEQ ID NO: 28530 - RNA, 20 nt, Homo sapiens
caagguuguggccuuagguu

SEQ ID NO: 28531 - RNA, 25 nt, Homo sapiens
ccaagcacuuuccucuuuuacagcu

SEQ ID NO: 28532 - RNA, 19 nt, Homo sapiens
cgaggaacuccggcugcuu

SEQ ID NO: 28533 - RNA, 22 nt, Homo sapiens
cucugugcgagagaucugugaa

SEQ ID NO: 28534 - RNA, 16 nt, Homo sapiens
cuuucucagcauauca

SEQ ID NO: 28535 - RNA, 17 nt, Homo sapiens
gauacaacuccccgauc

SEQ ID NO: 28536 - RNA, 19 nt, Homo sapiens
gcaagagccauguuuuuga

SEQ ID NO: 28537 - RNA, 18 nt, Homo sapiens
guuacucacacuuauguc

SEQ ID NO: 28538 - RNA, 20 nt, Homo sapiens
uaagugggucucgccugggc

SEQ ID NO: 28539 - RNA, 21 nt, Homo sapiens
ucuaggguuguagcuuuugau

SEQ ID NO: 28540 - RNA, 22 nt, Homo sapiens
ucuaggguuguagcuuuugaua

SEQ ID NO: 28541 - RNA, 21 nt, Homo sapiens
ucaguccuggcaccaugcaca

SEQ ID NO: 28542 - RNA, 23 nt, Homo sapiens
agaaaagggagccccaaaugcaa

SEQ ID NO: 28543 - RNA, 22 nt, Homo sapiens
agacccuccuccuccuccaucu

SEQ ID NO: 28544 - RNA, 19 nt, Homo sapiens
aggauuugcuaugaccuca

SEQ ID NO: 28545 - RNA, 19 nt, Homo sapiens
cuccuccuccuccaucucu

SEQ ID NO: 28546 - RNA, 21 nt, Homo sapiens
ucauccagcagccuccccucc

SEQ ID NO: 28547 - RNA, 19 nt, Homo sapiens
cugcaagcuccgccuccca

SEQ ID NO: 28548 - RNA, 16 nt, Homo sapiens
ugccauucuccugccu

SEQ ID NO: 28549 - RNA, 18 nt, Homo sapiens
agauaauuacugccuuga

SEQ ID NO: 28550 - RNA, 21 nt, Homo sapiens
caguacccaccaccuucuucu

SEQ ID NO: 28551 - RNA, 18 nt, Homo sapiens
cauaucccuuccagaugg

SEQ ID NO: 28552 - RNA, 22 nt, Homo sapiens
ggcuccaucccccgcccccucu

SEQ ID NO: 28553 - RNA, 18 nt, Homo sapiens
gugcggaguuuuggaaua

SEQ ID NO: 28554 - RNA, 18 nt, Homo sapiens
uaagaaacuuauuucuca

SEQ ID NO: 28555 - RNA, 23 nt, Homo sapiens
uaucccaagaaugcaagauuuca

SEQ ID NO: 28556 - RNA, 23 nt, Homo sapiens
gaggcugagcaucaugaagagaa

SEQ ID NO: 28557 - RNA, 19 nt, Homo sapiens
agaugcaggaacuuccaca

SEQ ID NO: 28558 - RNA, 24 nt, Homo sapiens
auuuucucugccuuccuuaucuca

SEQ ID NO: 28559 - RNA, 16 nt, Homo sapiens
caacaguggcuuuuaa

SEQ ID NO: 28560 - RNA, 21 nt, Homo sapiens
gguagucagcccaccuccucu

SEQ ID NO: 28561 - RNA, 20 nt, Homo sapiens
uauuuguaacuucccaacug

SEQ ID NO: 28562 - RNA, 16 nt, Homo sapiens
ugaaccccuuuggccu

SEQ ID NO: 28563 - RNA, 16 nt, Homo sapiens
aggaugccaaugaugc

SEQ ID NO: 28564 - RNA, 20 nt, Homo sapiens
caggcaaaucacgccaccuc

SEQ ID NO: 28565 - RNA, 20 nt, Homo sapiens
ccagauggucugagaaguga

SEQ ID NO: 28566 - RNA, 19 nt, Homo sapiens
ucucugagccugucuccca

SEQ ID NO: 28567 - RNA, 20 nt, Homo sapiens
ugaauauuauccaacauggg

SEQ ID NO: 28568 - RNA, 19 nt, Homo sapiens
uuuuuucauucuacagcau

SEQ ID NO: 28569 - RNA, 19 nt, Homo sapiens
acaugugauuguuuuguuu

SEQ ID NO: 28570 - RNA, 19 nt, Homo sapiens
cccaccccaacccacccca

SEQ ID NO: 28571 - RNA, 18 nt, Homo sapiens
gcccaccccaccccaacc

SEQ ID NO: 28572 - RNA, 19 nt, Homo sapiens
ucagaaugaaugcaguugu

SEQ ID NO: 28573 - RNA, 21 nt, Homo sapiens
ugcugucuccuucccacaucc

SEQ ID NO: 28574 - RNA, 15 nt, Homo sapiens
uucauugagcaguua

SEQ ID NO: 28575 - RNA, 18 nt, Homo sapiens
gagucuuguggugaaaca

SEQ ID NO: 28576 - RNA, 20 nt, Homo sapiens
gcuuaagucauggaauucua

SEQ ID NO: 28577 - RNA, 20 nt, Homo sapiens
ucuuuuuauggcugaauaau

SEQ ID NO: 28578 - RNA, 24 nt, Homo sapiens
cuucuucaucucuguuuugcucuu

SEQ ID NO: 28579 - RNA, 21 nt, Homo sapiens
gguuguggacucggucacugc

SEQ ID NO: 28580 - RNA, 24 nt, Homo sapiens
cuucuucaucucuguuuugcucuu

SEQ ID NO: 28581 - RNA, 21 nt, Homo sapiens
gguuguggacucggucacugc

SEQ ID NO: 28582 - RNA, 20 nt, Homo sapiens
augauuucaaaaucaguuuu

SEQ ID NO: 28583 - RNA, 22 nt, Homo sapiens
ccaaacaaaacugaaccacaaa

SEQ ID NO: 28584 - RNA, 20 nt, Homo sapiens
cuuccacgagccaggggugc

SEQ ID NO: 28585 - RNA, 18 nt, Homo sapiens
cuuguucuauuuuucaau

SEQ ID NO: 28586 - RNA, 20 nt, Homo sapiens
uaagggaacaauccauguga

SEQ ID NO: 28587 - RNA, 23 nt, Homo sapiens
uaaucagaaaaguaauuuuguca

SEQ ID NO: 28588 - RNA, 17 nt, Homo sapiens
ucccucagcagcucuca

SEQ ID NO: 28589 - RNA, 20 nt, Homo sapiens
ugcaaauuaaaacauauuuc

SEQ ID NO: 28590 - RNA, 23 nt, Homo sapiens
uuguuugaucccuaacccuacaa

SEQ ID NO: 28591 - RNA, 17 nt, Homo sapiens
cacccucgccucacagc

SEQ ID NO: 28592 - RNA, 22 nt, Homo sapiens
gaaucaacagaucaaugacaua

SEQ ID NO: 28593 - RNA, 23 nt, Homo sapiens
ucccauuuuccuucaccgugaca

SEQ ID NO: 28594 - RNA, 22 nt, Homo sapiens
gaaucaacagaucaaugacaua

SEQ ID NO: 28595 - RNA, 23 nt, Homo sapiens
ucccauuuuccuucaccgugaca

SEQ ID NO: 28596 - RNA, 21 nt, Homo sapiens
accccacuggaguggugcugg

SEQ ID NO: 28597 - RNA, 19 nt, Homo sapiens
augaccucucagccucuca

SEQ ID NO: 28598 - RNA, 20 nt, Homo sapiens
ccuggcucugcggguugcug

SEQ ID NO: 28599 - RNA, 18 nt, Homo sapiens
aagaagcccaccacuagg

SEQ ID NO: 28600 - RNA, 20 nt, Homo sapiens
ccaaagucacuccuguuuug

SEQ ID NO: 28601 - RNA, 22 nt, Homo sapiens
gaaggaacuacuucagugcaca

SEQ ID NO: 28602 - RNA, 23 nt, Homo sapiens
uuuaggauguucuggaugcuuuu

SEQ ID NO: 28603 - RNA, 20 nt, Homo sapiens
uugaucaauacaacaguaua

SEQ ID NO: 28604 - RNA, 21 nt, Homo sapiens
aacuagcuggcaugguagcac

SEQ ID NO: 28605 - RNA, 18 nt, Homo sapiens
cagauacuugggaggcca

SEQ ID NO: 28606 - RNA, 20 nt, Homo sapiens
cagcucacuguuuuuggugc

SEQ ID NO: 28607 - RNA, 20 nt, Homo sapiens
cugucuuuccagcaugcccu

SEQ ID NO: 28608 - RNA, 17 nt, Homo sapiens
ugaaagccuacagcuca

SEQ ID NO: 28609 - RNA, 17 nt, Homo sapiens
cagguacgcgccgccgc

SEQ ID NO: 28610 - RNA, 17 nt, Homo sapiens
cagguacgcgccgccgc

SEQ ID NO: 28611 - RNA, 19 nt, Homo sapiens
uggccucaguguggcauug

SEQ ID NO: 28612 - RNA, 23 nt, Homo sapiens
gcaggagcagcccgcaccggaca

SEQ ID NO: 28613 - RNA, 23 nt, Homo sapiens
acccaagaaguucaggagcugcc

SEQ ID NO: 28614 - RNA, 22 nt, Homo sapiens
accucaagcuuuacugacuuca

SEQ ID NO: 28615 - RNA, 21 nt, Homo sapiens
agccaagaucacaccacugca

SEQ ID NO: 28616 - RNA, 22 nt, Homo sapiens
ccuugugguauaaaguauuaua

SEQ ID NO: 28617 - RNA, 23 nt, Homo sapiens
ggccgcccccgcccgucuccucu

SEQ ID NO: 28618 - RNA, 21 nt, Homo sapiens
uaaauggauuucaguauagcu

SEQ ID NO: 28619 - RNA, 17 nt, Homo sapiens
uggaauugggagucuga

SEQ ID NO: 28620 - RNA, 22 nt, Homo sapiens
accucaagcuuuacugacuuca

SEQ ID NO: 28621 - RNA, 21 nt, Homo sapiens
agccaagaucacaccacugca

SEQ ID NO: 28622 - RNA, 22 nt, Homo sapiens
ccuugugguauaaaguauuaua

SEQ ID NO: 28623 - RNA, 23 nt, Homo sapiens
ggccgcccccgcccgucuccucu

SEQ ID NO: 28624 - RNA, 19 nt, Homo sapiens
caacuuaacacugaaccca

SEQ ID NO: 28625 - RNA, 16 nt, Homo sapiens
agugaguccuuaccgc

SEQ ID NO: 28626 - RNA, 21 nt, Homo sapiens
aaggcacagggcaaggagcca

SEQ ID NO: 28627 - RNA, 16 nt, Homo sapiens
agugaguccuuaccgc

SEQ ID NO: 28628 - RNA, 21 nt, Homo sapiens
gcaggccuuucacgucagcua

SEQ ID NO: 28629 - RNA, 20 nt, Homo sapiens
gguuuuuacugcugcagcag

SEQ ID NO: 28630 - RNA, 23 nt, Homo sapiens
ugaggagcaggccuuucacguca

SEQ ID NO: 28631 - RNA, 16 nt, Homo sapiens
ccgugcccagcacccg

SEQ ID NO: 28632 - RNA, 16 nt, Homo sapiens
gguggaaguccuccag

SEQ ID NO: 28633 - RNA, 18 nt, Homo sapiens
aacacaggcuugucgugc

SEQ ID NO: 28634 - RNA, 18 nt, Homo sapiens
ccccguucauuuucucca

SEQ ID NO: 28635 - RNA, 19 nt, Homo sapiens
cuucugcagccccucccca

SEQ ID NO: 28636 - RNA, 20 nt, Homo sapiens
ggcugcccccccguucauuu

SEQ ID NO: 28637 - RNA, 19 nt, Homo sapiens
gugaugauccucccauccg

SEQ ID NO: 28638 - RNA, 23 nt, Homo sapiens
gugcauggcugcccccccguuca

SEQ ID NO: 28639 - RNA, 19 nt, Homo sapiens
ucuggguuggcuguuccag

SEQ ID NO: 28640 - RNA, 25 nt, Homo sapiens
aacgucauugcgauuuaucuugcuu

SEQ ID NO: 28641 - RNA, 17 nt, Homo sapiens
acagcugcagcagguga

SEQ ID NO: 28642 - RNA, 18 nt, Homo sapiens
acgcaccagcggaagcuc

SEQ ID NO: 28643 - RNA, 22 nt, Homo sapiens
agacgggcugaagcgagcccuc

SEQ ID NO: 28644 - RNA, 20 nt, Homo sapiens
cucugaaaagugggcuguga

SEQ ID NO: 28645 - RNA, 18 nt, Homo sapiens
gcccucaggaguuuuggg

SEQ ID NO: 28646 - RNA, 19 nt, Homo sapiens
gucuguggaggaggcaaga

SEQ ID NO: 28647 - RNA, 18 nt, Homo sapiens
ucauucugaaccuuauca

SEQ ID NO: 28648 - RNA, 19 nt, Homo sapiens
ucuggacaaagacuaccug

SEQ ID NO: 28649 - RNA, 17 nt, Homo sapiens
ucuugaagacaacucug

SEQ ID NO: 28650 - RNA, 25 nt, Homo sapiens
aacgucauugcgauuuaucuugcuu

SEQ ID NO: 28651 - RNA, 17 nt, Homo sapiens
acagcugcagcagguga

SEQ ID NO: 28652 - RNA, 18 nt, Homo sapiens
acgcaccagcggaagcuc

SEQ ID NO: 28653 - RNA, 20 nt, Homo sapiens
cucugaaaagugggcuguga

SEQ ID NO: 28654 - RNA, 19 nt, Homo sapiens
gucuguggaggaggcaaga

SEQ ID NO: 28655 - RNA, 18 nt, Homo sapiens
ucauucugaaccuuauca

SEQ ID NO: 28656 - RNA, 19 nt, Homo sapiens
ucuggacaaagacuaccug

SEQ ID NO: 28657 - RNA, 17 nt, Homo sapiens
ucuugaagacaacucug

SEQ ID NO: 28658 - RNA, 21 nt, Homo sapiens
ugcacagacagcacccuccuc

SEQ ID NO: 28659 - RNA, 25 nt, Homo sapiens
aacgucauugcgauuuaucuugcuu

SEQ ID NO: 28660 - RNA, 17 nt, Homo sapiens
acagcugcagcagguga

SEQ ID NO: 28661 - RNA, 18 nt, Homo sapiens
acgcaccagcggaagcuc

SEQ ID NO: 28662 - RNA, 20 nt, Homo sapiens
cucugaaaagugggcuguga

SEQ ID NO: 28663 - RNA, 19 nt, Homo sapiens
gucuguggaggaggcaaga

SEQ ID NO: 28664 - RNA, 18 nt, Homo sapiens
ucauucugaaccuuauca

SEQ ID NO: 28665 - RNA, 17 nt, Homo sapiens
ucuugaagacaacucug

SEQ ID NO: 28666 - RNA, 23 nt, Homo sapiens
gcaggagcagcccgcaccggaca

SEQ ID NO: 28667 - RNA, 21 nt, Homo sapiens
aagagaggcccaggcuacugg

SEQ ID NO: 28668 - RNA, 21 nt, Homo sapiens
cccugcugcggagaccgcgga

SEQ ID NO: 28669 - RNA, 21 nt, Homo sapiens
cucccccggagcagcacuuug

SEQ ID NO: 28670 - RNA, 21 nt, Homo sapiens
cucucucucucucccucucuc

SEQ ID NO: 28671 - RNA, 20 nt, Homo sapiens
ucuccuccuccuccuccucu

SEQ ID NO: 28672 - RNA, 26 nt, Homo sapiens
aaauuuguucuuugauauuggaauua

SEQ ID NO: 28673 - RNA, 22 nt, Homo sapiens
aggguagaaguaagacauauca

SEQ ID NO: 28674 - RNA, 22 nt, Homo sapiens
cugcuuuggcuugcgcacggug

SEQ ID NO: 28675 - RNA, 23 nt, Homo sapiens
cuuaaccucauuggaggaucuca

SEQ ID NO: 28676 - RNA, 21 nt, Homo sapiens
gcacuacagauugagcuuuau

SEQ ID NO: 28677 - RNA, 19 nt, Homo sapiens
ggaggaggaaguacugcua

SEQ ID NO: 28678 - RNA, 16 nt, Homo sapiens
ugaaaagauugaagag

SEQ ID NO: 28679 - RNA, 21 nt, Homo sapiens
ugaauggcagauguggagcua

SEQ ID NO: 28680 - RNA, 19 nt, Homo sapiens
agcauuuugaauuacuuuu

SEQ ID NO: 28681 - RNA, 24 nt, Homo sapiens
acugaaguugugguuguuagguuc

SEQ ID NO: 28682 - RNA, 20 nt, Homo sapiens
auuugauuccuugugcacau

SEQ ID NO: 28683 - RNA, 24 nt, Homo sapiens
caguucugcaaaaaugaccuauaa

SEQ ID NO: 28684 - RNA, 18 nt, Homo sapiens
cucaacauggcagaacca

SEQ ID NO: 28685 - RNA, 18 nt, Homo sapiens
guuuuaauguucuuuuga

SEQ ID NO: 28686 - RNA, 20 nt, Homo sapiens
uguuuuauaaacaacaucaa

SEQ ID NO: 28687 - RNA, 21 nt, Homo sapiens
uucuuuggguguaaagcguuu

SEQ ID NO: 28688 - RNA, 15 nt, Homo sapiens
uuuaauugggugggg

SEQ ID NO: 28689 - RNA, 19 nt, Homo sapiens
ccuuuuuccuucuaaguca

SEQ ID NO: 28690 - RNA, 20 nt, Homo sapiens
gcacgccaccacgcccagcu

SEQ ID NO: 28691 - RNA, 17 nt, Homo sapiens
gcuaauaaacugcgaug

SEQ ID NO: 28692 - RNA, 19 nt, Homo sapiens
gcucccaaacuuaacagca

SEQ ID NO: 28693 - RNA, 19 nt, Homo sapiens
uaggaggcaagagaucuga

SEQ ID NO: 28694 - RNA, 22 nt, Homo sapiens
uccagcuggacaaagacucugg

SEQ ID NO: 28695 - RNA, 23 nt, Homo sapiens
uuucuuuguaugccuuuggccuu

SEQ ID NO: 28696 - RNA, 16 nt, Homo sapiens
aaugauacuguguucc

SEQ ID NO: 28697 - RNA, 17 nt, Homo sapiens
auaauuuuccugugaca

SEQ ID NO: 28698 - RNA, 16 nt, Homo sapiens
ugauacuguguucccu

SEQ ID NO: 28699 - RNA, 17 nt, Homo sapiens
gaguuccaaagaucuca

SEQ ID NO: 28700 - RNA, 18 nt, Homo sapiens
ggcuucuguuucugcauu

SEQ ID NO: 28701 - RNA, 19 nt, Homo sapiens
gguggaccaaagggaugca

SEQ ID NO: 28702 - RNA, 21 nt, Homo sapiens
auuacccccgugaaagcuuuu

SEQ ID NO: 28703 - RNA, 20 nt, Homo sapiens
guguguguggagcucgggug

SEQ ID NO: 28704 - RNA, 18 nt, Homo sapiens
agaaaaauuaccagguca

SEQ ID NO: 28705 - RNA, 22 nt, Homo sapiens
ccuuuugagcugucuugacguu

SEQ ID NO: 28706 - RNA, 18 nt, Homo sapiens
agaaaaauuaccagguca

SEQ ID NO: 28707 - RNA, 22 nt, Homo sapiens
ccuuuugagcugucuugacguu

SEQ ID NO: 28708 - RNA, 20 nt, Homo sapiens
acacuugagcuugccacucu

SEQ ID NO: 28709 - RNA, 18 nt, Homo sapiens
agacacacccacagaagg

SEQ ID NO: 28710 - RNA, 18 nt, Homo sapiens
ccacccucaaucaguacc

SEQ ID NO: 28711 - RNA, 16 nt, Homo sapiens
gcuugccuugaagggg

SEQ ID NO: 28712 - RNA, 21 nt, Homo sapiens
uggauggguccucacgcagac

SEQ ID NO: 28713 - RNA, 18 nt, Homo sapiens
aaaucuuugugcaagaaa

SEQ ID NO: 28714 - RNA, 21 nt, Homo sapiens
acaaaguuaagcacaagaucu

SEQ ID NO: 28715 - RNA, 18 nt, Homo sapiens
ugguuucaaaugaaacua

SEQ ID NO: 28716 - RNA, 22 nt, Homo sapiens
ugugggauguaaauuuguaggu

SEQ ID NO: 28717 - RNA, 23 nt, Homo sapiens
uuauaaauguaguguuucauugg

SEQ ID NO: 28718 - RNA, 25 nt, Homo sapiens
acccugggccauccucacaugugac

SEQ ID NO: 28719 - RNA, 23 nt, Homo sapiens
gcgccgcggccgccuccuccucc

SEQ ID NO: 28720 - RNA, 18 nt, Homo sapiens
ggcaggcacucccaucca

SEQ ID NO: 28721 - RNA, 18 nt, Homo sapiens
ugcauuguuaaucaucca

SEQ ID NO: 28722 - RNA, 23 nt, Homo sapiens
gcgccgcggccgccuccuccucc

SEQ ID NO: 28723 - RNA, 23 nt, Homo sapiens
gcgccgcggccgccuccuccucc

SEQ ID NO: 28724 - RNA, 23 nt, Homo sapiens
gcgccgcggccgccuccuccucc

SEQ ID NO: 28725 - RNA, 23 nt, Homo sapiens
gcgccgcggccgccuccuccucc

SEQ ID NO: 28726 - RNA, 18 nt, Homo sapiens
cgcaggcccuuuacuuca

SEQ ID NO: 28727 - RNA, 18 nt, Homo sapiens
aaacagggcagccaguga

SEQ ID NO: 28728 - RNA, 17 nt, Homo sapiens
agaauggccagaucuaa

SEQ ID NO: 28729 - RNA, 24 nt, Homo sapiens
ccaguagagugaggaagugagaca

SEQ ID NO: 28730 - RNA, 22 nt, Homo sapiens
cuucgccagcagccuugguuuu

SEQ ID NO: 28731 - RNA, 18 nt, Homo sapiens
gaaccuagaaugagacug

SEQ ID NO: 28732 - RNA, 21 nt, Homo sapiens
ucugcaaaaagugaauucuuc

SEQ ID NO: 28733 - RNA, 21 nt, Homo sapiens
acucaaauaaagcguguaaua

SEQ ID NO: 28734 - RNA, 19 nt, Homo sapiens
gcguguaauaaauaaguua

SEQ ID NO: 28735 - RNA, 19 nt, Homo sapiens
ugaauauuuauaucuugua

SEQ ID NO: 28736 - RNA, 24 nt, Homo sapiens
uuucugcacgugguugccuuaguc

SEQ ID NO: 28737 - RNA, 17 nt, Homo sapiens
aaccuaagguaugugcc

SEQ ID NO: 28738 - RNA, 19 nt, Homo sapiens
aagugggguggggaacuca

SEQ ID NO: 28739 - RNA, 19 nt, Homo sapiens
uggaucacaaacagcacaa

SEQ ID NO: 28740 - RNA, 20 nt, Homo sapiens
auaguauauguggacacaua

SEQ ID NO: 28741 - RNA, 19 nt, Homo sapiens
uucuuugggugcauuuugu

SEQ ID NO: 28742 - RNA, 20 nt, Homo sapiens
aguuguccacaggagaucca

SEQ ID NO: 28743 - RNA, 19 nt, Homo sapiens
ccuggaaacugcuuggugc

SEQ ID NO: 28744 - RNA, 21 nt, Homo sapiens
uaaaauacaaaaaauuagcca

SEQ ID NO: 28745 - RNA, 23 nt, Homo sapiens
uucagguaugugggaagcucuga

SEQ ID NO: 28746 - RNA, 22 nt, Homo sapiens
aaacuucaaaaacuucauggca

SEQ ID NO: 28747 - RNA, 20 nt, Homo sapiens
uccuaagcuccaagcauguc

SEQ ID NO: 28748 - RNA, 19 nt, Homo sapiens
ugcccaggagcccccaucc

SEQ ID NO: 28749 - RNA, 20 nt, Homo sapiens
ugcccaggagcccccauccu

SEQ ID NO: 28750 - RNA, 16 nt, Homo sapiens
aaagucaagcugcacu

SEQ ID NO: 28751 - RNA, 19 nt, Homo sapiens
cgugguugagaagcaucag

SEQ ID NO: 28752 - RNA, 22 nt, Homo sapiens
gcucugaacuucuccuucaucc

SEQ ID NO: 28753 - RNA, 16 nt, Homo sapiens
gaucuuucuccgugga

SEQ ID NO: 28754 - RNA, 20 nt, Homo sapiens
ugcucuuacagccuguucca

SEQ ID NO: 28755 - RNA, 22 nt, Homo sapiens
ccguagaauuucgcuucaccga

SEQ ID NO: 28756 - RNA, 18 nt, Homo sapiens
ucguggacuucuaagaaa

SEQ ID NO: 28757 - RNA, 19 nt, Homo sapiens
agggaaggccgaggucuca

SEQ ID NO: 28758 - RNA, 19 nt, Homo sapiens
ccagggcacagcccugaca

SEQ ID NO: 28759 - RNA, 16 nt, Homo sapiens
ccuagcuuugaacuga

SEQ ID NO: 28760 - RNA, 18 nt, Homo sapiens
guuugaguugaggaccaa

SEQ ID NO: 28761 - RNA, 21 nt, Homo sapiens
gcgucgggcacagggcagcuc

SEQ ID NO: 28762 - RNA, 20 nt, Homo sapiens
cccucaguccguccgcgcuu

SEQ ID NO: 28763 - RNA, 19 nt, Homo sapiens
aaagauuugaaaacuuacc

SEQ ID NO: 28764 - RNA, 20 nt, Homo sapiens
caagguuacuuagccaguaa

SEQ ID NO: 28765 - RNA, 20 nt, Homo sapiens
uaacucuuaaucuucacaau

SEQ ID NO: 28766 - RNA, 17 nt, Homo sapiens
ccaugggaccucagcaa

SEQ ID NO: 28767 - RNA, 20 nt, Homo sapiens
uggguugccucccacaaguc

SEQ ID NO: 28768 - RNA, 20 nt, Homo sapiens
ccgcccaaaaacaaauccuc

SEQ ID NO: 28769 - RNA, 22 nt, Homo sapiens
cucagggacaccuccucugaua

SEQ ID NO: 28770 - RNA, 20 nt, Homo sapiens
uccgggaagccaacaguguu

SEQ ID NO: 28771 - RNA, 23 nt, Homo sapiens
uggaaugcaauggcgcgaucuca

SEQ ID NO: 28772 - RNA, 19 nt, Homo sapiens
aagcaauucuccugccuca

SEQ ID NO: 28773 - RNA, 22 nt, Homo sapiens
uccugcuucuagaaccaccuca

SEQ ID NO: 28774 - RNA, 18 nt, Homo sapiens
ugcuucuagaaccaccuc

SEQ ID NO: 28775 - RNA, 18 nt, Homo sapiens
ugucuccucuccaucucu

SEQ ID NO: 28776 - RNA, 17 nt, Homo sapiens
uuuguguguuuuuuuaa

SEQ ID NO: 28777 - RNA, 18 nt, Homo sapiens
ccugcaaccuccaccucc

SEQ ID NO: 28778 - RNA, 19 nt, Homo sapiens
uuucacucugucgccaggc

SEQ ID NO: 28779 - RNA, 20 nt, Homo sapiens
acuugaucaggaaagugaca

SEQ ID NO: 28780 - RNA, 22 nt, Homo sapiens
aguuucacucugucacccaggc

SEQ ID NO: 28781 - RNA, 22 nt, Homo sapiens
cucuuuaguauugggaucccag

SEQ ID NO: 28782 - RNA, 22 nt, Homo sapiens
ugaucucgccuccuggguucaa

SEQ ID NO: 28783 - RNA, 20 nt, Homo sapiens
uggccaggcuggucuugaac

SEQ ID NO: 28784 - RNA, 19 nt, Homo sapiens
uguggaugcuuuccuacgc

SEQ ID NO: 28785 - RNA, 20 nt, Homo sapiens
auacacuuaccacuggguga

SEQ ID NO: 28786 - RNA, 22 nt, Homo sapiens
ccuuuucuguugguuugguuuu

SEQ ID NO: 28787 - RNA, 24 nt, Homo sapiens
ccaggcccugccagguucccaccc

SEQ ID NO: 28788 - RNA, 19 nt, Homo sapiens
uacacggccgaccugucgc

SEQ ID NO: 28789 - RNA, 19 nt, Homo sapiens
gugaugaagaagccaguua

SEQ ID NO: 28790 - RNA, 20 nt, Homo sapiens
uucuggcccuucccacacca

SEQ ID NO: 28791 - RNA, 20 nt, Homo sapiens
aucuguacuccccagaucuc

SEQ ID NO: 28792 - RNA, 22 nt, Homo sapiens
caugcucaccuccccuacccug

SEQ ID NO: 28793 - RNA, 20 nt, Homo sapiens
gggggucccccucaaccgca

SEQ ID NO: 28794 - RNA, 20 nt, Homo sapiens
ugagcucccaguaggggcug

SEQ ID NO: 28795 - RNA, 20 nt, Homo sapiens
cccaccuggaacccgaccuc

SEQ ID NO: 28796 - RNA, 17 nt, Homo sapiens
ucaagugauucuccugc

SEQ ID NO: 28797 - RNA, 18 nt, Homo sapiens
uccgccucccggguucaa

SEQ ID NO: 28798 - RNA, 18 nt, Homo sapiens
uucuccugccucagccuu

SEQ ID NO: 28799 - RNA, 20 nt, Homo sapiens
aacuacaccccgccuccccu

SEQ ID NO: 28800 - RNA, 24 nt, Homo sapiens
cacaugcucauggccagaaucuua

SEQ ID NO: 28801 - RNA, 19 nt, Homo sapiens
caggugggauauguccuca

SEQ ID NO: 28802 - RNA, 20 nt, Homo sapiens
ccagucuuuuuggggguuuc

SEQ ID NO: 28803 - RNA, 23 nt, Homo sapiens
ccugcuuguccuggaccacuuuu

SEQ ID NO: 28804 - RNA, 21 nt, Homo sapiens
gauugcucagaguuccuuuag

SEQ ID NO: 28805 - RNA, 19 nt, Homo sapiens
guagcuuuccugggcucca

SEQ ID NO: 28806 - RNA, 20 nt, Homo sapiens
ucuauuuccagacuacugga

SEQ ID NO: 28807 - RNA, 22 nt, Homo sapiens
cccagacccccucgccacucca

SEQ ID NO: 28808 - RNA, 19 nt, Homo sapiens
uguccauacagauguuaca

SEQ ID NO: 28809 - RNA, 23 nt, Homo sapiens
ccuccucgccuucagccuccuca

SEQ ID NO: 28810 - RNA, 22 nt, Homo sapiens
gcagcucaagguccacaucugc

SEQ ID NO: 28811 - RNA, 22 nt, Homo sapiens
gcagcucaagguccacaucugc

SEQ ID NO: 28812 - RNA, 21 nt, Homo sapiens
ugaaguuuccuuuuucccaca

SEQ ID NO: 28813 - RNA, 23 nt, Homo sapiens
gggaccgcggcgguaacuguggc

SEQ ID NO: 28814 - RNA, 21 nt, Homo sapiens
gcccuaaccugccuccuuugc

SEQ ID NO: 28815 - RNA, 16 nt, Homo sapiens
accacccucugcuccu

SEQ ID NO: 28816 - RNA, 19 nt, Homo sapiens
uccuggauacagaacacaa

SEQ ID NO: 28817 - RNA, 18 nt, Homo sapiens
aauaguauuccugaaaua

SEQ ID NO: 28818 - RNA, 19 nt, Homo sapiens
aucugagguucuauuugau

SEQ ID NO: 28819 - RNA, 16 nt, Homo sapiens
gauaaaaacguagcua

SEQ ID NO: 28820 - RNA, 19 nt, Homo sapiens
cuugaagcccaggcugaug

SEQ ID NO: 28821 - RNA, 18 nt, Homo sapiens
gaaaggagauacacuucu

SEQ ID NO: 28822 - RNA, 22 nt, Homo sapiens
gaggcugaccugaaagcaggua

SEQ ID NO: 28823 - RNA, 19 nt, Homo sapiens
ggucaaguuccgucugcca

SEQ ID NO: 28824 - RNA, 22 nt, Homo sapiens
uuaggagugcaccaguacucuc

SEQ ID NO: 28825 - RNA, 17 nt, Homo sapiens
gauaaggcacaugugaa

SEQ ID NO: 28826 - RNA, 19 nt, Homo sapiens
gcuaugcguuaccucugau

SEQ ID NO: 28827 - RNA, 18 nt, Homo sapiens
gucuucagcuugaucaga

SEQ ID NO: 28828 - RNA, 20 nt, Homo sapiens
ucaugagugacaaguguagc

SEQ ID NO: 28829 - RNA, 21 nt, Homo sapiens
uuccagauguuauuguuccag

SEQ ID NO: 28830 - RNA, 19 nt, Homo sapiens
ccucacccaagaaaccccc

SEQ ID NO: 28831 - RNA, 18 nt, Homo sapiens
ccugaugacccucugcgg

SEQ ID NO: 28832 - RNA, 20 nt, Homo sapiens
cuuccaagcugcuuagccuu

SEQ ID NO: 28833 - RNA, 19 nt, Homo sapiens
gggccuucucaaugagcac

SEQ ID NO: 28834 - RNA, 22 nt, Homo sapiens
uuauuacacugucugcuccuga

SEQ ID NO: 28835 - RNA, 23 nt, Homo sapiens
cccaggugaggauucacauccca

SEQ ID NO: 28836 - RNA, 25 nt, Homo sapiens
cccaggugaggauucacaucccaaa

SEQ ID NO: 28837 - RNA, 20 nt, Homo sapiens
gaaaccaccuagggaccacg

SEQ ID NO: 28838 - RNA, 23 nt, Homo sapiens
gccugagucaggacaccuggcuu

SEQ ID NO: 28839 - RNA, 21 nt, Homo sapiens
ugggugggcugaguggaggug

SEQ ID NO: 28840 - RNA, 28 nt, Homo sapiens
aagaggaaucaccagggcccggaucuaa

SEQ ID NO: 28841 - RNA, 16 nt, Homo sapiens
ccaggcacugcacagc

SEQ ID NO: 28842 - RNA, 22 nt, Homo sapiens
ccuggaaacuaccauugugagg

SEQ ID NO: 28843 - RNA, 19 nt, Homo sapiens
uggacaaucagcauggaau

SEQ ID NO: 28844 - RNA, 18 nt, Homo sapiens
ugaaugagaucaugcgca

SEQ ID NO: 28845 - RNA, 17 nt, Homo sapiens
caaaaccaagaugguga

SEQ ID NO: 28846 - RNA, 18 nt, Homo sapiens
cguccucacugcuacacu

SEQ ID NO: 28847 - RNA, 19 nt, Homo sapiens
ucuggucguccucacugcu

SEQ ID NO: 28848 - RNA, 19 nt, Homo sapiens
acuaaaaauuuacaagaga

SEQ ID NO: 28849 - RNA, 19 nt, Homo sapiens
cuuuucucguaaacuuugc

SEQ ID NO: 28850 - RNA, 18 nt, Homo sapiens
ucuuucucucucuggugu

SEQ ID NO: 28851 - RNA, 16 nt, Homo sapiens
aaacagacccacauug

SEQ ID NO: 28852 - RNA, 16 nt, Homo sapiens
cacauuggaacaguga

SEQ ID NO: 28853 - RNA, 23 nt, Homo sapiens
agaaacccgggguugggggcuca

SEQ ID NO: 28854 - RNA, 22 nt, Homo sapiens
cggggcggccagggcuagagug

SEQ ID NO: 28855 - RNA, 18 nt, Homo sapiens
gggggugggguugaaaua

SEQ ID NO: 28856 - RNA, 21 nt, Homo sapiens
uaauuccagaguacuguccuc

SEQ ID NO: 28857 - RNA, 29 nt, Homo sapiens
uaggucucccacuuucuaggaucauuuuu

SEQ ID NO: 28858 - RNA, 20 nt, Homo sapiens
ucugugacuggugccauaga

SEQ ID NO: 28859 - RNA, 15 nt, Homo sapiens
ugccaucggcuguga

SEQ ID NO: 28860 - RNA, 19 nt, Homo sapiens
aacaagaggcccaaucuca

SEQ ID NO: 28861 - RNA, 19 nt, Homo sapiens
aagcccccacagcuggcca

SEQ ID NO: 28862 - RNA, 25 nt, Homo sapiens
ccgggguacaagaggcccaaucuca

SEQ ID NO: 28863 - RNA, 19 nt, Homo sapiens
cgucccuugugacaacacc

SEQ ID NO: 28864 - RNA, 20 nt, Homo sapiens
ggcuugaagcagggcuccau

SEQ ID NO: 28865 - RNA, 22 nt, Homo sapiens
acccagagcacaggagcugcca

SEQ ID NO: 28866 - RNA, 17 nt, Homo sapiens
ccauccccugaugccca

SEQ ID NO: 28867 - RNA, 21 nt, Homo sapiens
ccccaagguccccccacagcu

SEQ ID NO: 28868 - RNA, 19 nt, Homo sapiens
gcuguccuggcauuugugg

SEQ ID NO: 28869 - RNA, 18 nt, Homo sapiens
acagcccaaggcagagcu

SEQ ID NO: 28870 - RNA, 21 nt, Homo sapiens
caugcuggcccaccccggcgg

SEQ ID NO: 28871 - RNA, 21 nt, Homo sapiens
cgccugcccuugccccacucc

SEQ ID NO: 28872 - RNA, 20 nt, Homo sapiens
gaagaagagaaagacagcca

SEQ ID NO: 28873 - RNA, 21 nt, Homo sapiens
gcaccacaugccucugucucc

SEQ ID NO: 28874 - RNA, 19 nt, Homo sapiens
gggugggccuggacggcug

SEQ ID NO: 28875 - RNA, 19 nt, Homo sapiens
gggugggccugggcagcug

SEQ ID NO: 28876 - RNA, 19 nt, Homo sapiens
gggugggccugggcagcug

SEQ ID NO: 28877 - RNA, 20 nt, Homo sapiens
ugcacagaacccucgccccu

SEQ ID NO: 28878 - RNA, 18 nt, Homo sapiens
auaccauacuacacaaug

SEQ ID NO: 28879 - RNA, 19 nt, Homo sapiens
uugaagcauugcaucuuuu

SEQ ID NO: 28880 - RNA, 21 nt, Homo sapiens
aucuuggcucacugcaaccuc

SEQ ID NO: 28881 - RNA, 17 nt, Homo sapiens
ccucuguccugcagcag

SEQ ID NO: 28882 - RNA, 23 nt, Homo sapiens
gccagcuccaacccaaagcccug

SEQ ID NO: 28883 - RNA, 22 nt, Homo sapiens
gccugaagccuuccucuggcuu

SEQ ID NO: 28884 - RNA, 18 nt, Homo sapiens
uccgccuccuggguucaa

SEQ ID NO: 28885 - RNA, 18 nt, Homo sapiens
ugcagcagaaccccuccu

SEQ ID NO: 28886 - RNA, 20 nt, Homo sapiens
accucuagacaccccucucc

SEQ ID NO: 28887 - RNA, 21 nt, Homo sapiens
cucuagacaccccucuccacc

SEQ ID NO: 28888 - RNA, 19 nt, Homo sapiens
gggggcuuccaaguuguuu

SEQ ID NO: 28889 - RNA, 20 nt, Homo sapiens
gucauauauaucacucaggc

SEQ ID NO: 28890 - RNA, 19 nt, Homo sapiens
ucuccccacagccucaagg

SEQ ID NO: 28891 - RNA, 20 nt, Homo sapiens
ggaggugcggcggcggcggc

SEQ ID NO: 28892 - RNA, 17 nt, Homo sapiens
ccccacacuuguuccag

SEQ ID NO: 28893 - RNA, 19 nt, Homo sapiens
cucccucucucuucugcuc

SEQ ID NO: 28894 - RNA, 20 nt, Homo sapiens
cugccuggccaggcagaucu

SEQ ID NO: 28895 - RNA, 20 nt, Homo sapiens
ucccccaacccccaccccac

SEQ ID NO: 28896 - RNA, 18 nt, Homo sapiens
agcaucacaucuucugug

SEQ ID NO: 28897 - RNA, 19 nt, Homo sapiens
ggcccucccuguuuccaca

SEQ ID NO: 28898 - RNA, 18 nt, Homo sapiens
guccagacugaacgcagc

SEQ ID NO: 28899 - RNA, 20 nt, Homo sapiens
uaguagacagccauuaaauu

SEQ ID NO: 28900 - RNA, 19 nt, Homo sapiens
acaaauguuacacuagaca

SEQ ID NO: 28901 - RNA, 21 nt, Homo sapiens
auggcuguacuggauauccca

SEQ ID NO: 28902 - RNA, 18 nt, Homo sapiens
ccaguauuuccccuucuc

SEQ ID NO: 28903 - RNA, 24 nt, Homo sapiens
cugguuccucccugccccuugcca

SEQ ID NO: 28904 - RNA, 17 nt, Homo sapiens
gcgcggcggcgggcggc

SEQ ID NO: 28905 - RNA, 23 nt, Homo sapiens
acacagcuaucaagugcuaaguu

SEQ ID NO: 28906 - RNA, 18 nt, Homo sapiens
caaaccaacauuugguga

SEQ ID NO: 28907 - RNA, 18 nt, Homo sapiens
ucuggugcaaucugugaa

SEQ ID NO: 28908 - RNA, 22 nt, Homo sapiens
aucuuggcucacugcaacccuc

SEQ ID NO: 28909 - RNA, 18 nt, Homo sapiens
auggauacaugaaaauua

SEQ ID NO: 28910 - RNA, 21 nt, Homo sapiens
cuuaccugaugccuugauuuu

SEQ ID NO: 28911 - RNA, 20 nt, Homo sapiens
gcacgccaccaugcccagcu

SEQ ID NO: 28912 - RNA, 23 nt, Homo sapiens
ugccugacaauuagcucuauuca

SEQ ID NO: 28913 - RNA, 24 nt, Homo sapiens
uuaaaguaauuucagagcacuuuu

SEQ ID NO: 28914 - RNA, 20 nt, Homo sapiens
ccaacacagaacuuccauuc

SEQ ID NO: 28915 - RNA, 17 nt, Homo sapiens
cucuuccgcguuaccua

SEQ ID NO: 28916 - RNA, 19 nt, Homo sapiens
aggaaccugagccuggcug

SEQ ID NO: 28917 - RNA, 17 nt, Homo sapiens
auccucuuccuucacag

SEQ ID NO: 28918 - RNA, 22 nt, Homo sapiens
cacuaccagaguucucuagcaa

SEQ ID NO: 28919 - RNA, 20 nt, Homo sapiens
cugcauucaguccuuugaug

SEQ ID NO: 28920 - RNA, 19 nt, Homo sapiens
cuugccagcugacgucaca

SEQ ID NO: 28921 - RNA, 21 nt, Homo sapiens
gccucugucccaauucugagu

SEQ ID NO: 28922 - RNA, 22 nt, Homo sapiens
guagagacaggauuucaccaug

SEQ ID NO: 28923 - RNA, 19 nt, Homo sapiens
gugaacucacacaugugua

SEQ ID NO: 28924 - RNA, 22 nt, Homo sapiens
gugaagcugcagccggcaucca

SEQ ID NO: 28925 - RNA, 16 nt, Homo sapiens
guugcguagucuugaa

SEQ ID NO: 28926 - RNA, 21 nt, Homo sapiens
ucaucaucaucaucucugcua

SEQ ID NO: 28927 - RNA, 26 nt, Homo sapiens
uggguggguuucuaccuuugaaacug

SEQ ID NO: 28928 - RNA, 22 nt, Homo sapiens
uuuugggacaaugccucugucc

SEQ ID NO: 28929 - RNA, 17 nt, Homo sapiens
cagcgacgccugcccag

SEQ ID NO: 28930 - RNA, 19 nt, Homo sapiens
gggcggggcggccgcugcc

SEQ ID NO: 28931 - RNA, 23 nt, Homo sapiens
aaaaugagaugccagaagccuca

SEQ ID NO: 28932 - RNA, 19 nt, Homo sapiens
ccugugcuucacaucugaa

SEQ ID NO: 28933 - RNA, 17 nt, Homo sapiens
guggaguggucugguga

SEQ ID NO: 28934 - RNA, 17 nt, Homo sapiens
ucaagugauucuccugc

SEQ ID NO: 28935 - RNA, 18 nt, Homo sapiens
uccgccucccagguucaa

SEQ ID NO: 28936 - RNA, 20 nt, Homo sapiens
acagaacuucaagucucuuc

SEQ ID NO: 28937 - RNA, 16 nt, Homo sapiens
agaacuguugauuuca

SEQ ID NO: 28938 - RNA, 19 nt, Homo sapiens
agaucguuaacauggguaa

SEQ ID NO: 28939 - RNA, 23 nt, Homo sapiens
ccucuuuguagaugauguauuuu

SEQ ID NO: 28940 - RNA, 21 nt, Homo sapiens
ccugcucccugaucugucaga

SEQ ID NO: 28941 - RNA, 16 nt, Homo sapiens
cuaguucaaugcuagg

SEQ ID NO: 28942 - RNA, 22 nt, Homo sapiens
ggcccauuucuuuucaaacuga

SEQ ID NO: 28943 - RNA, 16 nt, Homo sapiens
uaauuccacacuguua

SEQ ID NO: 28944 - RNA, 23 nt, Homo sapiens
ucuguauugauggacucauuucu

SEQ ID NO: 28945 - RNA, 19 nt, Homo sapiens
ugagaaguacuggcagaca

SEQ ID NO: 28946 - RNA, 18 nt, Homo sapiens
uucauucaugucuggaga

SEQ ID NO: 28947 - RNA, 23 nt, Homo sapiens
uuuuuccaacucaaugaaugaca

SEQ ID NO: 28948 - RNA, 23 nt, Homo sapiens
uuuaagaagucaaaagauaccac

SEQ ID NO: 28949 - RNA, 24 nt, Homo sapiens
ugaaugcgacuuuggaugagauua

SEQ ID NO: 28950 - RNA, 20 nt, Homo sapiens
ugagauuaagaaggcccagu

SEQ ID NO: 28951 - RNA, 23 nt, Homo sapiens
ucuccgacugaucgcugaucuca

SEQ ID NO: 28952 - RNA, 20 nt, Homo sapiens
ugcugcgguccucucuccga

SEQ ID NO: 28953 - RNA, 21 nt, Homo sapiens
cggaaacuuuuagcuccacga

SEQ ID NO: 28954 - RNA, 16 nt, Homo sapiens
cucccuccucuuccuc

SEQ ID NO: 28955 - RNA, 16 nt, Homo sapiens
cuccuccagcuguugu

SEQ ID NO: 28956 - RNA, 19 nt, Homo sapiens
gcgaugcccucggacuuca

SEQ ID NO: 28957 - RNA, 21 nt, Homo sapiens
gcggcuguccgggcgaugaca

SEQ ID NO: 28958 - RNA, 20 nt, Homo sapiens
gcuucucucggcucugucuc

SEQ ID NO: 28959 - RNA, 20 nt, Homo sapiens
ucccggcucaggaacagcag

SEQ ID NO: 28960 - RNA, 16 nt, Homo sapiens
auugcugauuuucucu

SEQ ID NO: 28961 - RNA, 20 nt, Homo sapiens
uugguggaucaaaaaugcca

SEQ ID NO: 28962 - RNA, 16 nt, Homo sapiens
auugcugauuuucucu

SEQ ID NO: 28963 - RNA, 20 nt, Homo sapiens
uugguggaucaaaaaugcca

SEQ ID NO: 28964 - RNA, 19 nt, Homo sapiens
cugugaccaccucauugcu

SEQ ID NO: 28965 - RNA, 19 nt, Homo sapiens
uaucuguggccuaugaggc

SEQ ID NO: 28966 - RNA, 20 nt, Homo sapiens
cauagaaagacuacugucaa

SEQ ID NO: 28967 - RNA, 18 nt, Homo sapiens
ugacaugacagccauucc

SEQ ID NO: 28968 - RNA, 20 nt, Homo sapiens
cauagaaagacuacugucaa

SEQ ID NO: 28969 - RNA, 19 nt, Homo sapiens
agaaguggucagacucugg

SEQ ID NO: 28970 - RNA, 20 nt, Homo sapiens
aggguggaguaauuugucca

SEQ ID NO: 28971 - RNA, 17 nt, Homo sapiens
aucucuauaucuagaua

SEQ ID NO: 28972 - RNA, 16 nt, Homo sapiens
ccuuguguuuguuaua

SEQ ID NO: 28973 - RNA, 19 nt, Homo sapiens
ggaaagagagcuaauucac

SEQ ID NO: 28974 - RNA, 20 nt, Homo sapiens
uuccagaaacagccucacag

SEQ ID NO: 28975 - RNA, 21 nt, Homo sapiens
augugacuuuguagauauucc

SEQ ID NO: 28976 - RNA, 17 nt, Homo sapiens
cccccaaccacccacca

SEQ ID NO: 28977 - RNA, 17 nt, Homo sapiens
guagcaggcaguuccca

SEQ ID NO: 28978 - RNA, 20 nt, Homo sapiens
uacugacaccccacuggcua

SEQ ID NO: 28979 - RNA, 17 nt, Homo sapiens
ucuucaccacugaucuc

SEQ ID NO: 28980 - RNA, 22 nt, Homo sapiens
uuucuucauucagcuuagccuu

SEQ ID NO: 28981 - RNA, 20 nt, Homo sapiens
cacuguccccacccuccuuc

SEQ ID NO: 28982 - RNA, 22 nt, Homo sapiens
cagggcacgugcucacagcccu

SEQ ID NO: 28983 - RNA, 21 nt, Homo sapiens
ccacgggcucccugcuccccc

SEQ ID NO: 28984 - RNA, 16 nt, Homo sapiens
cugcgcggccucguca

SEQ ID NO: 28985 - RNA, 18 nt, Homo sapiens
ggagcgcccggcccccuc

SEQ ID NO: 28986 - RNA, 20 nt, Homo sapiens
ggcuugcugugucucacugu

SEQ ID NO: 28987 - RNA, 20 nt, Homo sapiens
cacuguccccacccuccuuc

SEQ ID NO: 28988 - RNA, 22 nt, Homo sapiens
cagggcacgugcucacagcccu

SEQ ID NO: 28989 - RNA, 21 nt, Homo sapiens
ccacgggcucccugcuccccc

SEQ ID NO: 28990 - RNA, 16 nt, Homo sapiens
cugcgcggccucguca

SEQ ID NO: 28991 - RNA, 20 nt, Homo sapiens
ggcuugcugugucucacugu

SEQ ID NO: 28992 - RNA, 27 nt, Homo sapiens
acaaagacucagcuacuucuuuucuua

SEQ ID NO: 28993 - RNA, 20 nt, Homo sapiens
caaaauauaucucugcucuu

SEQ ID NO: 28994 - RNA, 18 nt, Homo sapiens
ccccacccgccggcacgc

SEQ ID NO: 28995 - RNA, 22 nt, Homo sapiens
cgcgccgcugcuccgcgcgcug

SEQ ID NO: 28996 - RNA, 21 nt, Homo sapiens
cuccccugcgcccucuccucu

SEQ ID NO: 28997 - RNA, 20 nt, Homo sapiens
uauguugcuggaacauuucu

SEQ ID NO: 28998 - RNA, 20 nt, Homo sapiens
acgcuuaacaccucuaacaa

SEQ ID NO: 28999 - RNA, 18 nt, Homo sapiens
cauauuagcucccacuca

SEQ ID NO: 29000 - RNA, 20 nt, Homo sapiens
cugcugagcucugugugauu

SEQ ID NO: 29001 - RNA, 22 nt, Homo sapiens
gaugccauccccacugaaccca

SEQ ID NO: 29002 - RNA, 24 nt, Homo sapiens
gugccucaccaccugcugagcucu

SEQ ID NO: 29003 - RNA, 21 nt, Homo sapiens
uuucuccccauuuuccaggga

SEQ ID NO: 29004 - RNA, 20 nt, Homo sapiens
aggcggaaacagcacuucau

SEQ ID NO: 29005 - RNA, 22 nt, Homo sapiens
ccagccccugcucagccccucc

SEQ ID NO: 29006 - RNA, 20 nt, Homo sapiens
gcugccaccucgcccagcca

SEQ ID NO: 29007 - RNA, 19 nt, Homo sapiens
uucuucaucguugagcuuu

SEQ ID NO: 29008 - RNA, 18 nt, Homo sapiens
cauguguuccgugaggga

SEQ ID NO: 29009 - RNA, 22 nt, Homo sapiens
gaauucugcaaagcuacuacga

SEQ ID NO: 29010 - RNA, 20 nt, Homo sapiens
uggagacuuaacuuuaagca

SEQ ID NO: 29011 - RNA, 24 nt, Homo sapiens
cugcuggcaaaaggccuguacuca

SEQ ID NO: 29012 - RNA, 21 nt, Homo sapiens
gacugucaccaugcugacaga

SEQ ID NO: 29013 - RNA, 21 nt, Homo sapiens
ggaaaacagaauagaagcaca

SEQ ID NO: 29014 - RNA, 18 nt, Homo sapiens
aucaggauagacaccaag

SEQ ID NO: 29015 - RNA, 20 nt, Homo sapiens
agaaaauucuguggcugugc

SEQ ID NO: 29016 - RNA, 20 nt, Homo sapiens
uauguucuuuuguucaguga

SEQ ID NO: 29017 - RNA, 21 nt, Homo sapiens
ugcugucagcauaaugauugu

SEQ ID NO: 29018 - RNA, 19 nt, Homo sapiens
aucccaggaaccugucaaa

SEQ ID NO: 29019 - RNA, 18 nt, Homo sapiens
cacagcucccagcuucuu

SEQ ID NO: 29020 - RNA, 20 nt, Homo sapiens
ugcccauguccuaaucccag

SEQ ID NO: 29021 - RNA, 19 nt, Homo sapiens
cccucagcaacgccgugca

SEQ ID NO: 29022 - RNA, 18 nt, Homo sapiens
cagggcuaggcucagcca

SEQ ID NO: 29023 - RNA, 22 nt, Homo sapiens
ucacauugcuuuuauuuccucc

SEQ ID NO: 29024 - RNA, 25 nt, Homo sapiens
uuaaagcuauucucacauugcuuuu

SEQ ID NO: 29025 - RNA, 22 nt, Homo sapiens
gggcggggcagggagcccgcca

SEQ ID NO: 29026 - RNA, 19 nt, Homo sapiens
cuuccuguugcucccucca

SEQ ID NO: 29027 - RNA, 21 nt, Homo sapiens
ucagagccugugcccuuccca

SEQ ID NO: 29028 - RNA, 17 nt, Homo sapiens
ucuccccacauguacca

SEQ ID NO: 29029 - RNA, 20 nt, Homo sapiens
gcccucggguggaagcugac

SEQ ID NO: 29030 - RNA, 21 nt, Homo sapiens
ucgauccagucuccgacuucc

SEQ ID NO: 29031 - RNA, 21 nt, Homo sapiens
gagccaagauugugccacuac

SEQ ID NO: 29032 - RNA, 19 nt, Homo sapiens
ggccgggugcgguggcuca

SEQ ID NO: 29033 - RNA, 18 nt, Homo sapiens
uggguggaucaccugagg

SEQ ID NO: 29034 - RNA, 18 nt, Homo sapiens
uggguggaucacuugagg

SEQ ID NO: 29035 - RNA, 20 nt, Homo sapiens
ccucugccucccggguucaa

SEQ ID NO: 29036 - RNA, 17 nt, Homo sapiens
ucaagugauucuccugc

SEQ ID NO: 29037 - RNA, 18 nt, Homo sapiens
uucuccugccucagccuu

SEQ ID NO: 29038 - RNA, 21 nt, Homo sapiens
gccuaacuuuguguucacuga

SEQ ID NO: 29039 - RNA, 17 nt, Homo sapiens
aagucugacuagaauuc

SEQ ID NO: 29040 - RNA, 20 nt, Homo sapiens
aggcaucagaguaaucuuca

SEQ ID NO: 29041 - RNA, 23 nt, Homo sapiens
caaagaaggcaauaaggaaccca

SEQ ID NO: 29042 - RNA, 17 nt, Homo sapiens
caccaucuccccucaaa

SEQ ID NO: 29043 - RNA, 20 nt, Homo sapiens
uuuaaguggcuaacauccaa

SEQ ID NO: 29044 - RNA, 17 nt, Homo sapiens
aagucugacuagaauuc

SEQ ID NO: 29045 - RNA, 20 nt, Homo sapiens
aggcaucagaguaaucuuca

SEQ ID NO: 29046 - RNA, 17 nt, Homo sapiens
caccaucuccccucaaa

SEQ ID NO: 29047 - RNA, 20 nt, Homo sapiens
uuuaaguggcuaacauccaa

SEQ ID NO: 29048 - RNA, 22 nt, Homo sapiens
agugauccucccgccuugcccu

SEQ ID NO: 29049 - RNA, 20 nt, Homo sapiens
ccucugccucccagguucaa

SEQ ID NO: 29050 - RNA, 20 nt, Homo sapiens
cugaccagcccucgucagcc

SEQ ID NO: 29051 - RNA, 19 nt, Homo sapiens
cugcaaccucugccuccca

SEQ ID NO: 29052 - RNA, 18 nt, Homo sapiens
gcgugccaccacuccggg

SEQ ID NO: 29053 - RNA, 23 nt, Homo sapiens
ggacagccccgccuccgcccccu

SEQ ID NO: 29054 - RNA, 22 nt, Homo sapiens
ggcgugagccaccaacacccug

SEQ ID NO: 29055 - RNA, 26 nt, Homo sapiens
aacaaaaagaacaaaaaaaucugcag

SEQ ID NO: 29056 - RNA, 23 nt, Homo sapiens
ccuuccccacuuccuucccucca

SEQ ID NO: 29057 - RNA, 24 nt, Homo sapiens
gaaaguuuuuaaguaaaccuccca

SEQ ID NO: 29058 - RNA, 23 nt, Homo sapiens
acaaaaauuauugagcaacccua

SEQ ID NO: 29059 - RNA, 22 nt, Homo sapiens
gugccaaaaaccuguggauuuu

SEQ ID NO: 29060 - RNA, 18 nt, Homo sapiens
auacagaaaccggaccca

SEQ ID NO: 29061 - RNA, 21 nt, Homo sapiens
cucucucucucuuuauuuuca

SEQ ID NO: 29062 - RNA, 22 nt, Homo sapiens
gcaccauuguuuuaauacggca

SEQ ID NO: 29063 - RNA, 18 nt, Homo sapiens
ccgaguggcugucggcuc

SEQ ID NO: 29064 - RNA, 16 nt, Homo sapiens
cccagguuccauacca

SEQ ID NO: 29065 - RNA, 24 nt, Homo sapiens
cccagugagguggaagacuucgag

SEQ ID NO: 29066 - RNA, 24 nt, Homo sapiens
gcaccuaccccagguuccauacca

SEQ ID NO: 29067 - RNA, 22 nt, Homo sapiens
guauuaucuacaauuauuggca

SEQ ID NO: 29068 - RNA, 18 nt, Homo sapiens
acauuuugagauuaacug

SEQ ID NO: 29069 - RNA, 21 nt, Homo sapiens
gacccuguccuccccccgcca

SEQ ID NO: 29070 - RNA, 20 nt, Homo sapiens
gacuaucccaacuuuauuuu

SEQ ID NO: 29071 - RNA, 15 nt, Homo sapiens
acauuuggcccugug

SEQ ID NO: 29072 - RNA, 19 nt, Homo sapiens
cccccacccuccaccugcc

SEQ ID NO: 29073 - RNA, 23 nt, Homo sapiens
cccggggagagaaccaguaugag

SEQ ID NO: 29074 - RNA, 19 nt, Homo sapiens
gcccccacccccacccucc

SEQ ID NO: 29075 - RNA, 27 nt, Homo sapiens
gccccucugccuaugucccucugccuc

SEQ ID NO: 29076 - RNA, 22 nt, Homo sapiens
gccugagccaaugugucugucu

SEQ ID NO: 29077 - RNA, 23 nt, Homo sapiens
gcuugggccugagaguuugaucu

SEQ ID NO: 29078 - RNA, 19 nt, Homo sapiens
ugggcugcacguggagcug

SEQ ID NO: 29079 - RNA, 19 nt, Homo sapiens
cccucucuccagaggacac

SEQ ID NO: 29080 - RNA, 24 nt, Homo sapiens
ucauaggcagugauccuagaccaa

SEQ ID NO: 29081 - RNA, 21 nt, Homo sapiens
acuaaccuggagacaguaaca

SEQ ID NO: 29082 - RNA, 17 nt, Homo sapiens
agacaucuccucacccc

SEQ ID NO: 29083 - RNA, 19 nt, Homo sapiens
agacuugggggcaggcgcc

SEQ ID NO: 29084 - RNA, 25 nt, Homo sapiens
agagauuccccuggaccacaccucc

SEQ ID NO: 29085 - RNA, 18 nt, Homo sapiens
agugaaugggaaagggug

SEQ ID NO: 29086 - RNA, 20 nt, Homo sapiens
ccugaaaaaugacuguccca

SEQ ID NO: 29087 - RNA, 23 nt, Homo sapiens
cggaucuccccugaccgcucucc

SEQ ID NO: 29088 - RNA, 21 nt, Homo sapiens
uccugaaaaaugacuguccca

SEQ ID NO: 29089 - RNA, 24 nt, Homo sapiens
ugggaccugcuaaguguggaauua

SEQ ID NO: 29090 - RNA, 18 nt, Homo sapiens
uuccucuggagcuuugca

SEQ ID NO: 29091 - RNA, 20 nt, Homo sapiens
ccagaugccuucuagauuca

SEQ ID NO: 29092 - RNA, 21 nt, Homo sapiens
cagcgucgcccccgugacccu

SEQ ID NO: 29093 - RNA, 20 nt, Homo sapiens
ccagaugccuucuagauuca

SEQ ID NO: 29094 - RNA, 20 nt, Homo sapiens
uugccaagacacccacacua

SEQ ID NO: 29095 - RNA, 18 nt, Homo sapiens
gaaagagcgagugccucu

SEQ ID NO: 29096 - RNA, 19 nt, Homo sapiens
gagugcgagccgcccgcca

SEQ ID NO: 29097 - RNA, 21 nt, Homo sapiens
ccaucaucucaucucuggaug

SEQ ID NO: 29098 - RNA, 21 nt, Homo sapiens
ccaaaagaagcggagauuuaa

SEQ ID NO: 29099 - RNA, 22 nt, Homo sapiens
gguugugaagagguguuuuuuc

SEQ ID NO: 29100 - RNA, 21 nt, Homo sapiens
ccaaaagaagcggagauuuaa

SEQ ID NO: 29101 - RNA, 21 nt, Homo sapiens
ccaaaagaagcggagauuuaa

SEQ ID NO: 29102 - RNA, 21 nt, Homo sapiens
ccaaaagaagcggagauuuaa

SEQ ID NO: 29103 - RNA, 21 nt, Homo sapiens
ccaaaagaagcggagauuuaa

SEQ ID NO: 29104 - RNA, 18 nt, Homo sapiens
aguaaaggccucaucucc

SEQ ID NO: 29105 - RNA, 22 nt, Homo sapiens
caagugauaucaccucucuuca

SEQ ID NO: 29106 - RNA, 22 nt, Homo sapiens
cccauaccuucugguugcuuca

SEQ ID NO: 29107 - RNA, 20 nt, Homo sapiens
ggggucgcggcagccgcacc

SEQ ID NO: 29108 - RNA, 20 nt, Homo sapiens
gguggaagggggugugcgug

SEQ ID NO: 29109 - RNA, 18 nt, Homo sapiens
ucccaauaacuaaugcua

SEQ ID NO: 29110 - RNA, 20 nt, Homo sapiens
ggggucgcggcagccgcacc

SEQ ID NO: 29111 - RNA, 18 nt, Homo sapiens
aguaaaggccucaucucc

SEQ ID NO: 29112 - RNA, 22 nt, Homo sapiens
caagugauaucaccucucuuca

SEQ ID NO: 29113 - RNA, 22 nt, Homo sapiens
cccauaccuucugguugcuuca

SEQ ID NO: 29114 - RNA, 20 nt, Homo sapiens
ggggucgcggcagccgcacc

SEQ ID NO: 29115 - RNA, 20 nt, Homo sapiens
gguggaagggggugugcgug

SEQ ID NO: 29116 - RNA, 18 nt, Homo sapiens
ucccaauaacuaaugcua

SEQ ID NO: 29117 - RNA, 20 nt, Homo sapiens
gccucaucgaccgucugccc

SEQ ID NO: 29118 - RNA, 19 nt, Homo sapiens
augccccaaaguuucuugu

SEQ ID NO: 29119 - RNA, 24 nt, Homo sapiens
caaauacauuuugaaacuagcuuu

SEQ ID NO: 29120 - RNA, 24 nt, Homo sapiens
cagacaccuucccccacccauacc

SEQ ID NO: 29121 - RNA, 22 nt, Homo sapiens
uacaaauggauacacuaacgga

SEQ ID NO: 29122 - RNA, 19 nt, Homo sapiens
ucccuaacaacuguuucag

SEQ ID NO: 29123 - RNA, 19 nt, Homo sapiens
ucccuaacaacuguuucag

SEQ ID NO: 29124 - RNA, 21 nt, Homo sapiens
agcuuccaagaguaaacacug

SEQ ID NO: 29125 - RNA, 19 nt, Homo sapiens
gucuguggguuucuggucc

SEQ ID NO: 29126 - RNA, 21 nt, Homo sapiens
agcuuccaagaguaaacacug

SEQ ID NO: 29127 - RNA, 19 nt, Homo sapiens
gucuguggguuucuggucc

SEQ ID NO: 29128 - RNA, 21 nt, Homo sapiens
agcuuccaagaguaaacacug

SEQ ID NO: 29129 - RNA, 24 nt, Homo sapiens
ccugggagccggcgggaggucugc

SEQ ID NO: 29130 - RNA, 19 nt, Homo sapiens
ggaggagguguggucacca

SEQ ID NO: 29131 - RNA, 19 nt, Homo sapiens
gucuguggguuucuggucc

SEQ ID NO: 29132 - RNA, 22 nt, Homo sapiens
uaguuguauuauuguuguuuca

SEQ ID NO: 29133 - RNA, 21 nt, Homo sapiens
uggaauaauaaugugggauua

SEQ ID NO: 29134 - RNA, 22 nt, Homo sapiens
uuccauguucuacuucagcuaa

SEQ ID NO: 29135 - RNA, 21 nt, Homo sapiens
accugauaggauugccugcuu

SEQ ID NO: 29136 - RNA, 18 nt, Homo sapiens
agcauugaaggaacucuc

SEQ ID NO: 29137 - RNA, 21 nt, Homo sapiens
accugauaggauugccugcuu

SEQ ID NO: 29138 - RNA, 18 nt, Homo sapiens
agcauugaaggaacucuc

SEQ ID NO: 29139 - RNA, 21 nt, Homo sapiens
accugauaggauugccugcuu

SEQ ID NO: 29140 - RNA, 18 nt, Homo sapiens
agcauugaaggaacucuc

SEQ ID NO: 29141 - RNA, 24 nt, Homo sapiens
auuugggcccugugcugccugccu

SEQ ID NO: 29142 - RNA, 15 nt, Homo sapiens
ccuaucucuucccac

SEQ ID NO: 29143 - RNA, 24 nt, Homo sapiens
ccucauaguaucugccuuggucuu

SEQ ID NO: 29144 - RNA, 23 nt, Homo sapiens
ccugcuuccccacccccuccuca

SEQ ID NO: 29145 - RNA, 23 nt, Homo sapiens
ccuguacccuccccuggucuaca

SEQ ID NO: 29146 - RNA, 20 nt, Homo sapiens
ccuuaauggagaaacgggcc

SEQ ID NO: 29147 - RNA, 18 nt, Homo sapiens
ucuagauaguguuagaga

SEQ ID NO: 29148 - RNA, 20 nt, Homo sapiens
cuaucauuuugaauacagua

SEQ ID NO: 29149 - RNA, 18 nt, Homo sapiens
ucuguuucuucccacaaa

SEQ ID NO: 29150 - RNA, 23 nt, Homo sapiens
ugaauggauuauuguaugagcua

SEQ ID NO: 29151 - RNA, 20 nt, Homo sapiens
uuucuuucuguuucuuccca

SEQ ID NO: 29152 - RNA, 23 nt, Homo sapiens
uuugagcucucuuaauugcuuuu

SEQ ID NO: 29153 - RNA, 20 nt, Homo sapiens
gagccgcagcgccgcggcga

SEQ ID NO: 29154 - RNA, 19 nt, Homo sapiens
aagugaugcccuccugcca

SEQ ID NO: 29155 - RNA, 24 nt, Homo sapiens
ccuuacgcuugugggggucugcgg

SEQ ID NO: 29156 - RNA, 16 nt, Homo sapiens
cuagacgcugcuagga

SEQ ID NO: 29157 - RNA, 20 nt, Homo sapiens
aacccaucgguccuacuguu

SEQ ID NO: 29158 - RNA, 20 nt, Homo sapiens
aucuuucagccuugaaaugu

SEQ ID NO: 29159 - RNA, 24 nt, Homo sapiens
cugaccacuuaucaaacccaucgg

SEQ ID NO: 29160 - RNA, 20 nt, Homo sapiens
ugguuucuaacauugaacug

SEQ ID NO: 29161 - RNA, 22 nt, Homo sapiens
uuuccaggccaugcuucuuacc

SEQ ID NO: 29162 - RNA, 24 nt, Homo sapiens
ccucuuagaacugguuuuaaccuu

SEQ ID NO: 29163 - RNA, 24 nt, Homo sapiens
gcgccucggccgccgccgccgccu

SEQ ID NO: 29164 - RNA, 24 nt, Homo sapiens
gcuuuucccccaaaguaucaugug

SEQ ID NO: 29165 - RNA, 18 nt, Homo sapiens
uugagauuuuuucaguga

SEQ ID NO: 29166 - RNA, 20 nt, Homo sapiens
aacagucuuggccauuucuc

SEQ ID NO: 29167 - RNA, 19 nt, Homo sapiens
cuugaugauaaccagugga

SEQ ID NO: 29168 - RNA, 18 nt, Homo sapiens
uucaugaucaacaucucu

SEQ ID NO: 29169 - RNA, 16 nt, Homo sapiens
gccgggugcuuuccug

SEQ ID NO: 29170 - RNA, 22 nt, Homo sapiens
ucuguccaucaccagcaaccaa

SEQ ID NO: 29171 - RNA, 22 nt, Homo sapiens
cccauuuugacaaaguggaaca

SEQ ID NO: 29172 - RNA, 18 nt, Homo sapiens
uacagaucaacucucuca

SEQ ID NO: 29173 - RNA, 20 nt, Homo sapiens
aaauuggugcaaauauauac

SEQ ID NO: 29174 - RNA, 21 nt, Homo sapiens
acucaucuucuaaaaucugug

SEQ ID NO: 29175 - RNA, 18 nt, Homo sapiens
auuucagaugaugcagcc

SEQ ID NO: 29176 - RNA, 21 nt, Homo sapiens
cguuuacuugaguuuaagaua

SEQ ID NO: 29177 - RNA, 18 nt, Homo sapiens
cuugauaucguuugguuc

SEQ ID NO: 29178 - RNA, 18 nt, Homo sapiens
ccagcccccaggcccucu

SEQ ID NO: 29179 - RNA, 17 nt, Homo sapiens
cccccaggcccucuccc

SEQ ID NO: 29180 - RNA, 20 nt, Homo sapiens
cuccaaauggagcucuacuu

SEQ ID NO: 29181 - RNA, 17 nt, Homo sapiens
gaugugaugacaguagc

SEQ ID NO: 29182 - RNA, 19 nt, Homo sapiens
guauguauuagucugcugg

SEQ ID NO: 29183 - RNA, 18 nt, Homo sapiens
aaggucaccuauagaagc

SEQ ID NO: 29184 - RNA, 19 nt, Homo sapiens
accuugggcugggucuaug

SEQ ID NO: 29185 - RNA, 21 nt, Homo sapiens
gagcugcaacaggccuugcca

SEQ ID NO: 29186 - RNA, 22 nt, Homo sapiens
ggagucagguaugcaggcauug

SEQ ID NO: 29187 - RNA, 22 nt, Homo sapiens
gggacaacaagcuucuuucuuc

SEQ ID NO: 29188 - RNA, 28 nt, Homo sapiens
ugaauggacucucucuucagugggauua

SEQ ID NO: 29189 - RNA, 18 nt, Homo sapiens
ugggacaacaagcuucuu

SEQ ID NO: 29190 - RNA, 17 nt, Homo sapiens
uuuguuuuggccacuga

SEQ ID NO: 29191 - RNA, 21 nt, Homo sapiens
ccuccuuaaagagaaggaucu

SEQ ID NO: 29192 - RNA, 16 nt, Homo sapiens
gcucagaaagauacca

SEQ ID NO: 29193 - RNA, 18 nt, Homo sapiens
ggauggaucccuuggcug

SEQ ID NO: 29194 - RNA, 20 nt, Homo sapiens
uggauguacaaauggaacug

SEQ ID NO: 29195 - RNA, 22 nt, Homo sapiens
gcccacuaaggaggaggaguca

SEQ ID NO: 29196 - RNA, 21 nt, Homo sapiens
gccccuguccacccuccccca

SEQ ID NO: 29197 - RNA, 22 nt, Homo sapiens
agaaaucucaaacuguacugua

SEQ ID NO: 29198 - RNA, 18 nt, Homo sapiens
aucccauacaugaaauua

SEQ ID NO: 29199 - RNA, 19 nt, Homo sapiens
caggacaguuuaugaaaua

SEQ ID NO: 29200 - RNA, 18 nt, Homo sapiens
ggaguuaaauguccugca

SEQ ID NO: 29201 - RNA, 19 nt, Homo sapiens
ggaguuaaauguccugcaa

SEQ ID NO: 29202 - RNA, 19 nt, Homo sapiens
uuagguggucaguccuuuu

SEQ ID NO: 29203 - RNA, 21 nt, Homo sapiens
aggagaaacaauuuauaggca

SEQ ID NO: 29204 - RNA, 18 nt, Homo sapiens
uccagaaacagccuccag

SEQ ID NO: 29205 - RNA, 21 nt, Homo sapiens
augugacuuuguagauauucc

SEQ ID NO: 29206 - RNA, 17 nt, Homo sapiens
cccccaaccacccacca

SEQ ID NO: 29207 - RNA, 17 nt, Homo sapiens
guagcaggcaguuccca

SEQ ID NO: 29208 - RNA, 20 nt, Homo sapiens
uacugacaccccacuggcua

SEQ ID NO: 29209 - RNA, 18 nt, Homo sapiens
uccagaaacagccuccag

SEQ ID NO: 29210 - RNA, 17 nt, Homo sapiens
ucuucaccacugaucuc

SEQ ID NO: 29211 - RNA, 22 nt, Homo sapiens
uuucuucauucagcuuagccuu

SEQ ID NO: 29212 - RNA, 18 nt, Homo sapiens
aaguaaugaucuucuggu

SEQ ID NO: 29213 - RNA, 25 nt, Homo sapiens
gcaccauggagcagccugcauguga

SEQ ID NO: 29214 - RNA, 18 nt, Homo sapiens
gcauguucaaagcugaca

SEQ ID NO: 29215 - RNA, 19 nt, Homo sapiens
cccagcgcccucuaccucc

SEQ ID NO: 29216 - RNA, 19 nt, Homo sapiens
ccccaccucccugcagcuu

SEQ ID NO: 29217 - RNA, 21 nt, Homo sapiens
cccugccaggggguuugagga

SEQ ID NO: 29218 - RNA, 21 nt, Homo sapiens
cucuugagagccccaccccug

SEQ ID NO: 29219 - RNA, 17 nt, Homo sapiens
gccaggggguuugagga

SEQ ID NO: 29220 - RNA, 22 nt, Homo sapiens
gggcggccugcagacccugcca

SEQ ID NO: 29221 - RNA, 21 nt, Homo sapiens
aggauccacuacugucuuuaa

SEQ ID NO: 29222 - RNA, 21 nt, Homo sapiens
caucucugcagaccccucucc

SEQ ID NO: 29223 - RNA, 25 nt, Homo sapiens
ucucucccuguggcuggucugguuc

SEQ ID NO: 29224 - RNA, 21 nt, Homo sapiens
gcagcuaaaauaaaaauuuca

SEQ ID NO: 29225 - RNA, 17 nt, Homo sapiens
ucugggcagucagcacu

SEQ ID NO: 29226 - RNA, 18 nt, Homo sapiens
auaaacauccaugacauc

SEQ ID NO: 29227 - RNA, 18 nt, Homo sapiens
ccugaaggagaccuaugg

SEQ ID NO: 29228 - RNA, 23 nt, Homo sapiens
cuguguauuacgcaaaguccuag

SEQ ID NO: 29229 - RNA, 17 nt, Homo sapiens
guccccaaagcauguca

SEQ ID NO: 29230 - RNA, 22 nt, Homo sapiens
uccacacguggaaaucugugga

SEQ ID NO: 29231 - RNA, 19 nt, Homo sapiens
aauacagaagggguguuug

SEQ ID NO: 29232 - RNA, 17 nt, Homo sapiens
uuccuuggaauauagcu

SEQ ID NO: 29233 - RNA, 19 nt, Homo sapiens
aauacagaagggguguuug

SEQ ID NO: 29234 - RNA, 17 nt, Homo sapiens
uuccuuggaauauagcu

SEQ ID NO: 29235 - RNA, 23 nt, Homo sapiens
acuccuuucuuagucuucuucca

SEQ ID NO: 29236 - RNA, 21 nt, Homo sapiens
aucugcccuggcuguuugccc

SEQ ID NO: 29237 - RNA, 17 nt, Homo sapiens
caggaguucuagaccaa

SEQ ID NO: 29238 - RNA, 22 nt, Homo sapiens
ccauguagucuccugggccuca

SEQ ID NO: 29239 - RNA, 19 nt, Homo sapiens
uccuccauggagggccugc

SEQ ID NO: 29240 - RNA, 18 nt, Homo sapiens
aaugauacugaaugaguc

SEQ ID NO: 29241 - RNA, 17 nt, Homo sapiens
cacauauaugaagugaa

SEQ ID NO: 29242 - RNA, 18 nt, Homo sapiens
ccaguggcaacugccugc

SEQ ID NO: 29243 - RNA, 16 nt, Homo sapiens
cucccugguggucuua

SEQ ID NO: 29244 - RNA, 16 nt, Homo sapiens
aaaagcaacaaacaaa

SEQ ID NO: 29245 - RNA, 17 nt, Homo sapiens
gaaugauaaucaguuuu

SEQ ID NO: 29246 - RNA, 23 nt, Homo sapiens
gaucccaagagacgcacaugaug

SEQ ID NO: 29247 - RNA, 23 nt, Homo sapiens
gccaugacgugucugcuuggcuc

SEQ ID NO: 29248 - RNA, 20 nt, Homo sapiens
uggcucccugauauaagcug

SEQ ID NO: 29249 - RNA, 20 nt, Homo sapiens
auaauagaaagaaagcuaca

SEQ ID NO: 29250 - RNA, 20 nt, Homo sapiens
cuguuugaaagcuucaccuc

SEQ ID NO: 29251 - RNA, 19 nt, Homo sapiens
cuuguuccgaccugucaau

SEQ ID NO: 29252 - RNA, 18 nt, Homo sapiens
ggguuuuuugaaauccca

SEQ ID NO: 29253 - RNA, 18 nt, Homo sapiens
agccuaccagcuuagcuc

SEQ ID NO: 29254 - RNA, 21 nt, Homo sapiens
accugggccucaggccugcuc

SEQ ID NO: 29255 - RNA, 20 nt, Homo sapiens
agaagaaagagaaauugucc

SEQ ID NO: 29256 - RNA, 19 nt, Homo sapiens
gggggcuuaccagcaaagc

SEQ ID NO: 29257 - RNA, 21 nt, Homo sapiens
ucuccaggcugccugggcuuu

SEQ ID NO: 29258 - RNA, 20 nt, Homo sapiens
augucauuguaaugauuuca

SEQ ID NO: 29259 - RNA, 20 nt, Homo sapiens
cauuuuuaucaaauguguga

SEQ ID NO: 29260 - RNA, 21 nt, Homo sapiens
cuguagaagggggacaugcca

SEQ ID NO: 29261 - RNA, 22 nt, Homo sapiens
gccugagcugucugucucguuu

SEQ ID NO: 29262 - RNA, 20 nt, Homo sapiens
gugugaacgauacuuggcua

SEQ ID NO: 29263 - RNA, 18 nt, Homo sapiens
uacaaagaaauuucccuc

SEQ ID NO: 29264 - RNA, 21 nt, Homo sapiens
cauccucuuugcccccucagg

SEQ ID NO: 29265 - RNA, 21 nt, Homo sapiens
ccuugacagccagucugugaa

SEQ ID NO: 29266 - RNA, 18 nt, Homo sapiens
gaauacagcacugcuugc

SEQ ID NO: 29267 - RNA, 22 nt, Homo sapiens
uugaugauauuuaaccaguuuu

SEQ ID NO: 29268 - RNA, 23 nt, Homo sapiens
uuguaaccauuuucuauuugugc

SEQ ID NO: 29269 - RNA, 17 nt, Homo sapiens
cuggcauugcacuuuuu

SEQ ID NO: 29270 - RNA, 23 nt, Homo sapiens
cuuugugguuccagauuuuuuuu

SEQ ID NO: 29271 - RNA, 22 nt, Homo sapiens
uuugagcaaucugggcacuuuu

SEQ ID NO: 29272 - RNA, 17 nt, Homo sapiens
accaaaacaaauaaaga

SEQ ID NO: 29273 - RNA, 21 nt, Homo sapiens
aucuuggcucacugcaaccuc

SEQ ID NO: 29274 - RNA, 18 nt, Homo sapiens
uccgccuccuggguucaa

SEQ ID NO: 29275 - RNA, 20 nt, Homo sapiens
uggccagcguggucuugaac

SEQ ID NO: 29276 - RNA, 18 nt, Homo sapiens
uuaaaaaugauacuuaga

SEQ ID NO: 29277 - RNA, 22 nt, Homo sapiens
cuccaggcauuguuuaccugcu

SEQ ID NO: 29278 - RNA, 23 nt, Homo sapiens
gcgggggccgcggccgccggccc

SEQ ID NO: 29279 - RNA, 20 nt, Homo sapiens
gcgguagcagcugccggugg

SEQ ID NO: 29280 - RNA, 20 nt, Homo sapiens
aaacacagaagcaugagugg

SEQ ID NO: 29281 - RNA, 17 nt, Homo sapiens
acucccagugaugaucu

SEQ ID NO: 29282 - RNA, 21 nt, Homo sapiens
auuugaguaacugucaggcuu

SEQ ID NO: 29283 - RNA, 19 nt, Homo sapiens
gggcuuuaugucuuuguua

SEQ ID NO: 29284 - RNA, 21 nt, Homo sapiens
uauuuuuuuauggaaauaaua

SEQ ID NO: 29285 - RNA, 18 nt, Homo sapiens
ucuuugccacugaucuca

SEQ ID NO: 29286 - RNA, 26 nt, Homo sapiens
ucuuuuuguguuaugcacuuaauuuu

SEQ ID NO: 29287 - RNA, 21 nt, Homo sapiens
agccagggccgagcgugccag

SEQ ID NO: 29288 - RNA, 18 nt, Homo sapiens
gcccuucaggucuaaagc

SEQ ID NO: 29289 - RNA, 19 nt, Homo sapiens
gguacaaaaaagccuguaa

SEQ ID NO: 29290 - RNA, 24 nt, Homo sapiens
ggucuagaauauguacacgcagcu

SEQ ID NO: 29291 - RNA, 19 nt, Homo sapiens
ucuugaagaugacaaaagu

SEQ ID NO: 29292 - RNA, 21 nt, Homo sapiens
caagaucacaggagccacugc

SEQ ID NO: 29293 - RNA, 19 nt, Homo sapiens
cagaugaauauuuaacuca

SEQ ID NO: 29294 - RNA, 17 nt, Homo sapiens
cucuacuaaacaugcaa

SEQ ID NO: 29295 - RNA, 20 nt, Homo sapiens
gucucggaaacacagagcca

SEQ ID NO: 29296 - RNA, 21 nt, Homo sapiens
accugggaucucuggcauuac

SEQ ID NO: 29297 - RNA, 18 nt, Homo sapiens
auaaaacacuaucugaug

SEQ ID NO: 29298 - RNA, 16 nt, Homo sapiens
ccacccacccucccuc

SEQ ID NO: 29299 - RNA, 16 nt, Homo sapiens
cucuccuucuccaucu

SEQ ID NO: 29300 - RNA, 16 nt, Homo sapiens
cugucucaacugugca

SEQ ID NO: 29301 - RNA, 23 nt, Homo sapiens
ggcaauuaucucucuuccaggga

SEQ ID NO: 29302 - RNA, 18 nt, Homo sapiens
guccaucucuuuugauca

SEQ ID NO: 29303 - RNA, 20 nt, Homo sapiens
ugccugucccucuccuucuc

SEQ ID NO: 29304 - RNA, 25 nt, Homo sapiens
ggccgucccgagcccccgcuuccuc

SEQ ID NO: 29305 - RNA, 21 nt, Homo sapiens
aagagaggcccaggcuacugg

SEQ ID NO: 29306 - RNA, 21 nt, Homo sapiens
cccugcugcggagaccgcgga

SEQ ID NO: 29307 - RNA, 21 nt, Homo sapiens
aagagaggcccaggcuacugg

SEQ ID NO: 29308 - RNA, 21 nt, Homo sapiens
cccugcugcggagaccgcgga

SEQ ID NO: 29309 - RNA, 18 nt, Homo sapiens
accccgagggcccaggga

SEQ ID NO: 29310 - RNA, 18 nt, Homo sapiens
gcugaguccucuugcaca

SEQ ID NO: 29311 - RNA, 22 nt, Homo sapiens
acuuguuaugguuguuuggacc

SEQ ID NO: 29312 - RNA, 20 nt, Homo sapiens
auccugaggcaaaguaguga

SEQ ID NO: 29313 - RNA, 17 nt, Homo sapiens
ggcaccuccgguucucc

SEQ ID NO: 29314 - RNA, 17 nt, Homo sapiens
uacuggauuguguuugu

SEQ ID NO: 29315 - RNA, 18 nt, Homo sapiens
aacauccagaggugagac

SEQ ID NO: 29316 - RNA, 19 nt, Homo sapiens
aaguuuguaaaauuccuua

SEQ ID NO: 29317 - RNA, 21 nt, Homo sapiens
aggaaguaaugggaagggguu

SEQ ID NO: 29318 - RNA, 18 nt, Homo sapiens
cccgcaaccuccgccucc

SEQ ID NO: 29319 - RNA, 19 nt, Homo sapiens
ccuuucuucucacacgucg

SEQ ID NO: 29320 - RNA, 18 nt, Homo sapiens
uccgccucccggguucaa

SEQ ID NO: 29321 - RNA, 23 nt, Homo sapiens
cagcuguucuagagcgggaauua

SEQ ID NO: 29322 - RNA, 22 nt, Homo sapiens
cuuauuugucuucuacacccca

SEQ ID NO: 29323 - RNA, 18 nt, Homo sapiens
ugucuguggaaaauggga

SEQ ID NO: 29324 - RNA, 21 nt, Homo sapiens
acagaccucccuacagcugua

SEQ ID NO: 29325 - RNA, 22 nt, Homo sapiens
acuugggggaucuccuuggccu

SEQ ID NO: 29326 - RNA, 22 nt, Homo sapiens
agaagguacuuacucuuguacc

SEQ ID NO: 29327 - RNA, 18 nt, Homo sapiens
augccucaaagccuugcu

SEQ ID NO: 29328 - RNA, 23 nt, Homo sapiens
cagcuguucuagagcgggaauua

SEQ ID NO: 29329 - RNA, 20 nt, Homo sapiens
cuauuuggaaaucccuaaca

SEQ ID NO: 29330 - RNA, 22 nt, Homo sapiens
cuuauuugucuucuacacccca

SEQ ID NO: 29331 - RNA, 18 nt, Homo sapiens
uccgccucccggguucaa

SEQ ID NO: 29332 - RNA, 18 nt, Homo sapiens
ugucuguggaaaauggga

SEQ ID NO: 29333 - RNA, 21 nt, Homo sapiens
acagaccucccuacagcugua

SEQ ID NO: 29334 - RNA, 22 nt, Homo sapiens
acuugggggaucuccuuggccu

SEQ ID NO: 29335 - RNA, 22 nt, Homo sapiens
agaagguacuuacucuuguacc

SEQ ID NO: 29336 - RNA, 18 nt, Homo sapiens
augccucaaagccuugcu

SEQ ID NO: 29337 - RNA, 23 nt, Homo sapiens
cagcuguucuagagcgggaauua

SEQ ID NO: 29338 - RNA, 24 nt, Homo sapiens
ccucuagcuccaacugagaaccca

SEQ ID NO: 29339 - RNA, 16 nt, Homo sapiens
ccugcugaaggagucc

SEQ ID NO: 29340 - RNA, 20 nt, Homo sapiens
cuauuuggaaaucccuaaca

SEQ ID NO: 29341 - RNA, 22 nt, Homo sapiens
cuuauuugucuucuacacccca

SEQ ID NO: 29342 - RNA, 18 nt, Homo sapiens
uccgccucccggguucaa

SEQ ID NO: 29343 - RNA, 18 nt, Homo sapiens
ugucuguggaaaauggga

SEQ ID NO: 29344 - RNA, 21 nt, Homo sapiens
acagaccucccuacagcugua

SEQ ID NO: 29345 - RNA, 22 nt, Homo sapiens
acuugggggaucuccuuggccu

SEQ ID NO: 29346 - RNA, 22 nt, Homo sapiens
agaagguacuuacucuuguacc

SEQ ID NO: 29347 - RNA, 18 nt, Homo sapiens
augccucaaagccuugcu

SEQ ID NO: 29348 - RNA, 23 nt, Homo sapiens
cagcuguucuagagcgggaauua

SEQ ID NO: 29349 - RNA, 24 nt, Homo sapiens
ccucuagcuccaacugagaaccca

SEQ ID NO: 29350 - RNA, 20 nt, Homo sapiens
cuauuuggaaaucccuaaca

SEQ ID NO: 29351 - RNA, 22 nt, Homo sapiens
cuuauuugucuucuacacccca

SEQ ID NO: 29352 - RNA, 18 nt, Homo sapiens
uccgccucccggguucaa

SEQ ID NO: 29353 - RNA, 18 nt, Homo sapiens
ugucuguggaaaauggga

SEQ ID NO: 29354 - RNA, 16 nt, Homo sapiens
aggacacggugccuca

SEQ ID NO: 29355 - RNA, 17 nt, Homo sapiens
caggacggccccguccc

SEQ ID NO: 29356 - RNA, 19 nt, Homo sapiens
caggcucucagucaccccu

SEQ ID NO: 29357 - RNA, 20 nt, Homo sapiens
cccugaugacacccugcgag

SEQ ID NO: 29358 - RNA, 21 nt, Homo sapiens
ccuguucuuccucccaacgaa

SEQ ID NO: 29359 - RNA, 19 nt, Homo sapiens
ggcuucuggggccaucuug

SEQ ID NO: 29360 - RNA, 23 nt, Homo sapiens
guccaccccaacuccugacagca

SEQ ID NO: 29361 - RNA, 21 nt, Homo sapiens
uaggacuacagacguuuauca

SEQ ID NO: 29362 - RNA, 23 nt, Homo sapiens
ugcccaggacggccccgucccag

SEQ ID NO: 29363 - RNA, 22 nt, Homo sapiens
aauggucauaacagugccuguu

SEQ ID NO: 29364 - RNA, 22 nt, Homo sapiens
accuggacuuccagucuggcuc

SEQ ID NO: 29365 - RNA, 18 nt, Homo sapiens
caagacaccaaacccuuc

SEQ ID NO: 29366 - RNA, 21 nt, Homo sapiens
cccuuguguuaccucccgcca

SEQ ID NO: 29367 - RNA, 22 nt, Homo sapiens
gcaccucuuguuuuccuuuuuc

SEQ ID NO: 29368 - RNA, 24 nt, Homo sapiens
gcgcugggccgaacauacuggaga

SEQ ID NO: 29369 - RNA, 20 nt, Homo sapiens
uccuggcccaggccuggcgg

SEQ ID NO: 29370 - RNA, 18 nt, Homo sapiens
ucugagccccccacuuuu

SEQ ID NO: 29371 - RNA, 21 nt, Homo sapiens
agccaagcagcugccuuccuu

SEQ ID NO: 29372 - RNA, 21 nt, Homo sapiens
cuguauuucccuuaauuccuc

SEQ ID NO: 29373 - RNA, 23 nt, Homo sapiens
ggggacccgguagcggcgguggc

SEQ ID NO: 29374 - RNA, 19 nt, Homo sapiens
uuccugugugcucccugag

SEQ ID NO: 29375 - RNA, 19 nt, Homo sapiens
ccucuaagcugcauugaga

SEQ ID NO: 29376 - RNA, 19 nt, Homo sapiens
ccuggcagggacuucuggg

SEQ ID NO: 29377 - RNA, 21 nt, Homo sapiens
gaagccucugcccaucccccu

SEQ ID NO: 29378 - RNA, 17 nt, Homo sapiens
guugaauuaaacuagca

SEQ ID NO: 29379 - RNA, 18 nt, Homo sapiens
cgaaucuuccugaaaaug

SEQ ID NO: 29380 - RNA, 20 nt, Homo sapiens
ggaaccugcccgucuccccu

SEQ ID NO: 29381 - RNA, 18 nt, Homo sapiens
gggccuuacgugggauug

SEQ ID NO: 29382 - RNA, 23 nt, Homo sapiens
agggcauucaugaaagaacaacu

SEQ ID NO: 29383 - RNA, 19 nt, Homo sapiens
uuaaaaaucuaagaugugg

SEQ ID NO: 29384 - RNA, 16 nt, Homo sapiens
agcucacccugcuccu

SEQ ID NO: 29385 - RNA, 24 nt, Homo sapiens
auuucugggccuuaugugggguug

SEQ ID NO: 29386 - RNA, 18 nt, Homo sapiens
gucugggucgucuuuuga

SEQ ID NO: 29387 - RNA, 17 nt, Homo sapiens
gugugagggugcaggga

SEQ ID NO: 29388 - RNA, 21 nt, Homo sapiens
ucccgcccucccccugccaga

SEQ ID NO: 29389 - RNA, 19 nt, Homo sapiens
ugcgauggugcugcacccc

SEQ ID NO: 29390 - RNA, 19 nt, Homo sapiens
agaaauaguuuuugcuguu

SEQ ID NO: 29391 - RNA, 19 nt, Homo sapiens
ccagggcuugcuaaaucca

SEQ ID NO: 29392 - RNA, 18 nt, Homo sapiens
gcuuccaggcagccuguu

SEQ ID NO: 29393 - RNA, 20 nt, Homo sapiens
guuccuuucaggcuuccgug

SEQ ID NO: 29394 - RNA, 25 nt, Homo sapiens
caacaucacaucacucaccauuuua

SEQ ID NO: 29395 - RNA, 21 nt, Homo sapiens
cggcuacaacaauucauagaa

SEQ ID NO: 29396 - RNA, 20 nt, Homo sapiens
cucuggagcuacuccugcua

SEQ ID NO: 29397 - RNA, 16 nt, Homo sapiens
gugggcauagguggca

SEQ ID NO: 29398 - RNA, 21 nt, Homo sapiens
uccuuugaauguuccaacaaa

SEQ ID NO: 29399 - RNA, 22 nt, Homo sapiens
ucugaagccucuguuguggcuc

SEQ ID NO: 29400 - RNA, 19 nt, Homo sapiens
ucugucucauguucgugca

SEQ ID NO: 29401 - RNA, 18 nt, Homo sapiens
aagagacuucuucuguuc

SEQ ID NO: 29402 - RNA, 22 nt, Homo sapiens
accugcccgccacauccucugc

SEQ ID NO: 29403 - RNA, 18 nt, Homo sapiens
cacccguccaccugccca

SEQ ID NO: 29404 - RNA, 21 nt, Homo sapiens
gcuuucccgggaggucuggag

SEQ ID NO: 29405 - RNA, 17 nt, Homo sapiens
ggccccgagucugugaa

SEQ ID NO: 29406 - RNA, 23 nt, Homo sapiens
gaggcgcggugcucggcccggga

SEQ ID NO: 29407 - RNA, 18 nt, Homo sapiens
cagcucuccuguaacuca

SEQ ID NO: 29408 - RNA, 17 nt, Homo sapiens
cggaccugcgacuuccg

SEQ ID NO: 29409 - RNA, 23 nt, Homo sapiens
cagaagauucaaggagcuguaga

SEQ ID NO: 29410 - RNA, 23 nt, Homo sapiens
gauauaucagcaaaaacacauca

SEQ ID NO: 29411 - RNA, 17 nt, Homo sapiens
uguuggggggccuuuga

SEQ ID NO: 29412 - RNA, 22 nt, Homo sapiens
aucucggcucacugcaaucucu

SEQ ID NO: 29413 - RNA, 20 nt, Homo sapiens
gccugcgcaccuaaacacug

SEQ ID NO: 29414 - RNA, 17 nt, Homo sapiens
ucaagugauucuccugc

SEQ ID NO: 29415 - RNA, 20 nt, Homo sapiens
uggccaggcuggucuugaac

SEQ ID NO: 29416 - RNA, 19 nt, Homo sapiens
uuuguuuguacugcggcaa

SEQ ID NO: 29417 - RNA, 18 nt, Homo sapiens
ccucacaaaagagccaga

SEQ ID NO: 29418 - RNA, 18 nt, Homo sapiens
ccuggucaggccugugga

SEQ ID NO: 29419 - RNA, 20 nt, Homo sapiens
cgccccugaucacccgcccc

SEQ ID NO: 29420 - RNA, 24 nt, Homo sapiens
gugccggagcagcucgugcagcua

SEQ ID NO: 29421 - RNA, 18 nt, Homo sapiens
gagcacacaguugcagcu

SEQ ID NO: 29422 - RNA, 20 nt, Homo sapiens
uucucauugcugagcacaca

SEQ ID NO: 29423 - RNA, 19 nt, Homo sapiens
acaggguguggacucaacu

SEQ ID NO: 29424 - RNA, 19 nt, Homo sapiens
ccccaccacccggugcugc

SEQ ID NO: 29425 - RNA, 25 nt, Homo sapiens
ccuccccagccagcuccugucugua

SEQ ID NO: 29426 - RNA, 20 nt, Homo sapiens
ccucugccucccggguucaa

SEQ ID NO: 29427 - RNA, 22 nt, Homo sapiens
ccugcccuccccagccagcucc

SEQ ID NO: 29428 - RNA, 19 nt, Homo sapiens
gagucacagaauggagcua

SEQ ID NO: 29429 - RNA, 18 nt, Homo sapiens
gcucaacauccugcaaug

SEQ ID NO: 29430 - RNA, 19 nt, Homo sapiens
guucaaaggacacacccua

SEQ ID NO: 29431 - RNA, 17 nt, Homo sapiens
ucaagugauucuccugc

SEQ ID NO: 29432 - RNA, 21 nt, Homo sapiens
ugacagcuacgagccagccca

SEQ ID NO: 29433 - RNA, 21 nt, Homo sapiens
acccucgcucucacacccccu

SEQ ID NO: 29434 - RNA, 22 nt, Homo sapiens
cuuaagaccccuccucuacuuc

SEQ ID NO: 29435 - RNA, 24 nt, Homo sapiens
ucccaggcuuacucucccaauaaa

SEQ ID NO: 29436 - RNA, 18 nt, Homo sapiens
aaaaacaaaacaaacaaa

SEQ ID NO: 29437 - RNA, 22 nt, Homo sapiens
gagccaagaucgugccacugca

SEQ ID NO: 29438 - RNA, 21 nt, Homo sapiens
ugcagugagccaagaucgugc

SEQ ID NO: 29439 - RNA, 19 nt, Homo sapiens
ugggaggacaggcauaugc

SEQ ID NO: 29440 - RNA, 17 nt, Homo sapiens
uuucucugugcaacuag

SEQ ID NO: 29441 - RNA, 23 nt, Homo sapiens
acacucaaggccgcugcccgcca

SEQ ID NO: 29442 - RNA, 16 nt, Homo sapiens
uacugacgcgagcagc

SEQ ID NO: 29443 - RNA, 21 nt, Homo sapiens
guguguaucuucaucuggcug

SEQ ID NO: 29444 - RNA, 24 nt, Homo sapiens
uggggacagaagcuccagcauuug

SEQ ID NO: 29445 - RNA, 24 nt, Homo sapiens
uuagggaacaagaggcaucacuca

SEQ ID NO: 29446 - RNA, 19 nt, Homo sapiens
aacugaagucuuuuacauc

SEQ ID NO: 29447 - RNA, 17 nt, Homo sapiens
auccugaagaauguuga

SEQ ID NO: 29448 - RNA, 22 nt, Homo sapiens
cucucucucucuuuuuuuucuc

SEQ ID NO: 29449 - RNA, 19 nt, Homo sapiens
ccagcaagccucuaucuug

SEQ ID NO: 29450 - RNA, 18 nt, Homo sapiens
gaucccagcauaaaguua

SEQ ID NO: 29451 - RNA, 20 nt, Homo sapiens
gugcuggcugggaguucugg

SEQ ID NO: 29452 - RNA, 21 nt, Homo sapiens
uuaguugcuauucaaauuaau

SEQ ID NO: 29453 - RNA, 21 nt, Homo sapiens
accacaaaaaauaaucugaga

SEQ ID NO: 29454 - RNA, 18 nt, Homo sapiens
cuccucggauaaugugaa

SEQ ID NO: 29455 - RNA, 21 nt, Homo sapiens
uuuggaaugaugaaagcaugu

SEQ ID NO: 29456 - RNA, 20 nt, Homo sapiens
ccuguggccgccacuuuuga

SEQ ID NO: 29457 - RNA, 24 nt, Homo sapiens
gccgcuucugcaaggucucaggga

SEQ ID NO: 29458 - RNA, 17 nt, Homo sapiens
uccaagaaaguuuccuu

SEQ ID NO: 29459 - RNA, 19 nt, Homo sapiens
ucucagggacgggcugcag

SEQ ID NO: 29460 - RNA, 23 nt, Homo sapiens
uuuugaugaucagaggucuugag

SEQ ID NO: 29461 - RNA, 22 nt, Homo sapiens
caacagaccaacagauaacuca

SEQ ID NO: 29462 - RNA, 17 nt, Homo sapiens
cccacccucccugcacu

SEQ ID NO: 29463 - RNA, 20 nt, Homo sapiens
ucaccugcccagccauggca

SEQ ID NO: 29464 - RNA, 24 nt, Homo sapiens
agaccuagguugagcagagcucca

SEQ ID NO: 29465 - RNA, 21 nt, Homo sapiens
uuacuucagucgccucugcgc

SEQ ID NO: 29466 - RNA, 19 nt, Homo sapiens
acaacccccaaaguccacg

SEQ ID NO: 29467 - RNA, 25 nt, Homo sapiens
ccaccagguccugccuuuugcggug

SEQ ID NO: 29468 - RNA, 18 nt, Homo sapiens
cccagaugcugauacaca

SEQ ID NO: 29469 - RNA, 21 nt, Homo sapiens
ccucaacacacauccaucuca

SEQ ID NO: 29470 - RNA, 21 nt, Homo sapiens
gauauagauaccauagucaag

SEQ ID NO: 29471 - RNA, 17 nt, Homo sapiens
agcgcgcucuuaccuca

SEQ ID NO: 29472 - RNA, 22 nt, Homo sapiens
gugaaaaucaggagguguaaua

SEQ ID NO: 29473 - RNA, 21 nt, Homo sapiens
auuuaggaaugccuucgauga

SEQ ID NO: 29474 - RNA, 17 nt, Homo sapiens
gacucaagggcuguaga

SEQ ID NO: 29475 - RNA, 18 nt, Homo sapiens
uaggcaaaacaccaaugc

SEQ ID NO: 29476 - RNA, 17 nt, Homo sapiens
ugaugguuaauaugaaa

SEQ ID NO: 29477 - RNA, 19 nt, Homo sapiens
aaugugaccaccgucagcc

SEQ ID NO: 29478 - RNA, 19 nt, Homo sapiens
ccgcugccugugcccccca

SEQ ID NO: 29479 - RNA, 19 nt, Homo sapiens
cacccgagcuacaaucucu

SEQ ID NO: 29480 - RNA, 20 nt, Homo sapiens
ggaggaggagacugaggagc

SEQ ID NO: 29481 - RNA, 19 nt, Homo sapiens
cacccucucccucugugcc

SEQ ID NO: 29482 - RNA, 19 nt, Homo sapiens
ggcuucugucuguaucuca

SEQ ID NO: 29483 - RNA, 18 nt, Homo sapiens
gugggaacccuccuauca

SEQ ID NO: 29484 - RNA, 19 nt, Homo sapiens
aacaugggcaaaguaauca

SEQ ID NO: 29485 - RNA, 21 nt, Homo sapiens
caaacuuccccgccuccacgu

SEQ ID NO: 29486 - RNA, 19 nt, Homo sapiens
uggccuacucaacaugaag

SEQ ID NO: 29487 - RNA, 22 nt, Homo sapiens
ccuucugaccaaccucucccca

SEQ ID NO: 29488 - RNA, 21 nt, Homo sapiens
gaacacuagaaagcgcuguga

SEQ ID NO: 29489 - RNA, 22 nt, Homo sapiens
gagggccgagggagaagauucc

SEQ ID NO: 29490 - RNA, 22 nt, Homo sapiens
gcaccccuuguguuuucccucu

SEQ ID NO: 29491 - RNA, 20 nt, Homo sapiens
ugugggaagggcguguuuuu

SEQ ID NO: 29492 - RNA, 24 nt, Homo sapiens
gcacagccagagacagagccccuc

SEQ ID NO: 29493 - RNA, 19 nt, Homo sapiens
uggagaagcacagccagag

SEQ ID NO: 29494 - RNA, 22 nt, Homo sapiens
uucugucucuggagacccuuga

SEQ ID NO: 29495 - RNA, 22 nt, Homo sapiens
aggagagagaagaaacaggcca

SEQ ID NO: 29496 - RNA, 17 nt, Homo sapiens
gccaccuucuguggagu

SEQ ID NO: 29497 - RNA, 20 nt, Homo sapiens
agucugguuacauuaagaaa

SEQ ID NO: 29498 - RNA, 18 nt, Homo sapiens
cccauucugaccccugac

SEQ ID NO: 29499 - RNA, 19 nt, Homo sapiens
cucccccauuucuggcucu

SEQ ID NO: 29500 - RNA, 23 nt, Homo sapiens
uaagggacucgccuagggucuca

SEQ ID NO: 29501 - RNA, 18 nt, Homo sapiens
aauguaaagaauaugaca

SEQ ID NO: 29502 - RNA, 18 nt, Homo sapiens
acacuacccaacuuuaaa

SEQ ID NO: 29503 - RNA, 20 nt, Homo sapiens
accuaaaaguauuaaauucc

SEQ ID NO: 29504 - RNA, 18 nt, Homo sapiens
ccaaaggcuccuagaucu

SEQ ID NO: 29505 - RNA, 18 nt, Homo sapiens
cucaaagacauaaaagca

SEQ ID NO: 29506 - RNA, 23 nt, Homo sapiens
gaagaaaacccaggaaaugccau

SEQ ID NO: 29507 - RNA, 18 nt, Homo sapiens
gcuauuugcagacuacag

SEQ ID NO: 29508 - RNA, 18 nt, Homo sapiens
uuuucccaucccucccca

SEQ ID NO: 29509 - RNA, 22 nt, Homo sapiens
accuaucagcccuugaaauucu

SEQ ID NO: 29510 - RNA, 21 nt, Homo sapiens
acggucccuaccuagacccca

SEQ ID NO: 29511 - RNA, 19 nt, Homo sapiens
uccagguggggacuguucc

SEQ ID NO: 29512 - RNA, 19 nt, Homo sapiens
aggaaaugccccccauccu

SEQ ID NO: 29513 - RNA, 20 nt, Homo sapiens
caagucccugcagcuggcca

SEQ ID NO: 29514 - RNA, 19 nt, Homo sapiens
cacggcaaccuccaccucc

SEQ ID NO: 29515 - RNA, 23 nt, Homo sapiens
ccacccuugcacccccagccucc

SEQ ID NO: 29516 - RNA, 19 nt, Homo sapiens
cgcccccgcccgcugcuga

SEQ ID NO: 29517 - RNA, 16 nt, Homo sapiens
cuugggcuccuaccuc

SEQ ID NO: 29518 - RNA, 18 nt, Homo sapiens
gccucuccccagcuucuu

SEQ ID NO: 29519 - RNA, 18 nt, Homo sapiens
uccaccucccggguucaa

SEQ ID NO: 29520 - RNA, 20 nt, Homo sapiens
uucugucuuucccuuccacc

SEQ ID NO: 29521 - RNA, 18 nt, Homo sapiens
ugucagugggagccucca

SEQ ID NO: 29522 - RNA, 19 nt, Homo sapiens
aaaaaugaacaaagaaaug

SEQ ID NO: 29523 - RNA, 22 nt, Homo sapiens
gccuaauaaaauaaaugguuga

SEQ ID NO: 29524 - RNA, 17 nt, Homo sapiens
uaccccuaugacugccu

SEQ ID NO: 29525 - RNA, 18 nt, Homo sapiens
uggguggaucaccugagg

SEQ ID NO: 29526 - RNA, 18 nt, Homo sapiens
uucccucauugaaagaug

SEQ ID NO: 29527 - RNA, 19 nt, Homo sapiens
cuucguccccuccgccucu

SEQ ID NO: 29528 - RNA, 17 nt, Homo sapiens
gcgaccguucugccucc

SEQ ID NO: 29529 - RNA, 21 nt, Homo sapiens
accuggacucacagccuggcu

SEQ ID NO: 29530 - RNA, 17 nt, Homo sapiens
ucaagcgauucucaugc

SEQ ID NO: 29531 - RNA, 18 nt, Homo sapiens
uguagcaugacugccucu

SEQ ID NO: 29532 - RNA, 21 nt, Homo sapiens
aucccaagccugauaaaucua

SEQ ID NO: 29533 - RNA, 20 nt, Homo sapiens
ccagagccugcagaaggcua

SEQ ID NO: 29534 - RNA, 19 nt, Homo sapiens
gaaucaacaguugaaacug

SEQ ID NO: 29535 - RNA, 25 nt, Homo sapiens
gucacgaccagaagcauuuaccaca

SEQ ID NO: 29536 - RNA, 17 nt, Homo sapiens
auccuagcacgugggga

SEQ ID NO: 29537 - RNA, 22 nt, Homo sapiens
guguccggaauugguggguucu

SEQ ID NO: 29538 - RNA, 21 nt, Homo sapiens
aagugaaauauacagccuuaa

SEQ ID NO: 29539 - RNA, 20 nt, Homo sapiens
ugggauccaggcgcccgguu

SEQ ID NO: 29540 - RNA, 19 nt, Homo sapiens
uuuccaucaagugaaauau

SEQ ID NO: 29541 - RNA, 20 nt, Homo sapiens
aggaucucagcacucugacc

SEQ ID NO: 29542 - RNA, 23 nt, Homo sapiens
cucuaaaugggauuuaacccaca

SEQ ID NO: 29543 - RNA, 18 nt, Homo sapiens
gaaaauuucacagagcua

SEQ ID NO: 29544 - RNA, 19 nt, Homo sapiens
gcagcuuuagaauagcuuc

SEQ ID NO: 29545 - RNA, 24 nt, Homo sapiens
ucacugaggccauaucuuuuuaca

SEQ ID NO: 29546 - RNA, 17 nt, Homo sapiens
aaauggaacaacuucac

SEQ ID NO: 29547 - RNA, 22 nt, Homo sapiens
aucuuggcucacugcagccucu

SEQ ID NO: 29548 - RNA, 20 nt, Homo sapiens
auuuccuuggaaacucccuu

SEQ ID NO: 29549 - RNA, 20 nt, Homo sapiens
ccucugccuccuggguucaa

SEQ ID NO: 29550 - RNA, 18 nt, Homo sapiens
ccugcuuucauccccuga

SEQ ID NO: 29551 - RNA, 18 nt, Homo sapiens
ucugaugaacacuuugga

SEQ ID NO: 29552 - RNA, 20 nt, Homo sapiens
ucugcugauguuuuauagag

SEQ ID NO: 29553 - RNA, 19 nt, Homo sapiens
uuccaaggaucuaauccag

SEQ ID NO: 29554 - RNA, 21 nt, Homo sapiens
aaaacaaaaacccaaccaaac

SEQ ID NO: 29555 - RNA, 22 nt, Homo sapiens
aacugacaaauuaaggagguua

SEQ ID NO: 29556 - RNA, 21 nt, Homo sapiens
gaaccaugaaaaccucuguga

SEQ ID NO: 29557 - RNA, 21 nt, Homo sapiens
aaguugacuuuuaguuccuaa

SEQ ID NO: 29558 - RNA, 18 nt, Homo sapiens
aaggcuugauguguauaa

SEQ ID NO: 29559 - RNA, 17 nt, Homo sapiens
uccaagaaagauucuga

SEQ ID NO: 29560 - RNA, 25 nt, Homo sapiens
gaggacauaugauaaugauaccaaa

SEQ ID NO: 29561 - RNA, 18 nt, Homo sapiens
caacccuccggacucucc

SEQ ID NO: 29562 - RNA, 21 nt, Homo sapiens
ccuucccuucaucccuuccca

SEQ ID NO: 29563 - RNA, 18 nt, Homo sapiens
ggccgggugcaguggcuc

SEQ ID NO: 29564 - RNA, 19 nt, Homo sapiens
ggccugagcauccauccua

SEQ ID NO: 29565 - RNA, 18 nt, Homo sapiens
gggauccccuagcugucc

SEQ ID NO: 29566 - RNA, 19 nt, Homo sapiens
uguuccaggcacuguccua

SEQ ID NO: 29567 - RNA, 18 nt, Homo sapiens
guucuucuccucgggugu

SEQ ID NO: 29568 - RNA, 18 nt, Homo sapiens
aagugugguguuugguuu

SEQ ID NO: 29569 - RNA, 20 nt, Homo sapiens
auucauuaccuuacagugua

SEQ ID NO: 29570 - RNA, 19 nt, Homo sapiens
ccuuuaauaauggagcauc

SEQ ID NO: 29571 - RNA, 18 nt, Homo sapiens
gccucggccacuugguuc

SEQ ID NO: 29572 - RNA, 17 nt, Homo sapiens
ggaucaucgccuguucu

SEQ ID NO: 29573 - RNA, 24 nt, Homo sapiens
guugaaucaugugauucuagauua

SEQ ID NO: 29574 - RNA, 23 nt, Homo sapiens
uaaaaaccuagucaaacaaggaa

SEQ ID NO: 29575 - RNA, 19 nt, Homo sapiens
ucugaaaacuagaugcacc

SEQ ID NO: 29576 - RNA, 17 nt, Homo sapiens
ucuggacagaccacaac

SEQ ID NO: 29577 - RNA, 20 nt, Homo sapiens
uuacugucaugucauuuacc

SEQ ID NO: 29578 - RNA, 21 nt, Homo sapiens
uugaugagugauugccugucc

SEQ ID NO: 29579 - RNA, 17 nt, Homo sapiens
agccaguggaaauugcc

SEQ ID NO: 29580 - RNA, 19 nt, Homo sapiens
uucucuacugaaaauacaa

SEQ ID NO: 29581 - RNA, 24 nt, Homo sapiens
auugguguuuacacccucuuguca

SEQ ID NO: 29582 - RNA, 17 nt, Homo sapiens
cuagccguguccacgca

SEQ ID NO: 29583 - RNA, 26 nt, Homo sapiens
ucucuuuuaccccugaucuuggcuuu

SEQ ID NO: 29584 - RNA, 21 nt, Homo sapiens
guguagcauuguucuugauua

SEQ ID NO: 29585 - RNA, 18 nt, Homo sapiens
ggaugggcuggguuuagu

SEQ ID NO: 29586 - RNA, 20 nt, Homo sapiens
gcugaagaagaauuuugccu

SEQ ID NO: 29587 - RNA, 16 nt, Homo sapiens
cugucuuuccuucuga

SEQ ID NO: 29588 - RNA, 25 nt, Homo sapiens
aaccuaauuucaaucuuacuguaaa

SEQ ID NO: 29589 - RNA, 19 nt, Homo sapiens
cccauggagugcucuccca

SEQ ID NO: 29590 - RNA, 22 nt, Homo sapiens
gagccaagaucccgccacugca

SEQ ID NO: 29591 - RNA, 19 nt, Homo sapiens
ggaauaauguuccaucaug

SEQ ID NO: 29592 - RNA, 20 nt, Homo sapiens
ccaaaagaugaugaugugau

SEQ ID NO: 29593 - RNA, 20 nt, Homo sapiens
uugggccagaagguagggua

SEQ ID NO: 29594 - RNA, 17 nt, Homo sapiens
acaggcagugaggauga

SEQ ID NO: 29595 - RNA, 20 nt, Homo sapiens
agaccacaccugccacgguc

SEQ ID NO: 29596 - RNA, 23 nt, Homo sapiens
gacagaggaccaccuccccauac

SEQ ID NO: 29597 - RNA, 21 nt, Homo sapiens
gcagaggcccagagccccugc

SEQ ID NO: 29598 - RNA, 21 nt, Homo sapiens
gccccagugacggucuggucu

SEQ ID NO: 29599 - RNA, 20 nt, Homo sapiens
gauauugauuauacaccuuu

SEQ ID NO: 29600 - RNA, 19 nt, Homo sapiens
ucuuaauaucagcaaggug

SEQ ID NO: 29601 - RNA, 18 nt, Homo sapiens
uuuaggugauucuaauuc

SEQ ID NO: 29602 - RNA, 18 nt, Homo sapiens
caauaacaugucugcucc

SEQ ID NO: 29603 - RNA, 16 nt, Homo sapiens
gaaauaguuaauuugu

SEQ ID NO: 29604 - RNA, 18 nt, Homo sapiens
acacuuaauaauagcuca

SEQ ID NO: 29605 - RNA, 17 nt, Homo sapiens
cauuugacuuuaaguaa

SEQ ID NO: 29606 - RNA, 22 nt, Homo sapiens
ccuaauguguaggguuguuaua

SEQ ID NO: 29607 - RNA, 22 nt, Homo sapiens
uccugaagaaauagauauagcu

SEQ ID NO: 29608 - RNA, 21 nt, Homo sapiens
caaccccuccccugccuccac

SEQ ID NO: 29609 - RNA, 20 nt, Homo sapiens
ugaagaggcacuuucgagua

SEQ ID NO: 29610 - RNA, 23 nt, Homo sapiens
uuguuaguuuaucuuggcacuga

SEQ ID NO: 29611 - RNA, 21 nt, Homo sapiens
acugcaagcgcugaguccuuc

SEQ ID NO: 29612 - RNA, 23 nt, Homo sapiens
agcaauuuuuuaaagggcagaua

SEQ ID NO: 29613 - RNA, 24 nt, Homo sapiens
auuugaguccagccaucuugguuc

SEQ ID NO: 29614 - RNA, 19 nt, Homo sapiens
gcagggagggaacuugcca

SEQ ID NO: 29615 - RNA, 20 nt, Homo sapiens
ggacgaggcaucucaggugg

SEQ ID NO: 29616 - RNA, 19 nt, Homo sapiens
ggaucucagaacagucuuu

SEQ ID NO: 29617 - RNA, 19 nt, Homo sapiens
gggcaaggggcuuucagug

SEQ ID NO: 29618 - RNA, 19 nt, Homo sapiens
gugagucuaaauauauuca

SEQ ID NO: 29619 - RNA, 23 nt, Homo sapiens
ucuuugucagaugggacacuuca

SEQ ID NO: 29620 - RNA, 18 nt, Homo sapiens
ugcucccagagucacuca

SEQ ID NO: 29621 - RNA, 18 nt, Homo sapiens
cuagccaccucugccucu

SEQ ID NO: 29622 - RNA, 20 nt, Homo sapiens
gccuagccaccucugccucu

SEQ ID NO: 29623 - RNA, 20 nt, Homo sapiens
aaaaacaaggagcuuuagcu

SEQ ID NO: 29624 - RNA, 22 nt, Homo sapiens
aacuuugggagcuucaggauca

SEQ ID NO: 29625 - RNA, 23 nt, Homo sapiens
acuaagaguucaccuguccuuca

SEQ ID NO: 29626 - RNA, 21 nt, Homo sapiens
gccugggcccguuccuggucu

SEQ ID NO: 29627 - RNA, 18 nt, Homo sapiens
uccgcauccuagguucaa

SEQ ID NO: 29628 - RNA, 21 nt, Homo sapiens
gccagcgguuuggcaccguac

SEQ ID NO: 29629 - RNA, 17 nt, Homo sapiens
cccuuuuuccuauaccu

SEQ ID NO: 29630 - RNA, 15 nt, Homo sapiens
ccuguucuugcaaca

SEQ ID NO: 29631 - RNA, 19 nt, Homo sapiens
ucacaucccagaagaaacu

SEQ ID NO: 29632 - RNA, 20 nt, Homo sapiens
ucaccugugauuuauccaca

SEQ ID NO: 29633 - RNA, 16 nt, Homo sapiens
uccugugauauuguga

SEQ ID NO: 29634 - RNA, 23 nt, Homo sapiens
uggguagcuucaggauggggcug

SEQ ID NO: 29635 - RNA, 18 nt, Homo sapiens
ugucaacuaaagcauugg

SEQ ID NO: 29636 - RNA, 23 nt, Homo sapiens
uucaaaaaauauaccauuggaga

SEQ ID NO: 29637 - RNA, 16 nt, Homo sapiens
accaccaaccagguca

SEQ ID NO: 29638 - RNA, 18 nt, Homo sapiens
gaaaagugaagcccacug

SEQ ID NO: 29639 - RNA, 18 nt, Homo sapiens
uaggauuuuauuuguacu

SEQ ID NO: 29640 - RNA, 21 nt, Homo sapiens
uuucacuucuccuggcucacu

SEQ ID NO: 29641 - RNA, 24 nt, Homo sapiens
uccugacuuucgguggcuugugga

SEQ ID NO: 29642 - RNA, 22 nt, Homo sapiens
acaccaucggggaccgaggacc

SEQ ID NO: 29643 - RNA, 19 nt, Homo sapiens
cuuccccaucuucuccucu

SEQ ID NO: 29644 - RNA, 26 nt, Homo sapiens
ggccccacuccacgacaaccacuucc

SEQ ID NO: 29645 - RNA, 23 nt, Homo sapiens
gggccccugcgcccgggcuggca

SEQ ID NO: 29646 - RNA, 21 nt, Homo sapiens
ucccucagauccaggcccuca

SEQ ID NO: 29647 - RNA, 20 nt, Homo sapiens
cagugaaaaaugugauucca

SEQ ID NO: 29648 - RNA, 17 nt, Homo sapiens
cuguggaaugcuauuga

SEQ ID NO: 29649 - RNA, 23 nt, Homo sapiens
ugaaugaaccagcuauggaauug

SEQ ID NO: 29650 - RNA, 18 nt, Homo sapiens
uuuguuacagcagcacug

SEQ ID NO: 29651 - RNA, 19 nt, Homo sapiens
aagcgauucucccaccuca

SEQ ID NO: 29652 - RNA, 21 nt, Homo sapiens
gguaagaguuuguagacucuu

SEQ ID NO: 29653 - RNA, 21 nt, Homo sapiens
aacuaaaguauaaucaaagua

SEQ ID NO: 29654 - RNA, 21 nt, Homo sapiens
acuggaaauucuuuuacuuca

SEQ ID NO: 29655 - RNA, 19 nt, Homo sapiens
auguauuuguugaguuuug

SEQ ID NO: 29656 - RNA, 18 nt, Homo sapiens
gaagaaccagaccuggac

SEQ ID NO: 29657 - RNA, 23 nt, Homo sapiens
ggggcgcuaguaaacugaugaua

SEQ ID NO: 29658 - RNA, 22 nt, Homo sapiens
uacuggaaauucuuuuacuuca

SEQ ID NO: 29659 - RNA, 18 nt, Homo sapiens
ucuucucuaugcacucuu

SEQ ID NO: 29660 - RNA, 19 nt, Homo sapiens
aagcaauucuccuaccuca

SEQ ID NO: 29661 - RNA, 20 nt, Homo sapiens
gaaauuaauaagauacuaaa

SEQ ID NO: 29662 - RNA, 21 nt, Homo sapiens
gaaaaccgccccuggacguuu

SEQ ID NO: 29663 - RNA, 21 nt, Homo sapiens
uugccguugaaaaauacagug

SEQ ID NO: 29664 - RNA, 23 nt, Homo sapiens
ccaccaccgcccagcucagcuca

SEQ ID NO: 29665 - RNA, 21 nt, Homo sapiens
ccucaucacacccuuaccucc

SEQ ID NO: 29666 - RNA, 21 nt, Homo sapiens
gaaaaucugaccuggcauuuu

SEQ ID NO: 29667 - RNA, 18 nt, Homo sapiens
gaggagccugggauccca

SEQ ID NO: 29668 - RNA, 18 nt, Homo sapiens
guccacauccugagccca

SEQ ID NO: 29669 - RNA, 18 nt, Homo sapiens
guuaacuucauacacaca

SEQ ID NO: 29670 - RNA, 17 nt, Homo sapiens
ucugcuuugaccaugug

SEQ ID NO: 29671 - RNA, 18 nt, Homo sapiens
uuaccucccacccccuca

SEQ ID NO: 29672 - RNA, 18 nt, Homo sapiens
caaccccuccucuucccu

SEQ ID NO: 29673 - RNA, 16 nt, Homo sapiens
cccggaaggcaauggg

SEQ ID NO: 29674 - RNA, 17 nt, Homo sapiens
gauggggucuugccaua

SEQ ID NO: 29675 - RNA, 18 nt, Homo sapiens
gcuccuguguuuuguuuu

SEQ ID NO: 29676 - RNA, 24 nt, Homo sapiens
cucgguaucaccuuugaggaaaaa

SEQ ID NO: 29677 - RNA, 21 nt, Homo sapiens
gcucuaaguuucacuuuucca

SEQ ID NO: 29678 - RNA, 19 nt, Homo sapiens
ugugggguguauuucugga

SEQ ID NO: 29679 - RNA, 17 nt, Homo sapiens
ugaaucaaaguuauuca

SEQ ID NO: 29680 - RNA, 21 nt, Homo sapiens
uuuuuuggcaaucaguuugua

SEQ ID NO: 29681 - RNA, 16 nt, Homo sapiens
aauaucugcuccuucc

SEQ ID NO: 29682 - RNA, 23 nt, Homo sapiens
gcuugaagccacaaauaaaacuc

SEQ ID NO: 29683 - RNA, 22 nt, Homo sapiens
uucuuugucccacuguaguuug

SEQ ID NO: 29684 - RNA, 22 nt, Homo sapiens
caggcccuccagcugcuggcca

SEQ ID NO: 29685 - RNA, 19 nt, Homo sapiens
cugccugcugacccaccug

SEQ ID NO: 29686 - RNA, 19 nt, Homo sapiens
gcaacaaggaaacuauccu

SEQ ID NO: 29687 - RNA, 21 nt, Homo sapiens
gccuggguuggcuuccugccc

SEQ ID NO: 29688 - RNA, 23 nt, Homo sapiens
cugaugagcccucucauuccucc

SEQ ID NO: 29689 - RNA, 22 nt, Homo sapiens
ggccugcuccucggcggagcgg

SEQ ID NO: 29690 - RNA, 22 nt, Homo sapiens
uucacaaagugcccccuccaug

SEQ ID NO: 29691 - RNA, 19 nt, Homo sapiens
uuggggauuugcuugggcu

SEQ ID NO: 29692 - RNA, 22 nt, Homo sapiens
gccugggcuccugccauggccc

SEQ ID NO: 29693 - RNA, 20 nt, Homo sapiens
cgaggucggcgggggucugg

SEQ ID NO: 29694 - RNA, 20 nt, Homo sapiens
gggcagguagggacucugcc

SEQ ID NO: 29695 - RNA, 21 nt, Homo sapiens
uccuccugccucagcuacuca

SEQ ID NO: 29696 - RNA, 20 nt, Homo sapiens
ugggcuuccaacggagacug

SEQ ID NO: 29697 - RNA, 19 nt, Homo sapiens
aaauauaaagguguuugcu

SEQ ID NO: 29698 - RNA, 18 nt, Homo sapiens
accaaaacaaaauuugag

SEQ ID NO: 29699 - RNA, 24 nt, Homo sapiens
agcaagauuggaaaaucaagaagg

SEQ ID NO: 29700 - RNA, 20 nt, Homo sapiens
gaaaaucaagaaggcauuga

SEQ ID NO: 29701 - RNA, 19 nt, Homo sapiens
uacuugcucagugcugucu

SEQ ID NO: 29702 - RNA, 20 nt, Homo sapiens
uuauuaguguuucauugaua

SEQ ID NO: 29703 - RNA, 18 nt, Homo sapiens
gagguccccaagaucucc

SEQ ID NO: 29704 - RNA, 23 nt, Homo sapiens
uggguggcaggcugggccuagca

SEQ ID NO: 29705 - RNA, 24 nt, Homo sapiens
gcugguuugagggccaccacugca

SEQ ID NO: 29706 - RNA, 23 nt, Homo sapiens
ugagaggagagaaauacacgucu

SEQ ID NO: 29707 - RNA, 18 nt, Homo sapiens
ccgcaggggcucuuggga

SEQ ID NO: 29708 - RNA, 19 nt, Homo sapiens
cacaguaaaagaauuccuu

SEQ ID NO: 29709 - RNA, 16 nt, Homo sapiens
ccucacccaggaguca

SEQ ID NO: 29710 - RNA, 22 nt, Homo sapiens
cuggcuuacaauaaaugcccaa

SEQ ID NO: 29711 - RNA, 24 nt, Homo sapiens
cuucucugugaaacacucuaccuu

SEQ ID NO: 29712 - RNA, 23 nt, Homo sapiens
guuucugcugacuugccuggcuu

SEQ ID NO: 29713 - RNA, 19 nt, Homo sapiens
agaggggaugaguugugug

SEQ ID NO: 29714 - RNA, 19 nt, Homo sapiens
gccgccgccgcugcuccuc

SEQ ID NO: 29715 - RNA, 22 nt, Homo sapiens
gccuggccugggccgucugccc

SEQ ID NO: 29716 - RNA, 21 nt, Homo sapiens
gcccagguggccuccuggccc

SEQ ID NO: 29717 - RNA, 19 nt, Homo sapiens
gugagugagugugugugug

SEQ ID NO: 29718 - RNA, 23 nt, Homo sapiens
gugugugugggggggacucggcu

SEQ ID NO: 29719 - RNA, 19 nt, Homo sapiens
gugagugagugugugugug

SEQ ID NO: 29720 - RNA, 23 nt, Homo sapiens
gugugugugggggggacucggcu

SEQ ID NO: 29721 - RNA, 21 nt, Homo sapiens
ccgcggauagcacuggcgacc

SEQ ID NO: 29722 - RNA, 19 nt, Homo sapiens
gugagugagugugugugug

SEQ ID NO: 29723 - RNA, 23 nt, Homo sapiens
gugugugugggggggacucggcu

SEQ ID NO: 29724 - RNA, 18 nt, Homo sapiens
aaugaccacaaauguagc

SEQ ID NO: 29725 - RNA, 22 nt, Homo sapiens
agcauguuuguuuuccucugug

SEQ ID NO: 29726 - RNA, 17 nt, Homo sapiens
aggauggggagcuggca

SEQ ID NO: 29727 - RNA, 19 nt, Homo sapiens
ccccacugacccccgcugc

SEQ ID NO: 29728 - RNA, 18 nt, Homo sapiens
cccccaaaacuugggcug

SEQ ID NO: 29729 - RNA, 22 nt, Homo sapiens
gcaccucucuccucugucuuca

SEQ ID NO: 29730 - RNA, 21 nt, Homo sapiens
gccuguccuggcugcuggccc

SEQ ID NO: 29731 - RNA, 24 nt, Homo sapiens
gcuuuucuuccuccccugcucucu

SEQ ID NO: 29732 - RNA, 19 nt, Homo sapiens
ucaugugguuguugcagca

SEQ ID NO: 29733 - RNA, 21 nt, Homo sapiens
auagauggguuacaaauacau

SEQ ID NO: 29734 - RNA, 22 nt, Homo sapiens
caggauuguggacauuugguua

SEQ ID NO: 29735 - RNA, 24 nt, Homo sapiens
guguuuugguuaaucacaaauuuu

SEQ ID NO: 29736 - RNA, 21 nt, Homo sapiens
agaaaggacauggccuucccc

SEQ ID NO: 29737 - RNA, 18 nt, Homo sapiens
gccuaccaagacacuacu

SEQ ID NO: 29738 - RNA, 18 nt, Homo sapiens
acagcccagcgaggguga

SEQ ID NO: 29739 - RNA, 18 nt, Homo sapiens
aggccgaguggacucuca

SEQ ID NO: 29740 - RNA, 20 nt, Homo sapiens
cccugugcccggcccaccuu

SEQ ID NO: 29741 - RNA, 21 nt, Homo sapiens
cucccgaaggccucaccucug

SEQ ID NO: 29742 - RNA, 20 nt, Homo sapiens
gcacggagcauguggcuggg

SEQ ID NO: 29743 - RNA, 21 nt, Homo sapiens
aucuuggcucacugcaaccuc

SEQ ID NO: 29744 - RNA, 18 nt, Homo sapiens
ccugcaaccuccaccucc

SEQ ID NO: 29745 - RNA, 23 nt, Homo sapiens
uaaucaagggagaaacccauuac

SEQ ID NO: 29746 - RNA, 21 nt, Homo sapiens
uaguccagcucugugaucuga

SEQ ID NO: 29747 - RNA, 20 nt, Homo sapiens
acuuuucuuuucccccugua

SEQ ID NO: 29748 - RNA, 21 nt, Homo sapiens
cuccuucucucucucucucuc

SEQ ID NO: 29749 - RNA, 19 nt, Homo sapiens
accaaagcgcccacuggca

SEQ ID NO: 29750 - RNA, 22 nt, Homo sapiens
accguuuacucugcaaaacuga

SEQ ID NO: 29751 - RNA, 23 nt, Homo sapiens
gcccuggcccccaccccuaagga

SEQ ID NO: 29752 - RNA, 19 nt, Homo sapiens
ucaccguuuacucugcaaa

SEQ ID NO: 29753 - RNA, 19 nt, Homo sapiens
ugcaucuugccaggcuccu

SEQ ID NO: 29754 - RNA, 20 nt, Homo sapiens
gccucugucugugaaaguca

SEQ ID NO: 29755 - RNA, 18 nt, Homo sapiens
ucugggucugccugacuc

SEQ ID NO: 29756 - RNA, 16 nt, Homo sapiens
gagccacggaaucuca

SEQ ID NO: 29757 - RNA, 18 nt, Homo sapiens
accacauauuuccaucug

SEQ ID NO: 29758 - RNA, 18 nt, Homo sapiens
agcaauucuccugccuca

SEQ ID NO: 29759 - RNA, 20 nt, Homo sapiens
uuugggcaguucuggaaacu

SEQ ID NO: 29760 - RNA, 19 nt, Homo sapiens
cacaguaaccuuuauccaa

SEQ ID NO: 29761 - RNA, 20 nt, Homo sapiens
aacacaugcgcgcgcacaca

SEQ ID NO: 29762 - RNA, 17 nt, Homo sapiens
cuugaagagcaacauca

SEQ ID NO: 29763 - RNA, 22 nt, Homo sapiens
cuuuggggaaggugauuugugg

SEQ ID NO: 29764 - RNA, 20 nt, Homo sapiens
ggagacggcagcggcauggc

SEQ ID NO: 29765 - RNA, 23 nt, Homo sapiens
uucuuuggggaaggugauuugug

SEQ ID NO: 29766 - RNA, 18 nt, Homo sapiens
ccguggaggaccacccug

SEQ ID NO: 29767 - RNA, 19 nt, Homo sapiens
accaagcccucugcucuga

SEQ ID NO: 29768 - RNA, 18 nt, Homo sapiens
ccugccacugccacagua

SEQ ID NO: 29769 - RNA, 18 nt, Homo sapiens
gaacagggacuugaacca

SEQ ID NO: 29770 - RNA, 19 nt, Homo sapiens
guguguuugucacuugguu

SEQ ID NO: 29771 - RNA, 17 nt, Homo sapiens
uaggagcaaagucucuc

SEQ ID NO: 29772 - RNA, 22 nt, Homo sapiens
gauacugacaccaaaugccuuu

SEQ ID NO: 29773 - RNA, 19 nt, Homo sapiens
cagaagaaaaauaaagcuu

SEQ ID NO: 29774 - RNA, 19 nt, Homo sapiens
uaggaaauagaauuuauga

SEQ ID NO: 29775 - RNA, 18 nt, Homo sapiens
uuaccaaauauauaacuu

SEQ ID NO: 29776 - RNA, 21 nt, Homo sapiens
cccugugcuggagguuugagg

SEQ ID NO: 29777 - RNA, 24 nt, Homo sapiens
gcuucucuaaagcaucuuaccccu

SEQ ID NO: 29778 - RNA, 19 nt, Homo sapiens
ucuaauaauaacauuuaaa

SEQ ID NO: 29779 - RNA, 20 nt, Homo sapiens
aaaaucuccagacauugcca

SEQ ID NO: 29780 - RNA, 19 nt, Homo sapiens
ccuucaggaagccugugaa

SEQ ID NO: 29781 - RNA, 27 nt, Homo sapiens
cggcgcgcgcagaaucucgugcugcug

SEQ ID NO: 29782 - RNA, 24 nt, Homo sapiens
ggcacgaucugcaaacuccgccuc

SEQ ID NO: 29783 - RNA, 21 nt, Homo sapiens
uaccugaaggugacuccgagu

SEQ ID NO: 29784 - RNA, 17 nt, Homo sapiens
ucaagugauucuucugc

SEQ ID NO: 29785 - RNA, 20 nt, Homo sapiens
uggccaggcuggucuugaac

SEQ ID NO: 29786 - RNA, 20 nt, Homo sapiens
aacggugaacacaagauuca

SEQ ID NO: 29787 - RNA, 19 nt, Homo sapiens
auuauggagauuaaccacu

SEQ ID NO: 29788 - RNA, 19 nt, Homo sapiens
uaaacggggugaggucaca

SEQ ID NO: 29789 - RNA, 19 nt, Homo sapiens
uacugcagauuucacccuu

SEQ ID NO: 29790 - RNA, 22 nt, Homo sapiens
aaacggugaccugaccaccuca

SEQ ID NO: 29791 - RNA, 19 nt, Homo sapiens
cuccccauccaauuaccua

SEQ ID NO: 29792 - RNA, 24 nt, Homo sapiens
gacaaagcuuaacucuuucaacca

SEQ ID NO: 29793 - RNA, 18 nt, Homo sapiens
gaguacuuugggaagcca

SEQ ID NO: 29794 - RNA, 21 nt, Homo sapiens
ggaucuugccaccacauucca

SEQ ID NO: 29795 - RNA, 21 nt, Homo sapiens
uauuucaagucagugcucaaa

SEQ ID NO: 29796 - RNA, 21 nt, Homo sapiens
ugaauggacccucuucuaggc

SEQ ID NO: 29797 - RNA, 22 nt, Homo sapiens
augcaaacugagggauauucua

SEQ ID NO: 29798 - RNA, 18 nt, Homo sapiens
uccauagaaaacacugga

SEQ ID NO: 29799 - RNA, 23 nt, Homo sapiens
ccuccccgcaggugaucauccuc

SEQ ID NO: 29800 - RNA, 17 nt, Homo sapiens
cuugagguugccuggcu

SEQ ID NO: 29801 - RNA, 19 nt, Homo sapiens
uuugauagcacaacagugu

SEQ ID NO: 29802 - RNA, 23 nt, Homo sapiens
gaggaggaugacuggguccgguc

SEQ ID NO: 29803 - RNA, 22 nt, Homo sapiens
cuaauguuucagaauuacuuuu

SEQ ID NO: 29804 - RNA, 17 nt, Homo sapiens
aaguaaugcuggacaca

SEQ ID NO: 29805 - RNA, 19 nt, Homo sapiens
agauccuggacuucaugua

SEQ ID NO: 29806 - RNA, 18 nt, Homo sapiens
ccuggcccagccugugaa

SEQ ID NO: 29807 - RNA, 21 nt, Homo sapiens
aacuaaauucaucucaaaaug

SEQ ID NO: 29808 - RNA, 24 nt, Homo sapiens
ucaucucaaaaugauuauaaauca

SEQ ID NO: 29809 - RNA, 18 nt, Homo sapiens
gacacgcaaauucgugaa

SEQ ID NO: 29810 - RNA, 21 nt, Homo sapiens
ccacacuuugguuuuccuuca

SEQ ID NO: 29811 - RNA, 18 nt, Homo sapiens
cuguauggacacuugcuu

SEQ ID NO: 29812 - RNA, 18 nt, Homo sapiens
guagugacuguauucuug

SEQ ID NO: 29813 - RNA, 18 nt, Homo sapiens
ggccgaaggcuuguuaug

SEQ ID NO: 29814 - RNA, 22 nt, Homo sapiens
aagcuccauauuuacagcuaua

SEQ ID NO: 29815 - RNA, 18 nt, Homo sapiens
ccaucacacccagugcuc

SEQ ID NO: 29816 - RNA, 25 nt, Homo sapiens
guuuaaaggcuguccaauccucuaa

SEQ ID NO: 29817 - RNA, 24 nt, Homo sapiens
accacagguguguguuuccccuuu

SEQ ID NO: 29818 - RNA, 18 nt, Homo sapiens
uguggaagacaugccgac

SEQ ID NO: 29819 - RNA, 15 nt, Homo sapiens
aacguuugugccaac

SEQ ID NO: 29820 - RNA, 19 nt, Homo sapiens
cggugagagaauguuucug

SEQ ID NO: 29821 - RNA, 19 nt, Homo sapiens
aaacuccugaccucaggug

SEQ ID NO: 29822 - RNA, 20 nt, Homo sapiens
agucucacucugucacacag

SEQ ID NO: 29823 - RNA, 21 nt, Homo sapiens
cagaguaccagggucuguaga

SEQ ID NO: 29824 - RNA, 18 nt, Homo sapiens
caggauaagccacugcac

SEQ ID NO: 29825 - RNA, 20 nt, Homo sapiens
uggccaggcuggucuugaac

SEQ ID NO: 29826 - RNA, 23 nt, Homo sapiens
ccucucccucaccaccaucauca

SEQ ID NO: 29827 - RNA, 24 nt, Homo sapiens
ucaccaccaucaucaucggcugcu

SEQ ID NO: 29828 - RNA, 21 nt, Homo sapiens
ugcuuccuccuuuauuguauc

SEQ ID NO: 29829 - RNA, 15 nt, Homo sapiens
uccauauuuaguugu

SEQ ID NO: 29830 - RNA, 21 nt, Homo sapiens
gaaacuuucgaacaaaaccaa

SEQ ID NO: 29831 - RNA, 18 nt, Homo sapiens
gagagccgcgucugugua

SEQ ID NO: 29832 - RNA, 22 nt, Homo sapiens
gggcccccgccggcgcgcugca

SEQ ID NO: 29833 - RNA, 22 nt, Homo sapiens
ucuuuuuguucgguugcuuugg

SEQ ID NO: 29834 - RNA, 22 nt, Homo sapiens
accauucacaccuaaagacuga

SEQ ID NO: 29835 - RNA, 21 nt, Homo sapiens
ccaggacguggcggcagggga

SEQ ID NO: 29836 - RNA, 25 nt, Homo sapiens
gccgcggcggcggcggcggacggcc

SEQ ID NO: 29837 - RNA, 18 nt, Homo sapiens
caacucuuccuccccucu

SEQ ID NO: 29838 - RNA, 18 nt, Homo sapiens
ccugggguggccuggccc

SEQ ID NO: 29839 - RNA, 15 nt, Homo sapiens
cucuuccuccccucu

SEQ ID NO: 29840 - RNA, 17 nt, Homo sapiens
gaggucccgggcuuagu

SEQ ID NO: 29841 - RNA, 20 nt, Homo sapiens
ggguggagaucaggucccgg

SEQ ID NO: 29842 - RNA, 25 nt, Homo sapiens
gccacagggagggaggucuugggga

SEQ ID NO: 29843 - RNA, 19 nt, Homo sapiens
ggggcaacccccugcggug

SEQ ID NO: 29844 - RNA, 22 nt, Homo sapiens
gggggaggaggcgacccuguca

SEQ ID NO: 29845 - RNA, 18 nt, Homo sapiens
cagaacagcuuucaccaa

SEQ ID NO: 29846 - RNA, 23 nt, Homo sapiens
ggcuuaguaucuuucucauuaca

SEQ ID NO: 29847 - RNA, 21 nt, Homo sapiens
ccccccagcaagggacuggac

SEQ ID NO: 29848 - RNA, 17 nt, Homo sapiens
uccuugcgagcccccca

SEQ ID NO: 29849 - RNA, 21 nt, Homo sapiens
cccauggcuucagaagagcua

SEQ ID NO: 29850 - RNA, 23 nt, Homo sapiens
uaaguuugugaaaaucuacauua

SEQ ID NO: 29851 - RNA, 19 nt, Homo sapiens
cugugaagaaugcuauuga

SEQ ID NO: 29852 - RNA, 19 nt, Homo sapiens
gaauucauucacuauugua

SEQ ID NO: 29853 - RNA, 19 nt, Homo sapiens
gguguuugaaaauuugcca

SEQ ID NO: 29854 - RNA, 21 nt, Homo sapiens
ucuugauccaaaguuugugaa

SEQ ID NO: 29855 - RNA, 20 nt, Homo sapiens
uguaaaggagugcugucuua

SEQ ID NO: 29856 - RNA, 23 nt, Homo sapiens
ccaaacucauccuaaaucucuca

SEQ ID NO: 29857 - RNA, 15 nt, Homo sapiens
gcuggggaguuuuua

SEQ ID NO: 29858 - RNA, 16 nt, Homo sapiens
uccauauuaguuccca

SEQ ID NO: 29859 - RNA, 20 nt, Homo sapiens
cagaugggacaagaagccgc

SEQ ID NO: 29860 - RNA, 19 nt, Homo sapiens
cccuccccaacccacucca

SEQ ID NO: 29861 - RNA, 20 nt, Homo sapiens
cccugaaaccugagaccugu

SEQ ID NO: 29862 - RNA, 17 nt, Homo sapiens
cucccacccucugcuuc

SEQ ID NO: 29863 - RNA, 23 nt, Homo sapiens
gaugaggcuuuaccucagacaag

SEQ ID NO: 29864 - RNA, 15 nt, Homo sapiens
ggagagggacagagg

SEQ ID NO: 29865 - RNA, 23 nt, Homo sapiens
ggaggaggaaaagccacaagaga

SEQ ID NO: 29866 - RNA, 17 nt, Homo sapiens
ucauacuggacagaaac

SEQ ID NO: 29867 - RNA, 17 nt, Homo sapiens
aagucaucaaguaaaca

SEQ ID NO: 29868 - RNA, 20 nt, Homo sapiens
aggaaagagaguuacaccuu

SEQ ID NO: 29869 - RNA, 23 nt, Homo sapiens
caccacagcaucugccccugcua

SEQ ID NO: 29870 - RNA, 21 nt, Homo sapiens
guagcuuuaaugauuuuuguu

SEQ ID NO: 29871 - RNA, 23 nt, Homo sapiens
guucagcauguuugcacuuguua

SEQ ID NO: 29872 - RNA, 18 nt, Homo sapiens
augcccauacgcagcgua

SEQ ID NO: 29873 - RNA, 17 nt, Homo sapiens
cccagacaacagaugcc

SEQ ID NO: 29874 - RNA, 17 nt, Homo sapiens
guaguuuacaguauuua

SEQ ID NO: 29875 - RNA, 19 nt, Homo sapiens
cagucugggaaaaacugug

SEQ ID NO: 29876 - RNA, 21 nt, Homo sapiens
acaucuucacacggcacgaca

SEQ ID NO: 29877 - RNA, 18 nt, Homo sapiens
cagagggagaaauaagcc

SEQ ID NO: 29878 - RNA, 22 nt, Homo sapiens
cccagugucgcacggugaagau

SEQ ID NO: 29879 - RNA, 24 nt, Homo sapiens
ccccucucguggucguucuggccc

SEQ ID NO: 29880 - RNA, 17 nt, Homo sapiens
cccucuguccccucugc

SEQ ID NO: 29881 - RNA, 22 nt, Homo sapiens
ccguguguccuucuguggccgc

SEQ ID NO: 29882 - RNA, 19 nt, Homo sapiens
cugccccugcccugccucu

SEQ ID NO: 29883 - RNA, 19 nt, Homo sapiens
gcaaggaguuggguuugga

SEQ ID NO: 29884 - RNA, 21 nt, Homo sapiens
gccacggcagucgcuugguuu

SEQ ID NO: 29885 - RNA, 21 nt, Homo sapiens
gccuccgcccucucagccugu

SEQ ID NO: 29886 - RNA, 21 nt, Homo sapiens
gccucuguccucucagccugu

SEQ ID NO: 29887 - RNA, 21 nt, Homo sapiens
gugcugugggccagggaaucc

SEQ ID NO: 29888 - RNA, 17 nt, Homo sapiens
ugguauggcuauucuug

SEQ ID NO: 29889 - RNA, 17 nt, Homo sapiens
caguuuggauugaugaa

SEQ ID NO: 29890 - RNA, 19 nt, Homo sapiens
cuccauaccagacaaauga

SEQ ID NO: 29891 - RNA, 21 nt, Homo sapiens
cuggaagcaggggagguacga

SEQ ID NO: 29892 - RNA, 18 nt, Homo sapiens
cugugguccagagacuca

SEQ ID NO: 29893 - RNA, 17 nt, Homo sapiens
gagcccagaaagccuca

SEQ ID NO: 29894 - RNA, 20 nt, Homo sapiens
gccauccacaagggcccagu

SEQ ID NO: 29895 - RNA, 18 nt, Homo sapiens
uuccaggaccuggcccag

SEQ ID NO: 29896 - RNA, 23 nt, Homo sapiens
uuuagguaauaauguauuacuuu

SEQ ID NO: 29897 - RNA, 19 nt, Homo sapiens
aaggucacggucuagauca

SEQ ID NO: 29898 - RNA, 17 nt, Homo sapiens
aguaaauuuggcuuaca

SEQ ID NO: 29899 - RNA, 22 nt, Homo sapiens
uaugagaaauagaaacauuucu

SEQ ID NO: 29900 - RNA, 20 nt, Homo sapiens
ucauacauaccuacauucag

SEQ ID NO: 29901 - RNA, 17 nt, Homo sapiens
aaaaacaaacaaacgaa

SEQ ID NO: 29902 - RNA, 20 nt, Homo sapiens
gcgcgccaccacgcccagcu

SEQ ID NO: 29903 - RNA, 18 nt, Homo sapiens
acugaaaucaaggccuca

SEQ ID NO: 29904 - RNA, 18 nt, Homo sapiens
acugaaaucaaggccuca

SEQ ID NO: 29905 - RNA, 22 nt, Homo sapiens
cacagagaaauuauauuccuua

SEQ ID NO: 29906 - RNA, 21 nt, Homo sapiens
ugagaauuauaauuauaugaa

SEQ ID NO: 29907 - RNA, 21 nt, Homo sapiens
aaaugcagcaucugcgaugug

SEQ ID NO: 29908 - RNA, 18 nt, Homo sapiens
aguggcacaacaguaugc

SEQ ID NO: 29909 - RNA, 21 nt, Homo sapiens
uuuugggauuguagcgucugc

SEQ ID NO: 29910 - RNA, 18 nt, Homo sapiens
aaagauuuuauuuaguaa

SEQ ID NO: 29911 - RNA, 19 nt, Homo sapiens
accuggagacucucuguua

SEQ ID NO: 29912 - RNA, 19 nt, Homo sapiens
acuaugcgaguauauaaca

SEQ ID NO: 29913 - RNA, 21 nt, Homo sapiens
cuucuuaguugucuugucuuu

SEQ ID NO: 29914 - RNA, 17 nt, Homo sapiens
guucaggaaacucagug

SEQ ID NO: 29915 - RNA, 17 nt, Homo sapiens
caagaacaaugacacca

SEQ ID NO: 29916 - RNA, 18 nt, Homo sapiens
caccaucuucuauucaaa

SEQ ID NO: 29917 - RNA, 18 nt, Homo sapiens
ccuacaccaaguuaccua

SEQ ID NO: 29918 - RNA, 18 nt, Homo sapiens
cuacaagaacaaugacac

SEQ ID NO: 29919 - RNA, 19 nt, Homo sapiens
cuugaauucauguuggucu

SEQ ID NO: 29920 - RNA, 18 nt, Homo sapiens
uccgccucccggguucaa

SEQ ID NO: 29921 - RNA, 17 nt, Homo sapiens
uucuccugcuucagcuu

SEQ ID NO: 29922 - RNA, 22 nt, Homo sapiens
acggcugcucggcuugaucaca

SEQ ID NO: 29923 - RNA, 19 nt, Homo sapiens
uccuguccguguuuguuua

SEQ ID NO: 29924 - RNA, 17 nt, Homo sapiens
uugcaaaugucaguuuc

SEQ ID NO: 29925 - RNA, 22 nt, Homo sapiens
caagaaguaggcugggcccggu

SEQ ID NO: 29926 - RNA, 22 nt, Homo sapiens
cuuugguggggugggcuucgga

SEQ ID NO: 29927 - RNA, 17 nt, Homo sapiens
augcaguuugggcauuu

SEQ ID NO: 29928 - RNA, 22 nt, Homo sapiens
uaaaacauguaaaaggauuugg

SEQ ID NO: 29929 - RNA, 22 nt, Homo sapiens
uuucaacuguaaucaguuaaua

SEQ ID NO: 29930 - RNA, 18 nt, Homo sapiens
agccagggagagugaguc

SEQ ID NO: 29931 - RNA, 18 nt, Homo sapiens
cagccccaccaggccuca

SEQ ID NO: 29932 - RNA, 23 nt, Homo sapiens
cagccccaccaggccucauuuca

SEQ ID NO: 29933 - RNA, 19 nt, Homo sapiens
cgagagggacuauuaccca

SEQ ID NO: 29934 - RNA, 16 nt, Homo sapiens
cugagcaaaacugcag

SEQ ID NO: 29935 - RNA, 16 nt, Homo sapiens
gagugagucccccaga

SEQ ID NO: 29936 - RNA, 20 nt, Homo sapiens
ggagacaaccacagauccua

SEQ ID NO: 29937 - RNA, 20 nt, Homo sapiens
uaagguuaugauugaaucua

SEQ ID NO: 29938 - RNA, 25 nt, Homo sapiens
uuguugguaugguuguuuuuguuuu

SEQ ID NO: 29939 - RNA, 21 nt, Homo sapiens
aaaucuugaaaaggguuucug

SEQ ID NO: 29940 - RNA, 22 nt, Homo sapiens
uagguauuuuuaaauuguuuuu

SEQ ID NO: 29941 - RNA, 20 nt, Homo sapiens
auagugaauaauuugaucaa

SEQ ID NO: 29942 - RNA, 18 nt, Homo sapiens
ucgucuuccugggcuuca

SEQ ID NO: 29943 - RNA, 19 nt, Homo sapiens
acaugaaacuuuucaugaa

SEQ ID NO: 29944 - RNA, 18 nt, Homo sapiens
uggucuuagccuguagac

SEQ ID NO: 29945 - RNA, 20 nt, Homo sapiens
uuuuuugcugcuauggucuu

SEQ ID NO: 29946 - RNA, 23 nt, Homo sapiens
ccuuaguugcuggcuuugaccuu

SEQ ID NO: 29947 - RNA, 21 nt, Homo sapiens
caacccucccugcuaaccccu

SEQ ID NO: 29948 - RNA, 21 nt, Homo sapiens
ccaccgccaccaugaccgcca

SEQ ID NO: 29949 - RNA, 17 nt, Homo sapiens
cgggucugcccgcugca

SEQ ID NO: 29950 - RNA, 20 nt, Homo sapiens
cguccccgacaugcaucuca

SEQ ID NO: 29951 - RNA, 22 nt, Homo sapiens
gccaccuccucccagcccccca

SEQ ID NO: 29952 - RNA, 22 nt, Homo sapiens
gcccccuugccuuucaaacugg

SEQ ID NO: 29953 - RNA, 24 nt, Homo sapiens
gccugggcugcggaugccugggcc

SEQ ID NO: 29954 - RNA, 19 nt, Homo sapiens
ggcaagcccccuugccuuu

SEQ ID NO: 29955 - RNA, 20 nt, Homo sapiens
caccucuucucaggcacccc

SEQ ID NO: 29956 - RNA, 26 nt, Homo sapiens
uauuccuagcaaaauaaaaucucuaa

SEQ ID NO: 29957 - RNA, 22 nt, Homo sapiens
uccuucugguauaugcauguca

SEQ ID NO: 29958 - RNA, 26 nt, Homo sapiens
ucgcuccuucugguauaugcauguca

SEQ ID NO: 29959 - RNA, 22 nt, Homo sapiens
ucuaagaaaucuauguuccuga

SEQ ID NO: 29960 - RNA, 23 nt, Homo sapiens
ugaaauucuucaccaacauuuca

SEQ ID NO: 29961 - RNA, 18 nt, Homo sapiens
uuuuggugguggauaaau

SEQ ID NO: 29962 - RNA, 20 nt, Homo sapiens
aguuuucuuuucaucccagc

SEQ ID NO: 29963 - RNA, 22 nt, Homo sapiens
ccaaacagagcaugaggaacca

SEQ ID NO: 29964 - RNA, 18 nt, Homo sapiens
aguuggugcaucuagaaa

SEQ ID NO: 29965 - RNA, 20 nt, Homo sapiens
cauccucuuccauuaaccag

SEQ ID NO: 29966 - RNA, 19 nt, Homo sapiens
caucuccgcaucgcauccu

SEQ ID NO: 29967 - RNA, 19 nt, Homo sapiens
gcauccucuuccauuaacc

SEQ ID NO: 29968 - RNA, 21 nt, Homo sapiens
gccagugcggcugccagguuc

SEQ ID NO: 29969 - RNA, 18 nt, Homo sapiens
ggccagccgcccacuucc

SEQ ID NO: 29970 - RNA, 25 nt, Homo sapiens
uccauuaaccaguggccgguugcca

SEQ ID NO: 29971 - RNA, 19 nt, Homo sapiens
auggucuugggcaaacaua

SEQ ID NO: 29972 - RNA, 19 nt, Homo sapiens
ccuaugaacuaaugacaac

SEQ ID NO: 29973 - RNA, 19 nt, Homo sapiens
gaauuugugacgaaagcug

SEQ ID NO: 29974 - RNA, 20 nt, Homo sapiens
gggauuuaauauauuuugaa

SEQ ID NO: 29975 - RNA, 19 nt, Homo sapiens
gucgaugugcaugcuuuua

SEQ ID NO: 29976 - RNA, 20 nt, Homo sapiens
ugagugggcuucaccagcua

SEQ ID NO: 29977 - RNA, 18 nt, Homo sapiens
cccggcuugaaaacuuca

SEQ ID NO: 29978 - RNA, 17 nt, Homo sapiens
ugaagagaugguucaga

SEQ ID NO: 29979 - RNA, 19 nt, Homo sapiens
cacccuaguccagcagcuc

SEQ ID NO: 29980 - RNA, 22 nt, Homo sapiens
acacugcagucagauccuguua

SEQ ID NO: 29981 - RNA, 21 nt, Homo sapiens
agacuagccacuccugccagg

SEQ ID NO: 29982 - RNA, 21 nt, Homo sapiens
acaccuaggucugagaacuca

SEQ ID NO: 29983 - RNA, 18 nt, Homo sapiens
auccuggucugcaccucu

SEQ ID NO: 29984 - RNA, 18 nt, Homo sapiens
cuuccuccuagcaaccaa

SEQ ID NO: 29985 - RNA, 23 nt, Homo sapiens
ugaauggacuuuacuaguggggc

SEQ ID NO: 29986 - RNA, 18 nt, Homo sapiens
acugucccuuggacucca

SEQ ID NO: 29987 - RNA, 20 nt, Homo sapiens
agaaauaaacgcauucuguc

SEQ ID NO: 29988 - RNA, 20 nt, Homo sapiens
agucucacucuguugcccag

SEQ ID NO: 29989 - RNA, 19 nt, Homo sapiens
cagucuucaggacaccauu

SEQ ID NO: 29990 - RNA, 23 nt, Homo sapiens
cggcagcuucugacgcugggcca

SEQ ID NO: 29991 - RNA, 18 nt, Homo sapiens
ugcggaaccaggcuucuu

SEQ ID NO: 29992 - RNA, 20 nt, Homo sapiens
uuuuguagaacacaacagug

SEQ ID NO: 29993 - RNA, 18 nt, Homo sapiens
cacagacccccuugcucc

SEQ ID NO: 29994 - RNA, 18 nt, Homo sapiens
ccaccccuccccgcauug

SEQ ID NO: 29995 - RNA, 17 nt, Homo sapiens
cuuugccacuguccuug

SEQ ID NO: 29996 - RNA, 22 nt, Homo sapiens
uuuuuuauauuugccacuguua

SEQ ID NO: 29997 - RNA, 21 nt, Homo sapiens
cuugcugcuggggucauuuuu

SEQ ID NO: 29998 - RNA, 16 nt, Homo sapiens
gcaaauaucucccucu

SEQ ID NO: 29999 - RNA, 15 nt, Homo sapiens
uaucucaggagcccc

SEQ ID NO: 30000 - RNA, 21 nt, Homo sapiens
uucuggacacucaaacacauc

SEQ ID NO: 30001 - RNA, 17 nt, Homo sapiens
accccacccccaccucu

SEQ ID NO: 30002 - RNA, 20 nt, Homo sapiens
agggucccaccccucacccc

SEQ ID NO: 30003 - RNA, 19 nt, Homo sapiens
cuagggagcccguccucca

SEQ ID NO: 30004 - RNA, 24 nt, Homo sapiens
caagaaacacuugcugaaucugca

SEQ ID NO: 30005 - RNA, 20 nt, Homo sapiens
ccaauucuaaaugcccugga

SEQ ID NO: 30006 - RNA, 18 nt, Homo sapiens
guuacucuguguuugcug

SEQ ID NO: 30007 - RNA, 20 nt, Homo sapiens
ugucgccaaagcccauggug

SEQ ID NO: 30008 - RNA, 18 nt, Homo sapiens
uuacugcgggccgcuccg

SEQ ID NO: 30009 - RNA, 24 nt, Homo sapiens
acuugagaaauuaccuuuugguuu

SEQ ID NO: 30010 - RNA, 18 nt, Homo sapiens
ccuguaaucccaauacug

SEQ ID NO: 30011 - RNA, 19 nt, Homo sapiens
cuguuuuucagaacccuca

SEQ ID NO: 30012 - RNA, 21 nt, Homo sapiens
uucugcccuucuuugcuuugg

SEQ ID NO: 30013 - RNA, 20 nt, Homo sapiens
ccauccccagccuccacccc

SEQ ID NO: 30014 - RNA, 18 nt, Homo sapiens
cccacugccuccccuguu

SEQ ID NO: 30015 - RNA, 21 nt, Homo sapiens
cuaucccauccccagccucca

SEQ ID NO: 30016 - RNA, 18 nt, Homo sapiens
cuggcccucaauuagcua

SEQ ID NO: 30017 - RNA, 23 nt, Homo sapiens
ccuuccccuguggccacuuucca

SEQ ID NO: 30018 - RNA, 19 nt, Homo sapiens
cuccccauguacccaagga

SEQ ID NO: 30019 - RNA, 19 nt, Homo sapiens
cuguuuuggcaagacccca

SEQ ID NO: 30020 - RNA, 18 nt, Homo sapiens
ugcccagaccccauucca

SEQ ID NO: 30021 - RNA, 18 nt, Homo sapiens
auccugaaugaacagugg

SEQ ID NO: 30022 - RNA, 17 nt, Homo sapiens
cuuccccuccuccuucc

SEQ ID NO: 30023 - RNA, 21 nt, Homo sapiens
gagaaaggggccguggucagc

SEQ ID NO: 30024 - RNA, 23 nt, Homo sapiens
gccuggauuuguauccuuggcuu

SEQ ID NO: 30025 - RNA, 18 nt, Homo sapiens
ggccaggcacccccaggg

SEQ ID NO: 30026 - RNA, 21 nt, Homo sapiens
ccuuuucauucuccuugcuuu

SEQ ID NO: 30027 - RNA, 24 nt, Homo sapiens
agucagagaucuugguaugggcug

SEQ ID NO: 30028 - RNA, 21 nt, Homo sapiens
ccauuuucucuauucuuucca

SEQ ID NO: 30029 - RNA, 19 nt, Homo sapiens
aguguuuucuuuuugggua

SEQ ID NO: 30030 - RNA, 20 nt, Homo sapiens
cagcagcagcagcaacacca

SEQ ID NO: 30031 - RNA, 20 nt, Homo sapiens
cgcccccgcccgcgcccccu

SEQ ID NO: 30032 - RNA, 21 nt, Homo sapiens
cuuuuuggguacguauuguuu

SEQ ID NO: 30033 - RNA, 18 nt, Homo sapiens
ggcauccucaggagcccc

SEQ ID NO: 30034 - RNA, 18 nt, Homo sapiens
ggggucaaugugaugcug

SEQ ID NO: 30035 - RNA, 25 nt, Homo sapiens
guguuuggaaacaucuguggacucu

SEQ ID NO: 30036 - RNA, 21 nt, Homo sapiens
aauggucacagaaugccuuuu

SEQ ID NO: 30037 - RNA, 20 nt, Homo sapiens
cugugauuucuguuuuguuu

SEQ ID NO: 30038 - RNA, 24 nt, Homo sapiens
acucggagaugcuaaacugucuua

SEQ ID NO: 30039 - RNA, 19 nt, Homo sapiens
acugcaagggcauuuucca

SEQ ID NO: 30040 - RNA, 17 nt, Homo sapiens
acuuaauuggaaaacac

SEQ ID NO: 30041 - RNA, 19 nt, Homo sapiens
caggguuggguggcucagu

SEQ ID NO: 30042 - RNA, 20 nt, Homo sapiens
ccucggccugggcacccuca

SEQ ID NO: 30043 - RNA, 18 nt, Homo sapiens
ccugcugaggggaagcca

SEQ ID NO: 30044 - RNA, 21 nt, Homo sapiens
cuggaagccugacccucuggu

SEQ ID NO: 30045 - RNA, 23 nt, Homo sapiens
gagggucccacagacguaaccug

SEQ ID NO: 30046 - RNA, 25 nt, Homo sapiens
gccuggaagccugacccucugguuc

SEQ ID NO: 30047 - RNA, 18 nt, Homo sapiens
gcuugggggugcugcuug

SEQ ID NO: 30048 - RNA, 22 nt, Homo sapiens
ucguaacaaaacaacguccccu

SEQ ID NO: 30049 - RNA, 17 nt, Homo sapiens
uuugaaccggucugucu

SEQ ID NO: 30050 - RNA, 20 nt, Homo sapiens
agcuccucagucaacaaaca

SEQ ID NO: 30051 - RNA, 21 nt, Homo sapiens
gagacaagacuucucuguuua

SEQ ID NO: 30052 - RNA, 19 nt, Homo sapiens
gcaccaaucuacugugaga

SEQ ID NO: 30053 - RNA, 17 nt, Homo sapiens
auguuugcagaguauuu

SEQ ID NO: 30054 - RNA, 18 nt, Homo sapiens
cagcacccagacaagcca

SEQ ID NO: 30055 - RNA, 20 nt, Homo sapiens
cucccuccacuccaucuggu

SEQ ID NO: 30056 - RNA, 17 nt, Homo sapiens
uguuauuguguauugcc

SEQ ID NO: 30057 - RNA, 24 nt, Homo sapiens
aggcugcugucccggcgggagcug

SEQ ID NO: 30058 - RNA, 22 nt, Homo sapiens
gccccucugcugcgucugcccu

SEQ ID NO: 30059 - RNA, 20 nt, Homo sapiens
aguaagaggacuacucagca

SEQ ID NO: 30060 - RNA, 20 nt, Homo sapiens
cccagaagauuagcaugcca

SEQ ID NO: 30061 - RNA, 23 nt, Homo sapiens
ugggugggcucugaugcagaacu

SEQ ID NO: 30062 - RNA, 19 nt, Homo sapiens
caaacagagaaggaaccca

SEQ ID NO: 30063 - RNA, 23 nt, Homo sapiens
ccucacccuugggcuuugcugcc

SEQ ID NO: 30064 - RNA, 23 nt, Homo sapiens
ccuucccugccccaacucccucc

SEQ ID NO: 30065 - RNA, 21 nt, Homo sapiens
ucccugcuccuaaccccugcc

SEQ ID NO: 30066 - RNA, 19 nt, Homo sapiens
ugucaccaccugaacauuc

SEQ ID NO: 30067 - RNA, 17 nt, Homo sapiens
ucucaccccaccccacc

SEQ ID NO: 30068 - RNA, 23 nt, Homo sapiens
ugggaacaauggaaaaaauuaca

SEQ ID NO: 30069 - RNA, 18 nt, Homo sapiens
uucauuuugacuguucca

SEQ ID NO: 30070 - RNA, 16 nt, Homo sapiens
ggcuuuaccuuuugau

SEQ ID NO: 30071 - RNA, 21 nt, Homo sapiens
uaugcuggaaacauuauccca

SEQ ID NO: 30072 - RNA, 19 nt, Homo sapiens
gauguuccccauauuguga

SEQ ID NO: 30073 - RNA, 19 nt, Homo sapiens
uucaggcagccggugcaca

SEQ ID NO: 30074 - RNA, 21 nt, Homo sapiens
aacugauguuuacaaaccaga

SEQ ID NO: 30075 - RNA, 15 nt, Homo sapiens
agguacccagugaua

SEQ ID NO: 30076 - RNA, 22 nt, Homo sapiens
ucugcuggaaacuccugaagag

SEQ ID NO: 30077 - RNA, 23 nt, Homo sapiens
uuaccauguuucaucuuggcaua

SEQ ID NO: 30078 - RNA, 18 nt, Homo sapiens
aaguuucuccagauuucu

SEQ ID NO: 30079 - RNA, 24 nt, Homo sapiens
auccuuagcccccauaucuggcug

SEQ ID NO: 30080 - RNA, 18 nt, Homo sapiens
auguacuugggcaucuca

SEQ ID NO: 30081 - RNA, 21 nt, Homo sapiens
ccagugcgcuuccucuguucc

SEQ ID NO: 30082 - RNA, 18 nt, Homo sapiens
cccgcuggcagccaggca

SEQ ID NO: 30083 - RNA, 17 nt, Homo sapiens
gcagcugcuucugcccc

SEQ ID NO: 30084 - RNA, 21 nt, Homo sapiens
gcccccugccaccccucccca

SEQ ID NO: 30085 - RNA, 18 nt, Homo sapiens
uccuaccuccccugccug

SEQ ID NO: 30086 - RNA, 19 nt, Homo sapiens
ccuccccgcucccaccucc

SEQ ID NO: 30087 - RNA, 24 nt, Homo sapiens
caacaacaauaauaaagaugugaa

SEQ ID NO: 30088 - RNA, 21 nt, Homo sapiens
gcuguccccucagcgggggcc

SEQ ID NO: 30089 - RNA, 20 nt, Homo sapiens
acggcccgccuaucauuagc

SEQ ID NO: 30090 - RNA, 19 nt, Homo sapiens
cccccgucccuaucggcag

SEQ ID NO: 30091 - RNA, 18 nt, Homo sapiens
agaaacgggaagccacua

SEQ ID NO: 30092 - RNA, 24 nt, Homo sapiens
cauguaccucuggugugucaggga

SEQ ID NO: 30093 - RNA, 20 nt, Homo sapiens
cuuccuaccgggauuaccua

SEQ ID NO: 30094 - RNA, 21 nt, Homo sapiens
guaaguuuuauuuugaagugu

SEQ ID NO: 30095 - RNA, 21 nt, Homo sapiens
uaaugucuucuauauguaaua

SEQ ID NO: 30096 - RNA, 15 nt, Homo sapiens
ucuggccucccauuc

SEQ ID NO: 30097 - RNA, 24 nt, Homo sapiens
aaagaacggcgucauugccuguca

SEQ ID NO: 30098 - RNA, 22 nt, Homo sapiens
auuugaacagauguuuuggcuc

SEQ ID NO: 30099 - RNA, 18 nt, Homo sapiens
ggugccgccgcccgcccc

SEQ ID NO: 30100 - RNA, 20 nt, Homo sapiens
uaggaaaugccagcacuccc

SEQ ID NO: 30101 - RNA, 18 nt, Homo sapiens
ucuccagcgaucuuccca

SEQ ID NO: 30102 - RNA, 18 nt, Homo sapiens
acacaggacccagucugc

SEQ ID NO: 30103 - RNA, 18 nt, Homo sapiens
cccuguucccagcacuca

SEQ ID NO: 30104 - RNA, 18 nt, Homo sapiens
cccuugcuugacucaguu

SEQ ID NO: 30105 - RNA, 21 nt, Homo sapiens
gcgccuucgggcguggacucu

SEQ ID NO: 30106 - RNA, 19 nt, Homo sapiens
ucgcggcccacaagcaucc

SEQ ID NO: 30107 - RNA, 18 nt, Homo sapiens
ccuuccucacacaucccu

SEQ ID NO: 30108 - RNA, 21 nt, Homo sapiens
ccuuccccuccacucccuucc

SEQ ID NO: 30109 - RNA, 22 nt, Homo sapiens
gcaauguaccacaaaccgagug

SEQ ID NO: 30110 - RNA, 24 nt, Homo sapiens
auaggacugauggaaaugauuuca

SEQ ID NO: 30111 - RNA, 18 nt, Homo sapiens
gcggcgucccggcugcua

SEQ ID NO: 30112 - RNA, 19 nt, Homo sapiens
aagugaaacugggcuuuaa

SEQ ID NO: 30113 - RNA, 22 nt, Homo sapiens
ucuugcuaccagcaauaaauca

SEQ ID NO: 30114 - RNA, 21 nt, Homo sapiens
uggccacucuugaugugaggc

SEQ ID NO: 30115 - RNA, 20 nt, Homo sapiens
ccccaggcgucaggaacugc

SEQ ID NO: 30116 - RNA, 16 nt, Homo sapiens
auauugugcuuaaauu

SEQ ID NO: 30117 - RNA, 17 nt, Homo sapiens
ccauaaggugcaguagg

SEQ ID NO: 30118 - RNA, 20 nt, Homo sapiens
caucuggagcacuuguuuua

SEQ ID NO: 30119 - RNA, 26 nt, Homo sapiens
ccugccauccaguuuuggaucuuuuu

SEQ ID NO: 30120 - RNA, 22 nt, Homo sapiens
uccuaagaacaaugccaacaaa

SEQ ID NO: 30121 - RNA, 26 nt, Homo sapiens
ucuugaucguuguggaagguuuggag

SEQ ID NO: 30122 - RNA, 16 nt, Homo sapiens
uuaucuugucauugcc

SEQ ID NO: 30123 - RNA, 21 nt, Homo sapiens
auuaaaaugcuaaauauugca

SEQ ID NO: 30124 - RNA, 20 nt, Homo sapiens
cagacugucacuugcuguua

SEQ ID NO: 30125 - RNA, 20 nt, Homo sapiens
cuuuacuacuguaaacagua

SEQ ID NO: 30126 - RNA, 18 nt, Homo sapiens
ugaggcccaggacccacc

SEQ ID NO: 30127 - RNA, 18 nt, Homo sapiens
uugccucuccccugcuca

SEQ ID NO: 30128 - RNA, 22 nt, Homo sapiens
uuucucauuugguaaugguguu

SEQ ID NO: 30129 - RNA, 18 nt, Homo sapiens
caggcaaccucccauccc

SEQ ID NO: 30130 - RNA, 20 nt, Homo sapiens
caccucccccccaccaacuc

SEQ ID NO: 30131 - RNA, 18 nt, Homo sapiens
caucacccaccucauuga

SEQ ID NO: 30132 - RNA, 19 nt, Homo sapiens
accuccuacuaccaccaca

SEQ ID NO: 30133 - RNA, 22 nt, Homo sapiens
caagugugcccuccucucuucu

SEQ ID NO: 30134 - RNA, 25 nt, Homo sapiens
uggcccccaauggucagaagagcca

SEQ ID NO: 30135 - RNA, 17 nt, Homo sapiens
uuccuuccaauacccca

SEQ ID NO: 30136 - RNA, 19 nt, Homo sapiens
acacagcuagcuccucauc

SEQ ID NO: 30137 - RNA, 16 nt, Homo sapiens
accacugacucuugcu

SEQ ID NO: 30138 - RNA, 17 nt, Homo sapiens
acugacucuugcucugg

SEQ ID NO: 30139 - RNA, 21 nt, Homo sapiens
aguacacacagcuagcuccuc

SEQ ID NO: 30140 - RNA, 19 nt, Homo sapiens
cagagccaacaggcuauau

SEQ ID NO: 30141 - RNA, 18 nt, Homo sapiens
cugugguuauguuguuuu

SEQ ID NO: 30142 - RNA, 22 nt, Homo sapiens
gaacaauuuuaagaaaauaaca

SEQ ID NO: 30143 - RNA, 19 nt, Homo sapiens
gcccuaaccacuucuuaca

SEQ ID NO: 30144 - RNA, 17 nt, Homo sapiens
gcuuggacuccauuuua

SEQ ID NO: 30145 - RNA, 19 nt, Homo sapiens
uguauauguuugaaauuuu

SEQ ID NO: 30146 - RNA, 19 nt, Homo sapiens
uguaucagguguuucagaa

SEQ ID NO: 30147 - RNA, 17 nt, Homo sapiens
guauuguuacagcugaa

SEQ ID NO: 30148 - RNA, 21 nt, Homo sapiens
ucaaaaucuuuagaauaguua

SEQ ID NO: 30149 - RNA, 21 nt, Homo sapiens
ucuccagcugauuuuaacuuu

SEQ ID NO: 30150 - RNA, 18 nt, Homo sapiens
cacacugcuaagauuuca

SEQ ID NO: 30151 - RNA, 18 nt, Homo sapiens
cauauguauguagauaug

SEQ ID NO: 30152 - RNA, 19 nt, Homo sapiens
ucuuaccauuucccuaaca

SEQ ID NO: 30153 - RNA, 18 nt, Homo sapiens
uaaguacacacaaacaaa

SEQ ID NO: 30154 - RNA, 17 nt, Homo sapiens
aaacagacaaacaagaa

SEQ ID NO: 30155 - RNA, 22 nt, Homo sapiens
aaagaaagucuccagaccagga

SEQ ID NO: 30156 - RNA, 21 nt, Homo sapiens
agcugacacuucugaaacuca

SEQ ID NO: 30157 - RNA, 18 nt, Homo sapiens
ccuccuugcaaugggcug

SEQ ID NO: 30158 - RNA, 22 nt, Homo sapiens
ccccacccacucccuacagucc

SEQ ID NO: 30159 - RNA, 20 nt, Homo sapiens
ccgggguccucccagggcug

SEQ ID NO: 30160 - RNA, 20 nt, Homo sapiens
cugcccccaaugccccgagg

SEQ ID NO: 30161 - RNA, 21 nt, Homo sapiens
uucugacccacugggauuugc

SEQ ID NO: 30162 - RNA, 19 nt, Homo sapiens
uucaggcuggcuaugaacu

SEQ ID NO: 30163 - RNA, 19 nt, Homo sapiens
uggcagggccuagcugcua

SEQ ID NO: 30164 - RNA, 20 nt, Homo sapiens
augugaauuuaagugugaaa

SEQ ID NO: 30165 - RNA, 21 nt, Homo sapiens
uuggcagugucaucucugaga

SEQ ID NO: 30166 - RNA, 21 nt, Homo sapiens
agaaaauucagcugauuacug

SEQ ID NO: 30167 - RNA, 21 nt, Homo sapiens
acuguaaaaaucaccugcaca

SEQ ID NO: 30168 - RNA, 19 nt, Homo sapiens
uacaaaagcaaauuuugca

SEQ ID NO: 30169 - RNA, 18 nt, Homo sapiens
uucugucuuucugguucc

SEQ ID NO: 30170 - RNA, 19 nt, Homo sapiens
aagcaauucuccugccuca

SEQ ID NO: 30171 - RNA, 18 nt, Homo sapiens
aauuugacuuuuguucca

SEQ ID NO: 30172 - RNA, 23 nt, Homo sapiens
agaaaaaagaaagcagaagagcc

SEQ ID NO: 30173 - RNA, 18 nt, Homo sapiens
agagcugaaaaacuaccu

SEQ ID NO: 30174 - RNA, 17 nt, Homo sapiens
agcuggacaaaugucau

SEQ ID NO: 30175 - RNA, 18 nt, Homo sapiens
cccccaaauccuguucca

SEQ ID NO: 30176 - RNA, 18 nt, Homo sapiens
aauuuugcagaauuccuc

SEQ ID NO: 30177 - RNA, 23 nt, Homo sapiens
aguauucuugauccuguguuuca

SEQ ID NO: 30178 - RNA, 18 nt, Homo sapiens
guaacaagcacacuauuu

SEQ ID NO: 30179 - RNA, 18 nt, Homo sapiens
auuguauguacuauugua

SEQ ID NO: 30180 - RNA, 23 nt, Homo sapiens
acuugaacaauuugauuuggcuu

SEQ ID NO: 30181 - RNA, 17 nt, Homo sapiens
aggaagccuggaauuca

SEQ ID NO: 30182 - RNA, 21 nt, Homo sapiens
ccacuaauuugcccacaacaa

SEQ ID NO: 30183 - RNA, 24 nt, Homo sapiens
uaaauggauauaggauugaaguua

SEQ ID NO: 30184 - RNA, 21 nt, Homo sapiens
uuaaagcaagauucaauuccu

SEQ ID NO: 30185 - RNA, 22 nt, Homo sapiens
augucauagaaauauugacuca

SEQ ID NO: 30186 - RNA, 18 nt, Homo sapiens
agauaaaacagacaucca

SEQ ID NO: 30187 - RNA, 22 nt, Homo sapiens
cuggaaaggaacaagugccucg

SEQ ID NO: 30188 - RNA, 18 nt, Homo sapiens
gaacaguucugcaaaaua

SEQ ID NO: 30189 - RNA, 18 nt, Homo sapiens
gaaacccgcauggaauua

SEQ ID NO: 30190 - RNA, 22 nt, Homo sapiens
ggaaagaggcuccagcaugggg

SEQ ID NO: 30191 - RNA, 16 nt, Homo sapiens
ggugcugaccuugcca

SEQ ID NO: 30192 - RNA, 19 nt, Homo sapiens
ggaaagagagaaaaucacu

SEQ ID NO: 30193 - RNA, 18 nt, Homo sapiens
ucuccugcuuugugccuu

SEQ ID NO: 30194 - RNA, 22 nt, Homo sapiens
uggccucaaugcccuccuuuau

SEQ ID NO: 30195 - RNA, 22 nt, Homo sapiens
ccugacuugggaggccggcgga

SEQ ID NO: 30196 - RNA, 19 nt, Homo sapiens
gcccaggcccagggcccca

SEQ ID NO: 30197 - RNA, 18 nt, Homo sapiens
cugcccggcugccacccc

SEQ ID NO: 30198 - RNA, 20 nt, Homo sapiens
gagcgccucugccccgccgc

SEQ ID NO: 30199 - RNA, 20 nt, Homo sapiens
ggcugccaucccgucuagga

SEQ ID NO: 30200 - RNA, 22 nt, Homo sapiens
ucugugugcugcugucuggcuc

SEQ ID NO: 30201 - RNA, 19 nt, Homo sapiens
agcauggccugggaucuca

SEQ ID NO: 30202 - RNA, 17 nt, Homo sapiens
cccagacacaccaucuc

SEQ ID NO: 30203 - RNA, 22 nt, Homo sapiens
acagcgagaacugcacuaccuu

SEQ ID NO: 30204 - RNA, 18 nt, Homo sapiens
cgcugagcgccguggcca

SEQ ID NO: 30205 - RNA, 24 nt, Homo sapiens
gagcugcgggaacaccgagacccc

SEQ ID NO: 30206 - RNA, 23 nt, Homo sapiens
ucuggacgagccuugccugaccu

SEQ ID NO: 30207 - RNA, 24 nt, Homo sapiens
gaacacucaaaauuccagcaauga

SEQ ID NO: 30208 - RNA, 23 nt, Homo sapiens
uguuaaaaucaggauuuuuagug

SEQ ID NO: 30209 - RNA, 19 nt, Homo sapiens
caaaucacgcaucucuacu

SEQ ID NO: 30210 - RNA, 20 nt, Homo sapiens
gcagugccccacuucaugga

SEQ ID NO: 30211 - RNA, 22 nt, Homo sapiens
gagcacccucccugcccgucuu

SEQ ID NO: 30212 - RNA, 16 nt, Homo sapiens
auauguuagauacaca

SEQ ID NO: 30213 - RNA, 15 nt, Homo sapiens
aucauauguuagaua

SEQ ID NO: 30214 - RNA, 18 nt, Homo sapiens
accagagagacucaagca

SEQ ID NO: 30215 - RNA, 18 nt, Homo sapiens
agagcuacacagagguga

SEQ ID NO: 30216 - RNA, 18 nt, Homo sapiens
gguggcaggagguauguc

SEQ ID NO: 30217 - RNA, 18 nt, Homo sapiens
uuuuccccuugcauauca

SEQ ID NO: 30218 - RNA, 20 nt, Homo sapiens
ccucugccuccuggguucaa

SEQ ID NO: 30219 - RNA, 20 nt, Homo sapiens
cgcccccaggccaccugcuc

SEQ ID NO: 30220 - RNA, 21 nt, Homo sapiens
cuccucaggacugcagcacug

SEQ ID NO: 30221 - RNA, 22 nt, Homo sapiens
gaaggucauccaaguuuccucc

SEQ ID NO: 30222 - RNA, 22 nt, Homo sapiens
gcccccaggccaccugcuccgg

SEQ ID NO: 30223 - RNA, 22 nt, Homo sapiens
guuccgcacgauccggaaccca

SEQ ID NO: 30224 - RNA, 17 nt, Homo sapiens
accagagagcugcuggg

SEQ ID NO: 30225 - RNA, 17 nt, Homo sapiens
auauugauuucugccuu

SEQ ID NO: 30226 - RNA, 19 nt, Homo sapiens
auggugccaauggaaccuc

SEQ ID NO: 30227 - RNA, 20 nt, Homo sapiens
caaaaugacauuuugccaaa

SEQ ID NO: 30228 - RNA, 19 nt, Homo sapiens
cagccucuagggaccccuc

SEQ ID NO: 30229 - RNA, 18 nt, Homo sapiens
ugcuccacagccauccca

SEQ ID NO: 30230 - RNA, 17 nt, Homo sapiens
uucaagaccuucaccaa

SEQ ID NO: 30231 - RNA, 20 nt, Homo sapiens
uucuggccuagucccuucca

SEQ ID NO: 30232 - RNA, 25 nt, Homo sapiens
cuacagccugacccaugggcaccgu

SEQ ID NO: 30233 - RNA, 21 nt, Homo sapiens
acacccaccucuaaggacuca

SEQ ID NO: 30234 - RNA, 20 nt, Homo sapiens
caguguuucacugucucaac

SEQ ID NO: 30235 - RNA, 22 nt, Homo sapiens
gucacccgucaaccagagcgug

SEQ ID NO: 30236 - RNA, 23 nt, Homo sapiens
gagagauauccuggcugaagcug

SEQ ID NO: 30237 - RNA, 21 nt, Homo sapiens
uaacccauuaggaaauagagc

SEQ ID NO: 30238 - RNA, 19 nt, Homo sapiens
uaucaaggaccaccaccac

SEQ ID NO: 30239 - RNA, 20 nt, Homo sapiens
uccaucagggagaccuggaa

SEQ ID NO: 30240 - RNA, 24 nt, Homo sapiens
ugaaugaccacaacugugaaguua

SEQ ID NO: 30241 - RNA, 17 nt, Homo sapiens
acgcuuguaaucgcagc

SEQ ID NO: 30242 - RNA, 23 nt, Homo sapiens
acugcugccauuguaguuugcug

SEQ ID NO: 30243 - RNA, 16 nt, Homo sapiens
agaaucacugcugcca

SEQ ID NO: 30244 - RNA, 20 nt, Homo sapiens
gucuuaaaauaaaagcuuuu

SEQ ID NO: 30245 - RNA, 19 nt, Homo sapiens
ucagagccaauguuguaca

SEQ ID NO: 30246 - RNA, 19 nt, Homo sapiens
uugagacgucaaugggacg

SEQ ID NO: 30247 - RNA, 23 nt, Homo sapiens
aagaagauacagaagaauauaau

SEQ ID NO: 30248 - RNA, 18 nt, Homo sapiens
uccagaagguguugccag

SEQ ID NO: 30249 - RNA, 19 nt, Homo sapiens
cacauagucauuuagauga

SEQ ID NO: 30250 - RNA, 18 nt, Homo sapiens
ucagcaagaggcguucga

SEQ ID NO: 30251 - RNA, 18 nt, Homo sapiens
aggggccuccaucccucu

SEQ ID NO: 30252 - RNA, 19 nt, Homo sapiens
ccacauauucuugccaauu

SEQ ID NO: 30253 - RNA, 18 nt, Homo sapiens
ccccgacccccauggcca

SEQ ID NO: 30254 - RNA, 23 nt, Homo sapiens
gcgagagggagagcgugcgcgag

SEQ ID NO: 30255 - RNA, 23 nt, Homo sapiens
ccucccaugcagaggucagugag

SEQ ID NO: 30256 - RNA, 18 nt, Homo sapiens
aagugccaaugugaaauu

SEQ ID NO: 30257 - RNA, 20 nt, Homo sapiens
ggagagaagcugaggccuca

SEQ ID NO: 30258 - RNA, 18 nt, Homo sapiens
ccgccgccuccucauuca

SEQ ID NO: 30259 - RNA, 17 nt, Homo sapiens
cuggagaaauuaugacu

SEQ ID NO: 30260 - RNA, 24 nt, Homo sapiens
ugaguggacuucauauuaugacua

SEQ ID NO: 30261 - RNA, 19 nt, Homo sapiens
aaaaugaaaaagguugcaa

SEQ ID NO: 30262 - RNA, 16 nt, Homo sapiens
aaacuuuacuagaugc

SEQ ID NO: 30263 - RNA, 18 nt, Homo sapiens
augggcguccuuugacug

SEQ ID NO: 30264 - RNA, 18 nt, Homo sapiens
aagagagguuauagagua

SEQ ID NO: 30265 - RNA, 20 nt, Homo sapiens
ggcacaugacaacuuugcca

SEQ ID NO: 30266 - RNA, 19 nt, Homo sapiens
uauuuaauaaagcuacuca

SEQ ID NO: 30267 - RNA, 18 nt, Homo sapiens
ugaguucugaucacuuuu

SEQ ID NO: 30268 - RNA, 20 nt, Homo sapiens
aaggaagcuaaauuugcaca

SEQ ID NO: 30269 - RNA, 22 nt, Homo sapiens
ccacuucaccucaucccagcca

SEQ ID NO: 30270 - RNA, 22 nt, Homo sapiens
ggagccgugaggauccacagua

SEQ ID NO: 30271 - RNA, 20 nt, Homo sapiens
ggcgaguugaagaauuucuc

SEQ ID NO: 30272 - RNA, 20 nt, Homo sapiens
ucaagaaaucaaguacuuca

SEQ ID NO: 30273 - RNA, 19 nt, Homo sapiens
ucugaaaacugauaacagg

SEQ ID NO: 30274 - RNA, 22 nt, Homo sapiens
uuauuucagagcccauccccca

SEQ ID NO: 30275 - RNA, 19 nt, Homo sapiens
acaaacaugggugguaaca

SEQ ID NO: 30276 - RNA, 23 nt, Homo sapiens
cauguaagauggcaacuguauua

SEQ ID NO: 30277 - RNA, 18 nt, Homo sapiens
aacaauaaauacuaugca

SEQ ID NO: 30278 - RNA, 17 nt, Homo sapiens
aaugcugcagucugcac

SEQ ID NO: 30279 - RNA, 17 nt, Homo sapiens
agagcaggcagagauga

SEQ ID NO: 30280 - RNA, 23 nt, Homo sapiens
cccuccccaacccacauaccucc

SEQ ID NO: 30281 - RNA, 24 nt, Homo sapiens
cccuccccaacccacauaccucca

SEQ ID NO: 30282 - RNA, 21 nt, Homo sapiens
cccugccgcggggccugugag

SEQ ID NO: 30283 - RNA, 18 nt, Homo sapiens
ccucgcgcgggcacccca

SEQ ID NO: 30284 - RNA, 21 nt, Homo sapiens
ccuggaggaucccagugagcu

SEQ ID NO: 30285 - RNA, 18 nt, Homo sapiens
cgcacagcgcggcuggga

SEQ ID NO: 30286 - RNA, 20 nt, Homo sapiens
gcccgguggaucucaggagu

SEQ ID NO: 30287 - RNA, 19 nt, Homo sapiens
gucgauauugauuacuuua

SEQ ID NO: 30288 - RNA, 20 nt, Homo sapiens
uaccugcaagaugcugcaca

SEQ ID NO: 30289 - RNA, 25 nt, Homo sapiens
ucacgcaagguccacacucauucca

SEQ ID NO: 30290 - RNA, 19 nt, Homo sapiens
ugaguuucagaauauucca

SEQ ID NO: 30291 - RNA, 18 nt, Homo sapiens
ucacaggccuugccaucu

SEQ ID NO: 30292 - RNA, 16 nt, Homo sapiens
cucccucccugccccu

SEQ ID NO: 30293 - RNA, 18 nt, Homo sapiens
uuugaugaccgccuggag

SEQ ID NO: 30294 - RNA, 20 nt, Homo sapiens
aguuguuaaacaacaugcua

SEQ ID NO: 30295 - RNA, 23 nt, Homo sapiens
ggacuuuccagugaugccacuga

SEQ ID NO: 30296 - RNA, 22 nt, Homo sapiens
caugaccuguaccugaguaucu

SEQ ID NO: 30297 - RNA, 19 nt, Homo sapiens
uucuacagucuggcucuaa

SEQ ID NO: 30298 - RNA, 19 nt, Homo sapiens
cugugcaggggggcugcgg

SEQ ID NO: 30299 - RNA, 20 nt, Homo sapiens
uaagacuuuccaucuuggca

SEQ ID NO: 30300 - RNA, 16 nt, Homo sapiens
uacaaaauucauaguu

SEQ ID NO: 30301 - RNA, 21 nt, Homo sapiens
uccaaaccacuaugcucuuca

SEQ ID NO: 30302 - RNA, 22 nt, Homo sapiens
agagaugauccagacagagaug

SEQ ID NO: 30303 - RNA, 19 nt, Homo sapiens
augucuuucucaccuucuc

SEQ ID NO: 30304 - RNA, 19 nt, Homo sapiens
cuuacagaaagauacccuc

SEQ ID NO: 30305 - RNA, 19 nt, Homo sapiens
guccaguuagcaugauuug

SEQ ID NO: 30306 - RNA, 21 nt, Homo sapiens
aaaucuugaaaaggguuucug

SEQ ID NO: 30307 - RNA, 22 nt, Homo sapiens
acacaguugcaaacaguccuca

SEQ ID NO: 30308 - RNA, 21 nt, Homo sapiens
gcuugaaauuacauucagaag

SEQ ID NO: 30309 - RNA, 19 nt, Homo sapiens
guagcuuuagcccuuuguu

SEQ ID NO: 30310 - RNA, 21 nt, Homo sapiens
uggaacuugaaguauaauuua

SEQ ID NO: 30311 - RNA, 16 nt, Homo sapiens
caugagggugugguca

SEQ ID NO: 30312 - RNA, 18 nt, Homo sapiens
cuuccagaagcaacccag

SEQ ID NO: 30313 - RNA, 17 nt, Homo sapiens
ugcaauuaaucuuuaua

SEQ ID NO: 30314 - RNA, 24 nt, Homo sapiens
uuuaguuaucccugcauuauuuuu

SEQ ID NO: 30315 - RNA, 18 nt, Homo sapiens
aauaccauucacuacuca

SEQ ID NO: 30316 - RNA, 18 nt, Homo sapiens
auggcuuauuucuaugac

SEQ ID NO: 30317 - RNA, 18 nt, Homo sapiens
ggaccccaaaugucacug

SEQ ID NO: 30318 - RNA, 23 nt, Homo sapiens
gugaaacaguugcugugaacuuu

SEQ ID NO: 30319 - RNA, 22 nt, Homo sapiens
uggcaucuucaauaugaaucua

SEQ ID NO: 30320 - RNA, 18 nt, Homo sapiens
agccucagguggcagaug

SEQ ID NO: 30321 - RNA, 17 nt, Homo sapiens
gcuuacaucccauuuug

SEQ ID NO: 30322 - RNA, 19 nt, Homo sapiens
gucuacuguuuuaaugaga

SEQ ID NO: 30323 - RNA, 21 nt, Homo sapiens
uagaaccuuagguagaacucc

SEQ ID NO: 30324 - RNA, 22 nt, Homo sapiens
uucaguuuaacaguuccuuuaa

SEQ ID NO: 30325 - RNA, 17 nt, Homo sapiens
caccaccaccguggucu

SEQ ID NO: 30326 - RNA, 21 nt, Homo sapiens
aucuugaaugagcugaucucu

SEQ ID NO: 30327 - RNA, 21 nt, Homo sapiens
gcggcugccacugugggcucu

SEQ ID NO: 30328 - RNA, 17 nt, Homo sapiens
ugccuaccuucccacuu

SEQ ID NO: 30329 - RNA, 18 nt, Homo sapiens
cccugccgauaaccagca

SEQ ID NO: 30330 - RNA, 19 nt, Homo sapiens
agucuuacucagcuaucca

SEQ ID NO: 30331 - RNA, 18 nt, Homo sapiens
uaaugaaacuguguguac

SEQ ID NO: 30332 - RNA, 17 nt, Homo sapiens
ugcauuccaagcuuuuu

SEQ ID NO: 30333 - RNA, 23 nt, Homo sapiens
ugguuguacuuuucuuauuauaa

SEQ ID NO: 30334 - RNA, 18 nt, Homo sapiens
uucuacaucacuggacac

SEQ ID NO: 30335 - RNA, 19 nt, Homo sapiens
gccugucccugacuauuga

SEQ ID NO: 30336 - RNA, 20 nt, Homo sapiens
agccccuccuguucaaaaca

SEQ ID NO: 30337 - RNA, 22 nt, Homo sapiens
ccagacaccccuccccgcacug

SEQ ID NO: 30338 - RNA, 20 nt, Homo sapiens
gugcuuuguccuggacucca

SEQ ID NO: 30339 - RNA, 21 nt, Homo sapiens
guggcccuccagcccagcuca

SEQ ID NO: 30340 - RNA, 20 nt, Homo sapiens
guguguaugacugugugacu

SEQ ID NO: 30341 - RNA, 19 nt, Homo sapiens
ucuuggccucccacuccca

SEQ ID NO: 30342 - RNA, 20 nt, Homo sapiens
acacuugggcccaugcacac

SEQ ID NO: 30343 - RNA, 22 nt, Homo sapiens
acggagucugcccaagacugca

SEQ ID NO: 30344 - RNA, 22 nt, Homo sapiens
agaagaaaugccuccccagguc

SEQ ID NO: 30345 - RNA, 22 nt, Homo sapiens
caucaucaucauccuccugugc

SEQ ID NO: 30346 - RNA, 22 nt, Homo sapiens
cuuccugggcccugguccuuca

SEQ ID NO: 30347 - RNA, 23 nt, Homo sapiens
gcagagucagauguuucugggua

SEQ ID NO: 30348 - RNA, 19 nt, Homo sapiens
acuuagagacuaauuagac

SEQ ID NO: 30349 - RNA, 17 nt, Homo sapiens
gcaauaccuucugugau

SEQ ID NO: 30350 - RNA, 18 nt, Homo sapiens
agaagggccugacguacc

SEQ ID NO: 30351 - RNA, 20 nt, Homo sapiens
agccagggaagcagccgcuc

SEQ ID NO: 30352 - RNA, 23 nt, Homo sapiens
aucuacaaccucugguucggcua

SEQ ID NO: 30353 - RNA, 21 nt, Homo sapiens
cauccucaacauccucaaagg

SEQ ID NO: 30354 - RNA, 20 nt, Homo sapiens
ccgaucuccuacuacaagcc

SEQ ID NO: 30355 - RNA, 16 nt, Homo sapiens
ugcacaacaagcuucu

SEQ ID NO: 30356 - RNA, 21 nt, Homo sapiens
gcuguauuuggagcugagcca

SEQ ID NO: 30357 - RNA, 21 nt, Homo sapiens
acacccaccucuaaggacuca

SEQ ID NO: 30358 - RNA, 20 nt, Homo sapiens
caguguuucacugucucaac

SEQ ID NO: 30359 - RNA, 18 nt, Homo sapiens
cuauccuucucugccucu

SEQ ID NO: 30360 - RNA, 24 nt, Homo sapiens
gccugaacugucugccccugaucu

SEQ ID NO: 30361 - RNA, 15 nt, Homo sapiens
ccuuuaagaggcgga

SEQ ID NO: 30362 - RNA, 22 nt, Homo sapiens
gauguuaaaugguggacgagua

SEQ ID NO: 30363 - RNA, 20 nt, Homo sapiens
cuauaaagcaaaaacauuua

SEQ ID NO: 30364 - RNA, 19 nt, Homo sapiens
uguuugaagguauacugua

SEQ ID NO: 30365 - RNA, 21 nt, Homo sapiens
acuugaaugacuuccugguuu

SEQ ID NO: 30366 - RNA, 19 nt, Homo sapiens
caaggaaaggggaaaccca

SEQ ID NO: 30367 - RNA, 20 nt, Homo sapiens
cccacucacccucugccagg

SEQ ID NO: 30368 - RNA, 18 nt, Homo sapiens
gaccaccauccucagaag

SEQ ID NO: 30369 - RNA, 21 nt, Homo sapiens
gcaccaaaugguauuucugga

SEQ ID NO: 30370 - RNA, 20 nt, Homo sapiens
gccucuuucuggagacccca

SEQ ID NO: 30371 - RNA, 21 nt, Homo sapiens
gcuuugucaggucagcccaac

SEQ ID NO: 30372 - RNA, 22 nt, Homo sapiens
ucaacaccagaguucaguguuu

SEQ ID NO: 30373 - RNA, 20 nt, Homo sapiens
ugguuuccuggcauaaauua

SEQ ID NO: 30374 - RNA, 19 nt, Homo sapiens
caggcuccuuuucacccug

SEQ ID NO: 30375 - RNA, 23 nt, Homo sapiens
gagaagcacagcacaggggcuca

SEQ ID NO: 30376 - RNA, 23 nt, Homo sapiens
gccccuccccauccccucccucu

SEQ ID NO: 30377 - RNA, 18 nt, Homo sapiens
gggugggcccagaaggug

SEQ ID NO: 30378 - RNA, 21 nt, Homo sapiens
guuagucuucauccccacgug

SEQ ID NO: 30379 - RNA, 18 nt, Homo sapiens
agccacaccccuccugcu

SEQ ID NO: 30380 - RNA, 19 nt, Homo sapiens
gaauggaccugaguagcug

SEQ ID NO: 30381 - RNA, 20 nt, Homo sapiens
caggaucaacaggguuuguu

SEQ ID NO: 30382 - RNA, 24 nt, Homo sapiens
aggaguucuauuuguuccugggga

SEQ ID NO: 30383 - RNA, 23 nt, Homo sapiens
ccacuguggcucaucucuugcca

SEQ ID NO: 30384 - RNA, 18 nt, Homo sapiens
cugggcacuggcuggucu

SEQ ID NO: 30385 - RNA, 28 nt, Homo sapiens
cuucaguauuuguggcaguuuuaguuuu

SEQ ID NO: 30386 - RNA, 17 nt, Homo sapiens
ucuccacgcacaguguu

SEQ ID NO: 30387 - RNA, 21 nt, Homo sapiens
ucugccugacccagccacccc

SEQ ID NO: 30388 - RNA, 19 nt, Homo sapiens
aagacauccccccuccauc

SEQ ID NO: 30389 - RNA, 22 nt, Homo sapiens
cccuggucccagucccuuucca

SEQ ID NO: 30390 - RNA, 18 nt, Homo sapiens
uccagcugucgcgccagu

SEQ ID NO: 30391 - RNA, 21 nt, Homo sapiens
aagacucuaaacaaaaaccuc

SEQ ID NO: 30392 - RNA, 20 nt, Homo sapiens
aagccaucacaaaacacuau

SEQ ID NO: 30393 - RNA, 22 nt, Homo sapiens
caaaauuuagauaaccuuugaa

SEQ ID NO: 30394 - RNA, 19 nt, Homo sapiens
caucaaacuagagacccca

SEQ ID NO: 30395 - RNA, 23 nt, Homo sapiens
gaccccagcuccccuucucgcca

SEQ ID NO: 30396 - RNA, 19 nt, Homo sapiens
gcgcucagggcccgggcgg

SEQ ID NO: 30397 - RNA, 17 nt, Homo sapiens
guucaucgcagcauguu

SEQ ID NO: 30398 - RNA, 19 nt, Homo sapiens
cccagcuuccuccccgcaa

SEQ ID NO: 30399 - RNA, 17 nt, Homo sapiens
ggacgacaccgauuucc

SEQ ID NO: 30400 - RNA, 18 nt, Homo sapiens
ggcgggugaaguuugcca

SEQ ID NO: 30401 - RNA, 23 nt, Homo sapiens
accgucgcggagagguuugugga

SEQ ID NO: 30402 - RNA, 21 nt, Homo sapiens
ccauauaacaaaaauggauuc

SEQ ID NO: 30403 - RNA, 25 nt, Homo sapiens
ccucuucuuuaguugcuuucguuuu

SEQ ID NO: 30404 - RNA, 17 nt, Homo sapiens
agcuugugaaaaucuca

SEQ ID NO: 30405 - RNA, 21 nt, Homo sapiens
uccuguauggagauuugagaa

SEQ ID NO: 30406 - RNA, 24 nt, Homo sapiens
agaagggcccaccccucgccugcc

SEQ ID NO: 30407 - RNA, 18 nt, Homo sapiens
cacauggcccccaggcug

SEQ ID NO: 30408 - RNA, 21 nt, Homo sapiens
ccccaggcugcgguugccugg

SEQ ID NO: 30409 - RNA, 20 nt, Homo sapiens
cuauuuuuuacagcgagcaa

SEQ ID NO: 30410 - RNA, 18 nt, Homo sapiens
ucuccuguaacauuuuuu

SEQ ID NO: 30411 - RNA, 18 nt, Homo sapiens
gcaguuuuauuaccuuug

SEQ ID NO: 30412 - RNA, 24 nt, Homo sapiens
uacauguuguucauauucauaaca

SEQ ID NO: 30413 - RNA, 19 nt, Homo sapiens
uugcgaaagacuugaaaac

SEQ ID NO: 30414 - RNA, 18 nt, Homo sapiens
agauauaaaaacaacucc

SEQ ID NO: 30415 - RNA, 20 nt, Homo sapiens
cagcuuuagacaaaacccca

SEQ ID NO: 30416 - RNA, 21 nt, Homo sapiens
cauggauguugccuuagccuu

SEQ ID NO: 30417 - RNA, 22 nt, Homo sapiens
gcccgcaugcccuagacucacu

SEQ ID NO: 30418 - RNA, 19 nt, Homo sapiens
ggcagcguaacacgcccua

SEQ ID NO: 30419 - RNA, 18 nt, Homo sapiens
ugauuccacguugcuuuu

SEQ ID NO: 30420 - RNA, 21 nt, Homo sapiens
ugcacgcaucgaaggaucuga

SEQ ID NO: 30421 - RNA, 21 nt, Homo sapiens
ugggcgcggccgaccuggucc

SEQ ID NO: 30422 - RNA, 19 nt, Homo sapiens
cuccuccuccugccgccuc

SEQ ID NO: 30423 - RNA, 24 nt, Homo sapiens
cuucccagacucuccucugucccu

SEQ ID NO: 30424 - RNA, 20 nt, Homo sapiens
gcuguauuucacugcugcug

SEQ ID NO: 30425 - RNA, 17 nt, Homo sapiens
ccugagagguuugugga

SEQ ID NO: 30426 - RNA, 18 nt, Homo sapiens
gcccccugucucucaggg

SEQ ID NO: 30427 - RNA, 23 nt, Homo sapiens
ccuaagugguaagcaauuacuuu

SEQ ID NO: 30428 - RNA, 20 nt, Homo sapiens
uaaaacuucaaauaaaacca

SEQ ID NO: 30429 - RNA, 18 nt, Homo sapiens
ucuucugacauuacugcu

SEQ ID NO: 30430 - RNA, 21 nt, Homo sapiens
uuuucaugugucuguguuugu

SEQ ID NO: 30431 - RNA, 22 nt, Homo sapiens
aagaggacaggaaggcuucuga

SEQ ID NO: 30432 - RNA, 18 nt, Homo sapiens
acccugguggugcaguga

SEQ ID NO: 30433 - RNA, 19 nt, Homo sapiens
agaucaauucccuuacuuc

SEQ ID NO: 30434 - RNA, 21 nt, Homo sapiens
agggauuaacaagaugccaua

SEQ ID NO: 30435 - RNA, 21 nt, Homo sapiens
auguucuacuuaugcacugcc

SEQ ID NO: 30436 - RNA, 18 nt, Homo sapiens
ccccucugccaggauccu

SEQ ID NO: 30437 - RNA, 18 nt, Homo sapiens
gcuggagugcugcaggug

SEQ ID NO: 30438 - RNA, 23 nt, Homo sapiens
uccagaccacgggccaaaucccu

SEQ ID NO: 30439 - RNA, 19 nt, Homo sapiens
uggaagcaguuccaccaca

SEQ ID NO: 30440 - RNA, 22 nt, Homo sapiens
ugggugggcacccgucaggcug

SEQ ID NO: 30441 - RNA, 21 nt, Homo sapiens
uugcaaaaccuccgagccuuc

SEQ ID NO: 30442 - RNA, 18 nt, Homo sapiens
gucgagccacuugcuuug

SEQ ID NO: 30443 - RNA, 18 nt, Homo sapiens
agaccaugaauuauggca

SEQ ID NO: 30444 - RNA, 18 nt, Homo sapiens
auccugaaaaagacggug

SEQ ID NO: 30445 - RNA, 17 nt, Homo sapiens
cucauaaucauguugaa

SEQ ID NO: 30446 - RNA, 24 nt, Homo sapiens
gucauagaaaauaaaugauuuuua

SEQ ID NO: 30447 - RNA, 18 nt, Homo sapiens
accuagagcucacucucu

SEQ ID NO: 30448 - RNA, 17 nt, Homo sapiens
auaguuaugucugugua

SEQ ID NO: 30449 - RNA, 24 nt, Homo sapiens
auuugaaccaggccugccugacuc

SEQ ID NO: 30450 - RNA, 20 nt, Homo sapiens
cauccucuccucuagcaggu

SEQ ID NO: 30451 - RNA, 20 nt, Homo sapiens
ccccacccccauucccaagc

SEQ ID NO: 30452 - RNA, 21 nt, Homo sapiens
ccuucuccucaucccucccca

SEQ ID NO: 30453 - RNA, 19 nt, Homo sapiens
gaagccaacauagagacug

SEQ ID NO: 30454 - RNA, 22 nt, Homo sapiens
gggaaggcgcggcggcggcggc

SEQ ID NO: 30455 - RNA, 17 nt, Homo sapiens
gggccugccauuacuca

SEQ ID NO: 30456 - RNA, 20 nt, Homo sapiens
ucaacagcaucuucauugua

SEQ ID NO: 30457 - RNA, 18 nt, Homo sapiens
uccagaaaguuuguacca

SEQ ID NO: 30458 - RNA, 23 nt, Homo sapiens
uguuccuucacuuaauaauauca

SEQ ID NO: 30459 - RNA, 19 nt, Homo sapiens
gauggaaacagggccacuu

SEQ ID NO: 30460 - RNA, 20 nt, Homo sapiens
uccaggugccccaccuauuu

SEQ ID NO: 30461 - RNA, 23 nt, Homo sapiens
accacaccugcacuucugccuca

SEQ ID NO: 30462 - RNA, 16 nt, Homo sapiens
ccugcacuucugccuc

SEQ ID NO: 30463 - RNA, 17 nt, Homo sapiens
gaaaaaggguguccagu

SEQ ID NO: 30464 - RNA, 24 nt, Homo sapiens
ucccaucaugggggcccauccuca

SEQ ID NO: 30465 - RNA, 18 nt, Homo sapiens
uccggaccucaugaucca

SEQ ID NO: 30466 - RNA, 20 nt, Homo sapiens
ugcacguucaucuaugugug

SEQ ID NO: 30467 - RNA, 18 nt, Homo sapiens
ugcuuuacagaugauugc

SEQ ID NO: 30468 - RNA, 21 nt, Homo sapiens
cgaggcugcugcuggcuguga

SEQ ID NO: 30469 - RNA, 21 nt, Homo sapiens
acauuucauugugauacugua

SEQ ID NO: 30470 - RNA, 23 nt, Homo sapiens
cuuaagaaaugcaauaauccuuu

SEQ ID NO: 30471 - RNA, 19 nt, Homo sapiens
cuugagacugagucucucc

SEQ ID NO: 30472 - RNA, 24 nt, Homo sapiens
guguguguaagugcauuuguauua

SEQ ID NO: 30473 - RNA, 22 nt, Homo sapiens
ugacaauagugcccacaccuua

SEQ ID NO: 30474 - RNA, 17 nt, Homo sapiens
ugcuguuaguuucuauu

SEQ ID NO: 30475 - RNA, 22 nt, Homo sapiens
uucuguuggccaggacacagau

SEQ ID NO: 30476 - RNA, 22 nt, Homo sapiens
acuucucucuagcuguaucuaa

SEQ ID NO: 30477 - RNA, 18 nt, Homo sapiens
ggaaacagaaacucgcag

SEQ ID NO: 30478 - RNA, 19 nt, Homo sapiens
aauuuuuuaugucucugga

SEQ ID NO: 30479 - RNA, 21 nt, Homo sapiens
gccucucccucuuccucugcu

SEQ ID NO: 30480 - RNA, 25 nt, Homo sapiens
ugaagaguugcuaggauucagagua

SEQ ID NO: 30481 - RNA, 22 nt, Homo sapiens
aaacccccuuuaaaacaaaaca

SEQ ID NO: 30482 - RNA, 23 nt, Homo sapiens
auggaguuuaaaauuggaaugca

SEQ ID NO: 30483 - RNA, 22 nt, Homo sapiens
ccaaccugaaaugucuguuaua

SEQ ID NO: 30484 - RNA, 19 nt, Homo sapiens
uuucccagagcaugguguu

SEQ ID NO: 30485 - RNA, 21 nt, Homo sapiens
acaggaaagacgggcauuaca

SEQ ID NO: 30486 - RNA, 21 nt, Homo sapiens
aggcuaguuccagccccaguc

SEQ ID NO: 30487 - RNA, 21 nt, Homo sapiens
aucuuggcucacugcaaccuc

SEQ ID NO: 30488 - RNA, 18 nt, Homo sapiens
ccugcaaccuccaccucc

SEQ ID NO: 30489 - RNA, 22 nt, Homo sapiens
ccuggguaauuuuuguauuuuu

SEQ ID NO: 30490 - RNA, 19 nt, Homo sapiens
cgucuccuggguucuugau

SEQ ID NO: 30491 - RNA, 18 nt, Homo sapiens
cuguuaucugagcaugaa

SEQ ID NO: 30492 - RNA, 20 nt, Homo sapiens
cuucugcccuguauaccuca

SEQ ID NO: 30493 - RNA, 19 nt, Homo sapiens
gucauuaaaaacagcauua

SEQ ID NO: 30494 - RNA, 18 nt, Homo sapiens
uccaccuccuggguucaa

SEQ ID NO: 30495 - RNA, 15 nt, Homo sapiens
uggcuggaaaaggga

SEQ ID NO: 30496 - RNA, 21 nt, Homo sapiens
gccugggcugucagccggccu

SEQ ID NO: 30497 - RNA, 21 nt, Homo sapiens
gcgggacccggcugccggcgg

SEQ ID NO: 30498 - RNA, 18 nt, Homo sapiens
ucuggcggcggcgguggg

SEQ ID NO: 30499 - RNA, 22 nt, Homo sapiens
aagaguagcggacguuuugcca

SEQ ID NO: 30500 - RNA, 18 nt, Homo sapiens
caaccuucaccuacuccu

SEQ ID NO: 30501 - RNA, 21 nt, Homo sapiens
ccucccccuuacuacucccca

SEQ ID NO: 30502 - RNA, 22 nt, Homo sapiens
ccuuggcggcugagccugugga

SEQ ID NO: 30503 - RNA, 23 nt, Homo sapiens
gcccgccccaccgugggcucugg

SEQ ID NO: 30504 - RNA, 20 nt, Homo sapiens
gcgcgccaccacgaccagcu

SEQ ID NO: 30505 - RNA, 20 nt, Homo sapiens
gggcgggguucuuuuuucca

SEQ ID NO: 30506 - RNA, 18 nt, Homo sapiens
uuuggaaaccucgcggua

SEQ ID NO: 30507 - RNA, 18 nt, Homo sapiens
cucuggacggugcuuuca

SEQ ID NO: 30508 - RNA, 21 nt, Homo sapiens
ggcccacgugccccgagccca

SEQ ID NO: 30509 - RNA, 24 nt, Homo sapiens
uuaaagaaaauacaaagaugcagu

SEQ ID NO: 30510 - RNA, 21 nt, Homo sapiens
uucugccucuggacggugcuu

SEQ ID NO: 30511 - RNA, 21 nt, Homo sapiens
acaguguuggguguaccaccc

SEQ ID NO: 30512 - RNA, 15 nt, Homo sapiens
accccaccaugccac

SEQ ID NO: 30513 - RNA, 23 nt, Homo sapiens
agaaaugccaagaaggcugaguc

SEQ ID NO: 30514 - RNA, 20 nt, Homo sapiens
cccgcccccgcuuggcacca

SEQ ID NO: 30515 - RNA, 20 nt, Homo sapiens
cgcggagcgggcggguggga

SEQ ID NO: 30516 - RNA, 18 nt, Homo sapiens
cugcaccaccaccgacac

SEQ ID NO: 30517 - RNA, 18 nt, Homo sapiens
cuguccugcccccaagga

SEQ ID NO: 30518 - RNA, 22 nt, Homo sapiens
gaggccacccgcagggcccaga

SEQ ID NO: 30519 - RNA, 15 nt, Homo sapiens
gcuuggcaccacuuc

SEQ ID NO: 30520 - RNA, 25 nt, Homo sapiens
acccacgccgcaccucauccgugca

SEQ ID NO: 30521 - RNA, 21 nt, Homo sapiens
auuucuuuaggaaguuaccca

SEQ ID NO: 30522 - RNA, 18 nt, Homo sapiens
cuccacacaguaacauuu

SEQ ID NO: 30523 - RNA, 17 nt, Homo sapiens
guauccauaguugucau

SEQ ID NO: 30524 - RNA, 18 nt, Homo sapiens
cucuucaccagcaaccag

SEQ ID NO: 30525 - RNA, 23 nt, Homo sapiens
gagggccaagggcuggaaccucc

SEQ ID NO: 30526 - RNA, 24 nt, Homo sapiens
gcgucugcaccugugucugcucgg

SEQ ID NO: 30527 - RNA, 19 nt, Homo sapiens
aguucgccuucucgcccga

SEQ ID NO: 30528 - RNA, 19 nt, Homo sapiens
ccauaacccucccugcuga

SEQ ID NO: 30529 - RNA, 19 nt, Homo sapiens
cccacaccagcggcuggag

SEQ ID NO: 30530 - RNA, 22 nt, Homo sapiens
ccgccccaguacagccugcuga

SEQ ID NO: 30531 - RNA, 17 nt, Homo sapiens
cgccacccuccaccccc

SEQ ID NO: 30532 - RNA, 23 nt, Homo sapiens
gccugagucggagagccuguucc

SEQ ID NO: 30533 - RNA, 19 nt, Homo sapiens
cugacaggcagcugcacca

SEQ ID NO: 30534 - RNA, 16 nt, Homo sapiens
uccagaguguugccag

SEQ ID NO: 30535 - RNA, 21 nt, Homo sapiens
uggguggacagacaggggcug

SEQ ID NO: 30536 - RNA, 22 nt, Homo sapiens
accacgcccaccccuccccucu

SEQ ID NO: 30537 - RNA, 17 nt, Homo sapiens
cacuuucuucuccauuc

SEQ ID NO: 30538 - RNA, 19 nt, Homo sapiens
cauccucucccucacccca

SEQ ID NO: 30539 - RNA, 21 nt, Homo sapiens
aagguguaacaccuuugcagu

SEQ ID NO: 30540 - RNA, 24 nt, Homo sapiens
agcauguaaaucaggaacaacuuu

SEQ ID NO: 30541 - RNA, 17 nt, Homo sapiens
auugacaaucccauaau

SEQ ID NO: 30542 - RNA, 17 nt, Homo sapiens
cccuggugcuguuccag

SEQ ID NO: 30543 - RNA, 19 nt, Homo sapiens
ugcccuggugcuguuccag

SEQ ID NO: 30544 - RNA, 16 nt, Homo sapiens
cccagaaaugucucag

SEQ ID NO: 30545 - RNA, 15 nt, Homo sapiens
acuguugcuuggccc

SEQ ID NO: 30546 - RNA, 18 nt, Homo sapiens
augcuaugucacuauuca

SEQ ID NO: 30547 - RNA, 24 nt, Homo sapiens
gcaaguuuaaauauuugagcuuua

SEQ ID NO: 30548 - RNA, 20 nt, Homo sapiens
ggcauuugguaacucaaaga

SEQ ID NO: 30549 - RNA, 19 nt, Homo sapiens
gcuuccacacacuuauuua

SEQ ID NO: 30550 - RNA, 20 nt, Homo sapiens
uuugguauaguauaaguuca

SEQ ID NO: 30551 - RNA, 21 nt, Homo sapiens
aaacaccaccaaagaaaauaa

SEQ ID NO: 30552 - RNA, 19 nt, Homo sapiens
acccaucccccuaccacua

SEQ ID NO: 30553 - RNA, 22 nt, Homo sapiens
accuaucagcccuucggucuca

SEQ ID NO: 30554 - RNA, 17 nt, Homo sapiens
agacacaaacacaugga

SEQ ID NO: 30555 - RNA, 19 nt, Homo sapiens
cacacccaccacucccauc

SEQ ID NO: 30556 - RNA, 19 nt, Homo sapiens
uaaaaacaccaccaaagaa

SEQ ID NO: 30557 - RNA, 21 nt, Homo sapiens
agaaacuucucccucaccccc

SEQ ID NO: 30558 - RNA, 19 nt, Homo sapiens
aggaaacacccccaggagg

SEQ ID NO: 30559 - RNA, 20 nt, Homo sapiens
cagagcccaacucaaggcuu

SEQ ID NO: 30560 - RNA, 19 nt, Homo sapiens
gcacugaccuguagugaaa

SEQ ID NO: 30561 - RNA, 21 nt, Homo sapiens
ggcuuaaauggcaccagacuc

SEQ ID NO: 30562 - RNA, 18 nt, Homo sapiens
ugucuugguugcugcucu

SEQ ID NO: 30563 - RNA, 23 nt, Homo sapiens
acuugaacugaaauuauuggcuu

SEQ ID NO: 30564 - RNA, 21 nt, Homo sapiens
aguuuucuuucuuuuuaaagc

SEQ ID NO: 30565 - RNA, 20 nt, Homo sapiens
ucaccgcaaccuccaccucc

SEQ ID NO: 30566 - RNA, 18 nt, Homo sapiens
uccaccucccggguucaa

SEQ ID NO: 30567 - RNA, 19 nt, Homo sapiens
uuaaauauucaaauaauua

SEQ ID NO: 30568 - RNA, 20 nt, Homo sapiens
uuccagaaaaugagauucca

SEQ ID NO: 30569 - RNA, 22 nt, Homo sapiens
ugcaagcuccaggaagcacuga

SEQ ID NO: 30570 - RNA, 21 nt, Homo sapiens
aaaguugggaaaacuccagca

SEQ ID NO: 30571 - RNA, 18 nt, Homo sapiens
cacacaugagcucacaca

SEQ ID NO: 30572 - RNA, 20 nt, Homo sapiens
cacuuccaaugccaguuuga

SEQ ID NO: 30573 - RNA, 21 nt, Homo sapiens
ccuccccagugccucuuccag

SEQ ID NO: 30574 - RNA, 18 nt, Homo sapiens
ccugcaaccuccaccucc

SEQ ID NO: 30575 - RNA, 20 nt, Homo sapiens
cucuccuuccugauucugau

SEQ ID NO: 30576 - RNA, 22 nt, Homo sapiens
ggcucugaccuaugucuuugaa

SEQ ID NO: 30577 - RNA, 23 nt, Homo sapiens
gugugugccaccaugcuuggcua

SEQ ID NO: 30578 - RNA, 18 nt, Homo sapiens
uccaccucccggguucaa

SEQ ID NO: 30579 - RNA, 20 nt, Homo sapiens
ucugaaaacacuuccaaugc

SEQ ID NO: 30580 - RNA, 21 nt, Homo sapiens
ugaggccauucauauucugua

SEQ ID NO: 30581 - RNA, 21 nt, Homo sapiens
uggauuccuagucagagguga

SEQ ID NO: 30582 - RNA, 20 nt, Homo sapiens
uucagcgcugaacuguacua

SEQ ID NO: 30583 - RNA, 22 nt, Homo sapiens
gcuuccccuucuccucuggcuc

SEQ ID NO: 30584 - RNA, 18 nt, Homo sapiens
gcugcugcuggugagcuu

SEQ ID NO: 30585 - RNA, 22 nt, Homo sapiens
ccucacccacaaagagaagaca

SEQ ID NO: 30586 - RNA, 21 nt, Homo sapiens
cuccccguccuccugcucccu

SEQ ID NO: 30587 - RNA, 18 nt, Homo sapiens
cuuggaggggacuggugg

SEQ ID NO: 30588 - RNA, 18 nt, Homo sapiens
ugaagacaggugcuccgg

SEQ ID NO: 30589 - RNA, 19 nt, Homo sapiens
aggauuugugcuccuauga

SEQ ID NO: 30590 - RNA, 20 nt, Homo sapiens
cagacguuauacauauucac

SEQ ID NO: 30591 - RNA, 18 nt, Homo sapiens
cuauccuccagauauuac

SEQ ID NO: 30592 - RNA, 16 nt, Homo sapiens
gagcuggauuuucuca

SEQ ID NO: 30593 - RNA, 23 nt, Homo sapiens
uaaauggauuucaggugcugcua

SEQ ID NO: 30594 - RNA, 20 nt, Homo sapiens
uccaaagguucuuucauucc

SEQ ID NO: 30595 - RNA, 25 nt, Homo sapiens
uuucugaaucaguuuucuuaacuuu

SEQ ID NO: 30596 - RNA, 22 nt, Homo sapiens
acuggaauucugucuccagaga

SEQ ID NO: 30597 - RNA, 19 nt, Homo sapiens
augguugucagugcauucu

SEQ ID NO: 30598 - RNA, 19 nt, Homo sapiens
ccagucuuuaggcaauggg

SEQ ID NO: 30599 - RNA, 19 nt, Homo sapiens
uggcagggccuagcugcua

SEQ ID NO: 30600 - RNA, 18 nt, Homo sapiens
accagcggugugcaggga

SEQ ID NO: 30601 - RNA, 18 nt, Homo sapiens
caagaucagagggguuca

SEQ ID NO: 30602 - RNA, 19 nt, Homo sapiens
caugugcuuccauacagug

SEQ ID NO: 30603 - RNA, 24 nt, Homo sapiens
gccaagaugauaaaaaaaaccuuc

SEQ ID NO: 30604 - RNA, 17 nt, Homo sapiens
gccacuuguggcaaaca

SEQ ID NO: 30605 - RNA, 23 nt, Homo sapiens
gccuggauagacugccugcgucc

SEQ ID NO: 30606 - RNA, 20 nt, Homo sapiens
ggguuucugaagcuuuugca

SEQ ID NO: 30607 - RNA, 20 nt, Homo sapiens
uauguucagaagccaacaaa

SEQ ID NO: 30608 - RNA, 25 nt, Homo sapiens
ucacaccacauuacacaugugcuuc

SEQ ID NO: 30609 - RNA, 22 nt, Homo sapiens
uugcuguugggcacaccuggau

SEQ ID NO: 30610 - RNA, 20 nt, Homo sapiens
uuucaucacagaacaguguu

SEQ ID NO: 30611 - RNA, 22 nt, Homo sapiens
uaccuugcagcuguauugcuca

SEQ ID NO: 30612 - RNA, 22 nt, Homo sapiens
uuuggguggaagaggcauagaa

SEQ ID NO: 30613 - RNA, 19 nt, Homo sapiens
aggucacagaagccaacga

SEQ ID NO: 30614 - RNA, 18 nt, Homo sapiens
cugggcuacagcaagcca

SEQ ID NO: 30615 - RNA, 18 nt, Homo sapiens
cuguuuccuccgccccca

SEQ ID NO: 30616 - RNA, 18 nt, Homo sapiens
gcccuccgccccgcccca

SEQ ID NO: 30617 - RNA, 21 nt, Homo sapiens
gccucucagugccccugcccu

SEQ ID NO: 30618 - RNA, 19 nt, Homo sapiens
uccugcccuccucuuccuc

SEQ ID NO: 30619 - RNA, 17 nt, Homo sapiens
uuccuaccuccuucacc

SEQ ID NO: 30620 - RNA, 18 nt, Homo sapiens
acucucuggaaguucugg

SEQ ID NO: 30621 - RNA, 19 nt, Homo sapiens
agacaucacccacaagggg

SEQ ID NO: 30622 - RNA, 20 nt, Homo sapiens
cccgcggauggcagucugga

SEQ ID NO: 30623 - RNA, 24 nt, Homo sapiens
cucugaugauggagaugaagugaa

SEQ ID NO: 30624 - RNA, 16 nt, Homo sapiens
gccccaccuuugcaaa

SEQ ID NO: 30625 - RNA, 25 nt, Homo sapiens
aacaaaacgauaauauuucacauca

SEQ ID NO: 30626 - RNA, 24 nt, Homo sapiens
agcacugcugaacagacaacuagc

SEQ ID NO: 30627 - RNA, 20 nt, Homo sapiens
cacugaccaaucaccccaac

SEQ ID NO: 30628 - RNA, 22 nt, Homo sapiens
cauacccccugcccuccucuga

SEQ ID NO: 30629 - RNA, 21 nt, Homo sapiens
cucugaagugaagaucuggaa

SEQ ID NO: 30630 - RNA, 17 nt, Homo sapiens
uucuuccuccuucuggu

SEQ ID NO: 30631 - RNA, 20 nt, Homo sapiens
ugucugccaagccagcccca

SEQ ID NO: 30632 - RNA, 18 nt, Homo sapiens
auaccucugaguuccuga

SEQ ID NO: 30633 - RNA, 21 nt, Homo sapiens
auuuuuuuuuuccauugguuu

SEQ ID NO: 30634 - RNA, 16 nt, Homo sapiens
gagggccggacaaaag

SEQ ID NO: 30635 - RNA, 19 nt, Homo sapiens
aguauuaccccaccugucc

SEQ ID NO: 30636 - RNA, 20 nt, Homo sapiens
gcaguguugugguuuuuguu

SEQ ID NO: 30637 - RNA, 16 nt, Homo sapiens
ugcaggccaagcucuu

SEQ ID NO: 30638 - RNA, 19 nt, Homo sapiens
aacugaucauggcuuccca

SEQ ID NO: 30639 - RNA, 22 nt, Homo sapiens
caaaaauguggaaggccuccca

SEQ ID NO: 30640 - RNA, 18 nt, Homo sapiens
gaaaaagccucaguuucc

SEQ ID NO: 30641 - RNA, 22 nt, Homo sapiens
gucaaaacaguuuuguggaacu

SEQ ID NO: 30642 - RNA, 18 nt, Homo sapiens
uucuuaauacuguaccac

SEQ ID NO: 30643 - RNA, 24 nt, Homo sapiens
aggauaauuugcauauccaucacc

SEQ ID NO: 30644 - RNA, 18 nt, Homo sapiens
aguauugcauaacuuuaa

SEQ ID NO: 30645 - RNA, 19 nt, Homo sapiens
auccuggugguaggucucu

SEQ ID NO: 30646 - RNA, 20 nt, Homo sapiens
caaaggauauaaaugacuaa

SEQ ID NO: 30647 - RNA, 18 nt, Homo sapiens
ccugagccugcauggccu

SEQ ID NO: 30648 - RNA, 22 nt, Homo sapiens
gacaagccugagcaacauauca

SEQ ID NO: 30649 - RNA, 19 nt, Homo sapiens
gacgcaggcgccauugcac

SEQ ID NO: 30650 - RNA, 18 nt, Homo sapiens
gagcagcuacguaaccug

SEQ ID NO: 30651 - RNA, 18 nt, Homo sapiens
gccauaucacugagggua

SEQ ID NO: 30652 - RNA, 17 nt, Homo sapiens
ggaucaggcagcuccaa

SEQ ID NO: 30653 - RNA, 18 nt, Homo sapiens
uuacaccuucuuucugua

SEQ ID NO: 30654 - RNA, 20 nt, Homo sapiens
uuauacauauuuguagggua

SEQ ID NO: 30655 - RNA, 21 nt, Homo sapiens
aagcuuucugucagaauucaa

SEQ ID NO: 30656 - RNA, 20 nt, Homo sapiens
accaauaugaggaaugugca

SEQ ID NO: 30657 - RNA, 18 nt, Homo sapiens
accaaaaccaaacagaga

SEQ ID NO: 30658 - RNA, 19 nt, Homo sapiens
accacgaccaccguggcca

SEQ ID NO: 30659 - RNA, 17 nt, Homo sapiens
accuaaggggcagguga

SEQ ID NO: 30660 - RNA, 20 nt, Homo sapiens
caagaaaagggcagucccca

SEQ ID NO: 30661 - RNA, 21 nt, Homo sapiens
cagaagaauuggaccagguca

SEQ ID NO: 30662 - RNA, 19 nt, Homo sapiens
ccaccaggggcauuaggua

SEQ ID NO: 30663 - RNA, 21 nt, Homo sapiens
cgugaccaggaggaacagccu

SEQ ID NO: 30664 - RNA, 19 nt, Homo sapiens
cuccaugccacacgggugg

SEQ ID NO: 30665 - RNA, 19 nt, Homo sapiens
cuccucugccgcuguccca

SEQ ID NO: 30666 - RNA, 19 nt, Homo sapiens
cuuccacaacuuuccucca

SEQ ID NO: 30667 - RNA, 23 nt, Homo sapiens
cuugacauugggccuacacugua

SEQ ID NO: 30668 - RNA, 18 nt, Homo sapiens
cuuuuuccauuuauuuaa

SEQ ID NO: 30669 - RNA, 20 nt, Homo sapiens
gacacagcacucacagccca

SEQ ID NO: 30670 - RNA, 18 nt, Homo sapiens
gaccaccguggccaucug

SEQ ID NO: 30671 - RNA, 22 nt, Homo sapiens
gcaccucuuucuuccucuguca

SEQ ID NO: 30672 - RNA, 17 nt, Homo sapiens
ggacacgccacacccag

SEQ ID NO: 30673 - RNA, 18 nt, Homo sapiens
ugucuguggggcagcaga

SEQ ID NO: 30674 - RNA, 23 nt, Homo sapiens
aucugggccgccucacccggcuc

SEQ ID NO: 30675 - RNA, 28 nt, Homo sapiens
auugugaauaaguggaauacagcucuca

SEQ ID NO: 30676 - RNA, 18 nt, Homo sapiens
cacagacucgcacuguca

SEQ ID NO: 30677 - RNA, 22 nt, Homo sapiens
caggaugucaccacccaugcca

SEQ ID NO: 30678 - RNA, 18 nt, Homo sapiens
cccagacuuucucaucca

SEQ ID NO: 30679 - RNA, 22 nt, Homo sapiens
ccccacucuccuauaagcauga

SEQ ID NO: 30680 - RNA, 22 nt, Homo sapiens
ccccauccgucucuucugcaga

SEQ ID NO: 30681 - RNA, 19 nt, Homo sapiens
cugccuggccagcugcccc

SEQ ID NO: 30682 - RNA, 19 nt, Homo sapiens
cuuggcaaccuccuggccc

SEQ ID NO: 30683 - RNA, 25 nt, Homo sapiens
gaagacaugcccccagaacauguca

SEQ ID NO: 30684 - RNA, 21 nt, Homo sapiens
gagaucaucaccuccaccacc

SEQ ID NO: 30685 - RNA, 19 nt, Homo sapiens
ggcccggacaauccugcag

SEQ ID NO: 30686 - RNA, 19 nt, Homo sapiens
gugaaggccaaggcugacu

SEQ ID NO: 30687 - RNA, 20 nt, Homo sapiens
ucuugugugagggccugugg

SEQ ID NO: 30688 - RNA, 20 nt, Homo sapiens
ugaacacccaagagcucuug

SEQ ID NO: 30689 - RNA, 21 nt, Homo sapiens
ugauggacagcaccaccaccc

SEQ ID NO: 30690 - RNA, 20 nt, Homo sapiens
ugcagacacagaaccaccuc

SEQ ID NO: 30691 - RNA, 20 nt, Homo sapiens
agguuccuaaacaacucacu

SEQ ID NO: 30692 - RNA, 18 nt, Homo sapiens
cagccugggcugacaccu

SEQ ID NO: 30693 - RNA, 17 nt, Homo sapiens
ccauuauuagauuaugu

SEQ ID NO: 30694 - RNA, 18 nt, Homo sapiens
gccugggcugacaccugg

SEQ ID NO: 30695 - RNA, 26 nt, Homo sapiens
acaccccgaagcccaccugcaaucuc

SEQ ID NO: 30696 - RNA, 15 nt, Homo sapiens
ccugcaaucucccac

SEQ ID NO: 30697 - RNA, 19 nt, Homo sapiens
gaccaaccugaccuacaug

SEQ ID NO: 30698 - RNA, 22 nt, Homo sapiens
ugcugugaaaagcuucauucca

SEQ ID NO: 30699 - RNA, 19 nt, Homo sapiens
aagucugauggagaccaca

SEQ ID NO: 30700 - RNA, 22 nt, Homo sapiens
aaugugggaaaacuuucaauca

SEQ ID NO: 30701 - RNA, 22 nt, Homo sapiens
aaugugggaaacucuucaugug

SEQ ID NO: 30702 - RNA, 19 nt, Homo sapiens
accagaaaauccacacugg

SEQ ID NO: 30703 - RNA, 22 nt, Homo sapiens
agaccuagguacuaaaauucca

SEQ ID NO: 30704 - RNA, 18 nt, Homo sapiens
cagcacuuugggaagcca

SEQ ID NO: 30705 - RNA, 22 nt, Homo sapiens
gagccaagaucaugccacugca

SEQ ID NO: 30706 - RNA, 21 nt, Homo sapiens
uccagggcagcucagaccuca

SEQ ID NO: 30707 - RNA, 22 nt, Homo sapiens
uuacaaugcuguacagugagag

SEQ ID NO: 30708 - RNA, 19 nt, Homo sapiens
uucauaccagagagaaacc

SEQ ID NO: 30709 - RNA, 19 nt, Homo sapiens
aggagaauagugguugcca

SEQ ID NO: 30710 - RNA, 25 nt, Homo sapiens
aaaaaaucauuucuagauuauuuuu

SEQ ID NO: 30711 - RNA, 24 nt, Homo sapiens
uacacucugauuuucaagcuccuc

SEQ ID NO: 30712 - RNA, 18 nt, Homo sapiens
uuucuuuguagcuacuug

SEQ ID NO: 30713 - RNA, 18 nt, Homo sapiens
cauuuccccaggccaagu

SEQ ID NO: 30714 - RNA, 19 nt, Homo sapiens
ccucucugggccugugcag

SEQ ID NO: 30715 - RNA, 21 nt, Homo sapiens
ccuugguaacugauggacuca

SEQ ID NO: 30716 - RNA, 18 nt, Homo sapiens
gaccuuagcauggggcua

SEQ ID NO: 30717 - RNA, 18 nt, Homo sapiens
gaccuuagcauggggcua

SEQ ID NO: 30718 - RNA, 19 nt, Homo sapiens
aaaacaaaaaccccacaaa

SEQ ID NO: 30719 - RNA, 21 nt, Homo sapiens
ccuacccagccugcugccuca

SEQ ID NO: 30720 - RNA, 28 nt, Homo sapiens
ccuuaauggagaaaaaaaaaccuaauaa

SEQ ID NO: 30721 - RNA, 21 nt, Homo sapiens
cagaaggaggaggaccuggga

SEQ ID NO: 30722 - RNA, 18 nt, Homo sapiens
gccugcagugugaggcug

SEQ ID NO: 30723 - RNA, 24 nt, Homo sapiens
ggauucuucaaacgcucccuccca

SEQ ID NO: 30724 - RNA, 23 nt, Homo sapiens
uaggaaauccauucacaguucuu

SEQ ID NO: 30725 - RNA, 18 nt, Homo sapiens
acccaggccccccaccca

SEQ ID NO: 30726 - RNA, 18 nt, Homo sapiens
guccaguccaagcccacc

SEQ ID NO: 30727 - RNA, 19 nt, Homo sapiens
ccaauuccacauuucugaa

SEQ ID NO: 30728 - RNA, 18 nt, Homo sapiens
cugauaucauauuccucc

SEQ ID NO: 30729 - RNA, 25 nt, Homo sapiens
gcuucucccugucuuccucuccucu

SEQ ID NO: 30730 - RNA, 18 nt, Homo sapiens
ucucuacuaaaaauacaa

SEQ ID NO: 30731 - RNA, 19 nt, Homo sapiens
uggguggaucgccugagau

SEQ ID NO: 30732 - RNA, 18 nt, Homo sapiens
uugcacuacugcauucca

SEQ ID NO: 30733 - RNA, 19 nt, Homo sapiens
agucugcaguuagagccaa

SEQ ID NO: 30734 - RNA, 22 nt, Homo sapiens
gacagaggaaucccccaaacua

SEQ ID NO: 30735 - RNA, 22 nt, Homo sapiens
gagccaagaucaggccacugca

SEQ ID NO: 30736 - RNA, 18 nt, Homo sapiens
ugacagaggaauccccca

SEQ ID NO: 30737 - RNA, 17 nt, Homo sapiens
uggggaagaucugagag

SEQ ID NO: 30738 - RNA, 18 nt, Homo sapiens
cuuccuucaugcacauca

SEQ ID NO: 30739 - RNA, 22 nt, Homo sapiens
guguauggacagcuuacucgac

SEQ ID NO: 30740 - RNA, 22 nt, Homo sapiens
guuccuuccuucaugcacauca

SEQ ID NO: 30741 - RNA, 17 nt, Homo sapiens
ucagaguacucacacug

SEQ ID NO: 30742 - RNA, 19 nt, Homo sapiens
cauugaguaccuccugccc

SEQ ID NO: 30743 - RNA, 24 nt, Homo sapiens
cccuggugacccggggucagcgga

SEQ ID NO: 30744 - RNA, 18 nt, Homo sapiens
uccuuuaaggucuuugga

SEQ ID NO: 30745 - RNA, 18 nt, Homo sapiens
aacuccuggaagacccga

SEQ ID NO: 30746 - RNA, 19 nt, Homo sapiens
accuccccaccaagccucc

SEQ ID NO: 30747 - RNA, 16 nt, Homo sapiens
agaaaugaaaugucau

SEQ ID NO: 30748 - RNA, 24 nt, Homo sapiens
caguggugcaaucauagccuuaaa

SEQ ID NO: 30749 - RNA, 24 nt, Homo sapiens
ccccuccagaggucucgcucgcag

SEQ ID NO: 30750 - RNA, 24 nt, Homo sapiens
cgcccaccccccccgaccccacca

SEQ ID NO: 30751 - RNA, 20 nt, Homo sapiens
gccucuauccuccuuucgag

SEQ ID NO: 30752 - RNA, 22 nt, Homo sapiens
uccuggugguuggggaccgugg

SEQ ID NO: 30753 - RNA, 21 nt, Homo sapiens
ucucaccuccccaccaagccu

SEQ ID NO: 30754 - RNA, 18 nt, Homo sapiens
ugaauuuuccuggcucca

SEQ ID NO: 30755 - RNA, 25 nt, Homo sapiens
aaguacccacaccuuuggccaguaa

SEQ ID NO: 30756 - RNA, 19 nt, Homo sapiens
caaguuucccaaguccuca

SEQ ID NO: 30757 - RNA, 20 nt, Homo sapiens
caguuagcucuaaauucugg

SEQ ID NO: 30758 - RNA, 20 nt, Homo sapiens
gcuacuuuucugcagggaua

SEQ ID NO: 30759 - RNA, 20 nt, Homo sapiens
guuaccuucuccauacacua

SEQ ID NO: 30760 - RNA, 19 nt, Homo sapiens
ucauguugaaugcauuugu

SEQ ID NO: 30761 - RNA, 23 nt, Homo sapiens
ucauugaugaauacaaguaccca

SEQ ID NO: 30762 - RNA, 22 nt, Homo sapiens
aaaaaaauuaaaacucuguaua

SEQ ID NO: 30763 - RNA, 18 nt, Homo sapiens
aggcaauuucguuccugg

SEQ ID NO: 30764 - RNA, 20 nt, Homo sapiens
auccagacuguuucagccca

SEQ ID NO: 30765 - RNA, 20 nt, Homo sapiens
cacaggcaucagcaguccca

SEQ ID NO: 30766 - RNA, 19 nt, Homo sapiens
cacguaccauuggcuguaa

SEQ ID NO: 30767 - RNA, 22 nt, Homo sapiens
caggcaucagcagucccauuca

SEQ ID NO: 30768 - RNA, 19 nt, Homo sapiens
cagguuaucccuugcucug

SEQ ID NO: 30769 - RNA, 18 nt, Homo sapiens
ccacccccuuccaccucc

SEQ ID NO: 30770 - RNA, 24 nt, Homo sapiens
ccagacugacgcugaaaucccuca

SEQ ID NO: 30771 - RNA, 21 nt, Homo sapiens
ccagggcuacuaaagacuuca

SEQ ID NO: 30772 - RNA, 19 nt, Homo sapiens
ccuccuuagacugagcugu

SEQ ID NO: 30773 - RNA, 21 nt, Homo sapiens
ccugccuccaccucccacccc

SEQ ID NO: 30774 - RNA, 21 nt, Homo sapiens
ccuuuagucuguaaaacuccu

SEQ ID NO: 30775 - RNA, 19 nt, Homo sapiens
gcaccccaaugccaggaua

SEQ ID NO: 30776 - RNA, 20 nt, Homo sapiens
ucaccaucauaugccccaaa

SEQ ID NO: 30777 - RNA, 23 nt, Homo sapiens
uccggaucaguacaugcauguca

SEQ ID NO: 30778 - RNA, 21 nt, Homo sapiens
ugccaggagccagcuguguga

SEQ ID NO: 30779 - RNA, 26 nt, Homo sapiens
uuuccuugggaaucugccucccucca

SEQ ID NO: 30780 - RNA, 18 nt, Homo sapiens
agacacugcuucuucuca

SEQ ID NO: 30781 - RNA, 17 nt, Homo sapiens
aucuugaccucuggcuu

SEQ ID NO: 30782 - RNA, 26 nt, Homo sapiens
augguccucaucccgaugggaaacug

SEQ ID NO: 30783 - RNA, 17 nt, Homo sapiens
auuaagaaaacauggug

SEQ ID NO: 30784 - RNA, 22 nt, Homo sapiens
cagccuggccaacauaaugaaa

SEQ ID NO: 30785 - RNA, 20 nt, Homo sapiens
ccaauaauaccgucaauuga

SEQ ID NO: 30786 - RNA, 24 nt, Homo sapiens
ccucaucaaggccuccucgcuccu

SEQ ID NO: 30787 - RNA, 22 nt, Homo sapiens
gcacccagcagcaucugccuca

SEQ ID NO: 30788 - RNA, 22 nt, Homo sapiens
gcccaagugagacagaaccuca

SEQ ID NO: 30789 - RNA, 18 nt, Homo sapiens
gcuguggcaaucgucccc

SEQ ID NO: 30790 - RNA, 22 nt, Homo sapiens
gggggugggggggcaccaagca

SEQ ID NO: 30791 - RNA, 19 nt, Homo sapiens
guuuuggucgucacagcag

SEQ ID NO: 30792 - RNA, 27 nt, Homo sapiens
ugcguggacuggauguguccccagaau

SEQ ID NO: 30793 - RNA, 22 nt, Homo sapiens
uggccacuuugaccuggggcug

SEQ ID NO: 30794 - RNA, 21 nt, Homo sapiens
aacacgugggcauuuauuguu

SEQ ID NO: 30795 - RNA, 20 nt, Homo sapiens
acuuacuuugugucuaggaa

SEQ ID NO: 30796 - RNA, 17 nt, Homo sapiens
auuuuuaggguaucaua

SEQ ID NO: 30797 - RNA, 22 nt, Homo sapiens
ccuaggugcaauuagguuguuu

SEQ ID NO: 30798 - RNA, 23 nt, Homo sapiens
cuuugguuuuugauaccugugga

SEQ ID NO: 30799 - RNA, 23 nt, Homo sapiens
gcaguuuuaauacugcuguguca

SEQ ID NO: 30800 - RNA, 21 nt, Homo sapiens
ugagguagagcugugcauuaa

SEQ ID NO: 30801 - RNA, 21 nt, Homo sapiens
ugggauugccaggcugugguu

SEQ ID NO: 30802 - RNA, 19 nt, Homo sapiens
ccaaagccaggggcccacc

SEQ ID NO: 30803 - RNA, 19 nt, Homo sapiens
ccaggaaggaaacccugug

SEQ ID NO: 30804 - RNA, 23 nt, Homo sapiens
gaaccaggaaggaaacccugugg

SEQ ID NO: 30805 - RNA, 26 nt, Homo sapiens
gccugggccagccugccuccuggccu

SEQ ID NO: 30806 - RNA, 17 nt, Homo sapiens
ugucuguggaguucagg

SEQ ID NO: 30807 - RNA, 23 nt, Homo sapiens
aaagccagguuacgcaacaggca

SEQ ID NO: 30808 - RNA, 18 nt, Homo sapiens
agaauaaaggcaaccagu

SEQ ID NO: 30809 - RNA, 17 nt, Homo sapiens
gauccaucccuugagcu

SEQ ID NO: 30810 - RNA, 18 nt, Homo sapiens
aaggaacuggcaugcaca

SEQ ID NO: 30811 - RNA, 19 nt, Homo sapiens
cccaccaggcccucuguug

SEQ ID NO: 30812 - RNA, 21 nt, Homo sapiens
ccuggaggaaggacugacugg

SEQ ID NO: 30813 - RNA, 17 nt, Homo sapiens
ccuggcucgagcacaca

SEQ ID NO: 30814 - RNA, 17 nt, Homo sapiens
gcccccagcaccccugc

SEQ ID NO: 30815 - RNA, 22 nt, Homo sapiens
gcccccagcaccccugccugcu

SEQ ID NO: 30816 - RNA, 22 nt, Homo sapiens
ccaguucuccaucccccacccc

SEQ ID NO: 30817 - RNA, 18 nt, Homo sapiens
cccacccucccccauucc

SEQ ID NO: 30818 - RNA, 19 nt, Homo sapiens
ccugugugaccguuggccc

SEQ ID NO: 30819 - RNA, 20 nt, Homo sapiens
ccuugauguuuagcacuuua

SEQ ID NO: 30820 - RNA, 24 nt, Homo sapiens
cggggcgcacccccagcuaccucc

SEQ ID NO: 30821 - RNA, 17 nt, Homo sapiens
cuccaggccugcccacu

SEQ ID NO: 30822 - RNA, 19 nt, Homo sapiens
cuggccucaccuccaccca

SEQ ID NO: 30823 - RNA, 20 nt, Homo sapiens
gguugccccuccucauggga

SEQ ID NO: 30824 - RNA, 18 nt, Homo sapiens
ugcccacucccuacgcug

SEQ ID NO: 30825 - RNA, 17 nt, Homo sapiens
accccgagggcaccuca

SEQ ID NO: 30826 - RNA, 24 nt, Homo sapiens
accgggucccuccaggcugcugcc

SEQ ID NO: 30827 - RNA, 20 nt, Homo sapiens
aggaaagagaguuccaaucc

SEQ ID NO: 30828 - RNA, 16 nt, Homo sapiens
ccucccaggccccugc

SEQ ID NO: 30829 - RNA, 17 nt, Homo sapiens
ccugcugcccaagucac

SEQ ID NO: 30830 - RNA, 24 nt, Homo sapiens
ccuuccccagaggccuacccccca

SEQ ID NO: 30831 - RNA, 19 nt, Homo sapiens
cugccuggcccugcucccc

SEQ ID NO: 30832 - RNA, 23 nt, Homo sapiens
cuuuggccagagagaccugugag

SEQ ID NO: 30833 - RNA, 17 nt, Homo sapiens
gcucgauuguuugguuu

SEQ ID NO: 30834 - RNA, 22 nt, Homo sapiens
uccauggccacucccugccccc

SEQ ID NO: 30835 - RNA, 18 nt, Homo sapiens
ucuuucucucccgucuca

SEQ ID NO: 30836 - RNA, 19 nt, Homo sapiens
aguaagauacagguuucuu

SEQ ID NO: 30837 - RNA, 22 nt, Homo sapiens
gcuugggcuguuguacggguuc

SEQ ID NO: 30838 - RNA, 20 nt, Homo sapiens
guccuuuaguuuccacugga

SEQ ID NO: 30839 - RNA, 23 nt, Homo sapiens
uuguuucuucuguuauacuauca

SEQ ID NO: 30840 - RNA, 16 nt, Homo sapiens
acauacacaagaucca

SEQ ID NO: 30841 - RNA, 21 nt, Homo sapiens
cucacccuacuuccaaauuac

SEQ ID NO: 30842 - RNA, 23 nt, Homo sapiens
aaacccagcccacagccaccucu

SEQ ID NO: 30843 - RNA, 22 nt, Homo sapiens
accugagcugcccauccugccu

SEQ ID NO: 30844 - RNA, 23 nt, Homo sapiens
caacggcuccaagacuccccuuc

SEQ ID NO: 30845 - RNA, 22 nt, Homo sapiens
cccagguggacccacccaacga

SEQ ID NO: 30846 - RNA, 18 nt, Homo sapiens
cuggccacacucucugaa

SEQ ID NO: 30847 - RNA, 17 nt, Homo sapiens
gucugaaaaaccuggug

SEQ ID NO: 30848 - RNA, 33 nt, Homo sapiens
ucgacccgccccuucuguccacucccggcccca

SEQ ID NO: 30849 - RNA, 18 nt, Homo sapiens
cuugacacauuuugaaca

SEQ ID NO: 30850 - RNA, 21 nt, Homo sapiens
acgcccucagccgccuugcca

SEQ ID NO: 30851 - RNA, 21 nt, Homo sapiens
caacaggcagaggcuacccua

SEQ ID NO: 30852 - RNA, 21 nt, Homo sapiens
cgcccccagccgcgcgcccca

SEQ ID NO: 30853 - RNA, 18 nt, Homo sapiens
ggccgacgccucccccca

SEQ ID NO: 30854 - RNA, 23 nt, Homo sapiens
aauugcuacccaacauuacuguu

SEQ ID NO: 30855 - RNA, 22 nt, Homo sapiens
cauuccaaauugcuacccaaca

SEQ ID NO: 30856 - RNA, 18 nt, Homo sapiens
uuguuucucacaugcaua

SEQ ID NO: 30857 - RNA, 21 nt, Homo sapiens
caggaaugcugccuuccuuca

SEQ ID NO: 30858 - RNA, 22 nt, Homo sapiens
cgcaacagcucuguaccccugc

SEQ ID NO: 30859 - RNA, 21 nt, Homo sapiens
uccacccucuccccuguuccu

SEQ ID NO: 30860 - RNA, 24 nt, Homo sapiens
uuuugaggauugcagaccugugga

SEQ ID NO: 30861 - RNA, 17 nt, Homo sapiens
agaaaagacaugcucca

SEQ ID NO: 30862 - RNA, 20 nt, Homo sapiens
ccucugccuccuggguucaa

SEQ ID NO: 30863 - RNA, 19 nt, Homo sapiens
gaauuccugguguuucauc

SEQ ID NO: 30864 - RNA, 18 nt, Homo sapiens
uacaaaaagaaucugcca

SEQ ID NO: 30865 - RNA, 24 nt, Homo sapiens
uauagauuaagcccuauaaugcua

SEQ ID NO: 30866 - RNA, 22 nt, Homo sapiens
ugcugucuccuaaggucaccca

SEQ ID NO: 30867 - RNA, 21 nt, Homo sapiens
cauggacagcaucaucacuga

SEQ ID NO: 30868 - RNA, 22 nt, Homo sapiens
gccugggcuccagcuuuggcuc

SEQ ID NO: 30869 - RNA, 21 nt, Homo sapiens
gugcuguccauggacagcagc

SEQ ID NO: 30870 - RNA, 16 nt, Homo sapiens
uuuggcucuggcacag

SEQ ID NO: 30871 - RNA, 19 nt, Homo sapiens
agcuccguuaagcacacac

SEQ ID NO: 30872 - RNA, 17 nt, Homo sapiens
aguagaacacucauuug

SEQ ID NO: 30873 - RNA, 21 nt, Homo sapiens
ccagagucaggccugcuguua

SEQ ID NO: 30874 - RNA, 16 nt, Homo sapiens
ccaggggguuugggga

SEQ ID NO: 30875 - RNA, 20 nt, Homo sapiens
ccccuccaggccagugugca

SEQ ID NO: 30876 - RNA, 24 nt, Homo sapiens
ccuagauuucccuggcucacuuuu

SEQ ID NO: 30877 - RNA, 23 nt, Homo sapiens
cucugcaccaggggguuugggga

SEQ ID NO: 30878 - RNA, 23 nt, Homo sapiens
ucuuaucugcugcuuugugucuu

SEQ ID NO: 30879 - RNA, 22 nt, Homo sapiens
agucucacuuugucaccuaagc

SEQ ID NO: 30880 - RNA, 19 nt, Homo sapiens
cuuuugguaacucugggga

SEQ ID NO: 30881 - RNA, 22 nt, Homo sapiens
uaaagacuucucuaagauaaug

SEQ ID NO: 30882 - RNA, 21 nt, Homo sapiens
uaauuccaaaauacugguauc

SEQ ID NO: 30883 - RNA, 17 nt, Homo sapiens
uucuccugccuuagccu

SEQ ID NO: 30884 - RNA, 23 nt, Homo sapiens
aucacaugcagcuucugcucuua

SEQ ID NO: 30885 - RNA, 19 nt, Homo sapiens
augguuucagcaugggcua

SEQ ID NO: 30886 - RNA, 17 nt, Homo sapiens
gauucggaauggaacua

SEQ ID NO: 30887 - RNA, 19 nt, Homo sapiens
guuggugccccugccauca

SEQ ID NO: 30888 - RNA, 23 nt, Homo sapiens
uaaauauaaagucaagacuaacu

SEQ ID NO: 30889 - RNA, 21 nt, Homo sapiens
ucagaaaggcagacucucuca

SEQ ID NO: 30890 - RNA, 21 nt, Homo sapiens
aaaccuggcagauaccaccuu

SEQ ID NO: 30891 - RNA, 20 nt, Homo sapiens
auuugaacccaggucugccc

SEQ ID NO: 30892 - RNA, 21 nt, Homo sapiens
ucaaaagaaagccuggugguu

SEQ ID NO: 30893 - RNA, 20 nt, Homo sapiens
cauuugagaaacaugacaaa

SEQ ID NO: 30894 - RNA, 19 nt, Homo sapiens
cgaccccaccucuguuccu

SEQ ID NO: 30895 - RNA, 19 nt, Homo sapiens
ucggcgccgccuccugcca

SEQ ID NO: 30896 - RNA, 18 nt, Homo sapiens
ugggaguagccccacugc

SEQ ID NO: 30897 - RNA, 18 nt, Homo sapiens
auguccuacccacaacuc

SEQ ID NO: 30898 - RNA, 20 nt, Homo sapiens
aaaaacaaaaaacaaacaaa

SEQ ID NO: 30899 - RNA, 20 nt, Homo sapiens
cagugguguaaucaugacua

SEQ ID NO: 30900 - RNA, 16 nt, Homo sapiens
ccccaugauucaguua

SEQ ID NO: 30901 - RNA, 20 nt, Homo sapiens
auaauaccacuagggccucu

SEQ ID NO: 30902 - RNA, 18 nt, Homo sapiens
cugacucagaaucugaug

SEQ ID NO: 30903 - RNA, 23 nt, Homo sapiens
cuucucccaaagcgccacugaaa

SEQ ID NO: 30904 - RNA, 25 nt, Homo sapiens
uuuuuugcagagguaucaguuuaug

SEQ ID NO: 30905 - RNA, 19 nt, Homo sapiens
gcagagcauggcccuccua

SEQ ID NO: 30906 - RNA, 18 nt, Homo sapiens
ccaggcaguuuggcacca

SEQ ID NO: 30907 - RNA, 18 nt, Homo sapiens
cccaaccucacgcagcuc

SEQ ID NO: 30908 - RNA, 21 nt, Homo sapiens
cugagcugaaaacuucacucc

SEQ ID NO: 30909 - RNA, 21 nt, Homo sapiens
gcaccauucucaucuuucuca

SEQ ID NO: 30910 - RNA, 20 nt, Homo sapiens
gccagaccccugacacgccc

SEQ ID NO: 30911 - RNA, 22 nt, Homo sapiens
gcguuggccacuggugcauuuu

SEQ ID NO: 30912 - RNA, 17 nt, Homo sapiens
ggcuguguuguuugcuc

SEQ ID NO: 30913 - RNA, 24 nt, Homo sapiens
gucucagaucuugaugugugacua

SEQ ID NO: 30914 - RNA, 26 nt, Homo sapiens
gucugaaccugccguguucuuggcuu

SEQ ID NO: 30915 - RNA, 22 nt, Homo sapiens
aacguguauucucuuugaacua

SEQ ID NO: 30916 - RNA, 17 nt, Homo sapiens
cggggccgcaucugccu

SEQ ID NO: 30917 - RNA, 18 nt, Homo sapiens
aggccccagcauuguuca

SEQ ID NO: 30918 - RNA, 21 nt, Homo sapiens
aauuuacagguuaccaacuca

SEQ ID NO: 30919 - RNA, 17 nt, Homo sapiens
auggcuuaauucugaca

SEQ ID NO: 30920 - RNA, 24 nt, Homo sapiens
cugcacuccagccugggugucaga

SEQ ID NO: 30921 - RNA, 19 nt, Homo sapiens
gcuaguaacugugauacca

SEQ ID NO: 30922 - RNA, 21 nt, Homo sapiens
ggcaucauagaaggcccugga

SEQ ID NO: 30923 - RNA, 21 nt, Homo sapiens
ggccaaagggaaguuguauua

SEQ ID NO: 30924 - RNA, 18 nt, Homo sapiens
ugugauaccauacuauaa

SEQ ID NO: 30925 - RNA, 23 nt, Homo sapiens
acuuuagcauguuguugaucaug

SEQ ID NO: 30926 - RNA, 23 nt, Homo sapiens
gcagcaagcugagggucuuuguu

SEQ ID NO: 30927 - RNA, 21 nt, Homo sapiens
agcaagcaagaugggguucuc

SEQ ID NO: 30928 - RNA, 20 nt, Homo sapiens
cuccugaagaaaaagccuau

SEQ ID NO: 30929 - RNA, 21 nt, Homo sapiens
gaugugggauggcagcagcca

SEQ ID NO: 30930 - RNA, 20 nt, Homo sapiens
gugcauugucaguuacguca

SEQ ID NO: 30931 - RNA, 20 nt, Homo sapiens
ucugagaaaccacccagugc

SEQ ID NO: 30932 - RNA, 18 nt, Homo sapiens
uucuccccuacccaggga

SEQ ID NO: 30933 - RNA, 21 nt, Homo sapiens
acaaagacucagccaagaguu

SEQ ID NO: 30934 - RNA, 18 nt, Homo sapiens
acuggccuugaucagugu

SEQ ID NO: 30935 - RNA, 21 nt, Homo sapiens
agguacggcggcaaugugagg

SEQ ID NO: 30936 - RNA, 19 nt, Homo sapiens
ccaaccccuagaucccacc

SEQ ID NO: 30937 - RNA, 17 nt, Homo sapiens
ccacucugguacuauca

SEQ ID NO: 30938 - RNA, 20 nt, Homo sapiens
ucucuuuauucccuuugauc

SEQ ID NO: 30939 - RNA, 18 nt, Homo sapiens
cgggagagcugcuggcca

SEQ ID NO: 30940 - RNA, 22 nt, Homo sapiens
aagaugcauaguugaccaguca

SEQ ID NO: 30941 - RNA, 19 nt, Homo sapiens
accagaagagacaucuauu

SEQ ID NO: 30942 - RNA, 16 nt, Homo sapiens
auccugagccauggug

SEQ ID NO: 30943 - RNA, 24 nt, Homo sapiens
auuuguacugaaauuguacaugau

SEQ ID NO: 30944 - RNA, 18 nt, Homo sapiens
aaaguugggauuuggcag

SEQ ID NO: 30945 - RNA, 20 nt, Homo sapiens
agaaaaaucuuuacccaaau

SEQ ID NO: 30946 - RNA, 17 nt, Homo sapiens
augcccugacuguucca

SEQ ID NO: 30947 - RNA, 17 nt, Homo sapiens
ugacagggacacaacca

SEQ ID NO: 30948 - RNA, 21 nt, Homo sapiens
uuugguccccucacauuuggc

SEQ ID NO: 30949 - RNA, 22 nt, Homo sapiens
cuucugaacuuuguuuugaccu

SEQ ID NO: 30950 - RNA, 21 nt, Homo sapiens
uguguucauguauuuucugaa

SEQ ID NO: 30951 - RNA, 24 nt, Homo sapiens
gagggccgggacagcuuuccucuc

SEQ ID NO: 30952 - RNA, 24 nt, Homo sapiens
gccugggcugagggucucuggccc

SEQ ID NO: 30953 - RNA, 17 nt, Homo sapiens
ucuucagcccucgcucu

SEQ ID NO: 30954 - RNA, 16 nt, Homo sapiens
aggccugagguacuca

SEQ ID NO: 30955 - RNA, 20 nt, Homo sapiens
gaaugcaaguuuaauuacca

SEQ ID NO: 30956 - RNA, 23 nt, Homo sapiens
gcuuggaaaaaucuugcuuggcu

SEQ ID NO: 30957 - RNA, 19 nt, Homo sapiens
aguggugguguuaccucac

SEQ ID NO: 30958 - RNA, 19 nt, Homo sapiens
ccugaacuguggguggcug

SEQ ID NO: 30959 - RNA, 21 nt, Homo sapiens
ucugccugagaucccacccca

SEQ ID NO: 30960 - RNA, 17 nt, Homo sapiens
acugccagcucugcucc

SEQ ID NO: 30961 - RNA, 20 nt, Homo sapiens
agcugucccgucccccagga

SEQ ID NO: 30962 - RNA, 20 nt, Homo sapiens
auggugaaaccccaugucua

SEQ ID NO: 30963 - RNA, 21 nt, Homo sapiens
cacacgcauacacacaugaac

SEQ ID NO: 30964 - RNA, 17 nt, Homo sapiens
cacaugcacaugugcac

SEQ ID NO: 30965 - RNA, 19 nt, Homo sapiens
ccagccauccccgccacca

SEQ ID NO: 30966 - RNA, 22 nt, Homo sapiens
ccuccucaccaacguguccuca

SEQ ID NO: 30967 - RNA, 21 nt, Homo sapiens
ggcaucucacacugcaaccgc

SEQ ID NO: 30968 - RNA, 19 nt, Homo sapiens
ggcccuggcuucugcgacg

SEQ ID NO: 30969 - RNA, 19 nt, Homo sapiens
uguggggguggugggggug

SEQ ID NO: 30970 - RNA, 19 nt, Homo sapiens
aaggccuacggguucaaga

SEQ ID NO: 30971 - RNA, 22 nt, Homo sapiens
accaucgucaacgugcagacca

SEQ ID NO: 30972 - RNA, 21 nt, Homo sapiens
aggacuacauggcggacgcca

SEQ ID NO: 30973 - RNA, 20 nt, Homo sapiens
gagccgcaaggcgcccaagc

SEQ ID NO: 30974 - RNA, 18 nt, Homo sapiens
gcccgaccaccacuuccu

SEQ ID NO: 30975 - RNA, 22 nt, Homo sapiens
gccuggacaccacgccgggcuc

SEQ ID NO: 30976 - RNA, 21 nt, Homo sapiens
gcggaagaagagggccuucuc

SEQ ID NO: 30977 - RNA, 18 nt, Homo sapiens
ggccuggacaccacgccg

SEQ ID NO: 30978 - RNA, 23 nt, Homo sapiens
uacuacauggagggcucugugga

SEQ ID NO: 30979 - RNA, 20 nt, Homo sapiens
uucuacuucugcaucgucac

SEQ ID NO: 30980 - RNA, 23 nt, Homo sapiens
aagaaaacgagcugagggucuaa

SEQ ID NO: 30981 - RNA, 19 nt, Homo sapiens
acccccucugcagaucuga

SEQ ID NO: 30982 - RNA, 24 nt, Homo sapiens
ccagagaccacaggagccguacca

SEQ ID NO: 30983 - RNA, 20 nt, Homo sapiens
ccuuagguggccccacgagc

SEQ ID NO: 30984 - RNA, 18 nt, Homo sapiens
cucuguguccuugcugcc

SEQ ID NO: 30985 - RNA, 20 nt, Homo sapiens
gccugaaacucucaggaguc

SEQ ID NO: 30986 - RNA, 20 nt, Homo sapiens
ugggcagcagcaugaggcug

SEQ ID NO: 30987 - RNA, 24 nt, Homo sapiens
aguguucaaaaccccagccaauga

SEQ ID NO: 30988 - RNA, 21 nt, Homo sapiens
cccaggccggagaucugcgag

SEQ ID NO: 30989 - RNA, 18 nt, Homo sapiens
cccauuucucauuuaaca

SEQ ID NO: 30990 - RNA, 23 nt, Homo sapiens
cauuccuggccccgcccccugca

SEQ ID NO: 30991 - RNA, 18 nt, Homo sapiens
aacaggacccauaucaac

SEQ ID NO: 30992 - RNA, 18 nt, Homo sapiens
aaacacagaauucaguga

SEQ ID NO: 30993 - RNA, 24 nt, Homo sapiens
cuuuacagggugcaaacagcaaga

SEQ ID NO: 30994 - RNA, 22 nt, Homo sapiens
gcaccucucuggucuucccuuu

SEQ ID NO: 30995 - RNA, 19 nt, Homo sapiens
gccuuuucaucacuacccg

SEQ ID NO: 30996 - RNA, 20 nt, Homo sapiens
uaccagauucgugucacugc

SEQ ID NO: 30997 - RNA, 18 nt, Homo sapiens
uuugauguaacuucucac

SEQ ID NO: 30998 - RNA, 19 nt, Homo sapiens
aggagcuggaccccaguga

SEQ ID NO: 30999 - RNA, 17 nt, Homo sapiens
caaagaaauggagaccc

SEQ ID NO: 31000 - RNA, 20 nt, Homo sapiens
gcaggcuucucucccugcca

SEQ ID NO: 31001 - RNA, 21 nt, Homo sapiens
gggaaagagcccagccugcca

SEQ ID NO: 31002 - RNA, 20 nt, Homo sapiens
gugggucacacaagcccuua

SEQ ID NO: 31003 - RNA, 23 nt, Homo sapiens
uaaauggauguugcuugaagcug

SEQ ID NO: 31004 - RNA, 17 nt, Homo sapiens
ugggcucacaaaacuga

SEQ ID NO: 31005 - RNA, 22 nt, Homo sapiens
gccccuguaggucccucuggga

SEQ ID NO: 31006 - RNA, 19 nt, Homo sapiens
ugggggucaggacaauuuu

SEQ ID NO: 31007 - RNA, 23 nt, Homo sapiens
uucuuuggccugggugguuuaua

SEQ ID NO: 31008 - RNA, 23 nt, Homo sapiens
cccugcccggcggggccugugaa

SEQ ID NO: 31009 - RNA, 19 nt, Homo sapiens
cugcccgaacucccaccuc

SEQ ID NO: 31010 - RNA, 18 nt, Homo sapiens
cuuaaugcugguccuuca

SEQ ID NO: 31011 - RNA, 18 nt, Homo sapiens
gcaccaccaccaccaccu

SEQ ID NO: 31012 - RNA, 25 nt, Homo sapiens
gccucaucgccguggccgucugccu

SEQ ID NO: 31013 - RNA, 19 nt, Homo sapiens
gcuuuggcacccaccaagg

SEQ ID NO: 31014 - RNA, 19 nt, Homo sapiens
gugccuggagccugggcca

SEQ ID NO: 31015 - RNA, 18 nt, Homo sapiens
ugaauaugcaaugggagu

SEQ ID NO: 31016 - RNA, 19 nt, Homo sapiens
aggacuaccagcuugcuca

SEQ ID NO: 31017 - RNA, 16 nt, Homo sapiens
ccagcuugcucaguua

SEQ ID NO: 31018 - RNA, 16 nt, Homo sapiens
ccaucucaguuugcaa

SEQ ID NO: 31019 - RNA, 19 nt, Homo sapiens
cuugcccucgaauucugca

SEQ ID NO: 31020 - RNA, 21 nt, Homo sapiens
gcuguuuccuccuccuccccc

SEQ ID NO: 31021 - RNA, 17 nt, Homo sapiens
guucaaucacugauggg

SEQ ID NO: 31022 - RNA, 20 nt, Homo sapiens
aauguuuaugauauguuaaa

SEQ ID NO: 31023 - RNA, 20 nt, Homo sapiens
aggagaaagagaaauaaccu

SEQ ID NO: 31024 - RNA, 21 nt, Homo sapiens
ccuuuuuauuucaguuuagcc

SEQ ID NO: 31025 - RNA, 21 nt, Homo sapiens
gcaauagauucauucagugga

SEQ ID NO: 31026 - RNA, 18 nt, Homo sapiens
gccauccuguauacacca

SEQ ID NO: 31027 - RNA, 16 nt, Homo sapiens
uggcauucucuagcaa

SEQ ID NO: 31028 - RNA, 22 nt, Homo sapiens
aucuuggcucacugcagccucu

SEQ ID NO: 31029 - RNA, 21 nt, Homo sapiens
caccaucaccauccuuuuuca

SEQ ID NO: 31030 - RNA, 18 nt, Homo sapiens
caucaccauccuuuuuca

SEQ ID NO: 31031 - RNA, 20 nt, Homo sapiens
ccucugccuccuggguucaa

SEQ ID NO: 31032 - RNA, 16 nt, Homo sapiens
gccuuuuugccacuca

SEQ ID NO: 31033 - RNA, 24 nt, Homo sapiens
uaaaaacauaucagaacaaaugaa

SEQ ID NO: 31034 - RNA, 18 nt, Homo sapiens
ucaccauuugccuguaaa

SEQ ID NO: 31035 - RNA, 20 nt, Homo sapiens
ucauuugucacagugacuca

SEQ ID NO: 31036 - RNA, 20 nt, Homo sapiens
ugggugggcucuaaauuugg

SEQ ID NO: 31037 - RNA, 17 nt, Homo sapiens
cugaacaauccauuuga

SEQ ID NO: 31038 - RNA, 18 nt, Homo sapiens
gaauuucuuguagucaua

SEQ ID NO: 31039 - RNA, 18 nt, Homo sapiens
uagcuucaagaauuucuu

SEQ ID NO: 31040 - RNA, 17 nt, Homo sapiens
cauguaccgugcugcag

SEQ ID NO: 31041 - RNA, 20 nt, Homo sapiens
cucaucaguaauauucacca

SEQ ID NO: 31042 - RNA, 19 nt, Homo sapiens
cuugagauuaugagacuga

SEQ ID NO: 31043 - RNA, 18 nt, Homo sapiens
ugaaccggagacaucacu

SEQ ID NO: 31044 - RNA, 22 nt, Homo sapiens
uuagcuuucucccauuaccuca

SEQ ID NO: 31045 - RNA, 22 nt, Homo sapiens
uccacggccagccccucccuca

SEQ ID NO: 31046 - RNA, 21 nt, Homo sapiens
gucccacccaccucugccucc

SEQ ID NO: 31047 - RNA, 20 nt, Homo sapiens
acaaaaauuagcugggcguu

SEQ ID NO: 31048 - RNA, 18 nt, Homo sapiens
agacauuuagguaucuca

SEQ ID NO: 31049 - RNA, 21 nt, Homo sapiens
cacugccuuuugcccucgcca

SEQ ID NO: 31050 - RNA, 23 nt, Homo sapiens
ccccugggcccugaauggagcua

SEQ ID NO: 31051 - RNA, 22 nt, Homo sapiens
cuaucccaagugugauccuuca

SEQ ID NO: 31052 - RNA, 24 nt, Homo sapiens
uccaccuagggccaccuaguggua

SEQ ID NO: 31053 - RNA, 17 nt, Homo sapiens
acaaaagcuagccugga

SEQ ID NO: 31054 - RNA, 20 nt, Homo sapiens
cauaccccagccugcacuga

SEQ ID NO: 31055 - RNA, 20 nt, Homo sapiens
gcccccacccgccauccucu

SEQ ID NO: 31056 - RNA, 21 nt, Homo sapiens
agagcaagcacaucuccaucu

SEQ ID NO: 31057 - RNA, 20 nt, Homo sapiens
aggagguaccagcaccugcc

SEQ ID NO: 31058 - RNA, 19 nt, Homo sapiens
caagcacaucuccaucucu

SEQ ID NO: 31059 - RNA, 16 nt, Homo sapiens
cccagcccugucccag

SEQ ID NO: 31060 - RNA, 24 nt, Homo sapiens
ccccacccggaggaccccugcggc

SEQ ID NO: 31061 - RNA, 23 nt, Homo sapiens
ccuccccaccauucccguacuca

SEQ ID NO: 31062 - RNA, 16 nt, Homo sapiens
cucccuccucuacucu

SEQ ID NO: 31063 - RNA, 22 nt, Homo sapiens
cugggcuagagcaagcacaucu

SEQ ID NO: 31064 - RNA, 18 nt, Homo sapiens
gagaugggggaccugugg

SEQ ID NO: 31065 - RNA, 17 nt, Homo sapiens
gagucgcccagguuagc

SEQ ID NO: 31066 - RNA, 23 nt, Homo sapiens
ucucagggugaggagcugccagu

SEQ ID NO: 31067 - RNA, 19 nt, Homo sapiens
ugccccaucccaucccccu

SEQ ID NO: 31068 - RNA, 22 nt, Homo sapiens
uggcuccucagcccacagaggg

SEQ ID NO: 31069 - RNA, 20 nt, Homo sapiens
ugggcuggcuggcaugaggc

SEQ ID NO: 31070 - RNA, 24 nt, Homo sapiens
uguguggaacgaguucuuggaaug

SEQ ID NO: 31071 - RNA, 22 nt, Homo sapiens
ccccacccacucccuacagucc

SEQ ID NO: 31072 - RNA, 20 nt, Homo sapiens
cugcccccaaugccccgagg

SEQ ID NO: 31073 - RNA, 21 nt, Homo sapiens
uucugacccacugggauuugc

SEQ ID NO: 31074 - RNA, 18 nt, Homo sapiens
agaugugacucagauccu

SEQ ID NO: 31075 - RNA, 20 nt, Homo sapiens
agcuguggcugcuuguuuca

SEQ ID NO: 31076 - RNA, 21 nt, Homo sapiens
aguguguggggggugugugug

SEQ ID NO: 31077 - RNA, 23 nt, Homo sapiens
auaaagcuguggcugcuuguuuc

SEQ ID NO: 31078 - RNA, 18 nt, Homo sapiens
caucuuaaaguuggagca

SEQ ID NO: 31079 - RNA, 20 nt, Homo sapiens
ccauccuacuuaaacaccua

SEQ ID NO: 31080 - RNA, 24 nt, Homo sapiens
ccugucugaaccccucguucuuca

SEQ ID NO: 31081 - RNA, 18 nt, Homo sapiens
cuucaccugccaccucgu

SEQ ID NO: 31082 - RNA, 20 nt, Homo sapiens
cuuggguuuucaaguugcuu

SEQ ID NO: 31083 - RNA, 19 nt, Homo sapiens
cuuggugucgguuugggag

SEQ ID NO: 31084 - RNA, 19 nt, Homo sapiens
gaaggaccucagacauuuu

SEQ ID NO: 31085 - RNA, 20 nt, Homo sapiens
gcaaggcauucuuggguuuu

SEQ ID NO: 31086 - RNA, 18 nt, Homo sapiens
gucacaugauaaaaguuu

SEQ ID NO: 31087 - RNA, 25 nt, Homo sapiens
ucuuuuuauacuuugucuuguuuuu

SEQ ID NO: 31088 - RNA, 18 nt, Homo sapiens
ugcgugugcacaugugug

SEQ ID NO: 31089 - RNA, 20 nt, Homo sapiens
uuuugaugaugguuguguga

SEQ ID NO: 31090 - RNA, 20 nt, Homo sapiens
accuuuucuaugucuaaaua

SEQ ID NO: 31091 - RNA, 17 nt, Homo sapiens
ugacuucaacuuuggca

SEQ ID NO: 31092 - RNA, 18 nt, Homo sapiens
ucuuccucucuuucauuc

SEQ ID NO: 31093 - RNA, 21 nt, Homo sapiens
agaugaaacaagaucaugaaa

SEQ ID NO: 31094 - RNA, 22 nt, Homo sapiens
agauucuaagaaaauguucaca

SEQ ID NO: 31095 - RNA, 19 nt, Homo sapiens
auugcugaaaaaugaguuu

SEQ ID NO: 31096 - RNA, 22 nt, Homo sapiens
ccacagugcccugcuuaccugc

SEQ ID NO: 31097 - RNA, 18 nt, Homo sapiens
cgggcagggaacaucaca

SEQ ID NO: 31098 - RNA, 23 nt, Homo sapiens
cuuaggaauucauaugcaccuua

SEQ ID NO: 31099 - RNA, 18 nt, Homo sapiens
gccaacccaaaugcccau

SEQ ID NO: 31100 - RNA, 24 nt, Homo sapiens
gccgccaacaaaacgucgaucacc

SEQ ID NO: 31101 - RNA, 22 nt, Homo sapiens
uaaacuaaagagcuucugcaca

SEQ ID NO: 31102 - RNA, 19 nt, Homo sapiens
ugaacaaugagaauacaug

SEQ ID NO: 31103 - RNA, 17 nt, Homo sapiens
aaguaacuacuacaggu

SEQ ID NO: 31104 - RNA, 23 nt, Homo sapiens
acgcccuucagcacccccuccca

SEQ ID NO: 31105 - RNA, 17 nt, Homo sapiens
ccacggcaacagguugc

SEQ ID NO: 31106 - RNA, 18 nt, Homo sapiens
ccugcaaccuccaccucc

SEQ ID NO: 31107 - RNA, 16 nt, Homo sapiens
gaauuuacucuacaac

SEQ ID NO: 31108 - RNA, 18 nt, Homo sapiens
gcccuucagcacccccuc

SEQ ID NO: 31109 - RNA, 24 nt, Homo sapiens
gccugagcugucuugucuguguuu

SEQ ID NO: 31110 - RNA, 21 nt, Homo sapiens
gcuuggacugcuucucugucu

SEQ ID NO: 31111 - RNA, 19 nt, Homo sapiens
gucacacaggagcccugga

SEQ ID NO: 31112 - RNA, 21 nt, Homo sapiens
gucaggauugcuauuccugcu

SEQ ID NO: 31113 - RNA, 19 nt, Homo sapiens
uaaaugcugugggaagcca

SEQ ID NO: 31114 - RNA, 20 nt, Homo sapiens
uaagcaauccucccacuuca

SEQ ID NO: 31115 - RNA, 25 nt, Homo sapiens
uacauggcucaaguuccaucugcca

SEQ ID NO: 31116 - RNA, 18 nt, Homo sapiens
uccaccucccggguucaa

SEQ ID NO: 31117 - RNA, 20 nt, Homo sapiens
uggucaggcuggucuugaac

SEQ ID NO: 31118 - RNA, 19 nt, Homo sapiens
uuucccuccccugaccucu

SEQ ID NO: 31119 - RNA, 22 nt, Homo sapiens
agaagucucaccggcagagcca

SEQ ID NO: 31120 - RNA, 22 nt, Homo sapiens
caggacaugacgccgcucagcg

SEQ ID NO: 31121 - RNA, 19 nt, Homo sapiens
cuggaaaugacuguuccag

SEQ ID NO: 31122 - RNA, 18 nt, Homo sapiens
ggagcccaagaagucuca

SEQ ID NO: 31123 - RNA, 21 nt, Homo sapiens
guaucaugcaccaacugugaa

SEQ ID NO: 31124 - RNA, 20 nt, Homo sapiens
uccaguugguccugcugcca

SEQ ID NO: 31125 - RNA, 18 nt, Homo sapiens
ccccacccggcccgcagc

SEQ ID NO: 31126 - RNA, 21 nt, Homo sapiens
ccccacccucugccccccagc

SEQ ID NO: 31127 - RNA, 24 nt, Homo sapiens
cuccgccgguccccacccucugcc

SEQ ID NO: 31128 - RNA, 23 nt, Homo sapiens
gacuauuuuaaccaauauuguca

SEQ ID NO: 31129 - RNA, 18 nt, Homo sapiens
uccagagaggcaccccag

SEQ ID NO: 31130 - RNA, 20 nt, Homo sapiens
uucaagaccagccugaccaa

SEQ ID NO: 31131 - RNA, 16 nt, Homo sapiens
uccaggaaacccgcug

SEQ ID NO: 31132 - RNA, 18 nt, Homo sapiens
cuucacccaccagcuggc

SEQ ID NO: 31133 - RNA, 21 nt, Homo sapiens
acaagcugaaggcagcagcuu

SEQ ID NO: 31134 - RNA, 18 nt, Homo sapiens
ggagaaaggaccuccugg

SEQ ID NO: 31135 - RNA, 23 nt, Homo sapiens
gguggguggagggguuugcagug

SEQ ID NO: 31136 - RNA, 22 nt, Homo sapiens
uucugucuuccuuugcuaacuu

SEQ ID NO: 31137 - RNA, 18 nt, Homo sapiens
accagcaauacaacguca

SEQ ID NO: 31138 - RNA, 23 nt, Homo sapiens
agucuccuacuucccuaccggca

SEQ ID NO: 31139 - RNA, 19 nt, Homo sapiens
auuugugaccugaaccuga

SEQ ID NO: 31140 - RNA, 19 nt, Homo sapiens
ccagacggaggaccuggaa

SEQ ID NO: 31141 - RNA, 23 nt, Homo sapiens
ccuuggcgguggaaggccccagc

SEQ ID NO: 31142 - RNA, 21 nt, Homo sapiens
cguuucagucccuuccuuggu

SEQ ID NO: 31143 - RNA, 22 nt, Homo sapiens
cugcauugacaauaaagauggg

SEQ ID NO: 31144 - RNA, 19 nt, Homo sapiens
cugucgggagcauuuguga

SEQ ID NO: 31145 - RNA, 16 nt, Homo sapiens
guacaaugacaagcac

SEQ ID NO: 31146 - RNA, 19 nt, Homo sapiens
gugaaguugggcucagccg

SEQ ID NO: 31147 - RNA, 24 nt, Homo sapiens
gugggcgaacaucuggucagcauc

SEQ ID NO: 31148 - RNA, 21 nt, Homo sapiens
ucaccaucgaaggcccaucca

SEQ ID NO: 31149 - RNA, 21 nt, Homo sapiens
uccuaaccuuacuaaagacca

SEQ ID NO: 31150 - RNA, 19 nt, Homo sapiens
cagcuagaugaucaucaua

SEQ ID NO: 31151 - RNA, 18 nt, Homo sapiens
cuguccuuucaagagcca

SEQ ID NO: 31152 - RNA, 22 nt, Homo sapiens
cuucuuuaugccacuuaggcuu

SEQ ID NO: 31153 - RNA, 19 nt, Homo sapiens
ccuggaaaggaucugggaa

SEQ ID NO: 31154 - RNA, 18 nt, Homo sapiens
cuuggguuugucuggcuu

SEQ ID NO: 31155 - RNA, 19 nt, Homo sapiens
gauauauuauuuuauucca

SEQ ID NO: 31156 - RNA, 28 nt, Homo sapiens
gccuggacaacuuggguuugucuggcuu

SEQ ID NO: 31157 - RNA, 21 nt, Homo sapiens
ucguggguaacuugcuuuugg

SEQ ID NO: 31158 - RNA, 21 nt, Homo sapiens
ugucagcuacuucauuccugu

SEQ ID NO: 31159 - RNA, 23 nt, Homo sapiens
uguguuauaaauauggcaagaaa

SEQ ID NO: 31160 - RNA, 18 nt, Homo sapiens
aacagauuaacacuggua

SEQ ID NO: 31161 - RNA, 22 nt, Homo sapiens
acuucagaggcagccaaucaua

SEQ ID NO: 31162 - RNA, 21 nt, Homo sapiens
ggaaaauauaaggaaauacug

SEQ ID NO: 31163 - RNA, 18 nt, Homo sapiens
uaucugcccaugaaaaca

SEQ ID NO: 31164 - RNA, 23 nt, Homo sapiens
agaucuaaagccuuuuuauccca

SEQ ID NO: 31165 - RNA, 18 nt, Homo sapiens
agcucuucacagaucuca

SEQ ID NO: 31166 - RNA, 22 nt, Homo sapiens
aguugugugaggauugcauuaa

SEQ ID NO: 31167 - RNA, 21 nt, Homo sapiens
cuuagugaccauuuggcauca

SEQ ID NO: 31168 - RNA, 17 nt, Homo sapiens
cuucuuuguauuaugau

SEQ ID NO: 31169 - RNA, 21 nt, Homo sapiens
gacuuagugaccauuuggcau

SEQ ID NO: 31170 - RNA, 23 nt, Homo sapiens
uaaaauuagaaucaagacagcug

SEQ ID NO: 31171 - RNA, 18 nt, Homo sapiens
uauaguggaaagcagucu

SEQ ID NO: 31172 - RNA, 17 nt, Homo sapiens
ucuguuuuguguuuacu

SEQ ID NO: 31173 - RNA, 20 nt, Homo sapiens
uuuuacuuuguuuguacaaa

SEQ ID NO: 31174 - RNA, 21 nt, Homo sapiens
agacagguuuuuggcuuauca

SEQ ID NO: 31175 - RNA, 21 nt, Homo sapiens
agaggcuugcagauuugcuuu

SEQ ID NO: 31176 - RNA, 19 nt, Homo sapiens
agcccuuuagaguuccuga

SEQ ID NO: 31177 - RNA, 23 nt, Homo sapiens
aucuuagucucuucaggaucuuu

SEQ ID NO: 31178 - RNA, 21 nt, Homo sapiens
ccaacugaaaacaacagugac

SEQ ID NO: 31179 - RNA, 20 nt, Homo sapiens
ccugaggcaucgaaugggcu

SEQ ID NO: 31180 - RNA, 23 nt, Homo sapiens
ccuuccccaugcuguugucccca

SEQ ID NO: 31181 - RNA, 22 nt, Homo sapiens
cucucucucuccucucucucuc

SEQ ID NO: 31182 - RNA, 17 nt, Homo sapiens
cucucucucucuccucu

SEQ ID NO: 31183 - RNA, 18 nt, Homo sapiens
cuugagcugaaccugguc

SEQ ID NO: 31184 - RNA, 20 nt, Homo sapiens
gaaauuaaaacaggacccca

SEQ ID NO: 31185 - RNA, 21 nt, Homo sapiens
gguuuuuggcuuaucacagca

SEQ ID NO: 31186 - RNA, 23 nt, Homo sapiens
uaaguggguauacgcugaagcug

SEQ ID NO: 31187 - RNA, 18 nt, Homo sapiens
ucucuccucauuuuaguu

SEQ ID NO: 31188 - RNA, 22 nt, Homo sapiens
uggaagcuccuaguagaggcug

SEQ ID NO: 31189 - RNA, 16 nt, Homo sapiens
uuuggagacacccagg

SEQ ID NO: 31190 - RNA, 19 nt, Homo sapiens
uuuugaugguggauaagau

SEQ ID NO: 31191 - RNA, 18 nt, Homo sapiens
aaguaacuacuuuggcuc

SEQ ID NO: 31192 - RNA, 17 nt, Homo sapiens
cauaucccucaggccuc

SEQ ID NO: 31193 - RNA, 17 nt, Homo sapiens
acacccauuucaagugu

SEQ ID NO: 31194 - RNA, 17 nt, Homo sapiens
aguuuccaaagucacag

SEQ ID NO: 31195 - RNA, 20 nt, Homo sapiens
cuucuucagacacugaacau

SEQ ID NO: 31196 - RNA, 19 nt, Homo sapiens
ggccuuugaacugcagcag

SEQ ID NO: 31197 - RNA, 23 nt, Homo sapiens
uacuuuguuuaaacuuuuuuaaa

SEQ ID NO: 31198 - RNA, 20 nt, Homo sapiens
uaggguugaucugccaccuc

SEQ ID NO: 31199 - RNA, 22 nt, Homo sapiens
ucagugguguagcuguaacuau

SEQ ID NO: 31200 - RNA, 21 nt, Homo sapiens
uccugaaccccauucaagaaa

SEQ ID NO: 31201 - RNA, 19 nt, Homo sapiens
ugaagaggcugccaaagua

SEQ ID NO: 31202 - RNA, 20 nt, Homo sapiens
ugccucuguccacauuuccc

SEQ ID NO: 31203 - RNA, 18 nt, Homo sapiens
uuucugauugcuacugug

SEQ ID NO: 31204 - RNA, 24 nt, Homo sapiens
uagcuaaaacagaaacguaaggcc

SEQ ID NO: 31205 - RNA, 19 nt, Homo sapiens
accagagaauccacacugg

SEQ ID NO: 31206 - RNA, 21 nt, Homo sapiens
caucuuagacuucaucagaca

SEQ ID NO: 31207 - RNA, 23 nt, Homo sapiens
gcaaagccuuuaaagcgucuucc

SEQ ID NO: 31208 - RNA, 19 nt, Homo sapiens
uguagcaaugcaguuauga

SEQ ID NO: 31209 - RNA, 20 nt, Homo sapiens
uuuuuuguagcaaugcaguu

SEQ ID NO: 31210 - RNA, 22 nt, Homo sapiens
cuugaguaggauucacauuuaa

SEQ ID NO: 31211 - RNA, 18 nt, Homo sapiens
uagacaucgaaacauuca

SEQ ID NO: 31212 - RNA, 19 nt, Homo sapiens
uagcacacacuuuuccuga

SEQ ID NO: 31213 - RNA, 20 nt, Homo sapiens
uuuuccugacaggcacagug

SEQ ID NO: 31214 - RNA, 19 nt, Homo sapiens
ggaucuucagcaaccagcc

SEQ ID NO: 31215 - RNA, 19 nt, Homo sapiens
aagcaauucuccugccuca

SEQ ID NO: 31216 - RNA, 19 nt, Homo sapiens
aagcaauucuccugccuca

SEQ ID NO: 31217 - RNA, 22 nt, Homo sapiens
aauguggcaaauuuuucagaca

SEQ ID NO: 31218 - RNA, 21 nt, Homo sapiens
accacuuauucaccaucaagc

SEQ ID NO: 31219 - RNA, 22 nt, Homo sapiens
aguaaugcuacaaccauugcac

SEQ ID NO: 31220 - RNA, 19 nt, Homo sapiens
auaguggagagaaaccuua

SEQ ID NO: 31221 - RNA, 22 nt, Homo sapiens
caauugaguauauaaucauuga

SEQ ID NO: 31222 - RNA, 21 nt, Homo sapiens
cacccgacuccaccucccaaa

SEQ ID NO: 31223 - RNA, 23 nt, Homo sapiens
ccuggguaauuuuuuguguuuuu

SEQ ID NO: 31224 - RNA, 24 nt, Homo sapiens
cuggguuucaccguguuagccaga

SEQ ID NO: 31225 - RNA, 20 nt, Homo sapiens
gcugacacuacaguugugug

SEQ ID NO: 31226 - RNA, 18 nt, Homo sapiens
uccacuucccagguucaa

SEQ ID NO: 31227 - RNA, 22 nt, Homo sapiens
ugaagagaaaccauacagaggu

SEQ ID NO: 31228 - RNA, 18 nt, Homo sapiens
ugucaucuacaaacaaau

SEQ ID NO: 31229 - RNA, 18 nt, Homo sapiens
uucuccugccucagccuu

SEQ ID NO: 31230 - RNA, 24 nt, Homo sapiens
agucucacucugucaccuagguug

SEQ ID NO: 31231 - RNA, 20 nt, Homo sapiens
caaccucugcgaggccugug

SEQ ID NO: 31232 - RNA, 20 nt, Homo sapiens
ccucugccucccggguucaa

SEQ ID NO: 31233 - RNA, 18 nt, Homo sapiens
ccugcccccaccuuccca

SEQ ID NO: 31234 - RNA, 23 nt, Homo sapiens
gccugagcuacugcgcuuggccc

SEQ ID NO: 31235 - RNA, 18 nt, Homo sapiens
ggacucgguugggcucgg

SEQ ID NO: 31236 - RNA, 19 nt, Homo sapiens
guaccaccccaccugccca

SEQ ID NO: 31237 - RNA, 21 nt, Homo sapiens
ugaaucugcccaguucccaca

SEQ ID NO: 31238 - RNA, 19 nt, Homo sapiens
uuccgcccgccucugccuc

SEQ ID NO: 31239 - RNA, 24 nt, Homo sapiens
aucugagaauguccuucuugguuu

SEQ ID NO: 31240 - RNA, 26 nt, Homo sapiens
cucuguuaccaguggggggccugugg

SEQ ID NO: 31241 - RNA, 20 nt, Homo sapiens
cuggagcgauugccuggccc

SEQ ID NO: 31242 - RNA, 19 nt, Homo sapiens
gaaaccuaguaaugccauc

SEQ ID NO: 31243 - RNA, 27 nt, Homo sapiens
gccugggcccccugcacugccuggucc

SEQ ID NO: 31244 - RNA, 17 nt, Homo sapiens
gggcugauggucccucc

SEQ ID NO: 31245 - RNA, 29 nt, Homo sapiens
uccccugugagccguggcuugucuggucu

SEQ ID NO: 31246 - RNA, 18 nt, Homo sapiens
uccugaacuccucaagca

SEQ ID NO: 31247 - RNA, 22 nt, Homo sapiens
uggggagguggauccucugcca

SEQ ID NO: 31248 - RNA, 24 nt, Homo sapiens
aacacuggaaaucauuuuaccaca

SEQ ID NO: 31249 - RNA, 19 nt, Homo sapiens
cccgaaaaagacuaccugg

SEQ ID NO: 31250 - RNA, 19 nt, Homo sapiens
ccuucaauaagccccacua

SEQ ID NO: 31251 - RNA, 18 nt, Homo sapiens
cuccuucuuuguucuggu

SEQ ID NO: 31252 - RNA, 18 nt, Homo sapiens
cuggacauagacaucaac

SEQ ID NO: 31253 - RNA, 18 nt, Homo sapiens
cugugagcugauccucca

SEQ ID NO: 31254 - RNA, 19 nt, Homo sapiens
gcuccaagagauaacacau

SEQ ID NO: 31255 - RNA, 18 nt, Homo sapiens
gucugacugcagaugcca

SEQ ID NO: 31256 - RNA, 18 nt, Homo sapiens
ugaugggaacaucuacca

SEQ ID NO: 31257 - RNA, 24 nt, Homo sapiens
uucuggggcaaggagagcuugugg

SEQ ID NO: 31258 - RNA, 20 nt, Homo sapiens
caacccuuauuccacugccu

SEQ ID NO: 31259 - RNA, 19 nt, Homo sapiens
uucuucccugccuuaccuu

SEQ ID NO: 31260 - RNA, 19 nt, Homo sapiens
aaacacagaagacuauuuc

SEQ ID NO: 31261 - RNA, 19 nt, Homo sapiens
aagcaauucuccugccuca

SEQ ID NO: 31262 - RNA, 24 nt, Homo sapiens
caccacuagugccucuggauuuag

SEQ ID NO: 31263 - RNA, 24 nt, Homo sapiens
ccucuuuuaaauguacuugacuuu

SEQ ID NO: 31264 - RNA, 18 nt, Homo sapiens
cuguguucacacugaauu

SEQ ID NO: 31265 - RNA, 19 nt, Homo sapiens
ucuccugccucagccuucg

SEQ ID NO: 31266 - RNA, 21 nt, Homo sapiens
auuugggcuaaaguuuggcuu

SEQ ID NO: 31267 - RNA, 17 nt, Homo sapiens
cucaccuccucugccuu

SEQ ID NO: 31268 - RNA, 18 nt, Homo sapiens
cuucucuggcucugcccu

SEQ ID NO: 31269 - RNA, 22 nt, Homo sapiens
uccacugucuucccugguggag

SEQ ID NO: 31270 - RNA, 16 nt, Homo sapiens
ugagugaguaugugug

SEQ ID NO: 31271 - RNA, 17 nt, Homo sapiens
acaaaaguagccuuaca

SEQ ID NO: 31272 - RNA, 23 nt, Homo sapiens
auaaauguuaugaaaaggcagaa

SEQ ID NO: 31273 - RNA, 18 nt, Homo sapiens
ccugauaagcucugugaa

SEQ ID NO: 31274 - RNA, 18 nt, Homo sapiens
ggagcccagcugggauug

SEQ ID NO: 31275 - RNA, 17 nt, Homo sapiens
uaagcccaagucauuuu

SEQ ID NO: 31276 - RNA, 21 nt, Homo sapiens
ucacccuguuuacaugccaua

SEQ ID NO: 31277 - RNA, 26 nt, Homo sapiens
ucuuuucauguuaaaagccuuaaucu

SEQ ID NO: 31278 - RNA, 18 nt, Homo sapiens
ugugcgcuuauugucuca

SEQ ID NO: 31279 - RNA, 22 nt, Homo sapiens
agucucccaccacccugcuggc

SEQ ID NO: 31280 - RNA, 24 nt, Homo sapiens
auguggagaugggacaguggguga

SEQ ID NO: 31281 - RNA, 16 nt, Homo sapiens
caagcacuccugccuc

SEQ ID NO: 31282 - RNA, 23 nt, Homo sapiens
ccauccuccacccaggcacuucc

SEQ ID NO: 31283 - RNA, 22 nt, Homo sapiens
ccuucagagcgaggaucugugg

SEQ ID NO: 31284 - RNA, 22 nt, Homo sapiens
gccugggucucugauuuggccu

SEQ ID NO: 31285 - RNA, 20 nt, Homo sapiens
uaauccugggagacagguca

SEQ ID NO: 31286 - RNA, 21 nt, Homo sapiens
uaucuccgagcaaagccucca

SEQ ID NO: 31287 - RNA, 21 nt, Homo sapiens
uccaagcaccacgacucccug

SEQ ID NO: 31288 - RNA, 18 nt, Homo sapiens
uggaauaaaaccacuucu

SEQ ID NO: 31289 - RNA, 20 nt, Homo sapiens
ugggagcccaggcuccgccc

SEQ ID NO: 31290 - RNA, 17 nt, Homo sapiens
ugugccugccacuggcu

SEQ ID NO: 31291 - RNA, 19 nt, Homo sapiens
aaauuagcacaacaaagaa

SEQ ID NO: 31292 - RNA, 22 nt, Homo sapiens
agucuucauuuaauuuauuguc

SEQ ID NO: 31293 - RNA, 19 nt, Homo sapiens
ugccuccucccuguuccag

SEQ ID NO: 31294 - RNA, 23 nt, Homo sapiens
uuugaugcaauuuuaucauaaga

SEQ ID NO: 31295 - RNA, 21 nt, Homo sapiens
aucuuuaugcugcauuagaga

SEQ ID NO: 31296 - RNA, 17 nt, Homo sapiens
gcccagaaaagcaucca

SEQ ID NO: 31297 - RNA, 15 nt, Homo sapiens
gcucccaggcugcac

SEQ ID NO: 31298 - RNA, 23 nt, Homo sapiens
aucuagacguucaaguuugcaaa

SEQ ID NO: 31299 - RNA, 21 nt, Homo sapiens
ccaaugcauuccuucaacaaa

SEQ ID NO: 31300 - RNA, 23 nt, Homo sapiens
ccagggcugcacucuagauucca

SEQ ID NO: 31301 - RNA, 19 nt, Homo sapiens
cuuuuggggguucagagga

SEQ ID NO: 31302 - RNA, 24 nt, Homo sapiens
gagacauccuuucugaauacuucu

SEQ ID NO: 31303 - RNA, 21 nt, Homo sapiens
uaaaaccagguuaauggcuaa

SEQ ID NO: 31304 - RNA, 21 nt, Homo sapiens
uauaaagaaacacaagauuua

SEQ ID NO: 31305 - RNA, 20 nt, Homo sapiens
ucugaauacuucuugauggg

SEQ ID NO: 31306 - RNA, 15 nt, Homo sapiens
agccuuccugccgca

SEQ ID NO: 31307 - RNA, 19 nt, Homo sapiens
cuguuugccuucuacuuuu

SEQ ID NO: 31308 - RNA, 15 nt, Homo sapiens
ucacuugucucacuu

SEQ ID NO: 31309 - RNA, 25 nt, Homo sapiens
cuucacagugagucgcuuuggcuuu

SEQ ID NO: 31310 - RNA, 18 nt, Homo sapiens
gggagaagacauguugca

SEQ ID NO: 31311 - RNA, 18 nt, Homo sapiens
gugaagugaaaacaauca

SEQ ID NO: 31312 - RNA, 24 nt, Homo sapiens
ucuuuuuaugucuguuuuguuuuu

SEQ ID NO: 31313 - RNA, 19 nt, Homo sapiens
ugauuucugcuucacuuug

SEQ ID NO: 31314 - RNA, 20 nt, Homo sapiens
uuuccaaauugucuucuuac

SEQ ID NO: 31315 - RNA, 17 nt, Homo sapiens
caacacuaucuguacua

SEQ ID NO: 31316 - RNA, 18 nt, Homo sapiens
uggguggaucaccugagg

SEQ ID NO: 31317 - RNA, 19 nt, Homo sapiens
acucuagaauaucuagcaa

SEQ ID NO: 31318 - RNA, 20 nt, Homo sapiens
uuucuaauacauguacagug

SEQ ID NO: 31319 - RNA, 21 nt, Homo sapiens
aucuuggcucacugcaaccuc

SEQ ID NO: 31320 - RNA, 18 nt, Homo sapiens
ccugcaaccuccaccucc

SEQ ID NO: 31321 - RNA, 19 nt, Homo sapiens
cugcaaccuccaccuccca

SEQ ID NO: 31322 - RNA, 22 nt, Homo sapiens
ggaagcaguaggaagccacuga

SEQ ID NO: 31323 - RNA, 18 nt, Homo sapiens
uccaccucccagguucaa

SEQ ID NO: 31324 - RNA, 22 nt, Homo sapiens
uucuccuacuccauugcuuuuu

SEQ ID NO: 31325 - RNA, 19 nt, Homo sapiens
cucuccuuccaggcccauc

SEQ ID NO: 31326 - RNA, 22 nt, Homo sapiens
auagcugugaauacccgcucca

SEQ ID NO: 31327 - RNA, 21 nt, Homo sapiens
gcucugcugagugggcugcga

SEQ ID NO: 31328 - RNA, 17 nt, Homo sapiens
ggcaggagaagcugcug

SEQ ID NO: 31329 - RNA, 24 nt, Homo sapiens
gccgccccucccuccgcgcgggga

SEQ ID NO: 31330 - RNA, 21 nt, Homo sapiens
cucccuucacuaaugcuuuuu

SEQ ID NO: 31331 - RNA, 16 nt, Homo sapiens
ucucuagaaucuuccu

SEQ ID NO: 31332 - RNA, 24 nt, Homo sapiens
ugccuaaauugccacaccuauuca

SEQ ID NO: 31333 - RNA, 21 nt, Homo sapiens
ugguuuuucuaauagaaacug

SEQ ID NO: 31334 - RNA, 19 nt, Homo sapiens
cuugauaaaugacagggug

SEQ ID NO: 31335 - RNA, 22 nt, Homo sapiens
gccuaacccgcggccgcgugca

SEQ ID NO: 31336 - RNA, 17 nt, Homo sapiens
caggauugggggcccgg

SEQ ID NO: 31337 - RNA, 18 nt, Homo sapiens
ggggaagagaugauucca

SEQ ID NO: 31338 - RNA, 25 nt, Homo sapiens
ugggugggccuccccauugaaagug

SEQ ID NO: 31339 - RNA, 24 nt, Homo sapiens
aagcuccacgggagcaaauacaga

SEQ ID NO: 31340 - RNA, 17 nt, Homo sapiens
ggcuucugcuucauuuu

SEQ ID NO: 31341 - RNA, 19 nt, Homo sapiens
ugcuacugaaaaauggcug

SEQ ID NO: 31342 - RNA, 21 nt, Homo sapiens
ugguaaauauccagcgcuuca

SEQ ID NO: 31343 - RNA, 19 nt, Homo sapiens
cagggccucgauggccuca

SEQ ID NO: 31344 - RNA, 29 nt, Homo sapiens
gccaccacugugacaaccaaaaguaucuc

SEQ ID NO: 31345 - RNA, 20 nt, Homo sapiens
ggccucagccucauaccuca

SEQ ID NO: 31346 - RNA, 24 nt, Homo sapiens
ucaccugcuagucacuggacguac

SEQ ID NO: 31347 - RNA, 18 nt, Homo sapiens
uccaaaguggcugcccag

SEQ ID NO: 31348 - RNA, 20 nt, Homo sapiens
uuccagaaaucgacccucua

SEQ ID NO: 31349 - RNA, 21 nt, Homo sapiens
gaagccaucggaggccagcga

SEQ ID NO: 31350 - RNA, 18 nt, Homo sapiens
gagauggaggacaugcgg

SEQ ID NO: 31351 - RNA, 18 nt, Homo sapiens
ggcaaggugcucaaacug

SEQ ID NO: 31352 - RNA, 20 nt, Homo sapiens
ucagucacccggagacccga

SEQ ID NO: 31353 - RNA, 22 nt, Homo sapiens
ucuugggccggaagaucgugga

SEQ ID NO: 31354 - RNA, 22 nt, Homo sapiens
uuuuuucauagcucagaaaacu

SEQ ID NO: 31355 - RNA, 25 nt, Homo sapiens
cggggccgcugacuggccucgguca

SEQ ID NO: 31356 - RNA, 20 nt, Homo sapiens
cgggugggaucguccuggcc

SEQ ID NO: 31357 - RNA, 21 nt, Homo sapiens
cuuuacugcagggccugcgag

SEQ ID NO: 31358 - RNA, 17 nt, Homo sapiens
gacaaaaccucauggca

SEQ ID NO: 31359 - RNA, 21 nt, Homo sapiens
gccccucggagaccacuccag

SEQ ID NO: 31360 - RNA, 22 nt, Homo sapiens
gucagugccaacgcugguguuu

SEQ ID NO: 31361 - RNA, 21 nt, Homo sapiens
gugugccaccacgcucggcua

SEQ ID NO: 31362 - RNA, 21 nt, Homo sapiens
uccccacuguugauccucuga

SEQ ID NO: 31363 - RNA, 20 nt, Homo sapiens
ucccggacccgacaaugggc

SEQ ID NO: 31364 - RNA, 18 nt, Homo sapiens
uccgucucccagguucaa

SEQ ID NO: 31365 - RNA, 16 nt, Homo sapiens
ugcaaacguuuccaaa

SEQ ID NO: 31366 - RNA, 18 nt, Homo sapiens
uggcuguuuuccacccaa

SEQ ID NO: 31367 - RNA, 18 nt, Homo sapiens
ugugcaaaugugcaggga

SEQ ID NO: 31368 - RNA, 23 nt, Homo sapiens
uucuccugugggacaaccaggga

SEQ ID NO: 31369 - RNA, 20 nt, Homo sapiens
ccugugucuccuggguucaa

SEQ ID NO: 31370 - RNA, 22 nt, Homo sapiens
ucugggcucucgucguuggccu

SEQ ID NO: 31371 - RNA, 19 nt, Homo sapiens
ucuguccaccucugccccu

SEQ ID NO: 31372 - RNA, 23 nt, Homo sapiens
uucuggugguggagcagguccgg

SEQ ID NO: 31373 - RNA, 19 nt, Homo sapiens
acagggccacuguccucca

SEQ ID NO: 31374 - RNA, 18 nt, Homo sapiens
ccucccgcccgccggccu

SEQ ID NO: 31375 - RNA, 26 nt, Homo sapiens
cuuugagggccguggagggcugugga

SEQ ID NO: 31376 - RNA, 22 nt, Homo sapiens
cuuccauucccagcucuugugc

SEQ ID NO: 31377 - RNA, 22 nt, Homo sapiens
aaguucaucucccaccaggaca

SEQ ID NO: 31378 - RNA, 20 nt, Homo sapiens
cccugccgaccccugcagua

SEQ ID NO: 31379 - RNA, 20 nt, Homo sapiens
ucauugauuacuucaucaca

SEQ ID NO: 31380 - RNA, 22 nt, Homo sapiens
uggaaaggacuggacgaaauga

SEQ ID NO: 31381 - RNA, 21 nt, Homo sapiens
ugggacuuugauauuuuugaa

SEQ ID NO: 31382 - RNA, 23 nt, Homo sapiens
ccugcccccgagacccagcccca

SEQ ID NO: 31383 - RNA, 18 nt, Homo sapiens
cuucucucccuccuccuc

SEQ ID NO: 31384 - RNA, 23 nt, Homo sapiens
uccugacguggcggagcugugga

SEQ ID NO: 31385 - RNA, 21 nt, Homo sapiens
caugugcugcuguugcaaaga

SEQ ID NO: 31386 - RNA, 21 nt, Homo sapiens
uaugaugcaaaaaagguuuug

SEQ ID NO: 31387 - RNA, 20 nt, Homo sapiens
ugcuggggcaagaugcagua

SEQ ID NO: 31388 - RNA, 19 nt, Homo sapiens
aaaagcaucguugauuaca

SEQ ID NO: 31389 - RNA, 22 nt, Homo sapiens
auccucauggacccaauggaga

SEQ ID NO: 31390 - RNA, 22 nt, Homo sapiens
gcccuugaugcaacgcacguca

SEQ ID NO: 31391 - RNA, 18 nt, Homo sapiens
cccggccccacccaacuc

SEQ ID NO: 31392 - RNA, 24 nt, Homo sapiens
cgccucucuauccucucuuccucu

SEQ ID NO: 31393 - RNA, 17 nt, Homo sapiens
aauggagacccaucuaa

SEQ ID NO: 31394 - RNA, 22 nt, Homo sapiens
aucuuggcucacugcaaccucu

SEQ ID NO: 31395 - RNA, 19 nt, Homo sapiens
cagaagaacauaaauugug

SEQ ID NO: 31396 - RNA, 19 nt, Homo sapiens
cuaccaucucccucucuca

SEQ ID NO: 31397 - RNA, 22 nt, Homo sapiens
gcuccugcggaaaucuacauua

SEQ ID NO: 31398 - RNA, 18 nt, Homo sapiens
gguuacuggcugaguucu

SEQ ID NO: 31399 - RNA, 18 nt, Homo sapiens
ucuaccuccuggguucaa

SEQ ID NO: 31400 - RNA, 21 nt, Homo sapiens
ugcauucaucuuuguaccccc

SEQ ID NO: 31401 - RNA, 22 nt, Homo sapiens
auuuggccccucuucucacauc

SEQ ID NO: 31402 - RNA, 23 nt, Homo sapiens
caaggaaaaaagagaaaacauac

SEQ ID NO: 31403 - RNA, 21 nt, Homo sapiens
ccugacccacagcauauaugc

SEQ ID NO: 31404 - RNA, 16 nt, Homo sapiens
cuaugggggcuccggc

SEQ ID NO: 31405 - RNA, 19 nt, Homo sapiens
cucaaaggaagcugcaagu

SEQ ID NO: 31406 - RNA, 22 nt, Homo sapiens
gcggugcugccgcgcgagcucu

SEQ ID NO: 31407 - RNA, 18 nt, Homo sapiens
ugacauguucaugaguca

SEQ ID NO: 31408 - RNA, 17 nt, Homo sapiens
aacccagcucuccucuc

SEQ ID NO: 31409 - RNA, 16 nt, Homo sapiens
cuugaaacugugugcu

SEQ ID NO: 31410 - RNA, 20 nt, Homo sapiens
gccuugaggagaugcugcca

SEQ ID NO: 31411 - RNA, 21 nt, Homo sapiens
uguuguugauguaauuuguga

SEQ ID NO: 31412 - RNA, 16 nt, Homo sapiens
aaggcauucuugcacc

SEQ ID NO: 31413 - RNA, 25 nt, Homo sapiens
gauacaauguaaaaaacaauugguu

SEQ ID NO: 31414 - RNA, 16 nt, Homo sapiens
cgccagcagccagccc

SEQ ID NO: 31415 - RNA, 19 nt, Homo sapiens
agccauuuaaaaaguaaca

SEQ ID NO: 31416 - RNA, 19 nt, Homo sapiens
aucaaaugaaagagcauuc

SEQ ID NO: 31417 - RNA, 25 nt, Homo sapiens
auguuuuucuccccugcucauugcc

SEQ ID NO: 31418 - RNA, 21 nt, Homo sapiens
caagagacuuggguuuaguua

SEQ ID NO: 31419 - RNA, 16 nt, Homo sapiens
cuaagaugacuaucca

SEQ ID NO: 31420 - RNA, 19 nt, Homo sapiens
uacuagugaagauacuagu

SEQ ID NO: 31421 - RNA, 21 nt, Homo sapiens
ucugagcaacuacuuacuuuu

SEQ ID NO: 31422 - RNA, 25 nt, Homo sapiens
ucugucauuguuuuauauuguguaa

SEQ ID NO: 31423 - RNA, 19 nt, Homo sapiens
uguuuuucuccccugcuca

SEQ ID NO: 31424 - RNA, 26 nt, Homo sapiens
uuaaaaauaaauaguaccacuuuucu

SEQ ID NO: 31425 - RNA, 25 nt, Homo sapiens
gugucucacagcuuggcugagcucu

SEQ ID NO: 31426 - RNA, 18 nt, Homo sapiens
gcuaccugccuucuuuca

SEQ ID NO: 31427 - RNA, 19 nt, Homo sapiens
aagcaauucuccugcuuca

SEQ ID NO: 31428 - RNA, 24 nt, Homo sapiens
agaacgggucagcucagcaggcca

SEQ ID NO: 31429 - RNA, 22 nt, Homo sapiens
aucucggcucacuacagccucu

SEQ ID NO: 31430 - RNA, 20 nt, Homo sapiens
caaccucuagaguagcuggg

SEQ ID NO: 31431 - RNA, 18 nt, Homo sapiens
cccgcaaccuccgccucc

SEQ ID NO: 31432 - RNA, 19 nt, Homo sapiens
ccugcugcgugccaccuca

SEQ ID NO: 31433 - RNA, 18 nt, Homo sapiens
cugcugcgugccaccuca

SEQ ID NO: 31434 - RNA, 16 nt, Homo sapiens
cugcuucagccucuca

SEQ ID NO: 31435 - RNA, 23 nt, Homo sapiens
gccaccucaggaaacucagggga

SEQ ID NO: 31436 - RNA, 22 nt, Homo sapiens
guacccggccuacccuugggua

SEQ ID NO: 31437 - RNA, 17 nt, Homo sapiens
uacagucccaaggagga

SEQ ID NO: 31438 - RNA, 18 nt, Homo sapiens
ucaauauguuuugaugau

SEQ ID NO: 31439 - RNA, 18 nt, Homo sapiens
uccgccucccggguucaa

SEQ ID NO: 31440 - RNA, 19 nt, Homo sapiens
ucuccugcauuagccuucc

SEQ ID NO: 31441 - RNA, 16 nt, Homo sapiens
ucuccugcuucaaccu

SEQ ID NO: 31442 - RNA, 19 nt, Homo sapiens
ugcguuggucuuuucugag

SEQ ID NO: 31443 - RNA, 20 nt, Homo sapiens
uggccaggcuggucuugaac

SEQ ID NO: 31444 - RNA, 18 nt, Homo sapiens
agaaaacuuuuuugugcu

SEQ ID NO: 31445 - RNA, 25 nt, Homo sapiens
augcccaccuaccuauccagaugua

SEQ ID NO: 31446 - RNA, 18 nt, Homo sapiens
ggcggaagaauuuugcca

SEQ ID NO: 31447 - RNA, 20 nt, Homo sapiens
acuuuggagaaaacucccca

SEQ ID NO: 31448 - RNA, 22 nt, Homo sapiens
gagccaagaucgugccacugca

SEQ ID NO: 31449 - RNA, 22 nt, Homo sapiens
ggaccucuccuaucaugaugaa

SEQ ID NO: 31450 - RNA, 24 nt, Homo sapiens
ucuauagcuguuucagauuuuuuu

SEQ ID NO: 31451 - RNA, 20 nt, Homo sapiens
ugcuaaauaugacuguaaca

SEQ ID NO: 31452 - RNA, 22 nt, Homo sapiens
uguuaacauugccuggacuuca

SEQ ID NO: 31453 - RNA, 19 nt, Homo sapiens
accagagauuuuuacuggg

SEQ ID NO: 31454 - RNA, 18 nt, Homo sapiens
gguaaagagugcuccuca

SEQ ID NO: 31455 - RNA, 18 nt, Homo sapiens
caggacuaccagaccgcc

SEQ ID NO: 31456 - RNA, 23 nt, Homo sapiens
ccuaguaaauucugaaugcuuuu

SEQ ID NO: 31457 - RNA, 20 nt, Homo sapiens
gucuaguuccaaauuuggua

SEQ ID NO: 31458 - RNA, 24 nt, Homo sapiens
guuuggaagacaacugcuuguucc

SEQ ID NO: 31459 - RNA, 21 nt, Homo sapiens
guuuuggucuuuuuauaacuu

SEQ ID NO: 31460 - RNA, 18 nt, Homo sapiens
agccauuugaaauuacug

SEQ ID NO: 31461 - RNA, 22 nt, Homo sapiens
cuguccuccacccuggacccca

SEQ ID NO: 31462 - RNA, 18 nt, Homo sapiens
gaggagggagcuacccuu

SEQ ID NO: 31463 - RNA, 25 nt, Homo sapiens
gcuugagcugcuccaaaccuggccc

SEQ ID NO: 31464 - RNA, 20 nt, Homo sapiens
uauuucccugacuguugccu

SEQ ID NO: 31465 - RNA, 18 nt, Homo sapiens
uuauuaauuuauuucccu

SEQ ID NO: 31466 - RNA, 19 nt, Homo sapiens
uuccuuggaacuccugccu

SEQ ID NO: 31467 - RNA, 19 nt, Homo sapiens
uucgccagaaguuugugag

SEQ ID NO: 31468 - RNA, 18 nt, Homo sapiens
cccaggcuuucucuccca

SEQ ID NO: 31469 - RNA, 20 nt, Homo sapiens
ccuagauacauguucccaca

SEQ ID NO: 31470 - RNA, 19 nt, Homo sapiens
gcccagcaccaacaguuuu

SEQ ID NO: 31471 - RNA, 21 nt, Homo sapiens
gcggggggcaagaacagcagg

SEQ ID NO: 31472 - RNA, 21 nt, Homo sapiens
uagaugccucggagagcauca

SEQ ID NO: 31473 - RNA, 19 nt, Homo sapiens
ucugggccagcuuggacuc

SEQ ID NO: 31474 - RNA, 21 nt, Homo sapiens
uucccucaacucucugcccuc

SEQ ID NO: 31475 - RNA, 17 nt, Homo sapiens
augucuaauggaguucu

SEQ ID NO: 31476 - RNA, 19 nt, Homo sapiens
ccuacccguaaaauaugaa

SEQ ID NO: 31477 - RNA, 22 nt, Homo sapiens
cuuuuuguagacuguaguuuau

SEQ ID NO: 31478 - RNA, 19 nt, Homo sapiens
uggguggaccaccugagau

SEQ ID NO: 31479 - RNA, 20 nt, Homo sapiens
uucaagaccagccugaccaa

SEQ ID NO: 31480 - RNA, 25 nt, Homo sapiens
cuacugaccaaaaaagaacauuuua

SEQ ID NO: 31481 - RNA, 23 nt, Homo sapiens
gguuggaggcugaguucuuuuga

SEQ ID NO: 31482 - RNA, 19 nt, Homo sapiens
uagggaaggagccuuucaa

SEQ ID NO: 31483 - RNA, 22 nt, Homo sapiens
uacugucaggcugggcccuccc

SEQ ID NO: 31484 - RNA, 16 nt, Homo sapiens
aguaccaugguucuga

SEQ ID NO: 31485 - RNA, 21 nt, Homo sapiens
cagaauuccacccaucuuuca

SEQ ID NO: 31486 - RNA, 21 nt, Homo sapiens
ccaugguucugacagagacug

SEQ ID NO: 31487 - RNA, 22 nt, Homo sapiens
ggcccgcagguaaccaccuccu

SEQ ID NO: 31488 - RNA, 18 nt, Homo sapiens
ucacaggccuugccaucu

SEQ ID NO: 31489 - RNA, 18 nt, Homo sapiens
agccuccugaguagcuca

SEQ ID NO: 31490 - RNA, 21 nt, Homo sapiens
gaagagguagcagaugaaucu

SEQ ID NO: 31491 - RNA, 18 nt, Homo sapiens
uauaucauauagggugaa

SEQ ID NO: 31492 - RNA, 19 nt, Homo sapiens
ucauaguccuuuugauuuu

SEQ ID NO: 31493 - RNA, 22 nt, Homo sapiens
uggaucauuccaauugaaguug

SEQ ID NO: 31494 - RNA, 20 nt, Homo sapiens
uggucaggcuggucuugaac

SEQ ID NO: 31495 - RNA, 22 nt, Homo sapiens
aguugcuuuuguugcagaguua

SEQ ID NO: 31496 - RNA, 20 nt, Homo sapiens
uuuccaggaugguaauaggu

SEQ ID NO: 31497 - RNA, 18 nt, Homo sapiens
acuacaugaaugcaguga

SEQ ID NO: 31498 - RNA, 22 nt, Homo sapiens
auucacagcuuguuauacauca

SEQ ID NO: 31499 - RNA, 22 nt, Homo sapiens
cagaaaccauauguguguaaug

SEQ ID NO: 31500 - RNA, 18 nt, Homo sapiens
guuguaguuuuuuugccu

SEQ ID NO: 31501 - RNA, 24 nt, Homo sapiens
uaucuuucaagacaaaaaccucau

SEQ ID NO: 31502 - RNA, 19 nt, Homo sapiens
ucuggcugcagaucuggag

SEQ ID NO: 31503 - RNA, 21 nt, Homo sapiens
aaucagcuuuucuaagaucaa

SEQ ID NO: 31504 - RNA, 19 nt, Homo sapiens
ucugcucugaucuuuuagg

SEQ ID NO: 31505 - RNA, 17 nt, Homo sapiens
caacccucccccugccc

SEQ ID NO: 31506 - RNA, 21 nt, Homo sapiens
ccuuccccaagccagcugccc

SEQ ID NO: 31507 - RNA, 18 nt, Homo sapiens
cgcgcggcgcccgcgccc

SEQ ID NO: 31508 - RNA, 19 nt, Homo sapiens
agaauuuguuauauuuuug

SEQ ID NO: 31509 - RNA, 19 nt, Homo sapiens
agaugacagccaugaugaa

SEQ ID NO: 31510 - RNA, 20 nt, Homo sapiens
auuuagcaguaauccauuaa

SEQ ID NO: 31511 - RNA, 24 nt, Homo sapiens
ccccuggcucccagcugccggcga

SEQ ID NO: 31512 - RNA, 20 nt, Homo sapiens
ccgggcuagcggcagacgag

SEQ ID NO: 31513 - RNA, 20 nt, Homo sapiens
gaccucagacaggaaacugg

SEQ ID NO: 31514 - RNA, 21 nt, Homo sapiens
gccgccccccaggugcccggg

SEQ ID NO: 31515 - RNA, 18 nt, Homo sapiens
ggaggcggcggcggcggc

SEQ ID NO: 31516 - RNA, 21 nt, Homo sapiens
uugucuauguacaaaacacaa

SEQ ID NO: 31517 - RNA, 17 nt, Homo sapiens
auccucuuccuccuagg

SEQ ID NO: 31518 - RNA, 19 nt, Homo sapiens
cagugagccaagaucgugc

SEQ ID NO: 31519 - RNA, 22 nt, Homo sapiens
gagccaagaucgugccacugca

SEQ ID NO: 31520 - RNA, 19 nt, Homo sapiens
gugaggcccuaccugaccc

SEQ ID NO: 31521 - RNA, 18 nt, Homo sapiens
uggagccaccggcuguga

SEQ ID NO: 31522 - RNA, 18 nt, Homo sapiens
uggguggaucaccugagg

SEQ ID NO: 31523 - RNA, 18 nt, Homo sapiens
uuccagaaaagggcccag

SEQ ID NO: 31524 - RNA, 24 nt, Homo sapiens
uuucagcugcuugaaaacauugua

SEQ ID NO: 31525 - RNA, 24 nt, Homo sapiens
uuuccugugccuuucccuccagaa

SEQ ID NO: 31526 - RNA, 19 nt, Homo sapiens
aacccuugucuuuuacuca

SEQ ID NO: 31527 - RNA, 20 nt, Homo sapiens
ccucugccucccagguucaa

SEQ ID NO: 31528 - RNA, 19 nt, Homo sapiens
cugcaaccucugccuccca

SEQ ID NO: 31529 - RNA, 17 nt, Homo sapiens
ucaagugauucuccugc

SEQ ID NO: 31530 - RNA, 18 nt, Homo sapiens
acagcagcagguaugugu

SEQ ID NO: 31531 - RNA, 19 nt, Homo sapiens
ccaagagcuauuacagaga

SEQ ID NO: 31532 - RNA, 20 nt, Homo sapiens
cccaggcagcugcugccucc

SEQ ID NO: 31533 - RNA, 20 nt, Homo sapiens
gacugcagugcgcuuaacca

SEQ ID NO: 31534 - RNA, 23 nt, Homo sapiens
ucuugagucggaguguuugcgag

SEQ ID NO: 31535 - RNA, 18 nt, Homo sapiens
ucuuucucccuuuuccuc

SEQ ID NO: 31536 - RNA, 20 nt, Homo sapiens
uggauaugagugugugugca

SEQ ID NO: 31537 - RNA, 21 nt, Homo sapiens
uacaaaguagauagcauuaua

SEQ ID NO: 31538 - RNA, 17 nt, Homo sapiens
ccucuucgcuugcuuua

SEQ ID NO: 31539 - RNA, 18 nt, Homo sapiens
ccuaccagcccacggugg

SEQ ID NO: 31540 - RNA, 22 nt, Homo sapiens
gagcgccuucaccagcugcccu

SEQ ID NO: 31541 - RNA, 18 nt, Homo sapiens
gccgguggucucuggccu

SEQ ID NO: 31542 - RNA, 21 nt, Homo sapiens
gcuuggagguggccuucguua

SEQ ID NO: 31543 - RNA, 17 nt, Homo sapiens
uccugaccagcacuuca

SEQ ID NO: 31544 - RNA, 24 nt, Homo sapiens
agugacccucccaccucauucuca

SEQ ID NO: 31545 - RNA, 21 nt, Homo sapiens
auucaauggguugcauaccca

SEQ ID NO: 31546 - RNA, 20 nt, Homo sapiens
cagaagaaaaaccuucagcc

SEQ ID NO: 31547 - RNA, 24 nt, Homo sapiens
gaaauguagaaaaaccuucagcca

SEQ ID NO: 31548 - RNA, 20 nt, Homo sapiens
ucccccuugggugccuaugc

SEQ ID NO: 31549 - RNA, 19 nt, Homo sapiens
aaaacuugauucuauaaug

SEQ ID NO: 31550 - RNA, 20 nt, Homo sapiens
aaacuaaagcccauggacca

SEQ ID NO: 31551 - RNA, 21 nt, Homo sapiens
cuuguuuaaaaaucacauuua

SEQ ID NO: 31552 - RNA, 18 nt, Homo sapiens
acacagggcuaagacugu

SEQ ID NO: 31553 - RNA, 17 nt, Homo sapiens
cagcgcacgcacaccgg

SEQ ID NO: 31554 - RNA, 22 nt, Homo sapiens
gccugagcuacggugccuggcc

SEQ ID NO: 31555 - RNA, 18 nt, Homo sapiens
uccgccucccggguucaa

SEQ ID NO: 31556 - RNA, 23 nt, Homo sapiens
ugucucucucugucacccaggcu

SEQ ID NO: 31557 - RNA, 21 nt, Homo sapiens
cauauguauaaugugccaggu

SEQ ID NO: 31558 - RNA, 19 nt, Homo sapiens
gagaaguuuaaaaagauaa

SEQ ID NO: 31559 - RNA, 20 nt, Homo sapiens
uaugaagguuucucauacuu

SEQ ID NO: 31560 - RNA, 19 nt, Homo sapiens
cagagaucacugcccugug

SEQ ID NO: 31561 - RNA, 15 nt, Homo sapiens
cuccuuuaaaucugg

SEQ ID NO: 31562 - RNA, 20 nt, Homo sapiens
gaacaccaacuaaauuugaa

SEQ ID NO: 31563 - RNA, 20 nt, Homo sapiens
gacauacaauccagcagcag

SEQ ID NO: 31564 - RNA, 18 nt, Homo sapiens
gagcauuuaaucauuuuu

SEQ ID NO: 31565 - RNA, 20 nt, Homo sapiens
gcaguuuccaagguggcauc

SEQ ID NO: 31566 - RNA, 18 nt, Homo sapiens
guaucuauuaacuggcca

SEQ ID NO: 31567 - RNA, 18 nt, Homo sapiens
guccaggaugccaaggga

SEQ ID NO: 31568 - RNA, 21 nt, Homo sapiens
gugcuaguacuuguggguuuu

SEQ ID NO: 31569 - RNA, 21 nt, Homo sapiens
uaaaagguaauagcaucuucc

SEQ ID NO: 31570 - RNA, 22 nt, Homo sapiens
ucaaaaaggcaacguuacuuca

SEQ ID NO: 31571 - RNA, 19 nt, Homo sapiens
ucuuauuauaugucccuua

SEQ ID NO: 31572 - RNA, 22 nt, Homo sapiens
ugaagaaauuauuugaaaccca

SEQ ID NO: 31573 - RNA, 18 nt, Homo sapiens
uguagacuuuaaaaacaa

SEQ ID NO: 31574 - RNA, 18 nt, Homo sapiens
uuuuucuccuuuuaucuc

SEQ ID NO: 31575 - RNA, 18 nt, Homo sapiens
acacuaacauuuuccuua

SEQ ID NO: 31576 - RNA, 18 nt, Homo sapiens
ccaguuuuccaccucgca

SEQ ID NO: 31577 - RNA, 20 nt, Homo sapiens
gaguaacugccaaaauauca

SEQ ID NO: 31578 - RNA, 20 nt, Homo sapiens
uugcaaagagcacgccucuu

SEQ ID NO: 31579 - RNA, 22 nt, Homo sapiens
gaaaaggagguuuggugagaca

SEQ ID NO: 31580 - RNA, 21 nt, Homo sapiens
aaggcuggcaucuucgugagu

SEQ ID NO: 31581 - RNA, 19 nt, Homo sapiens
agagccaggagaccaggga

SEQ ID NO: 31582 - RNA, 24 nt, Homo sapiens
cagguguggggcugggcaugguca

SEQ ID NO: 31583 - RNA, 21 nt, Homo sapiens
uauuauggagcugcuuccucu

SEQ ID NO: 31584 - RNA, 18 nt, Homo sapiens
uccuggagcagcaccuca

SEQ ID NO: 31585 - RNA, 17 nt, Homo sapiens
uggugcaagaguucuga

SEQ ID NO: 31586 - RNA, 21 nt, Homo sapiens
aaguaauuuacaaaccucuca

SEQ ID NO: 31587 - RNA, 23 nt, Homo sapiens
cagcacuaauuaguguccaacuc

SEQ ID NO: 31588 - RNA, 20 nt, Homo sapiens
ccucucuacuagcaccauca

SEQ ID NO: 31589 - RNA, 18 nt, Homo sapiens
cuugguuuagucugugaa

SEQ ID NO: 31590 - RNA, 22 nt, Homo sapiens
gagcacacggucucuuuuguuc

SEQ ID NO: 31591 - RNA, 18 nt, Homo sapiens
ggcggcggcgacugcggc

SEQ ID NO: 31592 - RNA, 24 nt, Homo sapiens
uaggguuaggaccagguuagguca

SEQ ID NO: 31593 - RNA, 21 nt, Homo sapiens
ucugagcacacggucucuuuu

SEQ ID NO: 31594 - RNA, 23 nt, Homo sapiens
agguacagcacauaggccaggag

SEQ ID NO: 31595 - RNA, 21 nt, Homo sapiens
aucucccagcagguagagcag

SEQ ID NO: 31596 - RNA, 21 nt, Homo sapiens
cccagcucaaacugacaggag

SEQ ID NO: 31597 - RNA, 20 nt, Homo sapiens
ccccaccaccacccccagcu

SEQ ID NO: 31598 - RNA, 21 nt, Homo sapiens
ccucaaacagccgcugucuca

SEQ ID NO: 31599 - RNA, 21 nt, Homo sapiens
cucggcucgggaggccuggga

SEQ ID NO: 31600 - RNA, 21 nt, Homo sapiens
gcaucagacacagguacagca

SEQ ID NO: 31601 - RNA, 20 nt, Homo sapiens
gccucugugaucuucuccau

SEQ ID NO: 31602 - RNA, 19 nt, Homo sapiens
ggggucuaauaacaaacua

SEQ ID NO: 31603 - RNA, 21 nt, Homo sapiens
gguagagcagagccggagcca

SEQ ID NO: 31604 - RNA, 21 nt, Homo sapiens
uaaaccaauggaaagaagggg

SEQ ID NO: 31605 - RNA, 19 nt, Homo sapiens
ucugggaaaggaccugggg

SEQ ID NO: 31606 - RNA, 20 nt, Homo sapiens
ugccaaguacccugcuccag

SEQ ID NO: 31607 - RNA, 20 nt, Homo sapiens
uuggagagaaggucuccuug

SEQ ID NO: 31608 - RNA, 24 nt, Homo sapiens
ggccaggagaucgacaccauccug

SEQ ID NO: 31609 - RNA, 21 nt, Homo sapiens
gugagucauuuuagaauauua

SEQ ID NO: 31610 - RNA, 20 nt, Homo sapiens
uaaaugugucuugguaugaa

SEQ ID NO: 31611 - RNA, 19 nt, Homo sapiens
uauuaauuauuucagucca

SEQ ID NO: 31612 - RNA, 17 nt, Homo sapiens
ugucuugguaugaauuu

SEQ ID NO: 31613 - RNA, 18 nt, Homo sapiens
acugugaucguguggccu

SEQ ID NO: 31614 - RNA, 18 nt, Homo sapiens
caagaacagcuuccagac

SEQ ID NO: 31615 - RNA, 19 nt, Homo sapiens
acaguugccaaacccauug

SEQ ID NO: 31616 - RNA, 25 nt, Homo sapiens
acgcuucauccacggcuccuuccca

SEQ ID NO: 31617 - RNA, 19 nt, Homo sapiens
cgcccuugcccccucguca

SEQ ID NO: 31618 - RNA, 20 nt, Homo sapiens
gccgggugcauggcagcccu

SEQ ID NO: 31619 - RNA, 21 nt, Homo sapiens
gcuccuuuguuccucccccuc

SEQ ID NO: 31620 - RNA, 22 nt, Homo sapiens
ucuggugccaacacaguugcca

SEQ ID NO: 31621 - RNA, 20 nt, Homo sapiens
ccacugccucccagguucaa

SEQ ID NO: 31622 - RNA, 22 nt, Homo sapiens
ccacuggcaucugaauucauca

SEQ ID NO: 31623 - RNA, 21 nt, Homo sapiens
cccagugauaacaaugggaua

SEQ ID NO: 31624 - RNA, 22 nt, Homo sapiens
gaagaauaauaauccauucagu

SEQ ID NO: 31625 - RNA, 21 nt, Homo sapiens
gaaguuuuaaaaauuucccca

SEQ ID NO: 31626 - RNA, 17 nt, Homo sapiens
ucaagugauucuccugc

SEQ ID NO: 31627 - RNA, 20 nt, Homo sapiens
uugccagaaggcucuuuuua

SEQ ID NO: 31628 - RNA, 21 nt, Homo sapiens
uuguuuguuuuuuccuucugg

SEQ ID NO: 31629 - RNA, 20 nt, Homo sapiens
acaacagguacaaagcccua

SEQ ID NO: 31630 - RNA, 25 nt, Homo sapiens
agagaagguuucagcacuucagaca

SEQ ID NO: 31631 - RNA, 19 nt, Homo sapiens
ccugcuuucuuucuguucc

SEQ ID NO: 31632 - RNA, 21 nt, Homo sapiens
acagccuucaucuccuccucu

SEQ ID NO: 31633 - RNA, 16 nt, Homo sapiens
ccgcgaaccccacugg

SEQ ID NO: 31634 - RNA, 19 nt, Homo sapiens
ccucaggccguggcccugc

SEQ ID NO: 31635 - RNA, 24 nt, Homo sapiens
ccucaggccguggcccugcugccu

SEQ ID NO: 31636 - RNA, 21 nt, Homo sapiens
gcccagcuguggucccgguga

SEQ ID NO: 31637 - RNA, 19 nt, Homo sapiens
uuucuugggggccugagga

SEQ ID NO: 31638 - RNA, 17 nt, Homo sapiens
caccaccaccacccucu

SEQ ID NO: 31639 - RNA, 20 nt, Homo sapiens
agugguuuugguggaggcug

SEQ ID NO: 31640 - RNA, 18 nt, Homo sapiens
aagaaaagcaguuugcag

SEQ ID NO: 31641 - RNA, 15 nt, Homo sapiens
gguugcaacgugaca

SEQ ID NO: 31642 - RNA, 22 nt, Homo sapiens
auaacuucaauaaagauuguaa

SEQ ID NO: 31643 - RNA, 20 nt, Homo sapiens
acugagacuuuaacugguaa

SEQ ID NO: 31644 - RNA, 18 nt, Homo sapiens
acuguggcgcucaccugu

SEQ ID NO: 31645 - RNA, 24 nt, Homo sapiens
aggcagcucuccucauuuucccca

SEQ ID NO: 31646 - RNA, 15 nt, Homo sapiens
gauaauauaguagag

SEQ ID NO: 31647 - RNA, 19 nt, Homo sapiens
ugggugacagugugagacu

SEQ ID NO: 31648 - RNA, 21 nt, Homo sapiens
aggccuuccuaguuagggcca

SEQ ID NO: 31649 - RNA, 17 nt, Homo sapiens
auggucauggcuguuuc

SEQ ID NO: 31650 - RNA, 18 nt, Homo sapiens
cagacccucuccagugua

SEQ ID NO: 31651 - RNA, 20 nt, Homo sapiens
ccagacccucuccaguguac

SEQ ID NO: 31652 - RNA, 22 nt, Homo sapiens
ccccgguucuuuccccacccca

SEQ ID NO: 31653 - RNA, 19 nt, Homo sapiens
uauguauuuaucaacaugu

SEQ ID NO: 31654 - RNA, 20 nt, Homo sapiens
cauaauuuuccauuccaguu

SEQ ID NO: 31655 - RNA, 19 nt, Homo sapiens
cugacauacaugguucuuu

SEQ ID NO: 31656 - RNA, 21 nt, Homo sapiens
gcagaggauuuaaccuuugca

SEQ ID NO: 31657 - RNA, 22 nt, Homo sapiens
ggguaugaaaaaaaaaacugca

SEQ ID NO: 31658 - RNA, 19 nt, Homo sapiens
ucagcaggcuggugaugga

SEQ ID NO: 31659 - RNA, 21 nt, Homo sapiens
ugcagugagcuauaaucgugc

SEQ ID NO: 31660 - RNA, 21 nt, Homo sapiens
uggaaaucaucagcaugagau

SEQ ID NO: 31661 - RNA, 24 nt, Homo sapiens
uuucccauuugaauaacuagaaua

SEQ ID NO: 31662 - RNA, 21 nt, Homo sapiens
uggugguuccugcugcacuga

SEQ ID NO: 31663 - RNA, 23 nt, Homo sapiens
cucugucacaugcucaguuugug

SEQ ID NO: 31664 - RNA, 18 nt, Homo sapiens
gcuccuugguauuccuga

SEQ ID NO: 31665 - RNA, 23 nt, Homo sapiens
uuuaagucauuacugaguuacuu

SEQ ID NO: 31666 - RNA, 19 nt, Homo sapiens
aaucaaagauuuaaacagu

SEQ ID NO: 31667 - RNA, 17 nt, Homo sapiens
acacuuaaaaccaccaa

SEQ ID NO: 31668 - RNA, 25 nt, Homo sapiens
agaaagcagcaugaacagaaccaca

SEQ ID NO: 31669 - RNA, 23 nt, Homo sapiens
agagauucugcuuggucuaguca

SEQ ID NO: 31670 - RNA, 22 nt, Homo sapiens
agccugggugauggagaugcca

SEQ ID NO: 31671 - RNA, 19 nt, Homo sapiens
cagucccuuaaaaauucca

SEQ ID NO: 31672 - RNA, 18 nt, Homo sapiens
accgcagaccgcaagcca

SEQ ID NO: 31673 - RNA, 19 nt, Homo sapiens
agaugggugcugguccuca

SEQ ID NO: 31674 - RNA, 21 nt, Homo sapiens
aguggcucuccugauucuuca

SEQ ID NO: 31675 - RNA, 18 nt, Homo sapiens
cagccacgcucugugaca

SEQ ID NO: 31676 - RNA, 19 nt, Homo sapiens
caguaacaucaagugcuca

SEQ ID NO: 31677 - RNA, 24 nt, Homo sapiens
ccuugggcugagaggaccugggaa

SEQ ID NO: 31678 - RNA, 21 nt, Homo sapiens
gugccuauuucauccuggugg

SEQ ID NO: 31679 - RNA, 23 nt, Homo sapiens
ugagaggaccugggaagccccuc

SEQ ID NO: 31680 - RNA, 19 nt, Homo sapiens
cuggcuugcagucuggccc

SEQ ID NO: 31681 - RNA, 24 nt, Homo sapiens
uaggaagccuuccagugugagcug

SEQ ID NO: 31682 - RNA, 15 nt, Homo sapiens
uugggaucugcuggu

SEQ ID NO: 31683 - RNA, 18 nt, Homo sapiens
aggcauugcugcagaacc

SEQ ID NO: 31684 - RNA, 17 nt, Homo sapiens
gccacguccgacgagga

SEQ ID NO: 31685 - RNA, 17 nt, Homo sapiens
ggaaacggggcccagcc

SEQ ID NO: 31686 - RNA, 21 nt, Homo sapiens
acccugaguuggugcuuugga

SEQ ID NO: 31687 - RNA, 19 nt, Homo sapiens
agguucugcucagccuuaa

SEQ ID NO: 31688 - RNA, 18 nt, Homo sapiens
cacuugacuggccaccag

SEQ ID NO: 31689 - RNA, 19 nt, Homo sapiens
cagaccaacucugcuguua

SEQ ID NO: 31690 - RNA, 18 nt, Homo sapiens
cccaaagacagcuugcac

SEQ ID NO: 31691 - RNA, 21 nt, Homo sapiens
ccuaaccuggaagccugugag

SEQ ID NO: 31692 - RNA, 19 nt, Homo sapiens
ccuagauuuuaacacugca

SEQ ID NO: 31693 - RNA, 24 nt, Homo sapiens
ccuugauugaguugcuugggcuuu

SEQ ID NO: 31694 - RNA, 20 nt, Homo sapiens
gcugcaucccuuuugagcaa

SEQ ID NO: 31695 - RNA, 23 nt, Homo sapiens
ggacugggagaggaaucuaagaa

SEQ ID NO: 31696 - RNA, 18 nt, Homo sapiens
gggaacugugucugguca

SEQ ID NO: 31697 - RNA, 21 nt, Homo sapiens
ucugcuuuaugugugugugua

SEQ ID NO: 31698 - RNA, 17 nt, Homo sapiens
ugcagagcauucucuac

SEQ ID NO: 31699 - RNA, 19 nt, Homo sapiens
aaacuccugaccucaggug

SEQ ID NO: 31700 - RNA, 19 nt, Homo sapiens
aagcaauucuccugccuca

SEQ ID NO: 31701 - RNA, 22 nt, Homo sapiens
accuugugauccacccaccucg

SEQ ID NO: 31702 - RNA, 20 nt, Homo sapiens
agcauccacucuccugcggu

SEQ ID NO: 31703 - RNA, 22 nt, Homo sapiens
aucucggcucacugcaaucucu

SEQ ID NO: 31704 - RNA, 21 nt, Homo sapiens
aucuuggcucacugcaaccuc

SEQ ID NO: 31705 - RNA, 23 nt, Homo sapiens
auucuccguuuucugaauugcau

SEQ ID NO: 31706 - RNA, 18 nt, Homo sapiens
cccgcaaccuccgccucc

SEQ ID NO: 31707 - RNA, 21 nt, Homo sapiens
ccgaauucuccguuuucugaa

SEQ ID NO: 31708 - RNA, 19 nt, Homo sapiens
cugcaaucucugccuccca

SEQ ID NO: 31709 - RNA, 21 nt, Homo sapiens
gagaugcacaccuucgcuucu

SEQ ID NO: 31710 - RNA, 21 nt, Homo sapiens
gcaaauauccuuguuucugau

SEQ ID NO: 31711 - RNA, 19 nt, Homo sapiens
ggcccccuaguagcuggca

SEQ ID NO: 31712 - RNA, 19 nt, Homo sapiens
gggugggucccagaaguga

SEQ ID NO: 31713 - RNA, 19 nt, Homo sapiens
guauaugugggucuaugau

SEQ ID NO: 31714 - RNA, 19 nt, Homo sapiens
uauaugugggucuaugaug

SEQ ID NO: 31715 - RNA, 18 nt, Homo sapiens
ucacgucagugcauguca

SEQ ID NO: 31716 - RNA, 18 nt, Homo sapiens
uccacuucucagguucaa

SEQ ID NO: 31717 - RNA, 17 nt, Homo sapiens
ucuccugcgggauugca

SEQ ID NO: 31718 - RNA, 20 nt, Homo sapiens
ucucugccucccagguucaa

SEQ ID NO: 31719 - RNA, 20 nt, Homo sapiens
uggccaggcuggucuugaac

SEQ ID NO: 31720 - RNA, 22 nt, Homo sapiens
gaccucaucacuggauuugcca

SEQ ID NO: 31721 - RNA, 19 nt, Homo sapiens
acaaaagcaugaucauuca

SEQ ID NO: 31722 - RNA, 21 nt, Homo sapiens
acuugaagccugaucuggccu

SEQ ID NO: 31723 - RNA, 19 nt, Homo sapiens
aguuccccuaguuacuaca

SEQ ID NO: 31724 - RNA, 19 nt, Homo sapiens
auucccccaauggacaaga

SEQ ID NO: 31725 - RNA, 22 nt, Homo sapiens
auucccugcagaagccgcagca

SEQ ID NO: 31726 - RNA, 19 nt, Homo sapiens
cuacaaguaugcugggaua

SEQ ID NO: 31727 - RNA, 21 nt, Homo sapiens
ggcucaucucugcugcaguaa

SEQ ID NO: 31728 - RNA, 19 nt, Homo sapiens
gggccgcccgcucgccucc

SEQ ID NO: 31729 - RNA, 20 nt, Homo sapiens
ucaugcccaaucuggaccaa

SEQ ID NO: 31730 - RNA, 17 nt, Homo sapiens
ugagccacaaaggcugg

SEQ ID NO: 31731 - RNA, 21 nt, Homo sapiens
ugaucucaccccuguacuuca

SEQ ID NO: 31732 - RNA, 19 nt, Homo sapiens
uugcugagagcaacuugca

SEQ ID NO: 31733 - RNA, 20 nt, Homo sapiens
agcaacugguacaacugguc

SEQ ID NO: 31734 - RNA, 22 nt, Homo sapiens
cauaagggcuucaucucaagug

SEQ ID NO: 31735 - RNA, 20 nt, Homo sapiens
ccaggcaauaucucaggaua

SEQ ID NO: 31736 - RNA, 20 nt, Homo sapiens
uccccuauaacauaaugcua

SEQ ID NO: 31737 - RNA, 21 nt, Homo sapiens
uuucuucaacaaccuugacuu

SEQ ID NO: 31738 - RNA, 20 nt, Homo sapiens
aaaaccagccaagaucuguu

SEQ ID NO: 31739 - RNA, 17 nt, Homo sapiens
aacccagaaagaccugg

SEQ ID NO: 31740 - RNA, 17 nt, Homo sapiens
auuccuggugucugaua

SEQ ID NO: 31741 - RNA, 20 nt, Homo sapiens
caucaaauucuuaucuuuuc

SEQ ID NO: 31742 - RNA, 20 nt, Homo sapiens
cuuagaaaacaucugcucca

SEQ ID NO: 31743 - RNA, 19 nt, Homo sapiens
gauauuuucuugaugaagu

SEQ ID NO: 31744 - RNA, 19 nt, Homo sapiens
gaucuguucacacaccucu

SEQ ID NO: 31745 - RNA, 17 nt, Homo sapiens
ucuaguuugcaccuuga

SEQ ID NO: 31746 - RNA, 22 nt, Homo sapiens
ugaguggauuucaagcauuugc

SEQ ID NO: 31747 - RNA, 18 nt, Homo sapiens
ugccagaaaucuuugcca

SEQ ID NO: 31748 - RNA, 18 nt, Homo sapiens
uuuauuaguucuuugaua

SEQ ID NO: 31749 - RNA, 16 nt, Homo sapiens
aucugcuuaacuugua

SEQ ID NO: 31750 - RNA, 19 nt, Homo sapiens
caucagucucuucuccaga

SEQ ID NO: 31751 - RNA, 20 nt, Homo sapiens
ccaccaacuauuucuggaua

SEQ ID NO: 31752 - RNA, 20 nt, Homo sapiens
ccaccaacuauuucuggaua

SEQ ID NO: 31753 - RNA, 18 nt, Homo sapiens
ccagagaucaaucccuca

SEQ ID NO: 31754 - RNA, 20 nt, Homo sapiens
uguguaggguaugcccagca

SEQ ID NO: 31755 - RNA, 19 nt, Homo sapiens
aagcaauucuccugccuca

SEQ ID NO: 31756 - RNA, 18 nt, Homo sapiens
acugccaccuccaccucc

SEQ ID NO: 31757 - RNA, 22 nt, Homo sapiens
aggccucucuccccguucauuu

SEQ ID NO: 31758 - RNA, 19 nt, Homo sapiens
cacaugguauugcacauga

SEQ ID NO: 31759 - RNA, 20 nt, Homo sapiens
gcauugaaacccacauggua

SEQ ID NO: 31760 - RNA, 22 nt, Homo sapiens
ucaaagacauaaaaggaugcac

SEQ ID NO: 31761 - RNA, 17 nt, Homo sapiens
ucaagugauucuccugc

SEQ ID NO: 31762 - RNA, 22 nt, Homo sapiens
aaaagguaucaguaauugaaga

SEQ ID NO: 31763 - RNA, 20 nt, Homo sapiens
aaccuugaaaaaagauuaga

SEQ ID NO: 31764 - RNA, 20 nt, Homo sapiens
cacaccaaaacccaucugua

SEQ ID NO: 31765 - RNA, 18 nt, Homo sapiens
gcacacauaagaaugcau

SEQ ID NO: 31766 - RNA, 20 nt, Homo sapiens
ucaagugggucccugaucuc

SEQ ID NO: 31767 - RNA, 18 nt, Homo sapiens
ucugccucacaccuuuga

SEQ ID NO: 31768 - RNA, 17 nt, Homo sapiens
aagugaaugagauguca

SEQ ID NO: 31769 - RNA, 15 nt, Homo sapiens
auucacuucugccuu

SEQ ID NO: 31770 - RNA, 18 nt, Homo sapiens
gggcaacauuuggcccaa

SEQ ID NO: 31771 - RNA, 20 nt, Homo sapiens
ugaaugagaugucaccagga

SEQ ID NO: 31772 - RNA, 18 nt, Homo sapiens
uugggaugggcgucugcu

SEQ ID NO: 31773 - RNA, 21 nt, Homo sapiens
accagaaggaaacccuaugaa

SEQ ID NO: 31774 - RNA, 19 nt, Homo sapiens
uaaagccuuaauuguucca

SEQ ID NO: 31775 - RNA, 18 nt, Homo sapiens
ucaagacuucaaaugcau

SEQ ID NO: 31776 - RNA, 25 nt, Homo sapiens
cuuacagcaauuacagauuauuuuu

SEQ ID NO: 31777 - RNA, 18 nt, Homo sapiens
gauaauaauuagaucuug

SEQ ID NO: 31778 - RNA, 15 nt, Homo sapiens
augacaucccaguua

SEQ ID NO: 31779 - RNA, 20 nt, Homo sapiens
cagcaggguaagagacacca

SEQ ID NO: 31780 - RNA, 19 nt, Homo sapiens
uuccagaagcagguuucag

SEQ ID NO: 31781 - RNA, 23 nt, Homo sapiens
acagagaggucagccccacccga

SEQ ID NO: 31782 - RNA, 22 nt, Homo sapiens
ccuuccccucagccucucccca

SEQ ID NO: 31783 - RNA, 19 nt, Homo sapiens
gccucugugcuccauccua

SEQ ID NO: 31784 - RNA, 20 nt, Homo sapiens
gcggcgcuggagcuuucguc

SEQ ID NO: 31785 - RNA, 18 nt, Homo sapiens
ucaagaaggccuucucca

SEQ ID NO: 31786 - RNA, 19 nt, Homo sapiens
agccgaacucaacagucuc

SEQ ID NO: 31787 - RNA, 19 nt, Homo sapiens
gagaauaggacuacgucau

SEQ ID NO: 31788 - RNA, 22 nt, Homo sapiens
gugccgcccgugcucugaacug

SEQ ID NO: 31789 - RNA, 20 nt, Homo sapiens
cugaaaaagaucauuucucc

SEQ ID NO: 31790 - RNA, 19 nt, Homo sapiens
gacagcgaagaaccuccug

SEQ ID NO: 31791 - RNA, 17 nt, Homo sapiens
guucagaaaucauaccu

SEQ ID NO: 31792 - RNA, 18 nt, Homo sapiens
ucuuucuuugcccaguaa

SEQ ID NO: 31793 - RNA, 18 nt, Homo sapiens
aaaacaugugaauacuac

SEQ ID NO: 31794 - RNA, 21 nt, Homo sapiens
aagccagaagacgugcaccca

SEQ ID NO: 31795 - RNA, 22 nt, Homo sapiens
aagcuuccuuccguagccucuu

SEQ ID NO: 31796 - RNA, 16 nt, Homo sapiens
aggugcacucuauuca

SEQ ID NO: 31797 - RNA, 20 nt, Homo sapiens
aguuucacucuguugcccag

SEQ ID NO: 31798 - RNA, 20 nt, Homo sapiens
cagccugcacagggcaaggc

SEQ ID NO: 31799 - RNA, 23 nt, Homo sapiens
cucgguacaaucuuugaaagaaa

SEQ ID NO: 31800 - RNA, 17 nt, Homo sapiens
gagcacagcgggccugu

SEQ ID NO: 31801 - RNA, 19 nt, Homo sapiens
gggcuugagggcuuuuguu

SEQ ID NO: 31802 - RNA, 24 nt, Homo sapiens
guucucucaguuagcagcugggca

SEQ ID NO: 31803 - RNA, 19 nt, Homo sapiens
uuucacuuuaaaaugcgca

SEQ ID NO: 31804 - RNA, 20 nt, Homo sapiens
ggaacagaccuggcuguggc

SEQ ID NO: 31805 - RNA, 23 nt, Homo sapiens
uacgcuaaaaaagggaacuucca

SEQ ID NO: 31806 - RNA, 16 nt, Homo sapiens
ugugugucccgcaguu

SEQ ID NO: 31807 - RNA, 18 nt, Homo sapiens
cacccggugccugccuca

SEQ ID NO: 31808 - RNA, 20 nt, Homo sapiens
gccucugucccuggcggcca

SEQ ID NO: 31809 - RNA, 27 nt, Homo sapiens
gccugggccgcuugcuggcuguggccu

SEQ ID NO: 31810 - RNA, 19 nt, Homo sapiens
uccuuggaguuuacgcuca

SEQ ID NO: 31811 - RNA, 18 nt, Homo sapiens
accucagcccucauguca

SEQ ID NO: 31812 - RNA, 22 nt, Homo sapiens
cagccuggccaacauaaugaaa

SEQ ID NO: 31813 - RNA, 19 nt, Homo sapiens
cuuaggcaguuccagagcu

SEQ ID NO: 31814 - RNA, 17 nt, Homo sapiens
gauuuagccaugaugaa

SEQ ID NO: 31815 - RNA, 18 nt, Homo sapiens
gugucaaaacacauuuau

SEQ ID NO: 31816 - RNA, 25 nt, Homo sapiens
gugcuuuuacaaauuggugaguuuu

SEQ ID NO: 31817 - RNA, 20 nt, Homo sapiens
ucuuuguacuuuuuaacuuu

SEQ ID NO: 31818 - RNA, 22 nt, Homo sapiens
cuaccaaguuuaaauuaaccaa

SEQ ID NO: 31819 - RNA, 22 nt, Homo sapiens
guguugucuguuggcgcgcucu

SEQ ID NO: 31820 - RNA, 15 nt, Homo sapiens
guuaggcugggacaa

SEQ ID NO: 31821 - RNA, 16 nt, Homo sapiens
acagagaaguaucuug

SEQ ID NO: 31822 - RNA, 21 nt, Homo sapiens
agacugucaagauuguauacc

SEQ ID NO: 31823 - RNA, 18 nt, Homo sapiens
ccuuuaagaaaacaugga

SEQ ID NO: 31824 - RNA, 20 nt, Homo sapiens
cuugacuuuuuugucuuaca

SEQ ID NO: 31825 - RNA, 22 nt, Homo sapiens
ccgcucugccacguucccugag

SEQ ID NO: 31826 - RNA, 18 nt, Homo sapiens
guccaccccucaccgaca

SEQ ID NO: 31827 - RNA, 20 nt, Homo sapiens
cccuccccagcccccucucc

SEQ ID NO: 31828 - RNA, 22 nt, Homo sapiens
acuggagaaaucaaagugauca

SEQ ID NO: 31829 - RNA, 24 nt, Homo sapiens
gcuugagcugagauggacuggucu

SEQ ID NO: 31830 - RNA, 19 nt, Homo sapiens
ugggcgcccaaggcgcugg

SEQ ID NO: 31831 - RNA, 19 nt, Homo sapiens
aaagcugggagggaggcga

SEQ ID NO: 31832 - RNA, 21 nt, Homo sapiens
gauaucaucagaaaauuacca

SEQ ID NO: 31833 - RNA, 21 nt, Homo sapiens
uuugaaaaaaaaaaaaagugg

SEQ ID NO: 31834 - RNA, 21 nt, Homo sapiens
agccaucccagagccugggga

SEQ ID NO: 31835 - RNA, 16 nt, Homo sapiens
cagagccacaacaaca

SEQ ID NO: 31836 - RNA, 17 nt, Homo sapiens
gcagagcaggcacaccu

SEQ ID NO: 31837 - RNA, 19 nt, Homo sapiens
ggugaagccuuaccugcgg

SEQ ID NO: 31838 - RNA, 19 nt, Homo sapiens
ucuggagcuuuucuggucc

SEQ ID NO: 31839 - RNA, 18 nt, Homo sapiens
ugaaugagacccagcuga

SEQ ID NO: 31840 - RNA, 16 nt, Homo sapiens
cugaggcuggcggugg

SEQ ID NO: 31841 - RNA, 22 nt, Homo sapiens
ugccuacggguacuugcagcug

SEQ ID NO: 31842 - RNA, 16 nt, Homo sapiens
aaggaaccucaggcac

SEQ ID NO: 31843 - RNA, 20 nt, Homo sapiens
agaaacaaggcccccaguga

SEQ ID NO: 31844 - RNA, 22 nt, Homo sapiens
agucgcagagagggaccccggg

SEQ ID NO: 31845 - RNA, 22 nt, Homo sapiens
caggcuccccuuuccuuaaagc

SEQ ID NO: 31846 - RNA, 18 nt, Homo sapiens
cauccucucccaagcacc

SEQ ID NO: 31847 - RNA, 21 nt, Homo sapiens
gccugcugagcucagcuggca

SEQ ID NO: 31848 - RNA, 21 nt, Homo sapiens
ggaggagccuugguggcgaga

SEQ ID NO: 31849 - RNA, 18 nt, Homo sapiens
acugaacuauaucaagaa

SEQ ID NO: 31850 - RNA, 23 nt, Homo sapiens
agaagaggaccuccuuuccccca

SEQ ID NO: 31851 - RNA, 19 nt, Homo sapiens
agaauuggagagaacuguu

SEQ ID NO: 31852 - RNA, 24 nt, Homo sapiens
cauuuuuaucaaaagcagguuauu

SEQ ID NO: 31853 - RNA, 21 nt, Homo sapiens
ccuuucccccaaccuccucca

SEQ ID NO: 31854 - RNA, 19 nt, Homo sapiens
ucaaaagcagguuauuucc

SEQ ID NO: 31855 - RNA, 19 nt, Homo sapiens
uccauuugcaaugagaaac

SEQ ID NO: 31856 - RNA, 20 nt, Homo sapiens
uggacacuugccaaugauga

SEQ ID NO: 31857 - RNA, 20 nt, Homo sapiens
aaggaugucauuucaugagu

SEQ ID NO: 31858 - RNA, 17 nt, Homo sapiens
aagugugacaugcuuua

SEQ ID NO: 31859 - RNA, 19 nt, Homo sapiens
acaucuucauuuuuccuca

SEQ ID NO: 31860 - RNA, 21 nt, Homo sapiens
auccaauuacugugccuucua

SEQ ID NO: 31861 - RNA, 23 nt, Homo sapiens
caaaccagcuaacaccauuacag

SEQ ID NO: 31862 - RNA, 18 nt, Homo sapiens
ccaccccaccuucuccuu

SEQ ID NO: 31863 - RNA, 19 nt, Homo sapiens
cugccacauuguuuccuuu

SEQ ID NO: 31864 - RNA, 20 nt, Homo sapiens
cuuuguucugccuuggucuu

SEQ ID NO: 31865 - RNA, 25 nt, Homo sapiens
uuccccagacagguauacuucuuca

SEQ ID NO: 31866 - RNA, 19 nt, Homo sapiens
uugguaaaauuacauuuaa

SEQ ID NO: 31867 - RNA, 17 nt, Homo sapiens
acaacaucaguacacuc

SEQ ID NO: 31868 - RNA, 23 nt, Homo sapiens
agaaauauucauuaucugucauu

SEQ ID NO: 31869 - RNA, 21 nt, Homo sapiens
auagagcugugcagaucuuca

SEQ ID NO: 31870 - RNA, 21 nt, Homo sapiens
cuuuaaguaugugcaguuugu

SEQ ID NO: 31871 - RNA, 19 nt, Homo sapiens
ugagcacagcaagcugaca

SEQ ID NO: 31872 - RNA, 21 nt, Homo sapiens
uguugaggaaacaaucuguug

SEQ ID NO: 31873 - RNA, 18 nt, Homo sapiens
uuaaagucaccucuacug

SEQ ID NO: 31874 - RNA, 19 nt, Homo sapiens
uuaccuaauaauuaccuca

SEQ ID NO: 31875 - RNA, 19 nt, Homo sapiens
guuuuuucuguugcaacag

SEQ ID NO: 31876 - RNA, 24 nt, Homo sapiens
ucuaagaccuccaagcuuguuuuu

SEQ ID NO: 31877 - RNA, 25 nt, Homo sapiens
uucuuguaucuuggcugucugguuu

SEQ ID NO: 31878 - RNA, 21 nt, Homo sapiens
uuucuuguaucuuggcugucu

SEQ ID NO: 31879 - RNA, 26 nt, Homo sapiens
aguggucuccuuacgugcucacaccc

SEQ ID NO: 31880 - RNA, 17 nt, Homo sapiens
ugaacagaccugucagc

SEQ ID NO: 31881 - RNA, 15 nt, Homo sapiens
uugguaguuggcaua

SEQ ID NO: 31882 - RNA, 18 nt, Homo sapiens
ggccuguagccccauuuu

SEQ ID NO: 31883 - RNA, 21 nt, Homo sapiens
guucccauaauccgcaccugu

SEQ ID NO: 31884 - RNA, 20 nt, Homo sapiens
ugaaccacuaauugagauua

SEQ ID NO: 31885 - RNA, 17 nt, Homo sapiens
ugcccugucucagauga

SEQ ID NO: 31886 - RNA, 23 nt, Homo sapiens
agaaacugcagguucucuuguga

SEQ ID NO: 31887 - RNA, 19 nt, Homo sapiens
auuuugcuaacuguuaaca

SEQ ID NO: 31888 - RNA, 20 nt, Homo sapiens
ccucugccucccagguucaa

SEQ ID NO: 31889 - RNA, 20 nt, Homo sapiens
ccuuuguccacgggcuauug

SEQ ID NO: 31890 - RNA, 19 nt, Homo sapiens
cucuggucuccuugccucu

SEQ ID NO: 31891 - RNA, 19 nt, Homo sapiens
cugagcugccugcagguuc

SEQ ID NO: 31892 - RNA, 19 nt, Homo sapiens
cugcaaccucugccuccca

SEQ ID NO: 31893 - RNA, 16 nt, Homo sapiens
gagggcaagauccaag

SEQ ID NO: 31894 - RNA, 21 nt, Homo sapiens
gccccuguggcuggcuggccc

SEQ ID NO: 31895 - RNA, 20 nt, Homo sapiens
gcccuuccuccaggugugug

SEQ ID NO: 31896 - RNA, 19 nt, Homo sapiens
gcucuuugcaaacgaaaga

SEQ ID NO: 31897 - RNA, 19 nt, Homo sapiens
gugaaacaaaccaaugcac

SEQ ID NO: 31898 - RNA, 22 nt, Homo sapiens
cagagcggccacccccaccuca

SEQ ID NO: 31899 - RNA, 24 nt, Homo sapiens
gccaccgcccgugggcaucgauga

SEQ ID NO: 31900 - RNA, 18 nt, Homo sapiens
auuugugcugggauggaa

SEQ ID NO: 31901 - RNA, 18 nt, Homo sapiens
cagagaauauccaaugca

SEQ ID NO: 31902 - RNA, 19 nt, Homo sapiens
cccuuugaccugccuuuuu

SEQ ID NO: 31903 - RNA, 20 nt, Homo sapiens
ccucuucaccccuuugaccu

SEQ ID NO: 31904 - RNA, 18 nt, Homo sapiens
cucccccaccuuuccucu

SEQ ID NO: 31905 - RNA, 22 nt, Homo sapiens
gcccucccaccuuuucuuuaga

SEQ ID NO: 31906 - RNA, 22 nt, Homo sapiens
gguggguggagagcccuguuug

SEQ ID NO: 31907 - RNA, 23 nt, Homo sapiens
uccaaggcccccagcaggcucuc

SEQ ID NO: 31908 - RNA, 17 nt, Homo sapiens
aaaguuggagccuggca

SEQ ID NO: 31909 - RNA, 20 nt, Homo sapiens
ccauaaaugcauacacauac

SEQ ID NO: 31910 - RNA, 17 nt, Homo sapiens
cucacaggaacuguuca

SEQ ID NO: 31911 - RNA, 19 nt, Homo sapiens
cuccagggacaggcacugc

SEQ ID NO: 31912 - RNA, 25 nt, Homo sapiens
gccuggacucuaggggaugccgcca

SEQ ID NO: 31913 - RNA, 22 nt, Homo sapiens
acccccagggccuccuucccca

SEQ ID NO: 31914 - RNA, 19 nt, Homo sapiens
cugcugcugccugauggag

SEQ ID NO: 31915 - RNA, 21 nt, Homo sapiens
aaggucaccuguucuccagcc

SEQ ID NO: 31916 - RNA, 21 nt, Homo sapiens
accugagcuucuugucugcuu

SEQ ID NO: 31917 - RNA, 18 nt, Homo sapiens
accuuguuaaacguugac

SEQ ID NO: 31918 - RNA, 19 nt, Homo sapiens
acgcugucgcccagccaug

SEQ ID NO: 31919 - RNA, 22 nt, Homo sapiens
auuuggggguuuuguuugguuc

SEQ ID NO: 31920 - RNA, 23 nt, Homo sapiens
cacucccgaaagcuccguuguca

SEQ ID NO: 31921 - RNA, 20 nt, Homo sapiens
ccaccaguggccuugcggua

SEQ ID NO: 31922 - RNA, 22 nt, Homo sapiens
ccuaccaacagcgcccacccca

SEQ ID NO: 31923 - RNA, 23 nt, Homo sapiens
ccuuuuguuuauguuuuggccuu

SEQ ID NO: 31924 - RNA, 20 nt, Homo sapiens
cuuugaggcuuuuuguuuua

SEQ ID NO: 31925 - RNA, 23 nt, Homo sapiens
gccacuucuagggacacugggga

SEQ ID NO: 31926 - RNA, 18 nt, Homo sapiens
gccgggaggguuugggga

SEQ ID NO: 31927 - RNA, 20 nt, Homo sapiens
ggucuuaguggcugcagcag

SEQ ID NO: 31928 - RNA, 22 nt, Homo sapiens
guaagaaacaaggaaaucacuc

SEQ ID NO: 31929 - RNA, 18 nt, Homo sapiens
guggauauauggcauuga

SEQ ID NO: 31930 - RNA, 17 nt, Homo sapiens
auauuuccuuuuccuca

SEQ ID NO: 31931 - RNA, 19 nt, Homo sapiens
cugcaagcuccgccuccca

SEQ ID NO: 31932 - RNA, 23 nt, Homo sapiens
ucacaaauauuaauauuuccuuu

SEQ ID NO: 31933 - RNA, 25 nt, Homo sapiens
ugagucacuuuauuggguucaguca

SEQ ID NO: 31934 - RNA, 21 nt, Homo sapiens
acaaaaggaccucccagaguu

SEQ ID NO: 31935 - RNA, 18 nt, Homo sapiens
accagugcuguuuggccu

SEQ ID NO: 31936 - RNA, 27 nt, Homo sapiens
gcuugugucuuugucauugucugguuc

SEQ ID NO: 31937 - RNA, 17 nt, Homo sapiens
gucaaauggccugccca

SEQ ID NO: 31938 - RNA, 20 nt, Homo sapiens
ugguggguauggguccccua

SEQ ID NO: 31939 - RNA, 22 nt, Homo sapiens
acacaggaaagucguacuguuc

SEQ ID NO: 31940 - RNA, 22 nt, Homo sapiens
agaggcccuucacccagagcca

SEQ ID NO: 31941 - RNA, 16 nt, Homo sapiens
caggaaccauuuucac

SEQ ID NO: 31942 - RNA, 18 nt, Homo sapiens
gauucuuuuucucccccu

SEQ ID NO: 31943 - RNA, 19 nt, Homo sapiens
ugauuuccaacaugagguu

SEQ ID NO: 31944 - RNA, 23 nt, Homo sapiens
cugacaggauuuuaggucacuuu

SEQ ID NO: 31945 - RNA, 20 nt, Homo sapiens
ggauuuuaggucacuuugua

SEQ ID NO: 31946 - RNA, 21 nt, Homo sapiens
ccaaacagauaucuaaacacu

SEQ ID NO: 31947 - RNA, 21 nt, Homo sapiens
ccgagcgcgggcggcuccccg

SEQ ID NO: 31948 - RNA, 19 nt, Homo sapiens
gucgguccaguccuugccu

SEQ ID NO: 31949 - RNA, 20 nt, Homo sapiens
aagagagguaggagaggcug

SEQ ID NO: 31950 - RNA, 22 nt, Homo sapiens
caggcuucccugucuguagagc

SEQ ID NO: 31951 - RNA, 21 nt, Homo sapiens
gcaagugccauccacacuugc

SEQ ID NO: 31952 - RNA, 18 nt, Homo sapiens
gcuaaccaucuuaugagu

SEQ ID NO: 31953 - RNA, 21 nt, Homo sapiens
guguugguaccuguggauuuu

SEQ ID NO: 31954 - RNA, 18 nt, Homo sapiens
uauugaagugucuaacaa

SEQ ID NO: 31955 - RNA, 26 nt, Homo sapiens
ucuuuuacagaggcuauuuuaaucuu

SEQ ID NO: 31956 - RNA, 22 nt, Homo sapiens
uggaauuuauagaggcuacaac

SEQ ID NO: 31957 - RNA, 25 nt, Homo sapiens
gcuucccuguguccucucucccucu

SEQ ID NO: 31958 - RNA, 19 nt, Homo sapiens
ugcaugcggacuuacuuug

SEQ ID NO: 31959 - RNA, 17 nt, Homo sapiens
uugaagauaugugcuua

SEQ ID NO: 31960 - RNA, 23 nt, Homo sapiens
uuguuucucccucugguaacauc

SEQ ID NO: 31961 - RNA, 23 nt, Homo sapiens
cccuccccaccaacuucucugcc

SEQ ID NO: 31962 - RNA, 23 nt, Homo sapiens
ccuuggugucagggaccugagag

SEQ ID NO: 31963 - RNA, 17 nt, Homo sapiens
ggcuuggcccacugcca

SEQ ID NO: 31964 - RNA, 21 nt, Homo sapiens
caggguucaugauuacuguga

SEQ ID NO: 31965 - RNA, 23 nt, Homo sapiens
cauacuagguuaaagauaaagug

SEQ ID NO: 31966 - RNA, 21 nt, Homo sapiens
cauccauggaauuuuggaaug

SEQ ID NO: 31967 - RNA, 18 nt, Homo sapiens
cucuaaacaaaugcaugc

SEQ ID NO: 31968 - RNA, 17 nt, Homo sapiens
ggggacucuuaaaaaga

SEQ ID NO: 31969 - RNA, 18 nt, Homo sapiens
ucaggaacagaccauuca

SEQ ID NO: 31970 - RNA, 26 nt, Homo sapiens
ugaaugguaacuuuuuaaugugaaac

SEQ ID NO: 31971 - RNA, 21 nt, Homo sapiens
ugaguaauuuguacagucaau

SEQ ID NO: 31972 - RNA, 20 nt, Homo sapiens
uuccuugcugacucauuucc

SEQ ID NO: 31973 - RNA, 20 nt, Homo sapiens
uugaaaacaacagacguaca

SEQ ID NO: 31974 - RNA, 16 nt, Homo sapiens
agcccggcacuacggg

SEQ ID NO: 31975 - RNA, 18 nt, Homo sapiens
cccgccgcccccgcccuc

SEQ ID NO: 31976 - RNA, 17 nt, Homo sapiens
cucagcgccgccgacac

SEQ ID NO: 31977 - RNA, 19 nt, Homo sapiens
ggcaaagguucccaccuua

SEQ ID NO: 31978 - RNA, 19 nt, Homo sapiens
ucuccaucaccgcaaccaa

SEQ ID NO: 31979 - RNA, 17 nt, Homo sapiens
ugaagagacuguggagu

SEQ ID NO: 31980 - RNA, 18 nt, Homo sapiens
agagugagacaagcaaca

SEQ ID NO: 31981 - RNA, 20 nt, Homo sapiens
gcggcuguagcggcgugaca

SEQ ID NO: 31982 - RNA, 21 nt, Homo sapiens
ggagacggcggcggcuguagc

SEQ ID NO: 31983 - RNA, 24 nt, Homo sapiens
caaauaaugaagaucucuccuuca

SEQ ID NO: 31984 - RNA, 20 nt, Homo sapiens
cucuccuucagucugcucug

SEQ ID NO: 31985 - RNA, 19 nt, Homo sapiens
cccacagcccguguucccg

SEQ ID NO: 31986 - RNA, 23 nt, Homo sapiens
ccccgcccgccggccccuccagc

SEQ ID NO: 31987 - RNA, 21 nt, Homo sapiens
uaucccucacucauuuagcca

SEQ ID NO: 31988 - RNA, 17 nt, Homo sapiens
ccccagaggaccagagc

SEQ ID NO: 31989 - RNA, 23 nt, Homo sapiens
ggagauggaggcggcggcguggc

SEQ ID NO: 31990 - RNA, 19 nt, Homo sapiens
aaaaagauacagugaguaa

SEQ ID NO: 31991 - RNA, 18 nt, Homo sapiens
auagagagcauauggaua

SEQ ID NO: 31992 - RNA, 24 nt, Homo sapiens
ccgagucucagauauucuguuaua

SEQ ID NO: 31993 - RNA, 19 nt, Homo sapiens
cuuuccugaccucugguuu

SEQ ID NO: 31994 - RNA, 24 nt, Homo sapiens
uacguuuauuuucuucauaaauua

SEQ ID NO: 31995 - RNA, 21 nt, Homo sapiens
cagaaccuuuuuuaaauguaa

SEQ ID NO: 31996 - RNA, 18 nt, Homo sapiens
gugcggugguguguguag

SEQ ID NO: 31997 - RNA, 24 nt, Homo sapiens
ucugggaaguucugaauuucuuuu

SEQ ID NO: 31998 - RNA, 20 nt, Homo sapiens
ccccacccccaccccgcugc

SEQ ID NO: 31999 - RNA, 23 nt, Homo sapiens
cuggugauuaauuagcaauucuc

SEQ ID NO: 32000 - RNA, 20 nt, Homo sapiens
gccuggauugcucacuguuu

SEQ ID NO: 32001 - RNA, 18 nt, Homo sapiens
accaccaaaauagcuaca

SEQ ID NO: 32002 - RNA, 18 nt, Homo sapiens
accuggguaacugccugg

SEQ ID NO: 32003 - RNA, 23 nt, Homo sapiens
cacuuccguccaaaguccacuua

SEQ ID NO: 32004 - RNA, 22 nt, Homo sapiens
ccccuccccaccuccugccccc

SEQ ID NO: 32005 - RNA, 22 nt, Homo sapiens
aggcacuugcugagcccacgcu

SEQ ID NO: 32006 - RNA, 21 nt, Homo sapiens
ccaaugccaaagaggcaccga

SEQ ID NO: 32007 - RNA, 18 nt, Homo sapiens
cguguaggaaacccagug

SEQ ID NO: 32008 - RNA, 22 nt, Homo sapiens
guguccagaauugguggguucu

SEQ ID NO: 32009 - RNA, 19 nt, Homo sapiens
cugagucgcggggcagcuc

SEQ ID NO: 32010 - RNA, 22 nt, Homo sapiens
ugaagucucacgccuacauuca

SEQ ID NO: 32011 - RNA, 22 nt, Homo sapiens
accugggccacagugccugccu

SEQ ID NO: 32012 - RNA, 21 nt, Homo sapiens
ccaagagaaucuguucuagac

SEQ ID NO: 32013 - RNA, 16 nt, Homo sapiens
cccauaucaucagcug

SEQ ID NO: 32014 - RNA, 16 nt, Homo sapiens
gggaaguuuuaucagu

SEQ ID NO: 32015 - RNA, 16 nt, Homo sapiens
ugaaguugugguaaca

SEQ ID NO: 32016 - RNA, 17 nt, Homo sapiens
cuauuaauagaaugagg

SEQ ID NO: 32017 - RNA, 19 nt, Homo sapiens
ggaauaguagaagagguga

SEQ ID NO: 32018 - RNA, 18 nt, Homo sapiens
ugguccuaaucuguaaau

SEQ ID NO: 32019 - RNA, 20 nt, Homo sapiens
uguaucagcagcauuucuga

SEQ ID NO: 32020 - RNA, 21 nt, Homo sapiens
cccaccacaccccagcugcga

SEQ ID NO: 32021 - RNA, 20 nt, Homo sapiens
aagacuucagcagcaaacca

SEQ ID NO: 32022 - RNA, 17 nt, Homo sapiens
auccguuccuccucuga

SEQ ID NO: 32023 - RNA, 22 nt, Homo sapiens
ccuacagaagacauagaagaug

SEQ ID NO: 32024 - RNA, 21 nt, Homo sapiens
cugcagguggaagugcuuuuc

SEQ ID NO: 32025 - RNA, 17 nt, Homo sapiens
gaagaggcucgccuccc

SEQ ID NO: 32026 - RNA, 20 nt, Homo sapiens
gcagguggaagugcuuuucu

SEQ ID NO: 32027 - RNA, 23 nt, Homo sapiens
ucaaagacuucagcagcaaacca

SEQ ID NO: 32028 - RNA, 21 nt, Homo sapiens
agcagccacuggugccacugc

SEQ ID NO: 32029 - RNA, 21 nt, Homo sapiens
aucucuaaagcaaaagccuca

SEQ ID NO: 32030 - RNA, 25 nt, Homo sapiens
cuuaugggaauccugagcugcuuuu

SEQ ID NO: 32031 - RNA, 20 nt, Homo sapiens
gaaugcuggauuucucugga

SEQ ID NO: 32032 - RNA, 16 nt, Homo sapiens
gacccaucucugcccu

SEQ ID NO: 32033 - RNA, 21 nt, Homo sapiens
gacuaauugggaaacggggaa

SEQ ID NO: 32034 - RNA, 23 nt, Homo sapiens
gagcaccuucagcaugaguuguu

SEQ ID NO: 32035 - RNA, 22 nt, Homo sapiens
gcuucagaguuucaccugccca

SEQ ID NO: 32036 - RNA, 18 nt, Homo sapiens
guccaggaggccugugga

SEQ ID NO: 32037 - RNA, 19 nt, Homo sapiens
guccaggaggccuguggac

SEQ ID NO: 32038 - RNA, 21 nt, Homo sapiens
ugaguggauugcuugagccua

SEQ ID NO: 32039 - RNA, 24 nt, Homo sapiens
uucuuuuauguaacauguaguuua

SEQ ID NO: 32040 - RNA, 17 nt, Homo sapiens
aauaccaaaauacuacu

SEQ ID NO: 32041 - RNA, 20 nt, Homo sapiens
aguacuuuugcccaugugcu

SEQ ID NO: 32042 - RNA, 22 nt, Homo sapiens
aucuuguaaggcuauauuuuuu

SEQ ID NO: 32043 - RNA, 20 nt, Homo sapiens
cguccccgcccagccugcuc

SEQ ID NO: 32044 - RNA, 18 nt, Homo sapiens
gagcauuaaauuauccua

SEQ ID NO: 32045 - RNA, 18 nt, Homo sapiens
ucccucuccacuccugaa

SEQ ID NO: 32046 - RNA, 18 nt, Homo sapiens
caguucuaaaauacuuuu

SEQ ID NO: 32047 - RNA, 17 nt, Homo sapiens
aaacacugaaaggcuuc

SEQ ID NO: 32048 - RNA, 18 nt, Homo sapiens
acucaguguacaucugaa

SEQ ID NO: 32049 - RNA, 18 nt, Homo sapiens
agcuugaugcucucaguc

SEQ ID NO: 32050 - RNA, 22 nt, Homo sapiens
uccugaugaugaagugauuugc

SEQ ID NO: 32051 - RNA, 19 nt, Homo sapiens
ugcuuugcuuaacaacauc

SEQ ID NO: 32052 - RNA, 20 nt, Homo sapiens
uggaggauauuuggcuuuga

SEQ ID NO: 32053 - RNA, 20 nt, Homo sapiens
uuugagcaguugucuggucc

SEQ ID NO: 32054 - RNA, 18 nt, Homo sapiens
cauauggcuagccagcuu

SEQ ID NO: 32055 - RNA, 17 nt, Homo sapiens
gcaauugugaaugggag

SEQ ID NO: 32056 - RNA, 22 nt, Homo sapiens
ggcauuuucccagauguuuaca

SEQ ID NO: 32057 - RNA, 19 nt, Homo sapiens
gguuuucaguaugaaccua

SEQ ID NO: 32058 - RNA, 21 nt, Homo sapiens
uauuuccucaaauuugccuca

SEQ ID NO: 32059 - RNA, 18 nt, Homo sapiens
ugggcucaagucacuuuu

SEQ ID NO: 32060 - RNA, 22 nt, Homo sapiens
uuguaaucauguuaccauuaca

SEQ ID NO: 32061 - RNA, 22 nt, Homo sapiens
uuuaagaacuguauuuuauuuu

SEQ ID NO: 32062 - RNA, 20 nt, Homo sapiens
accacacuuuccuccuacuc

SEQ ID NO: 32063 - RNA, 20 nt, Homo sapiens
agaaaauucauaaaaaugua

SEQ ID NO: 32064 - RNA, 20 nt, Homo sapiens
cgcuuuacaaaggcaugacu

SEQ ID NO: 32065 - RNA, 18 nt, Homo sapiens
cucuucugaugcauggca

SEQ ID NO: 32066 - RNA, 19 nt, Homo sapiens
cugauuucuugacucucaa

SEQ ID NO: 32067 - RNA, 18 nt, Homo sapiens
gacacaucacaugcauca

SEQ ID NO: 32068 - RNA, 21 nt, Homo sapiens
ggcacuauuccuggugcagua

SEQ ID NO: 32069 - RNA, 17 nt, Homo sapiens
uagcuuugaguggcaga

SEQ ID NO: 32070 - RNA, 21 nt, Homo sapiens
ugguccuaaggaagcaugagc

SEQ ID NO: 32071 - RNA, 20 nt, Homo sapiens
ugugagacuccaagcuccuu

SEQ ID NO: 32072 - RNA, 18 nt, Homo sapiens
uguguuaugaauuucuga

SEQ ID NO: 32073 - RNA, 19 nt, Homo sapiens
ggacgacggcggcggcggc

SEQ ID NO: 32074 - RNA, 22 nt, Homo sapiens
gugcuguccgugccccaggcug

SEQ ID NO: 32075 - RNA, 21 nt, Homo sapiens
auccccaaagacauuaucugu

SEQ ID NO: 32076 - RNA, 25 nt, Homo sapiens
auuaacucucuuuucuugcaucuca

SEQ ID NO: 32077 - RNA, 17 nt, Homo sapiens
caauacaugauuaaaug

SEQ ID NO: 32078 - RNA, 18 nt, Homo sapiens
cagcuuggaaggcauuga

SEQ ID NO: 32079 - RNA, 25 nt, Homo sapiens
cauaaacuaauuauuucucuggaua

SEQ ID NO: 32080 - RNA, 17 nt, Homo sapiens
cauguauucuaacauuu

SEQ ID NO: 32081 - RNA, 21 nt, Homo sapiens
gcugugggcaacuguuuuguu

SEQ ID NO: 32082 - RNA, 19 nt, Homo sapiens
guagcaguguuauucuaca

SEQ ID NO: 32083 - RNA, 24 nt, Homo sapiens
uagaagguggaaaccaaaacccuc

SEQ ID NO: 32084 - RNA, 20 nt, Homo sapiens
ucacuuauuaacucucuuuu

SEQ ID NO: 32085 - RNA, 19 nt, Homo sapiens
aaacuccugaccucaggug

SEQ ID NO: 32086 - RNA, 19 nt, Homo sapiens
agcugugguugucucguuu

SEQ ID NO: 32087 - RNA, 28 nt, Homo sapiens
caaaaucuucaccuugaguacaauguac

SEQ ID NO: 32088 - RNA, 17 nt, Homo sapiens
cuugaaacccuauuucu

SEQ ID NO: 32089 - RNA, 21 nt, Homo sapiens
gaaaaaugagacaauauaucc

SEQ ID NO: 32090 - RNA, 20 nt, Homo sapiens
gacaucuacuugggagcugu

SEQ ID NO: 32091 - RNA, 18 nt, Homo sapiens
gcugugguugucucguuu

SEQ ID NO: 32092 - RNA, 21 nt, Homo sapiens
ggcagcagggcccucaagcca

SEQ ID NO: 32093 - RNA, 21 nt, Homo sapiens
ucaaaaucuucaccuugagua

SEQ ID NO: 32094 - RNA, 20 nt, Homo sapiens
ucucacaaaauacagauaug

SEQ ID NO: 32095 - RNA, 26 nt, Homo sapiens
uuagggguaacacaacacagauacuu

SEQ ID NO: 32096 - RNA, 20 nt, Homo sapiens
uuuccaucgcugaagacucu

SEQ ID NO: 32097 - RNA, 19 nt, Homo sapiens
aaacacugauaguaucuca

SEQ ID NO: 32098 - RNA, 21 nt, Homo sapiens
acacagaaauguagcuguguu

SEQ ID NO: 32099 - RNA, 21 nt, Homo sapiens
accugagacuugccgucuggc

SEQ ID NO: 32100 - RNA, 20 nt, Homo sapiens
agcuuccagauagcaccguu

SEQ ID NO: 32101 - RNA, 18 nt, Homo sapiens
auggaagguauuaaacua

SEQ ID NO: 32102 - RNA, 22 nt, Homo sapiens
cauagugguaaauaauuaugaa

SEQ ID NO: 32103 - RNA, 19 nt, Homo sapiens
gauaaauaugcaugcuuuu

SEQ ID NO: 32104 - RNA, 21 nt, Homo sapiens
gguaaauggagaaaauauuuc

SEQ ID NO: 32105 - RNA, 21 nt, Homo sapiens
aacaggcuuauuuucugugaa

SEQ ID NO: 32106 - RNA, 19 nt, Homo sapiens
acuuuuccaguaaaugaag

SEQ ID NO: 32107 - RNA, 19 nt, Homo sapiens
cugucuuucccaucuucga

SEQ ID NO: 32108 - RNA, 18 nt, Homo sapiens
uccugaacugggaacaaa

SEQ ID NO: 32109 - RNA, 24 nt, Homo sapiens
acagugugcaaagaccaguccuca

SEQ ID NO: 32110 - RNA, 19 nt, Homo sapiens
accuuccccagaacccuca

SEQ ID NO: 32111 - RNA, 25 nt, Homo sapiens
gaaagcugggcuagaaaaucucuca

SEQ ID NO: 32112 - RNA, 19 nt, Homo sapiens
guuuucuaagccacccuca

SEQ ID NO: 32113 - RNA, 16 nt, Homo sapiens
uagugucauuucagga

SEQ ID NO: 32114 - RNA, 17 nt, Homo sapiens
ugcccagaagggcccca

SEQ ID NO: 32115 - RNA, 18 nt, Homo sapiens
uuauaugccagucacacc

SEQ ID NO: 32116 - RNA, 18 nt, Homo sapiens
caauuggaaacuuucaca

SEQ ID NO: 32117 - RNA, 17 nt, Homo sapiens
cuuucuuucuguuagca

SEQ ID NO: 32118 - RNA, 20 nt, Homo sapiens
aaggcuggaguuuggaauca

SEQ ID NO: 32119 - RNA, 19 nt, Homo sapiens
ccuuugcuauaugcaguca

SEQ ID NO: 32120 - RNA, 19 nt, Homo sapiens
guccacugaagcgugcaga

SEQ ID NO: 32121 - RNA, 18 nt, Homo sapiens
ucucuuggcuuccaugga

SEQ ID NO: 32122 - RNA, 20 nt, Homo sapiens
agaauacgguaagcuuccca

SEQ ID NO: 32123 - RNA, 20 nt, Homo sapiens
uguaucaggagaaucaagcu

SEQ ID NO: 32124 - RNA, 24 nt, Homo sapiens
ggaacaagucucccaaauuuccca

SEQ ID NO: 32125 - RNA, 19 nt, Homo sapiens
uagugaaucacccacaagg

SEQ ID NO: 32126 - RNA, 18 nt, Homo sapiens
ccagaaagccagcuuggu

SEQ ID NO: 32127 - RNA, 22 nt, Homo sapiens
gagccaagaucacgccacugca

SEQ ID NO: 32128 - RNA, 23 nt, Homo sapiens
gcacucagcaucuuuguucuuca

SEQ ID NO: 32129 - RNA, 21 nt, Homo sapiens
gguugcucuggucuuuuuuga

SEQ ID NO: 32130 - RNA, 20 nt, Homo sapiens
guccugaaauggauuggaga

SEQ ID NO: 32131 - RNA, 18 nt, Homo sapiens
uauuccaacgaauucuca

SEQ ID NO: 32132 - RNA, 18 nt, Homo sapiens
uacuggcagagcuguggc

SEQ ID NO: 32133 - RNA, 19 nt, Homo sapiens
guaugaauugcugauacuu

SEQ ID NO: 32134 - RNA, 20 nt, Homo sapiens
uaaaccaacgggaaaauuag

SEQ ID NO: 32135 - RNA, 21 nt, Homo sapiens
gagaagccgcacggcuguggc

SEQ ID NO: 32136 - RNA, 21 nt, Homo sapiens
accugauuuggcuucuggcuc

SEQ ID NO: 32137 - RNA, 21 nt, Homo sapiens
accugggcaguccucugguuu

SEQ ID NO: 32138 - RNA, 17 nt, Homo sapiens
agccaguggaaauugcc

SEQ ID NO: 32139 - RNA, 19 nt, Homo sapiens
ccugggcaguccucugguu

SEQ ID NO: 32140 - RNA, 21 nt, Homo sapiens
cugcggagcaauucuugcuuu

SEQ ID NO: 32141 - RNA, 18 nt, Homo sapiens
gagacgccugggguccca

SEQ ID NO: 32142 - RNA, 20 nt, Homo sapiens
ggcucuuuaaucucauuuua

SEQ ID NO: 32143 - RNA, 18 nt, Homo sapiens
gggacagacuugaaggca

SEQ ID NO: 32144 - RNA, 19 nt, Homo sapiens
ucugaaaaugcuucuuggu

SEQ ID NO: 32145 - RNA, 20 nt, Homo sapiens
uggcauuccagcaggagcua

SEQ ID NO: 32146 - RNA, 19 nt, Homo sapiens
aaauaaauauguuugucau

SEQ ID NO: 32147 - RNA, 26 nt, Homo sapiens
acuugaauugcuugauacuuugguuu

SEQ ID NO: 32148 - RNA, 18 nt, Homo sapiens
ccugcucaaccuggcaga

SEQ ID NO: 32149 - RNA, 19 nt, Homo sapiens
ccuucucaguuucucccca

SEQ ID NO: 32150 - RNA, 22 nt, Homo sapiens
cuccucuaggaacuauguugaa

SEQ ID NO: 32151 - RNA, 19 nt, Homo sapiens
cuggggcuaccugaucuga

SEQ ID NO: 32152 - RNA, 21 nt, Homo sapiens
cuguguauuacccuugcuuuu

SEQ ID NO: 32153 - RNA, 18 nt, Homo sapiens
ggcaauuaccccggugga

SEQ ID NO: 32154 - RNA, 24 nt, Homo sapiens
uaagagggcaggcagcagcagugc

SEQ ID NO: 32155 - RNA, 16 nt, Homo sapiens
ugaauggggaucccag

SEQ ID NO: 32156 - RNA, 20 nt, Homo sapiens
accacacaguuacacauuca

SEQ ID NO: 32157 - RNA, 19 nt, Homo sapiens
agaugguagcagaaacuga

SEQ ID NO: 32158 - RNA, 21 nt, Homo sapiens
ccaacgaagggggugcccugu

SEQ ID NO: 32159 - RNA, 19 nt, Homo sapiens
gccagaaaccuucagaagg

SEQ ID NO: 32160 - RNA, 23 nt, Homo sapiens
ucuugcuuccggaagcuugcgaa

SEQ ID NO: 32161 - RNA, 19 nt, Homo sapiens
ugggaacuggguggaacug

SEQ ID NO: 32162 - RNA, 22 nt, Homo sapiens
uuucucccugcccagccaggga

SEQ ID NO: 32163 - RNA, 19 nt, Homo sapiens
agccaggaucacucacucu

SEQ ID NO: 32164 - RNA, 25 nt, Homo sapiens
ccaccccagugucucacuccacuga

SEQ ID NO: 32165 - RNA, 21 nt, Homo sapiens
cccaagauauuaaaccaguga

SEQ ID NO: 32166 - RNA, 19 nt, Homo sapiens
cuucucugcacugccccuc

SEQ ID NO: 32167 - RNA, 19 nt, Homo sapiens
gcaggagguucauggccca

SEQ ID NO: 32168 - RNA, 19 nt, Homo sapiens
gccaaggaagcccagcuga

SEQ ID NO: 32169 - RNA, 21 nt, Homo sapiens
gccuuugucaggacccuguga

SEQ ID NO: 32170 - RNA, 23 nt, Homo sapiens
gcugcaaagcagaugugcaggga

SEQ ID NO: 32171 - RNA, 21 nt, Homo sapiens
ucugccgggcauuguuuguuu

SEQ ID NO: 32172 - RNA, 22 nt, Homo sapiens
uguaguuugacagaguaugcua

SEQ ID NO: 32173 - RNA, 22 nt, Homo sapiens
cuuuggcugaggggcuugggaa

SEQ ID NO: 32174 - RNA, 17 nt, Homo sapiens
gcucccugcuuuggcug

SEQ ID NO: 32175 - RNA, 21 nt, Homo sapiens
ugagaccaguguaucagguca

SEQ ID NO: 32176 - RNA, 24 nt, Homo sapiens
aggaagucaugucucacuacuuuu

SEQ ID NO: 32177 - RNA, 18 nt, Homo sapiens
uggguggaucaccugagg

SEQ ID NO: 32178 - RNA, 20 nt, Homo sapiens
uucaagaccagccugaccaa

SEQ ID NO: 32179 - RNA, 21 nt, Homo sapiens
auguuguaaacagcuguucca

SEQ ID NO: 32180 - RNA, 21 nt, Homo sapiens
ucuuuaguaauuuaaucuuca

SEQ ID NO: 32181 - RNA, 24 nt, Homo sapiens
ugcaaccuccgccuccuggauuca

SEQ ID NO: 32182 - RNA, 21 nt, Homo sapiens
ugcaauugugucugguaugcu

SEQ ID NO: 32183 - RNA, 19 nt, Homo sapiens
ugucauaaaugucacaaua

SEQ ID NO: 32184 - RNA, 19 nt, Homo sapiens
auauguucgguaaaugcuc

SEQ ID NO: 32185 - RNA, 18 nt, Homo sapiens
cuccaccuccucuacucu

SEQ ID NO: 32186 - RNA, 23 nt, Homo sapiens
uagccuuuuuaugagacagguca

SEQ ID NO: 32187 - RNA, 21 nt, Homo sapiens
ugccagacacacccuccccag

SEQ ID NO: 32188 - RNA, 21 nt, Homo sapiens
caggacuacguaaauuggacu

SEQ ID NO: 32189 - RNA, 19 nt, Homo sapiens
gaagaagccuggggccuca

SEQ ID NO: 32190 - RNA, 21 nt, Homo sapiens
cuugucuuucagaauuacuua

SEQ ID NO: 32191 - RNA, 18 nt, Homo sapiens
guccuuuaagaagaaggg

SEQ ID NO: 32192 - RNA, 18 nt, Homo sapiens
gugccaucuccguuaaaa

SEQ ID NO: 32193 - RNA, 21 nt, Homo sapiens
ucuauuuucuaugaccagaga

SEQ ID NO: 32194 - RNA, 21 nt, Homo sapiens
acagccagcaugacugcuucu

SEQ ID NO: 32195 - RNA, 20 nt, Homo sapiens
acugcaauguuaacaacggu

SEQ ID NO: 32196 - RNA, 18 nt, Homo sapiens
caguacccucagugccug

SEQ ID NO: 32197 - RNA, 23 nt, Homo sapiens
ccacugaugaggcccuccuagcc

SEQ ID NO: 32198 - RNA, 22 nt, Homo sapiens
ccucccaccccauaacuguucc

SEQ ID NO: 32199 - RNA, 19 nt, Homo sapiens
cuuccuguugaacuuccua

SEQ ID NO: 32200 - RNA, 20 nt, Homo sapiens
gagaauacaggaagccccca

SEQ ID NO: 32201 - RNA, 24 nt, Homo sapiens
gcaaaaucucucuguccuaaacua

SEQ ID NO: 32202 - RNA, 21 nt, Homo sapiens
gcuugagugaauguuaggccu

SEQ ID NO: 32203 - RNA, 17 nt, Homo sapiens
uccugggauucugggga

SEQ ID NO: 32204 - RNA, 19 nt, Homo sapiens
ccugaguagucccuggcuu

SEQ ID NO: 32205 - RNA, 21 nt, Homo sapiens
ccugaguagucccuggcuuuu

SEQ ID NO: 32206 - RNA, 20 nt, Homo sapiens
guguguguggguggggacua

SEQ ID NO: 32207 - RNA, 30 nt, Homo sapiens
gcgaccucaucugccgcaaccggacggcua

SEQ ID NO: 32208 - RNA, 22 nt, Homo sapiens
ggaaagcggcagcggcggcggc

SEQ ID NO: 32209 - RNA, 20 nt, Homo sapiens
agugaauuacccaacuuaac

SEQ ID NO: 32210 - RNA, 21 nt, Homo sapiens
cgcggguggccccucuggcau

SEQ ID NO: 32211 - RNA, 20 nt, Homo sapiens
cuucuaucuugccuugucuu

SEQ ID NO: 32212 - RNA, 25 nt, Homo sapiens
gcagcacauuaucagcagugaccua

SEQ ID NO: 32213 - RNA, 20 nt, Homo sapiens
aacaggagugaugucauuuc

SEQ ID NO: 32214 - RNA, 23 nt, Homo sapiens
aaugugaccgucuguaugacccg

SEQ ID NO: 32215 - RNA, 22 nt, Homo sapiens
acccguuuaccgugcuauaauc

SEQ ID NO: 32216 - RNA, 21 nt, Homo sapiens
auguggccacacgguggauga

SEQ ID NO: 32217 - RNA, 18 nt, Homo sapiens
ccacuccucaccaccagc

SEQ ID NO: 32218 - RNA, 19 nt, Homo sapiens
cuaucucccuuucugugau

SEQ ID NO: 32219 - RNA, 20 nt, Homo sapiens
gaagaaaaauaaagccauug

SEQ ID NO: 32220 - RNA, 23 nt, Homo sapiens
gcuuggcaggugcuuuuugguuc

SEQ ID NO: 32221 - RNA, 16 nt, Homo sapiens
guuccugagcuuccgg

SEQ ID NO: 32222 - RNA, 20 nt, Homo sapiens
uauccugaucccugaauuuc

SEQ ID NO: 32223 - RNA, 18 nt, Homo sapiens
ucaacguucugaaaccac

SEQ ID NO: 32224 - RNA, 18 nt, Homo sapiens
ucaagaaaucaucaucug

SEQ ID NO: 32225 - RNA, 19 nt, Homo sapiens
uguaguacauggccaacuu

SEQ ID NO: 32226 - RNA, 21 nt, Homo sapiens
cuggccaccaucaucuuugca

SEQ ID NO: 32227 - RNA, 21 nt, Homo sapiens
uuuccaguugcauuuaauuuu

SEQ ID NO: 32228 - RNA, 17 nt, Homo sapiens
aaaaaaauaccacugug

SEQ ID NO: 32229 - RNA, 22 nt, Homo sapiens
aaaaguuuaaaacuuucuaaua

SEQ ID NO: 32230 - RNA, 19 nt, Homo sapiens
ccuccaacagcugcuuuaa

SEQ ID NO: 32231 - RNA, 19 nt, Homo sapiens
auucaguuucccccaagga

SEQ ID NO: 32232 - RNA, 22 nt, Homo sapiens
gagccaagauugcaccacugca

SEQ ID NO: 32233 - RNA, 18 nt, Homo sapiens
uggagaccacuuacuuug

SEQ ID NO: 32234 - RNA, 20 nt, Homo sapiens
uaguugaaaaauaaaaucuc

SEQ ID NO: 32235 - RNA, 22 nt, Homo sapiens
uguucauauuucuugcauauca

SEQ ID NO: 32236 - RNA, 23 nt, Homo sapiens
ccucgggcgcuacgaacccggca

SEQ ID NO: 32237 - RNA, 19 nt, Homo sapiens
agguuccacggcagccacg

SEQ ID NO: 32238 - RNA, 16 nt, Homo sapiens
cacaggcucuuuggca

SEQ ID NO: 32239 - RNA, 18 nt, Homo sapiens
ccacuuccccuucccucu

SEQ ID NO: 32240 - RNA, 19 nt, Homo sapiens
cgcgcccccguacccgcgu

SEQ ID NO: 32241 - RNA, 19 nt, Homo sapiens
gucggguuuaccaaucagc

SEQ ID NO: 32242 - RNA, 19 nt, Homo sapiens
cgucgcggugguggacucu

SEQ ID NO: 32243 - RNA, 17 nt, Homo sapiens
aagaagauacagaucug

SEQ ID NO: 32244 - RNA, 20 nt, Homo sapiens
aagauacagaucugcacuga

SEQ ID NO: 32245 - RNA, 20 nt, Homo sapiens
aucugugaccuauaucaagu

SEQ ID NO: 32246 - RNA, 26 nt, Homo sapiens
cucuuccauuguacauguggguuaua

SEQ ID NO: 32247 - RNA, 23 nt, Homo sapiens
uaucugugaccuauaucaaguac

SEQ ID NO: 32248 - RNA, 18 nt, Homo sapiens
ucaagugauucugaugca

SEQ ID NO: 32249 - RNA, 24 nt, Homo sapiens
ucuagaauuuuguauuuuauuuca

SEQ ID NO: 32250 - RNA, 21 nt, Homo sapiens
uggccauagaaaaguaagcuu

SEQ ID NO: 32251 - RNA, 20 nt, Homo sapiens
uuguggaauaaguguuccag

SEQ ID NO: 32252 - RNA, 19 nt, Homo sapiens
aagcaauucuccugcuuca

SEQ ID NO: 32253 - RNA, 18 nt, Homo sapiens
acucaucuccuccuccca

SEQ ID NO: 32254 - RNA, 17 nt, Homo sapiens
ccccagagacagagcca

SEQ ID NO: 32255 - RNA, 21 nt, Homo sapiens
ccuuccccaugauucucuaca

SEQ ID NO: 32256 - RNA, 16 nt, Homo sapiens
cgcacaaagaguuuau

SEQ ID NO: 32257 - RNA, 17 nt, Homo sapiens
uucuccugcuucagccu

SEQ ID NO: 32258 - RNA, 25 nt, Homo sapiens
cgaucguuauucccccaauucauca

SEQ ID NO: 32259 - RNA, 19 nt, Homo sapiens
cucucucucucccucucuc

SEQ ID NO: 32260 - RNA, 24 nt, Homo sapiens
gcauuguagucuaccugcauguga

SEQ ID NO: 32261 - RNA, 18 nt, Homo sapiens
aagccaucuucgcgaucg

SEQ ID NO: 32262 - RNA, 21 nt, Homo sapiens
agucuccuacacgcagucaac

SEQ ID NO: 32263 - RNA, 19 nt, Homo sapiens
auaaauguauaccccuuac

SEQ ID NO: 32264 - RNA, 21 nt, Homo sapiens
ggaaauguuacaguaauccac

SEQ ID NO: 32265 - RNA, 20 nt, Homo sapiens
ucccuaaauguaaccaggga

SEQ ID NO: 32266 - RNA, 23 nt, Homo sapiens
aguuugccauuguugcagaguua

SEQ ID NO: 32267 - RNA, 15 nt, Homo sapiens
aguuuuucugucuca

SEQ ID NO: 32268 - RNA, 17 nt, Homo sapiens
ccagcaccuuuucuuua

SEQ ID NO: 32269 - RNA, 18 nt, Homo sapiens
guuugccauuguugcaga

SEQ ID NO: 32270 - RNA, 19 nt, Homo sapiens
uggaaaaauuguguuuaca

SEQ ID NO: 32271 - RNA, 24 nt, Homo sapiens
ugguuuccuuuuaccaugaaauug

SEQ ID NO: 32272 - RNA, 22 nt, Homo sapiens
ccccaccccagugcccacaggc

SEQ ID NO: 32273 - RNA, 20 nt, Homo sapiens
gccugacccucagggaguca

SEQ ID NO: 32274 - RNA, 19 nt, Homo sapiens
ucauuuccuuuuugcacac

SEQ ID NO: 32275 - RNA, 21 nt, Homo sapiens
ucccuauucacaaccagugca

SEQ ID NO: 32276 - RNA, 22 nt, Homo sapiens
agcggcccuccccacugcccuc

SEQ ID NO: 32277 - RNA, 18 nt, Homo sapiens
gccccagggcccaccuuu

SEQ ID NO: 32278 - RNA, 16 nt, Homo sapiens
aacaucacuugagcca

SEQ ID NO: 32279 - RNA, 18 nt, Homo sapiens
aagguaagugggcaaaga

SEQ ID NO: 32280 - RNA, 27 nt, Homo sapiens
ccacauuucuguacuguuccucuuuca

SEQ ID NO: 32281 - RNA, 22 nt, Homo sapiens
cuuguuccaguuucugucacug

SEQ ID NO: 32282 - RNA, 20 nt, Homo sapiens
cuuuuuugcccuuggcucuu

SEQ ID NO: 32283 - RNA, 18 nt, Homo sapiens
gauaaacaucacuugagc

SEQ ID NO: 32284 - RNA, 18 nt, Homo sapiens
uaaaaaugacuuugggau

SEQ ID NO: 32285 - RNA, 18 nt, Homo sapiens
uaucuacucuucugugau

SEQ ID NO: 32286 - RNA, 18 nt, Homo sapiens
agccacagcacccagcca

SEQ ID NO: 32287 - RNA, 18 nt, Homo sapiens
uccaccuccuggguucaa

SEQ ID NO: 32288 - RNA, 21 nt, Homo sapiens
aaacuaaagaaggcccaccac

SEQ ID NO: 32289 - RNA, 16 nt, Homo sapiens
acaguaauaaugggag

SEQ ID NO: 32290 - RNA, 21 nt, Homo sapiens
aguggaaaacccacgaucuga

SEQ ID NO: 32291 - RNA, 25 nt, Homo sapiens
guucuccaaaacgcucuaaaacggg

SEQ ID NO: 32292 - RNA, 24 nt, Homo sapiens
accuuugcagaauaaacucucucc

SEQ ID NO: 32293 - RNA, 21 nt, Homo sapiens
agcugucuccugccccaggga

SEQ ID NO: 32294 - RNA, 19 nt, Homo sapiens
aggugccucucccucacca

SEQ ID NO: 32295 - RNA, 22 nt, Homo sapiens
agugccugugcccacucugugc

SEQ ID NO: 32296 - RNA, 17 nt, Homo sapiens
ccgcgcacgccgccuca

SEQ ID NO: 32297 - RNA, 22 nt, Homo sapiens
gcgacccucagcccggcgggga

SEQ ID NO: 32298 - RNA, 23 nt, Homo sapiens
gcuguuuuuuuguuguuguuuua

SEQ ID NO: 32299 - RNA, 21 nt, Homo sapiens
gcuuugauggucuggugccag

SEQ ID NO: 32300 - RNA, 19 nt, Homo sapiens
ucuucggguacaacccuga

SEQ ID NO: 32301 - RNA, 17 nt, Homo sapiens
cccagcaaagaacuggc

SEQ ID NO: 32302 - RNA, 21 nt, Homo sapiens
cguugcacagaaauucugaga

SEQ ID NO: 32303 - RNA, 22 nt, Homo sapiens
cuuuggugcuagaagccugcgg

SEQ ID NO: 32304 - RNA, 19 nt, Homo sapiens
guaugugugaggaauuugg

SEQ ID NO: 32305 - RNA, 17 nt, Homo sapiens
ccugcugacaggcaaca

SEQ ID NO: 32306 - RNA, 19 nt, Homo sapiens
cugagcaccgguuccuuuu

SEQ ID NO: 32307 - RNA, 24 nt, Homo sapiens
gcauuguaugccucaaaugucuca

SEQ ID NO: 32308 - RNA, 20 nt, Homo sapiens
ugcuuuuuaaaauaaugacu

SEQ ID NO: 32309 - RNA, 23 nt, Homo sapiens
uuguaaauacuguaauauauuua

SEQ ID NO: 32310 - RNA, 22 nt, Homo sapiens
uuuuucuaacuauauuacugua

SEQ ID NO: 32311 - RNA, 19 nt, Homo sapiens
aggccccacacagucuuca

SEQ ID NO: 32312 - RNA, 21 nt, Homo sapiens
aucucccagcagguagagcag

SEQ ID NO: 32313 - RNA, 23 nt, Homo sapiens
cagcuugccugacccccauguca

SEQ ID NO: 32314 - RNA, 21 nt, Homo sapiens
ccaggcucccaacuccacccu

SEQ ID NO: 32315 - RNA, 20 nt, Homo sapiens
ccccaccaccacccccagcu

SEQ ID NO: 32316 - RNA, 21 nt, Homo sapiens
cucggcucgggaggcuuggga

SEQ ID NO: 32317 - RNA, 21 nt, Homo sapiens
gcaucagacacagguacagca

SEQ ID NO: 32318 - RNA, 20 nt, Homo sapiens
gccucugugaucuucuccau

SEQ ID NO: 32319 - RNA, 19 nt, Homo sapiens
ggggucuaauaacaaacua

SEQ ID NO: 32320 - RNA, 21 nt, Homo sapiens
gguagagcagagccggagcca

SEQ ID NO: 32321 - RNA, 21 nt, Homo sapiens
uaaaccaauggaaagaagggg

SEQ ID NO: 32322 - RNA, 19 nt, Homo sapiens
ucugggaaaggaccugggg

SEQ ID NO: 32323 - RNA, 20 nt, Homo sapiens
ugccaaguacccugcuccag

SEQ ID NO: 32324 - RNA, 21 nt, Homo sapiens
uggccuccccagcguggggcu

SEQ ID NO: 32325 - RNA, 27 nt, Homo sapiens
ugggguggcagcugauuaggcccagca

SEQ ID NO: 32326 - RNA, 20 nt, Homo sapiens
uuggagagaaggucuccuug

SEQ ID NO: 32327 - RNA, 23 nt, Homo sapiens
ccaucaguucccccaguaccucc

SEQ ID NO: 32328 - RNA, 19 nt, Homo sapiens
ucacccugucaaguuaaca

SEQ ID NO: 32329 - RNA, 18 nt, Homo sapiens
uguugggagcccuuugga

SEQ ID NO: 32330 - RNA, 19 nt, Homo sapiens
ccugggccgccggcuguuu

SEQ ID NO: 32331 - RNA, 19 nt, Homo sapiens
aauguuuauaccaggcuca

SEQ ID NO: 32332 - RNA, 20 nt, Homo sapiens
auugggugggucucccacua

SEQ ID NO: 32333 - RNA, 18 nt, Homo sapiens
ccagugguggucugguuu

SEQ ID NO: 32334 - RNA, 24 nt, Homo sapiens
cccagagugguagccucucaguga

SEQ ID NO: 32335 - RNA, 21 nt, Homo sapiens
ccucccagauugcaucuccag

SEQ ID NO: 32336 - RNA, 18 nt, Homo sapiens
cuggccaccagguccagu

SEQ ID NO: 32337 - RNA, 18 nt, Homo sapiens
gccugcaaauguccagca

SEQ ID NO: 32338 - RNA, 19 nt, Homo sapiens
ucaugacacuaagauguga

SEQ ID NO: 32339 - RNA, 22 nt, Homo sapiens
uccaacaugguucuucuguucc

SEQ ID NO: 32340 - RNA, 20 nt, Homo sapiens
uuugagaggcgcuccuugca

SEQ ID NO: 32341 - RNA, 18 nt, Homo sapiens
gcuuggugaccucccuca

SEQ ID NO: 32342 - RNA, 24 nt, Homo sapiens
ugaccaccaccauccaccaguuca

SEQ ID NO: 32343 - RNA, 19 nt, Homo sapiens
accugcagcugagcugcca

SEQ ID NO: 32344 - RNA, 16 nt, Homo sapiens
aguaccaugguucuga

SEQ ID NO: 32345 - RNA, 21 nt, Homo sapiens
cagaauuccacccaucuuuca

SEQ ID NO: 32346 - RNA, 25 nt, Homo sapiens
ccaucccaggucaccaccuggcuga

SEQ ID NO: 32347 - RNA, 21 nt, Homo sapiens
ccaugguucugacagagacug

SEQ ID NO: 32348 - RNA, 17 nt, Homo sapiens
ccuccaacuugacauca

SEQ ID NO: 32349 - RNA, 18 nt, Homo sapiens
auuugaacugugacuugu

SEQ ID NO: 32350 - RNA, 19 nt, Homo sapiens
cauguauugcauguaaagg

SEQ ID NO: 32351 - RNA, 18 nt, Homo sapiens
uacuacuacacuuuacca

SEQ ID NO: 32352 - RNA, 20 nt, Homo sapiens
ucuucuucacaauaauagga

SEQ ID NO: 32353 - RNA, 19 nt, Homo sapiens
acagaggcacagggcaggc

SEQ ID NO: 32354 - RNA, 20 nt, Homo sapiens
aggcauuuuguuucugguga

SEQ ID NO: 32355 - RNA, 19 nt, Homo sapiens
ccagggcuggcuggccugc

SEQ ID NO: 32356 - RNA, 17 nt, Homo sapiens
ugaaaauuaauggaugc

SEQ ID NO: 32357 - RNA, 19 nt, Homo sapiens
uucucuacuaaaaauacaa

SEQ ID NO: 32358 - RNA, 24 nt, Homo sapiens
uuugccauagcucagaccacuucu

SEQ ID NO: 32359 - RNA, 19 nt, Homo sapiens
ccugagcaagcaucauuuu

SEQ ID NO: 32360 - RNA, 17 nt, Homo sapiens
uagccugguggcagaug

SEQ ID NO: 32361 - RNA, 22 nt, Homo sapiens
uuccuuggggcuagcucacuuu

SEQ ID NO: 32362 - RNA, 17 nt, Homo sapiens
aagaugugaauuuuugu

SEQ ID NO: 32363 - RNA, 20 nt, Homo sapiens
ucauacacacacaauucagu

SEQ ID NO: 32364 - RNA, 16 nt, Homo sapiens
aacagucuguuuucuu

SEQ ID NO: 32365 - RNA, 19 nt, Homo sapiens
acucauuaccguauucgcc

SEQ ID NO: 32366 - RNA, 21 nt, Homo sapiens
guuuucuauuuacgcaugaua

SEQ ID NO: 32367 - RNA, 21 nt, Homo sapiens
ucugcugagguccuugcgugg

SEQ ID NO: 32368 - RNA, 19 nt, Homo sapiens
ugcuguuaaucgucacugu

SEQ ID NO: 32369 - RNA, 17 nt, Homo sapiens
gcuuugauucuugguuc

SEQ ID NO: 32370 - RNA, 21 nt, Homo sapiens
gugucuccagggaacccacgg

SEQ ID NO: 32371 - RNA, 16 nt, Homo sapiens
uuguccccugaccuca

SEQ ID NO: 32372 - RNA, 24 nt, Homo sapiens
gaagucucaguucagugaacacaa

SEQ ID NO: 32373 - RNA, 24 nt, Homo sapiens
guauauauguguaugcucagauua

SEQ ID NO: 32374 - RNA, 23 nt, Homo sapiens
gccugaaccccaacccaacccua

SEQ ID NO: 32375 - RNA, 18 nt, Homo sapiens
uggccuuccuggaccgca

SEQ ID NO: 32376 - RNA, 23 nt, Homo sapiens
gcagaugcuuuucuuauaaucua

SEQ ID NO: 32377 - RNA, 19 nt, Homo sapiens
gcaguuuuacaguauuccu

SEQ ID NO: 32378 - RNA, 23 nt, Homo sapiens
uuugugacuuaggauuuugaugu

SEQ ID NO: 32379 - RNA, 20 nt, Homo sapiens
aaggaccaaccaguuugggu

SEQ ID NO: 32380 - RNA, 21 nt, Homo sapiens
gggcagugcugccgugccaac

SEQ ID NO: 32381 - RNA, 25 nt, Homo sapiens
guauguauguauauguauaugauua

SEQ ID NO: 32382 - RNA, 17 nt, Homo sapiens
uccagaaacaacugcgg

SEQ ID NO: 32383 - RNA, 18 nt, Homo sapiens
uugcugcagagcucugca

SEQ ID NO: 32384 - RNA, 21 nt, Homo sapiens
aggguuuuuaaagaauaaccu

SEQ ID NO: 32385 - RNA, 20 nt, Homo sapiens
agucucacucuguugcccag

SEQ ID NO: 32386 - RNA, 22 nt, Homo sapiens
ccaaaauagcagcugguaguaa

SEQ ID NO: 32387 - RNA, 17 nt, Homo sapiens
ccagucaucuuauuucu

SEQ ID NO: 32388 - RNA, 16 nt, Homo sapiens
ggucaauuacauuuca

SEQ ID NO: 32389 - RNA, 24 nt, Homo sapiens
uaaauuauguaucauuuuagcaua

SEQ ID NO: 32390 - RNA, 18 nt, Homo sapiens
uccgccucccggguucaa

SEQ ID NO: 32391 - RNA, 20 nt, Homo sapiens
caguucuaccuaacguccca

SEQ ID NO: 32392 - RNA, 23 nt, Homo sapiens
auuaggguaaaguauccaucacc

SEQ ID NO: 32393 - RNA, 18 nt, Homo sapiens
caccauucuccugccuca

SEQ ID NO: 32394 - RNA, 18 nt, Homo sapiens
ccugcaaccuccaccucc

SEQ ID NO: 32395 - RNA, 19 nt, Homo sapiens
cugcaaccuccaccuccca

SEQ ID NO: 32396 - RNA, 19 nt, Homo sapiens
cugcaaccuccgccuccca

SEQ ID NO: 32397 - RNA, 18 nt, Homo sapiens
gccaguggcuuuaaacug

SEQ ID NO: 32398 - RNA, 21 nt, Homo sapiens
gguuauguuaucuacagauua

SEQ ID NO: 32399 - RNA, 21 nt, Homo sapiens
uaugcccaauuucugcuucca

SEQ ID NO: 32400 - RNA, 17 nt, Homo sapiens
ucaagugauucuucugc

SEQ ID NO: 32401 - RNA, 21 nt, Homo sapiens
ucagaggcacaagauucucuc

SEQ ID NO: 32402 - RNA, 18 nt, Homo sapiens
uccgccucccagguucaa

SEQ ID NO: 32403 - RNA, 18 nt, Homo sapiens
ugaauuguucccauagcu

SEQ ID NO: 32404 - RNA, 23 nt, Homo sapiens
agcccuaccugucuucccaccug

SEQ ID NO: 32405 - RNA, 17 nt, Homo sapiens
ucauauuuauuccugca

SEQ ID NO: 32406 - RNA, 19 nt, Homo sapiens
ucuucuguaauggguaaug

SEQ ID NO: 32407 - RNA, 21 nt, Homo sapiens
ucuuuuaauugucuuaauuuu

SEQ ID NO: 32408 - RNA, 17 nt, Homo sapiens
aggaccacaucugguca

SEQ ID NO: 32409 - RNA, 19 nt, Homo sapiens
auuaagaaaacagggaaug

SEQ ID NO: 32410 - RNA, 22 nt, Homo sapiens
cucaccacaacucccaaagcau

SEQ ID NO: 32411 - RNA, 23 nt, Homo sapiens
cucgccggugaaagcucagccua

SEQ ID NO: 32412 - RNA, 15 nt, Homo sapiens
ucccuuuucuuacca

SEQ ID NO: 32413 - RNA, 19 nt, Homo sapiens
uuucaaaauaaaauuccau

SEQ ID NO: 32414 - RNA, 24 nt, Homo sapiens
acccaucccagaaacacaaucuca

SEQ ID NO: 32415 - RNA, 19 nt, Homo sapiens
agcaggacaccucaccuga

SEQ ID NO: 32416 - RNA, 19 nt, Homo sapiens
ccacugaguuggggaaaga

SEQ ID NO: 32417 - RNA, 18 nt, Homo sapiens
ccccacccccuaggaucc

SEQ ID NO: 32418 - RNA, 18 nt, Homo sapiens
ggcaccucacuggcacug

SEQ ID NO: 32419 - RNA, 19 nt, Homo sapiens
gguggauggaagggagcau

SEQ ID NO: 32420 - RNA, 16 nt, Homo sapiens
gucuagaagaggcagc

SEQ ID NO: 32421 - RNA, 21 nt, Homo sapiens
agugguucuccuacuuucuca

SEQ ID NO: 32422 - RNA, 18 nt, Homo sapiens
gccuugguggaggauugg

SEQ ID NO: 32423 - RNA, 25 nt, Homo sapiens
ugaagaacuccugauugugaaacug

SEQ ID NO: 32424 - RNA, 22 nt, Homo sapiens
agcacugauguaggagauacac

SEQ ID NO: 32425 - RNA, 19 nt, Homo sapiens
auuaauuuaacaugcauuu

SEQ ID NO: 32426 - RNA, 18 nt, Homo sapiens
cccuggagaaggacuugc

SEQ ID NO: 32427 - RNA, 20 nt, Homo sapiens
cugaaagagcccucuccuug

SEQ ID NO: 32428 - RNA, 23 nt, Homo sapiens
gcuguauaguuauuuuuguuuua

SEQ ID NO: 32429 - RNA, 19 nt, Homo sapiens
aaguguguuggaaauccac

SEQ ID NO: 32430 - RNA, 18 nt, Homo sapiens
ccugaacuuccucuggca

SEQ ID NO: 32431 - RNA, 21 nt, Homo sapiens
uuucagaauugacucauuucc

SEQ ID NO: 32432 - RNA, 23 nt, Homo sapiens
accucucaucagcccagguccca

SEQ ID NO: 32433 - RNA, 20 nt, Homo sapiens
cauucuucacggaugccgua

SEQ ID NO: 32434 - RNA, 21 nt, Homo sapiens
ggccgggugcaguggcuccua

SEQ ID NO: 32435 - RNA, 16 nt, Homo sapiens
uccaaaaacagugauu

SEQ ID NO: 32436 - RNA, 18 nt, Homo sapiens
ucugugcucacccauugu

SEQ ID NO: 32437 - RNA, 26 nt, Homo sapiens
ccucuuugugacuauuccuuagccuu

SEQ ID NO: 32438 - RNA, 21 nt, Homo sapiens
aaaagaccccuaaaaagccua

SEQ ID NO: 32439 - RNA, 18 nt, Homo sapiens
ccuggaggugcuuggccu

SEQ ID NO: 32440 - RNA, 16 nt, Homo sapiens
cgcgcuggcgcugcug

SEQ ID NO: 32441 - RNA, 20 nt, Homo sapiens
cgcggagcuucgcgcugcug

SEQ ID NO: 32442 - RNA, 19 nt, Homo sapiens
cuaccuugagccaagccaa

SEQ ID NO: 32443 - RNA, 21 nt, Homo sapiens
gacaccuuguacuuuuccuca

SEQ ID NO: 32444 - RNA, 22 nt, Homo sapiens
gagccaagaucgcaccacugca

SEQ ID NO: 32445 - RNA, 23 nt, Homo sapiens
gccccugcuguucucagcagcca

SEQ ID NO: 32446 - RNA, 19 nt, Homo sapiens
ggccgggugcgguggcuca

SEQ ID NO: 32447 - RNA, 24 nt, Homo sapiens
ugaguagacaggauauugcauuaa

SEQ ID NO: 32448 - RNA, 24 nt, Homo sapiens
uuuaugccaugacugaccuuaaua

SEQ ID NO: 32449 - RNA, 22 nt, Homo sapiens
agcuccuguuucuuuucaucuc

SEQ ID NO: 32450 - RNA, 19 nt, Homo sapiens
guuuucaugcugcugauaa

SEQ ID NO: 32451 - RNA, 19 nt, Homo sapiens
uccuuaacucagugugcua

SEQ ID NO: 32452 - RNA, 20 nt, Homo sapiens
aacagugaccacaguugcca

SEQ ID NO: 32453 - RNA, 22 nt, Homo sapiens
acuugccggcgguugcuugcuc

SEQ ID NO: 32454 - RNA, 17 nt, Homo sapiens
ccagcuuuucaauguga

SEQ ID NO: 32455 - RNA, 16 nt, Homo sapiens
cccggccacccgcagc

SEQ ID NO: 32456 - RNA, 19 nt, Homo sapiens
ccgucgagucucucaguga

SEQ ID NO: 32457 - RNA, 21 nt, Homo sapiens
cuaccuaucaaagcugaacca

SEQ ID NO: 32458 - RNA, 23 nt, Homo sapiens
ucuggcucagggucucagguugc

SEQ ID NO: 32459 - RNA, 21 nt, Homo sapiens
ugaauggacuuugcaccagug

SEQ ID NO: 32460 - RNA, 20 nt, Homo sapiens
uucugcugacuaaugcacuc

SEQ ID NO: 32461 - RNA, 21 nt, Homo sapiens
uuuuauaugccuauuauucac

SEQ ID NO: 32462 - RNA, 25 nt, Homo sapiens
auuugacuguguggcucuuuggccc

SEQ ID NO: 32463 - RNA, 18 nt, Homo sapiens
cccgcgccgcucugccag

SEQ ID NO: 32464 - RNA, 19 nt, Homo sapiens
gccucuggccgccuggcuc

SEQ ID NO: 32465 - RNA, 23 nt, Homo sapiens
ggggauggcuacacgcggcugug

SEQ ID NO: 32466 - RNA, 15 nt, Homo sapiens
uccagaccuaccacu

SEQ ID NO: 32467 - RNA, 21 nt, Homo sapiens
uacuaguucuacuugcucuga

SEQ ID NO: 32468 - RNA, 22 nt, Homo sapiens
uuuugauuguuuucuuaacuuu

SEQ ID NO: 32469 - RNA, 20 nt, Homo sapiens
agcuucacauuauuuuacuu

SEQ ID NO: 32470 - RNA, 21 nt, Homo sapiens
gaacuaaugucucauaugaug

SEQ ID NO: 32471 - RNA, 17 nt, Homo sapiens
guugugacaaaugugua

SEQ ID NO: 32472 - RNA, 22 nt, Homo sapiens
uaucagguucaccugcuugaua

SEQ ID NO: 32473 - RNA, 17 nt, Homo sapiens
uauuugugaucuacugu

SEQ ID NO: 32474 - RNA, 20 nt, Homo sapiens
uuaaaucagugcuguuuuua

SEQ ID NO: 32475 - RNA, 18 nt, Homo sapiens
uuagaaugacuguuacag

SEQ ID NO: 32476 - RNA, 19 nt, Homo sapiens
ccaugcccucagcaccacu

SEQ ID NO: 32477 - RNA, 19 nt, Homo sapiens
cucuucccaacuuccucca

SEQ ID NO: 32478 - RNA, 21 nt, Homo sapiens
gcugggagcccuuuuguuuua

SEQ ID NO: 32479 - RNA, 21 nt, Homo sapiens
auuucaguggagugaaguuca

SEQ ID NO: 32480 - RNA, 18 nt, Homo sapiens
cagcacugucugucugug

SEQ ID NO: 32481 - RNA, 21 nt, Homo sapiens
guuggugcugagaacagccuu

SEQ ID NO: 32482 - RNA, 19 nt, Homo sapiens
aagcaauucuccugccuca

SEQ ID NO: 32483 - RNA, 21 nt, Homo sapiens
auguugcucaggcuggucaca

SEQ ID NO: 32484 - RNA, 18 nt, Homo sapiens
cguccuccucagcacuca

SEQ ID NO: 32485 - RNA, 19 nt, Homo sapiens
gccuccagccucaggagca

SEQ ID NO: 32486 - RNA, 18 nt, Homo sapiens
uccgccucccggguucaa

SEQ ID NO: 32487 - RNA, 19 nt, Homo sapiens
agcagaagacugguuuaca

SEQ ID NO: 32488 - RNA, 25 nt, Homo sapiens
gguugaaguggugguguucuuugaa

SEQ ID NO: 32489 - RNA, 23 nt, Homo sapiens
uaccacuccaaguaaaucauugc

SEQ ID NO: 32490 - RNA, 20 nt, Homo sapiens
ucuuuuauggccaucugcca

SEQ ID NO: 32491 - RNA, 22 nt, Homo sapiens
uuucguggaaacuccauguuua

SEQ ID NO: 32492 - RNA, 20 nt, Homo sapiens
gcagccaccgcuguccgcca

SEQ ID NO: 32493 - RNA, 19 nt, Homo sapiens
ggugcgagaccaaguguag

SEQ ID NO: 32494 - RNA, 17 nt, Homo sapiens
aacuaaggaucuguggg

SEQ ID NO: 32495 - RNA, 21 nt, Homo sapiens
acaugcuuuguuuauuccugc

SEQ ID NO: 32496 - RNA, 22 nt, Homo sapiens
acuuggaagcacugccugggcu

SEQ ID NO: 32497 - RNA, 21 nt, Homo sapiens
agcauugcuccugugcugcca

SEQ ID NO: 32498 - RNA, 22 nt, Homo sapiens
aguuuucuuucuccagaugcua

SEQ ID NO: 32499 - RNA, 24 nt, Homo sapiens
auuuggauauuccuucccuggucc

SEQ ID NO: 32500 - RNA, 18 nt, Homo sapiens
caucaucauagagacuga

SEQ ID NO: 32501 - RNA, 17 nt, Homo sapiens
gcggcuguucacagggc

SEQ ID NO: 32502 - RNA, 21 nt, Homo sapiens
ggagcguuggaggcauuggca

SEQ ID NO: 32503 - RNA, 18 nt, Homo sapiens
uaugucaucaucagccca

SEQ ID NO: 32504 - RNA, 23 nt, Homo sapiens
gcuauugaaaagguuauuuugua

SEQ ID NO: 32505 - RNA, 21 nt, Homo sapiens
ucuguauuauaaccauuguuu

SEQ ID NO: 32506 - RNA, 22 nt, Homo sapiens
gcucugagcugggcugucacuu

SEQ ID NO: 32507 - RNA, 20 nt, Homo sapiens
gagaauacauagucuaacca

SEQ ID NO: 32508 - RNA, 19 nt, Homo sapiens
gugguaccaagauuagcaa

SEQ ID NO: 32509 - RNA, 20 nt, Homo sapiens
cagcaggagcaguggaugaa

SEQ ID NO: 32510 - RNA, 19 nt, Homo sapiens
cagccuguccuuuacuuca

SEQ ID NO: 32511 - RNA, 21 nt, Homo sapiens
cccaaaggaacuggaugggcu

SEQ ID NO: 32512 - RNA, 23 nt, Homo sapiens
cccuggugcucuggauuuuugga

SEQ ID NO: 32513 - RNA, 18 nt, Homo sapiens
ccugcaaccuccaccucc

SEQ ID NO: 32514 - RNA, 20 nt, Homo sapiens
cucaaaccgggaucaugacg

SEQ ID NO: 32515 - RNA, 20 nt, Homo sapiens
gaugccacugaugacuauuu

SEQ ID NO: 32516 - RNA, 20 nt, Homo sapiens
gccugggcugcggguggggc

SEQ ID NO: 32517 - RNA, 18 nt, Homo sapiens
uccaccuccuggguucaa

SEQ ID NO: 32518 - RNA, 16 nt, Homo sapiens
ugcaaaaauuauauca

SEQ ID NO: 32519 - RNA, 20 nt, Homo sapiens
uggaugggcugcagugaggu

SEQ ID NO: 32520 - RNA, 15 nt, Homo sapiens
uucugcaguugaucc

SEQ ID NO: 32521 - RNA, 20 nt, Homo sapiens
caccucugcaguccucuuca

SEQ ID NO: 32522 - RNA, 21 nt, Homo sapiens
ccaccccucaccaacaccucu

SEQ ID NO: 32523 - RNA, 17 nt, Homo sapiens
aagacccuggguccagu

SEQ ID NO: 32524 - RNA, 22 nt, Homo sapiens
aucaauauguuugugcagugau

SEQ ID NO: 32525 - RNA, 20 nt, Homo sapiens
ccagaagcccuucuugccca

SEQ ID NO: 32526 - RNA, 16 nt, Homo sapiens
cccucaccaacuuucc

SEQ ID NO: 32527 - RNA, 22 nt, Homo sapiens
cgccccaucagcacuuaagcca

SEQ ID NO: 32528 - RNA, 18 nt, Homo sapiens
cuaaagagcccucugggc

SEQ ID NO: 32529 - RNA, 19 nt, Homo sapiens
cugggucugguccuuacca

SEQ ID NO: 32530 - RNA, 17 nt, Homo sapiens
gucugguccuuaccaac

SEQ ID NO: 32531 - RNA, 26 nt, Homo sapiens
gugccugcagcucaccuguggguuuu

SEQ ID NO: 32532 - RNA, 25 nt, Homo sapiens
uaccaggacccccucccccuaccuc

SEQ ID NO: 32533 - RNA, 18 nt, Homo sapiens
ucucagguuccagcaagu

SEQ ID NO: 32534 - RNA, 18 nt, Homo sapiens
uuuaacuuucuaccagga

SEQ ID NO: 32535 - RNA, 21 nt, Homo sapiens
uuugaacuggaaggucugggg

SEQ ID NO: 32536 - RNA, 21 nt, Homo sapiens
uuuuccugagaucacacacag

SEQ ID NO: 32537 - RNA, 23 nt, Homo sapiens
agucuggccucaugaagaugcca

SEQ ID NO: 32538 - RNA, 18 nt, Homo sapiens
acacuuuaaaggacagca

SEQ ID NO: 32539 - RNA, 22 nt, Homo sapiens
acgaaaggugauauaucuuuaa

SEQ ID NO: 32540 - RNA, 22 nt, Homo sapiens
gugaaugccaugagaguucuga

SEQ ID NO: 32541 - RNA, 18 nt, Homo sapiens
ugaguaaaauucuuaagc

SEQ ID NO: 32542 - RNA, 20 nt, Homo sapiens
uggcuuucagcguagaauug

SEQ ID NO: 32543 - RNA, 19 nt, Homo sapiens
uguguggggugcaguuuuu

SEQ ID NO: 32544 - RNA, 17 nt, Homo sapiens
uuuuuagauuugcuuuu

SEQ ID NO: 32545 - RNA, 19 nt, Homo sapiens
auuaaucaacaugccuugu

SEQ ID NO: 32546 - RNA, 20 nt, Homo sapiens
ccuuuucauauacuuaaucu

SEQ ID NO: 32547 - RNA, 23 nt, Homo sapiens
gaauaagaguuccuguagcuccu

SEQ ID NO: 32548 - RNA, 21 nt, Homo sapiens
gauuacaggcaucagccacca

SEQ ID NO: 32549 - RNA, 24 nt, Homo sapiens
uugacaaugaauaagaguuccugu

SEQ ID NO: 32550 - RNA, 20 nt, Homo sapiens
gcuggaaacuuuaccuggua

SEQ ID NO: 32551 - RNA, 22 nt, Homo sapiens
acucagcuggcccacuccacag

SEQ ID NO: 32552 - RNA, 22 nt, Homo sapiens
ccgcccugucaccuucaccucc

SEQ ID NO: 32553 - RNA, 20 nt, Homo sapiens
cugcccccucagcacacaca

SEQ ID NO: 32554 - RNA, 21 nt, Homo sapiens
gcaccagcagcucuugccacc

SEQ ID NO: 32555 - RNA, 21 nt, Homo sapiens
ugggggcggugagggcuccac

SEQ ID NO: 32556 - RNA, 27 nt, Homo sapiens
aaguauggucaaaggaaaaaaauccca

SEQ ID NO: 32557 - RNA, 20 nt, Homo sapiens
acauuuuagauaacugugaa

SEQ ID NO: 32558 - RNA, 19 nt, Homo sapiens
agaucugaaaagaaaccuu

SEQ ID NO: 32559 - RNA, 20 nt, Homo sapiens
cccuaugaggaaaucuggag

SEQ ID NO: 32560 - RNA, 20 nt, Homo sapiens
ccuccucaugcaguguugua

SEQ ID NO: 32561 - RNA, 16 nt, Homo sapiens
ccugacauccagcaaa

SEQ ID NO: 32562 - RNA, 19 nt, Homo sapiens
ggacuaaaauuucccacug

SEQ ID NO: 32563 - RNA, 19 nt, Homo sapiens
guauguguucauauucgau

SEQ ID NO: 32564 - RNA, 18 nt, Homo sapiens
ucagaacucaugccaaca

SEQ ID NO: 32565 - RNA, 22 nt, Homo sapiens
uuagccacuucauuucuauuua

SEQ ID NO: 32566 - RNA, 24 nt, Homo sapiens
uuugggggucauuuugucaucaga

SEQ ID NO: 32567 - RNA, 17 nt, Homo sapiens
uuuguguguuuuuuuaa

SEQ ID NO: 32568 - RNA, 19 nt, Homo sapiens
caagacacucuauguauua

SEQ ID NO: 32569 - RNA, 19 nt, Homo sapiens
cugaagcuuuuucuggccu

SEQ ID NO: 32570 - RNA, 20 nt, Homo sapiens
cuucuccuccagaacaagug

SEQ ID NO: 32571 - RNA, 18 nt, Homo sapiens
ugucuuaacccuguucca

SEQ ID NO: 32572 - RNA, 19 nt, Homo sapiens
uuguaaauuuguauauaug

SEQ ID NO: 32573 - RNA, 17 nt, Homo sapiens
aaaaacaaacaaacaaa

SEQ ID NO: 32574 - RNA, 20 nt, Homo sapiens
ccuguccuucagaacacuuc

SEQ ID NO: 32575 - RNA, 18 nt, Homo sapiens
cuucacgacugaaugcac

SEQ ID NO: 32576 - RNA, 21 nt, Homo sapiens
gugggagccaggaagccucag

SEQ ID NO: 32577 - RNA, 19 nt, Homo sapiens
aagacauaucaaacaugca

SEQ ID NO: 32578 - RNA, 21 nt, Homo sapiens
aaguuaaaaaaagacauauca

SEQ ID NO: 32579 - RNA, 19 nt, Homo sapiens
accaccaccacuaccacga

SEQ ID NO: 32580 - RNA, 17 nt, Homo sapiens
acugccugggaauuuga

SEQ ID NO: 32581 - RNA, 19 nt, Homo sapiens
aucuugacccaagaguucu

SEQ ID NO: 32582 - RNA, 21 nt, Homo sapiens
caaauaacacuaaccccauga

SEQ ID NO: 32583 - RNA, 24 nt, Homo sapiens
caacuauaacaauaaaacuguaaa

SEQ ID NO: 32584 - RNA, 19 nt, Homo sapiens
caccaccaccaccaccacu

SEQ ID NO: 32585 - RNA, 15 nt, Homo sapiens
cacuaccacgagcaa

SEQ ID NO: 32586 - RNA, 22 nt, Homo sapiens
ccagcugccuggccuguacuug

SEQ ID NO: 32587 - RNA, 25 nt, Homo sapiens
cgcccccgcaccaggccgguacuca

SEQ ID NO: 32588 - RNA, 19 nt, Homo sapiens
cgggaacccaacaggcacu

SEQ ID NO: 32589 - RNA, 17 nt, Homo sapiens
gcauuccaacagugaca

SEQ ID NO: 32590 - RNA, 19 nt, Homo sapiens
ggaacagaaacaagcacuu

SEQ ID NO: 32591 - RNA, 19 nt, Homo sapiens
uagaccaagggcacaucca

SEQ ID NO: 32592 - RNA, 20 nt, Homo sapiens
ugcuguuaguacugcugcug

SEQ ID NO: 32593 - RNA, 20 nt, Homo sapiens
aacacagaagacuucuguga

SEQ ID NO: 32594 - RNA, 22 nt, Homo sapiens
gaaaaauugccaaaacaaagaa

SEQ ID NO: 32595 - RNA, 17 nt, Homo sapiens
uccagcgugaugguguu

SEQ ID NO: 32596 - RNA, 20 nt, Homo sapiens
uccagcgugaugguguuagg

SEQ ID NO: 32597 - RNA, 17 nt, Homo sapiens
uuucuccccacgugcca

SEQ ID NO: 32598 - RNA, 15 nt, Homo sapiens
gccaccaagcuuuuu

SEQ ID NO: 32599 - RNA, 22 nt, Homo sapiens
uggugcaggacagcugccagca

SEQ ID NO: 32600 - RNA, 18 nt, Homo sapiens
agaaagcccugagcauug

SEQ ID NO: 32601 - RNA, 21 nt, Homo sapiens
cccugcacccgagcggcaccu

SEQ ID NO: 32602 - RNA, 16 nt, Homo sapiens
gccaggcacagauccc

SEQ ID NO: 32603 - RNA, 22 nt, Homo sapiens
guguuuuucaucaaucaguuuu

SEQ ID NO: 32604 - RNA, 22 nt, Homo sapiens
uggaaguucuccaauaguggcu

SEQ ID NO: 32605 - RNA, 22 nt, Homo sapiens
ugguguuagugaauuuugcaaa

SEQ ID NO: 32606 - RNA, 19 nt, Homo sapiens
caaauacugacccauucug

SEQ ID NO: 32607 - RNA, 25 nt, Homo sapiens
cccaaauacugacccauucuggacu

SEQ ID NO: 32608 - RNA, 21 nt, Homo sapiens
ggacagggaauugggauaccu

SEQ ID NO: 32609 - RNA, 19 nt, Homo sapiens
ugucuuagagaacuuguca

SEQ ID NO: 32610 - RNA, 24 nt, Homo sapiens
uucuggacuuuuguaaacauaccu

SEQ ID NO: 32611 - RNA, 18 nt, Homo sapiens
ccaccgccccugccgcca

SEQ ID NO: 32612 - RNA, 22 nt, Homo sapiens
guaucagagggggccuucgccg

SEQ ID NO: 32613 - RNA, 19 nt, Homo sapiens
gugggagaguugacugugu

SEQ ID NO: 32614 - RNA, 17 nt, Homo sapiens
cggggcgggcgcggcga

SEQ ID NO: 32615 - RNA, 20 nt, Homo sapiens
aacucguccccucuuccaca

SEQ ID NO: 32616 - RNA, 22 nt, Homo sapiens
caaauaacaaaacugcaacacu

SEQ ID NO: 32617 - RNA, 30 nt, Homo sapiens
cgacccgccucccgcccgcccgccggccuc

SEQ ID NO: 32618 - RNA, 20 nt, Homo sapiens
gcgccagcagcccgcgcccc

SEQ ID NO: 32619 - RNA, 23 nt, Homo sapiens
gggcucgcccccgccccucccuc

SEQ ID NO: 32620 - RNA, 18 nt, Homo sapiens
acaucgaauguagcuuac

SEQ ID NO: 32621 - RNA, 19 nt, Homo sapiens
aguaaggguaugcuuacca

SEQ ID NO: 32622 - RNA, 18 nt, Homo sapiens
gaaauauuauuuaccuua

SEQ ID NO: 32623 - RNA, 19 nt, Homo sapiens
ucagauaccacaaacuuua

SEQ ID NO: 32624 - RNA, 20 nt, Homo sapiens
uuuaagaguguuaagucauu

SEQ ID NO: 32625 - RNA, 18 nt, Homo sapiens
agagccacugcagaguca

SEQ ID NO: 32626 - RNA, 15 nt, Homo sapiens
gcacugcuguuuccu

SEQ ID NO: 32627 - RNA, 18 nt, Homo sapiens
cccugcaccugcaccuca

SEQ ID NO: 32628 - RNA, 21 nt, Homo sapiens
ccucaucaucccccuccugcc

SEQ ID NO: 32629 - RNA, 22 nt, Homo sapiens
auggguaaggaacagucuguga

SEQ ID NO: 32630 - RNA, 17 nt, Homo sapiens
ucaagugauucuccugc

SEQ ID NO: 32631 - RNA, 21 nt, Homo sapiens
ugggauuauaggugcccauca

SEQ ID NO: 32632 - RNA, 24 nt, Homo sapiens
uucaauaccuugaagaaagauuca

SEQ ID NO: 32633 - RNA, 22 nt, Homo sapiens
gcccacccagcgcacagucagg

SEQ ID NO: 32634 - RNA, 22 nt, Homo sapiens
gccuggauuccugugccugcuc

SEQ ID NO: 32635 - RNA, 19 nt, Homo sapiens
gguggaggacgcgcaggag

SEQ ID NO: 32636 - RNA, 18 nt, Homo sapiens
ugcccagucuuccaucuc

SEQ ID NO: 32637 - RNA, 21 nt, Homo sapiens
uuugagcaauuuucucgacuu

SEQ ID NO: 32638 - RNA, 19 nt, Homo sapiens
ccccccgcgcccgccccca

SEQ ID NO: 32639 - RNA, 20 nt, Homo sapiens
cucucucucuucucugucuc

SEQ ID NO: 32640 - RNA, 19 nt, Homo sapiens
cuucucucucuccgucucu

SEQ ID NO: 32641 - RNA, 22 nt, Homo sapiens
caccaauguccuagcuguauua

SEQ ID NO: 32642 - RNA, 22 nt, Homo sapiens
cuuuuucaaagcaucuaaucuu

SEQ ID NO: 32643 - RNA, 18 nt, Homo sapiens
cccagcuccgcgagcuca

SEQ ID NO: 32644 - RNA, 20 nt, Homo sapiens
guugugugggcuuuuuuuga

SEQ ID NO: 32645 - RNA, 21 nt, Homo sapiens
uagguucagggaugagcaaca

SEQ ID NO: 32646 - RNA, 25 nt, Homo sapiens
ugcuaaaucauaggagaaaaaucua

SEQ ID NO: 32647 - RNA, 20 nt, Homo sapiens
cgucuguguauuggaggccc

SEQ ID NO: 32648 - RNA, 21 nt, Homo sapiens
gcccgcgguuugagguccuuc

SEQ ID NO: 32649 - RNA, 24 nt, Homo sapiens
gccuaauaaaugcucguuacuuga

SEQ ID NO: 32650 - RNA, 26 nt, Homo sapiens
gccugggcuuuaugggucucuggccc

SEQ ID NO: 32651 - RNA, 21 nt, Homo sapiens
gcgguuugagguccuucguua

SEQ ID NO: 32652 - RNA, 20 nt, Homo sapiens
ggggcgccccgcccuggcca

SEQ ID NO: 32653 - RNA, 21 nt, Homo sapiens
ugccucaguuuccccaucucu

SEQ ID NO: 32654 - RNA, 18 nt, Homo sapiens
ggccuuguuggugcccac

SEQ ID NO: 32655 - RNA, 20 nt, Homo sapiens
cagaaaccauuugagccagg

SEQ ID NO: 32656 - RNA, 23 nt, Homo sapiens
ccuucccuaucaccccuccccca

SEQ ID NO: 32657 - RNA, 17 nt, Homo sapiens
gcaacauucauaacuua

SEQ ID NO: 32658 - RNA, 18 nt, Homo sapiens
uccaccucccggguucaa

SEQ ID NO: 32659 - RNA, 20 nt, Homo sapiens
uuuuuucaugaacuuuaauc

SEQ ID NO: 32660 - RNA, 26 nt, Homo sapiens
acagcccauuaaguucccugguauuu

SEQ ID NO: 32661 - RNA, 24 nt, Homo sapiens
ccccacccaaccccuauguuaguu

SEQ ID NO: 32662 - RNA, 22 nt, Homo sapiens
uacucccuggagccuucucccg

SEQ ID NO: 32663 - RNA, 19 nt, Homo sapiens
accguccccuacccaggga

SEQ ID NO: 32664 - RNA, 24 nt, Homo sapiens
agaaauuacugaugaagcagcaug

SEQ ID NO: 32665 - RNA, 21 nt, Homo sapiens
cccaagccagggccccgguga

SEQ ID NO: 32666 - RNA, 22 nt, Homo sapiens
gcgcuuggagcugcugagcuuu

SEQ ID NO: 32667 - RNA, 24 nt, Homo sapiens
ucugaccacacuucauccuccccc

SEQ ID NO: 32668 - RNA, 18 nt, Homo sapiens
acagcaaaggauuugcaa

SEQ ID NO: 32669 - RNA, 18 nt, Homo sapiens
caggaaaaaucuguucca

SEQ ID NO: 32670 - RNA, 20 nt, Homo sapiens
ucagcacauugcaccaguua

SEQ ID NO: 32671 - RNA, 17 nt, Homo sapiens
accgacgccauuagcua

SEQ ID NO: 32672 - RNA, 19 nt, Homo sapiens
caugccacaaagcauauca

SEQ ID NO: 32673 - RNA, 22 nt, Homo sapiens
ccugaggcaguccgauggggcu

SEQ ID NO: 32674 - RNA, 19 nt, Homo sapiens
gcccccugugcccacccuc

SEQ ID NO: 32675 - RNA, 23 nt, Homo sapiens
uaggguugaugaaggcucggccg

SEQ ID NO: 32676 - RNA, 24 nt, Homo sapiens
uccuguucuguuaguaccaaaguu

SEQ ID NO: 32677 - RNA, 17 nt, Homo sapiens
acugaacauauuagcua

SEQ ID NO: 32678 - RNA, 17 nt, Homo sapiens
uccuggcagcucugugg

SEQ ID NO: 32679 - RNA, 18 nt, Homo sapiens
augugacagaauguucca

SEQ ID NO: 32680 - RNA, 24 nt, Homo sapiens
cuuaggcagcucaagcuugcuuuu

SEQ ID NO: 32681 - RNA, 21 nt, Homo sapiens
ugguaggugcuguuuggaaua

SEQ ID NO: 32682 - RNA, 19 nt, Homo sapiens
uguaacguggaaaucuuau

SEQ ID NO: 32683 - RNA, 18 nt, Homo sapiens
ugugugugagcgggacuu

SEQ ID NO: 32684 - RNA, 21 nt, Homo sapiens
aaccacuaacaccucugcaca

SEQ ID NO: 32685 - RNA, 22 nt, Homo sapiens
aucuggaccaucgaccuggccu

SEQ ID NO: 32686 - RNA, 17 nt, Homo sapiens
cauccagcagcucuacc

SEQ ID NO: 32687 - RNA, 21 nt, Homo sapiens
ccguguguugucaugucacuc

SEQ ID NO: 32688 - RNA, 17 nt, Homo sapiens
ggcaguuagccagcuca

SEQ ID NO: 32689 - RNA, 18 nt, Homo sapiens
uccgccuccuggguucaa

SEQ ID NO: 32690 - RNA, 18 nt, Homo sapiens
aaguauccagucaccuca

SEQ ID NO: 32691 - RNA, 19 nt, Homo sapiens
cagaguagccuagaugaca

SEQ ID NO: 32692 - RNA, 21 nt, Homo sapiens
ccaccaccccuuugcacauca

SEQ ID NO: 32693 - RNA, 19 nt, Homo sapiens
gauugaccuggagauuuuu

SEQ ID NO: 32694 - RNA, 17 nt, Homo sapiens
ugggugggcucaggaag

SEQ ID NO: 32695 - RNA, 20 nt, Homo sapiens
aauccaaagaaauuugcagg

SEQ ID NO: 32696 - RNA, 20 nt, Homo sapiens
gcugauucaacuguuuuguu

SEQ ID NO: 32697 - RNA, 19 nt, Homo sapiens
gguauuguuguaguuuaug

SEQ ID NO: 32698 - RNA, 21 nt, Homo sapiens
guucugugauucuuuaagcaa

SEQ ID NO: 32699 - RNA, 25 nt, Homo sapiens
ucucaaaugagcuuaaacugcaagu

SEQ ID NO: 32700 - RNA, 16 nt, Homo sapiens
uuccagcaaaauucca

SEQ ID NO: 32701 - RNA, 22 nt, Homo sapiens
acuugauggguacguuuggucc

SEQ ID NO: 32702 - RNA, 21 nt, Homo sapiens
aguggccacaaaacuguguua

SEQ ID NO: 32703 - RNA, 18 nt, Homo sapiens
cugccugggagccccccc

SEQ ID NO: 32704 - RNA, 23 nt, Homo sapiens
ucuuggugccccugggcuucgga

SEQ ID NO: 32705 - RNA, 23 nt, Homo sapiens
uucugauggccuagcugugugga

SEQ ID NO: 32706 - RNA, 20 nt, Homo sapiens
ccucugccucccagguuuaa

SEQ ID NO: 32707 - RNA, 21 nt, Homo sapiens
cgucuucucgcccuggacaaa

SEQ ID NO: 32708 - RNA, 20 nt, Homo sapiens
cuguuuugaggacgauaccc

SEQ ID NO: 32709 - RNA, 16 nt, Homo sapiens
gcauugucccauuuua

SEQ ID NO: 32710 - RNA, 20 nt, Homo sapiens
gccagagugcuugugacuca

SEQ ID NO: 32711 - RNA, 23 nt, Homo sapiens
aacagauuuccucccaaaccuua

SEQ ID NO: 32712 - RNA, 20 nt, Homo sapiens
acccauugcugauggcacac

SEQ ID NO: 32713 - RNA, 21 nt, Homo sapiens
acuucugugcccgcuuggucc

SEQ ID NO: 32714 - RNA, 18 nt, Homo sapiens
agacagaaauguuacuuc

SEQ ID NO: 32715 - RNA, 19 nt, Homo sapiens
cagcccauccgcgugcugu

SEQ ID NO: 32716 - RNA, 17 nt, Homo sapiens
cccccacaucaugcuuc

SEQ ID NO: 32717 - RNA, 20 nt, Homo sapiens
ccugaacugccaucugcaga

SEQ ID NO: 32718 - RNA, 20 nt, Homo sapiens
ccuuccccccuucccuuucc

SEQ ID NO: 32719 - RNA, 18 nt, Homo sapiens
cugaccacaugccaguga

SEQ ID NO: 32720 - RNA, 21 nt, Homo sapiens
ucugaagaaaccuguccccac

SEQ ID NO: 32721 - RNA, 19 nt, Homo sapiens
ugagcauggcaugaggcug

SEQ ID NO: 32722 - RNA, 16 nt, Homo sapiens
ugaggaaagauagcaa

SEQ ID NO: 32723 - RNA, 19 nt, Homo sapiens
uggucccaaccugaagcug

SEQ ID NO: 32724 - RNA, 22 nt, Homo sapiens
uuguuucuuccucuaugacaug

SEQ ID NO: 32725 - RNA, 23 nt, Homo sapiens
accuggucaaggccaggauccca

SEQ ID NO: 32726 - RNA, 18 nt, Homo sapiens
cagggcuaggcccagcca

SEQ ID NO: 32727 - RNA, 28 nt, Homo sapiens
cccccaaccugcagggaagaugaccaua

SEQ ID NO: 32728 - RNA, 20 nt, Homo sapiens
ccugggucacuguuccccca

SEQ ID NO: 32729 - RNA, 20 nt, Homo sapiens
ccuggguucuuccacacaaa

SEQ ID NO: 32730 - RNA, 17 nt, Homo sapiens
cucauccuccuccgccu

SEQ ID NO: 32731 - RNA, 17 nt, Homo sapiens
cucccuucccugccucu

SEQ ID NO: 32732 - RNA, 22 nt, Homo sapiens
cucuggggcacagaccugugag

SEQ ID NO: 32733 - RNA, 24 nt, Homo sapiens
gcugcgcugcuggccgccuggcuu

SEQ ID NO: 32734 - RNA, 24 nt, Homo sapiens
gggacgcaacugcugcaccugcuc

SEQ ID NO: 32735 - RNA, 19 nt, Homo sapiens
gguucuggcucugacacag

SEQ ID NO: 32736 - RNA, 22 nt, Homo sapiens
guccagcucaaaggccaccucc

SEQ ID NO: 32737 - RNA, 22 nt, Homo sapiens
uggaacuaaggaggcuacagca

SEQ ID NO: 32738 - RNA, 20 nt, Homo sapiens
uguuucagcgccugcuccag

SEQ ID NO: 32739 - RNA, 20 nt, Homo sapiens
cagaggccaucucuacuacu

SEQ ID NO: 32740 - RNA, 18 nt, Homo sapiens
gcccaaacccacauucca

SEQ ID NO: 32741 - RNA, 29 nt, Homo sapiens
gcuuaggcagcauugauuuaggucacuuu

SEQ ID NO: 32742 - RNA, 26 nt, Homo sapiens
guauauguguauauuugcauugauua

SEQ ID NO: 32743 - RNA, 23 nt, Homo sapiens
uagaugguaccuggcauggacug

SEQ ID NO: 32744 - RNA, 20 nt, Homo sapiens
cccuucugucacuggccuca

SEQ ID NO: 32745 - RNA, 21 nt, Homo sapiens
gaugaggcuugcggcuguggc

SEQ ID NO: 32746 - RNA, 26 nt, Homo sapiens
uccugcuggccuggaagacucugugg

SEQ ID NO: 32747 - RNA, 20 nt, Homo sapiens
aagcaaagaaagccacauug

SEQ ID NO: 32748 - RNA, 20 nt, Homo sapiens
agccuuuuuaagagaggcca

SEQ ID NO: 32749 - RNA, 21 nt, Homo sapiens
guguuucgguugguaaguucu

SEQ ID NO: 32750 - RNA, 24 nt, Homo sapiens
auucucgccugcuuucucaucuca

SEQ ID NO: 32751 - RNA, 18 nt, Homo sapiens
caacucauccucugcccc

SEQ ID NO: 32752 - RNA, 18 nt, Homo sapiens
gugaguuacacguacuca

SEQ ID NO: 32753 - RNA, 21 nt, Homo sapiens
cugggccccaaccucauccaa

SEQ ID NO: 32754 - RNA, 20 nt, Homo sapiens
agcaguugguuuaccaagca

SEQ ID NO: 32755 - RNA, 18 nt, Homo sapiens
auccucuugccucagcug

SEQ ID NO: 32756 - RNA, 19 nt, Homo sapiens
gcaacugcuauuugaguuu

SEQ ID NO: 32757 - RNA, 25 nt, Homo sapiens
guaugguuuugggguuauuugguug

SEQ ID NO: 32758 - RNA, 19 nt, Homo sapiens
guggcauuaacauaacuca

SEQ ID NO: 32759 - RNA, 20 nt, Homo sapiens
ugguauggauggcccuuaga

SEQ ID NO: 32760 - RNA, 18 nt, Homo sapiens
uuaaaaaugacacucuga

SEQ ID NO: 32761 - RNA, 24 nt, Homo sapiens
uuuaagugguugugcugcuucaca

SEQ ID NO: 32762 - RNA, 20 nt, Homo sapiens
acccucucgucaagcucauc

SEQ ID NO: 32763 - RNA, 20 nt, Homo sapiens
agucucacucuguugcccgg

SEQ ID NO: 32764 - RNA, 19 nt, Homo sapiens
cugcaaccuccgccuccca

SEQ ID NO: 32765 - RNA, 18 nt, Homo sapiens
gccgcccccugaaggcgg

SEQ ID NO: 32766 - RNA, 16 nt, Homo sapiens
ugaaggccacuuccca

SEQ ID NO: 32767 - RNA, 17 nt, Homo sapiens
uggagguggugucauca

SEQ ID NO: 32768 - RNA, 23 nt, Homo sapiens
uggcuuucccacucugugccuca

SEQ ID NO: 32769 - RNA, 17 nt, Homo sapiens
agcaaauuauguuuaca

SEQ ID NO: 32770 - RNA, 22 nt, Homo sapiens
agcaccuucuuuccugucucuu

SEQ ID NO: 32771 - RNA, 20 nt, Homo sapiens
aucuggguuugguuugguuu

SEQ ID NO: 32772 - RNA, 19 nt, Homo sapiens
cucugaugagaacacuugc

SEQ ID NO: 32773 - RNA, 19 nt, Homo sapiens
gcuguaguccagugcgugu

SEQ ID NO: 32774 - RNA, 20 nt, Homo sapiens
ggcucuccuucccccgggga

SEQ ID NO: 32775 - RNA, 20 nt, Homo sapiens
gggcuuuagagcuuuuguua

SEQ ID NO: 32776 - RNA, 17 nt, Homo sapiens
ucuucugugccccagug

SEQ ID NO: 32777 - RNA, 23 nt, Homo sapiens
uguccagcuccuagaauuccuca

SEQ ID NO: 32778 - RNA, 20 nt, Homo sapiens
aaaaccauccuuaaccccau

SEQ ID NO: 32779 - RNA, 18 nt, Homo sapiens
cacugccccucccccccu

SEQ ID NO: 32780 - RNA, 18 nt, Homo sapiens
cccucccccccuuccucu

SEQ ID NO: 32781 - RNA, 22 nt, Homo sapiens
ccucccccccuuccucuugcca

SEQ ID NO: 32782 - RNA, 20 nt, Homo sapiens
gcccacccccacacccucca

SEQ ID NO: 32783 - RNA, 21 nt, Homo sapiens
ucccgguguccgucucuucca

SEQ ID NO: 32784 - RNA, 21 nt, Homo sapiens
ugacauuuucuccccuuccuc

SEQ ID NO: 32785 - RNA, 16 nt, Homo sapiens
gccugugguaagcaac

SEQ ID NO: 32786 - RNA, 21 nt, Homo sapiens
cuggcgaugaggaagaucuug

SEQ ID NO: 32787 - RNA, 21 nt, Homo sapiens
gacuaccuacucagcauucca

SEQ ID NO: 32788 - RNA, 15 nt, Homo sapiens
ggcgacggcggcggc

SEQ ID NO: 32789 - RNA, 21 nt, Homo sapiens
aucuuugguaugguugccuua

SEQ ID NO: 32790 - RNA, 24 nt, Homo sapiens
caagcuagauaucuuuauuugaua

SEQ ID NO: 32791 - RNA, 22 nt, Homo sapiens
cacuaagagggaugcgcaaagc

SEQ ID NO: 32792 - RNA, 17 nt, Homo sapiens
ccaaaguuuuacagaca

SEQ ID NO: 32793 - RNA, 19 nt, Homo sapiens
uggaagcuggcauggacua

SEQ ID NO: 32794 - RNA, 23 nt, Homo sapiens
uuuguuugggguauuuuuggugu

SEQ ID NO: 32795 - RNA, 18 nt, Homo sapiens
acaucaguccacaagcaa

SEQ ID NO: 32796 - RNA, 22 nt, Homo sapiens
aguuucacucugucgcccaagc

SEQ ID NO: 32797 - RNA, 21 nt, Homo sapiens
cgaauguuaaugucuaagaca

SEQ ID NO: 32798 - RNA, 20 nt, Homo sapiens
cucaaaaaaaaaaaaagcau

SEQ ID NO: 32799 - RNA, 23 nt, Homo sapiens
gcaguugaaaauuaacugcauua

SEQ ID NO: 32800 - RNA, 21 nt, Homo sapiens
ugcagugagcuaagaucgugc

SEQ ID NO: 32801 - RNA, 18 nt, Homo sapiens
acccuaagggccccauga

SEQ ID NO: 32802 - RNA, 25 nt, Homo sapiens
acccuccaaggcaggcuucccuuua

SEQ ID NO: 32803 - RNA, 22 nt, Homo sapiens
aggccccagcccggcuccuuca

SEQ ID NO: 32804 - RNA, 17 nt, Homo sapiens
caagauagauaacacuc

SEQ ID NO: 32805 - RNA, 18 nt, Homo sapiens
gccccuaaaccacuuccu

SEQ ID NO: 32806 - RNA, 19 nt, Homo sapiens
uccaggggccugucuccag

SEQ ID NO: 32807 - RNA, 19 nt, Homo sapiens
ugcccagagcacccugcuc

SEQ ID NO: 32808 - RNA, 24 nt, Homo sapiens
uucuggugaucccugaguuugcgg

SEQ ID NO: 32809 - RNA, 16 nt, Homo sapiens
cucuuuauguaguuug

SEQ ID NO: 32810 - RNA, 17 nt, Homo sapiens
uccuuuugcaucuggaa

SEQ ID NO: 32811 - RNA, 20 nt, Homo sapiens
ucucuuuauguaguuugacu

SEQ ID NO: 32812 - RNA, 17 nt, Homo sapiens
accucuuucacuaccca

SEQ ID NO: 32813 - RNA, 16 nt, Homo sapiens
ccagcugccccauccc

SEQ ID NO: 32814 - RNA, 17 nt, Homo sapiens
ccccagggaacucaguu

SEQ ID NO: 32815 - RNA, 23 nt, Homo sapiens
ggacaaagagggcaaaugagauc

SEQ ID NO: 32816 - RNA, 18 nt, Homo sapiens
guucccccagggaacuca

SEQ ID NO: 32817 - RNA, 19 nt, Homo sapiens
uaaaugugccaguguggag

SEQ ID NO: 32818 - RNA, 19 nt, Homo sapiens
ucaauacgguaccaaagau

SEQ ID NO: 32819 - RNA, 19 nt, Homo sapiens
ucaggaaccaugccccuuc

SEQ ID NO: 32820 - RNA, 21 nt, Homo sapiens
accacaacgcaauuccauuuu

SEQ ID NO: 32821 - RNA, 23 nt, Homo sapiens
caaauuuuaaaauuucgacuuca

SEQ ID NO: 32822 - RNA, 24 nt, Homo sapiens
cccuucuaugaaggggaagcagac

SEQ ID NO: 32823 - RNA, 17 nt, Homo sapiens
ccucuucccccaacaag

SEQ ID NO: 32824 - RNA, 19 nt, Homo sapiens
cugaugaauugcuuagccu

SEQ ID NO: 32825 - RNA, 18 nt, Homo sapiens
gacauaaccuagcagcag

SEQ ID NO: 32826 - RNA, 22 nt, Homo sapiens
gacuacaccaucucucaagcca

SEQ ID NO: 32827 - RNA, 17 nt, Homo sapiens
ccuaggccgaugcaaug

SEQ ID NO: 32828 - RNA, 21 nt, Homo sapiens
guauauucugucacucagcug

SEQ ID NO: 32829 - RNA, 19 nt, Homo sapiens
gucauggucuggugccaga

SEQ ID NO: 32830 - RNA, 20 nt, Homo sapiens
uuucuaacauugcagcaguu

SEQ ID NO: 32831 - RNA, 21 nt, Homo sapiens
agggacauuuccuagccagcu

SEQ ID NO: 32832 - RNA, 20 nt, Homo sapiens
cacagcccacccuccccgca

SEQ ID NO: 32833 - RNA, 20 nt, Homo sapiens
cuccaggucucuggacucca

SEQ ID NO: 32834 - RNA, 22 nt, Homo sapiens
gcugucuucacaggucugaugu

SEQ ID NO: 32835 - RNA, 18 nt, Homo sapiens
acaaaaaaagcguuuacc

SEQ ID NO: 32836 - RNA, 21 nt, Homo sapiens
augaagucuuuuaacagucuc

SEQ ID NO: 32837 - RNA, 22 nt, Homo sapiens
cagccugcccaacauagugaaa

SEQ ID NO: 32838 - RNA, 19 nt, Homo sapiens
ccucaguauuagucuguga

SEQ ID NO: 32839 - RNA, 18 nt, Homo sapiens
ccuucuaugaaagcaguc

SEQ ID NO: 32840 - RNA, 20 nt, Homo sapiens
cugguaaagacauuugugau

SEQ ID NO: 32841 - RNA, 22 nt, Homo sapiens
ggcggccggcggcgaccauggc

SEQ ID NO: 32842 - RNA, 19 nt, Homo sapiens
gugaccauuauacugugua

SEQ ID NO: 32843 - RNA, 19 nt, Homo sapiens
aaugacugauccuuccucc

SEQ ID NO: 32844 - RNA, 22 nt, Homo sapiens
agaaagaauuuauucuccuccc

SEQ ID NO: 32845 - RNA, 22 nt, Homo sapiens
gcagaaagaauuuauucuccuc

SEQ ID NO: 32846 - RNA, 19 nt, Homo sapiens
uagauaagggaaaaaugug

SEQ ID NO: 32847 - RNA, 22 nt, Homo sapiens
uccucaaauacauggcacauuc

SEQ ID NO: 32848 - RNA, 22 nt, Homo sapiens
gaaaugugcagaaagccauuga

SEQ ID NO: 32849 - RNA, 18 nt, Homo sapiens
augccagcacacacugcc

SEQ ID NO: 32850 - RNA, 22 nt, Homo sapiens
ccucagccuccgaguugcuuuu

SEQ ID NO: 32851 - RNA, 21 nt, Homo sapiens
ccugcaagggggacccugcca

SEQ ID NO: 32852 - RNA, 19 nt, Homo sapiens
gacuuguggaaaucauuca

SEQ ID NO: 32853 - RNA, 19 nt, Homo sapiens
gagugggcucgggaugcug

SEQ ID NO: 32854 - RNA, 19 nt, Homo sapiens
cucugaggauggggcuugu

SEQ ID NO: 32855 - RNA, 18 nt, Homo sapiens
cucugugcaaagcugcca

SEQ ID NO: 32856 - RNA, 22 nt, Homo sapiens
acuugaggagauccagcagcaa

SEQ ID NO: 32857 - RNA, 21 nt, Homo sapiens
caccaagcagaaccucugguc

SEQ ID NO: 32858 - RNA, 18 nt, Homo sapiens
caucugcagugugucagg

SEQ ID NO: 32859 - RNA, 18 nt, Homo sapiens
gcaccaucugcagugugu

SEQ ID NO: 32860 - RNA, 18 nt, Homo sapiens
acugcaacuuccaccucc

SEQ ID NO: 32861 - RNA, 24 nt, Homo sapiens
caaacgauaacauuuuaaggacua

SEQ ID NO: 32862 - RNA, 23 nt, Homo sapiens
caucauauguucacaguguuuua

SEQ ID NO: 32863 - RNA, 22 nt, Homo sapiens
ucuacuagguuauaaguaguau

SEQ ID NO: 32864 - RNA, 17 nt, Homo sapiens
ugauacuugaauaauca

SEQ ID NO: 32865 - RNA, 18 nt, Homo sapiens
uucaagugauucuccugc

SEQ ID NO: 32866 - RNA, 25 nt, Homo sapiens
uuuguaaucauuuuuguuuaacuga

SEQ ID NO: 32867 - RNA, 23 nt, Homo sapiens
cagaaggggaaaugauucccuca

SEQ ID NO: 32868 - RNA, 21 nt, Homo sapiens
uggguggacgugcagagacug

SEQ ID NO: 32869 - RNA, 16 nt, Homo sapiens
gguuccgugggcagcc

SEQ ID NO: 32870 - RNA, 23 nt, Homo sapiens
uguggagggagugacuugcacug

SEQ ID NO: 32871 - RNA, 20 nt, Homo sapiens
aagguggaccccugccucca

SEQ ID NO: 32872 - RNA, 18 nt, Homo sapiens
aaguaggacggaaagcuc

SEQ ID NO: 32873 - RNA, 18 nt, Homo sapiens
agcaaacuaaacaauaaa

SEQ ID NO: 32874 - RNA, 22 nt, Homo sapiens
cccugggucaggcgcuugugga

SEQ ID NO: 32875 - RNA, 21 nt, Homo sapiens
gacuccuuugaugucaaacug

SEQ ID NO: 32876 - RNA, 21 nt, Homo sapiens
gauccuggccuaaccugguga

SEQ ID NO: 32877 - RNA, 22 nt, Homo sapiens
ccuugggguuggggagaucugc

SEQ ID NO: 32878 - RNA, 17 nt, Homo sapiens
acguucacaccauucuc

SEQ ID NO: 32879 - RNA, 18 nt, Homo sapiens
auucugauaguuuagaac

SEQ ID NO: 32880 - RNA, 18 nt, Homo sapiens
caccauucuccugccuca

SEQ ID NO: 32881 - RNA, 19 nt, Homo sapiens
ccagguucugucucuucca

SEQ ID NO: 32882 - RNA, 23 nt, Homo sapiens
gcaaugacaauucaaccauaucu

SEQ ID NO: 32883 - RNA, 17 nt, Homo sapiens
ggcuuuuauuuccaacc

SEQ ID NO: 32884 - RNA, 17 nt, Homo sapiens
gggagacaccuugcucc

SEQ ID NO: 32885 - RNA, 22 nt, Homo sapiens
uaccuccucaccugcagaucua

SEQ ID NO: 32886 - RNA, 23 nt, Homo sapiens
ugcauucaucauuaaauauccua

SEQ ID NO: 32887 - RNA, 19 nt, Homo sapiens
uguugcaaugacaauagca

SEQ ID NO: 32888 - RNA, 19 nt, Homo sapiens
uuggaucuuucuagaucuu

SEQ ID NO: 32889 - RNA, 22 nt, Homo sapiens
aagguggguuuuucccauucau

SEQ ID NO: 32890 - RNA, 18 nt, Homo sapiens
acccccagcggaugcaca

SEQ ID NO: 32891 - RNA, 26 nt, Homo sapiens
ccaccccagugcgucucgccugcuga

SEQ ID NO: 32892 - RNA, 20 nt, Homo sapiens
cgauccccgugcgcuccuca

SEQ ID NO: 32893 - RNA, 22 nt, Homo sapiens
ucuguguccucuuuacucccca

SEQ ID NO: 32894 - RNA, 17 nt, Homo sapiens
acagcaggaagagguga

SEQ ID NO: 32895 - RNA, 18 nt, Homo sapiens
aggauucaacucgugaua

SEQ ID NO: 32896 - RNA, 23 nt, Homo sapiens
ccauauaacaugggauuuuccuc

SEQ ID NO: 32897 - RNA, 23 nt, Homo sapiens
uuucccucaguccucauaacuuc

SEQ ID NO: 32898 - RNA, 18 nt, Homo sapiens
uuuucuuuguggcaguca

SEQ ID NO: 32899 - RNA, 19 nt, Homo sapiens
aacuguaaugcucaaaaua

SEQ ID NO: 32900 - RNA, 18 nt, Homo sapiens
caccaaaaugcuccuauc

SEQ ID NO: 32901 - RNA, 23 nt, Homo sapiens
uuucaaaauguaccuuauuccca

SEQ ID NO: 32902 - RNA, 18 nt, Homo sapiens
caaacuggggguuguggg

SEQ ID NO: 32903 - RNA, 16 nt, Homo sapiens
cuauucccacuccccu

SEQ ID NO: 32904 - RNA, 17 nt, Homo sapiens
cugcuuuggagcugugu

SEQ ID NO: 32905 - RNA, 16 nt, Homo sapiens
cuucucuguuuugacu

SEQ ID NO: 32906 - RNA, 23 nt, Homo sapiens
gccuguggaacauugucuggucc

SEQ ID NO: 32907 - RNA, 20 nt, Homo sapiens
ucacuuugccauguuuccuu

SEQ ID NO: 32908 - RNA, 18 nt, Homo sapiens
ugaaugcuacuuggaugc

SEQ ID NO: 32909 - RNA, 20 nt, Homo sapiens
uucaaacaucauaugccgga

SEQ ID NO: 32910 - RNA, 21 nt, Homo sapiens
aaacaucaccuuguuuuucca

SEQ ID NO: 32911 - RNA, 20 nt, Homo sapiens
cccucaccacaaccgaauga

SEQ ID NO: 32912 - RNA, 22 nt, Homo sapiens
cucugaaaaugaagauuuggaa

SEQ ID NO: 32913 - RNA, 18 nt, Homo sapiens
cugcccuggcaucaccca

SEQ ID NO: 32914 - RNA, 17 nt, Homo sapiens
aagagaucguuagagug

SEQ ID NO: 32915 - RNA, 24 nt, Homo sapiens
ccuaaguggauaaaauguacuuuu

SEQ ID NO: 32916 - RNA, 21 nt, Homo sapiens
cugcuuugacuucagccaugg

SEQ ID NO: 32917 - RNA, 24 nt, Homo sapiens
gcucugaggcaagacuucgacuuu

SEQ ID NO: 32918 - RNA, 19 nt, Homo sapiens
guguuguauuacuuguuua

SEQ ID NO: 32919 - RNA, 19 nt, Homo sapiens
uaaaaacaucaugggaaaa

SEQ ID NO: 32920 - RNA, 19 nt, Homo sapiens
uacaacuuaaaaggaacuu

SEQ ID NO: 32921 - RNA, 18 nt, Homo sapiens
ugaggcaagacuucgacu

SEQ ID NO: 32922 - RNA, 23 nt, Homo sapiens
gagacauagcggcccgggcgcug

SEQ ID NO: 32923 - RNA, 23 nt, Homo sapiens
accacacagugcucccugcccug

SEQ ID NO: 32924 - RNA, 24 nt, Homo sapiens
auccuuggcugcuuccuuuucuua

SEQ ID NO: 32925 - RNA, 22 nt, Homo sapiens
aucuccaaguguccuggugcca

SEQ ID NO: 32926 - RNA, 18 nt, Homo sapiens
caccaccugccuucucuu

SEQ ID NO: 32927 - RNA, 18 nt, Homo sapiens
cuucgguuuuuuuaaugc

SEQ ID NO: 32928 - RNA, 23 nt, Homo sapiens
gcaggaaguugcuuggcccgaca

SEQ ID NO: 32929 - RNA, 21 nt, Homo sapiens
gcuauuuauuuugugcagaga

SEQ ID NO: 32930 - RNA, 19 nt, Homo sapiens
aggaggcugggggaucacc

SEQ ID NO: 32931 - RNA, 21 nt, Homo sapiens
ccccuccccgcacccaccucc

SEQ ID NO: 32932 - RNA, 16 nt, Homo sapiens
cccgccccaccccagc

SEQ ID NO: 32933 - RNA, 26 nt, Homo sapiens
ccuccuuaccuuggcaagcccuugua

SEQ ID NO: 32934 - RNA, 19 nt, Homo sapiens
ccugagcuccugucugccu

SEQ ID NO: 32935 - RNA, 22 nt, Homo sapiens
ccuucccugcagccccucccca

SEQ ID NO: 32936 - RNA, 20 nt, Homo sapiens
gaggaagcauuccccacccc

SEQ ID NO: 32937 - RNA, 28 nt, Homo sapiens
ggugggugugucugaggggguguguuug

SEQ ID NO: 32938 - RNA, 22 nt, Homo sapiens
ucucggagcuggauccccguca

SEQ ID NO: 32939 - RNA, 21 nt, Homo sapiens
ucuggggccuccaguccuuca

SEQ ID NO: 32940 - RNA, 22 nt, Homo sapiens
uggauggucgggauugaggcug

SEQ ID NO: 32941 - RNA, 22 nt, Homo sapiens
uguaaagaugugcuugugggug

SEQ ID NO: 32942 - RNA, 20 nt, Homo sapiens
uguaaguggcaggugugugu

SEQ ID NO: 32943 - RNA, 23 nt, Homo sapiens
uuagaacauauuacaaaguagca

SEQ ID NO: 32944 - RNA, 20 nt, Homo sapiens
aacacuuggaagcucuguga

SEQ ID NO: 32945 - RNA, 25 nt, Homo sapiens
aagaacagaucaagaagcugucaca

SEQ ID NO: 32946 - RNA, 18 nt, Homo sapiens
agccuuccucuuaucuca

SEQ ID NO: 32947 - RNA, 21 nt, Homo sapiens
aguauugcugcccgcauguca

SEQ ID NO: 32948 - RNA, 19 nt, Homo sapiens
auccauaccuauauguggc

SEQ ID NO: 32949 - RNA, 18 nt, Homo sapiens
caggauuggacccaguua

SEQ ID NO: 32950 - RNA, 20 nt, Homo sapiens
ccugguugcagccacguaga

SEQ ID NO: 32951 - RNA, 18 nt, Homo sapiens
gaaggcuuagugugcaac

SEQ ID NO: 32952 - RNA, 23 nt, Homo sapiens
gcaguauuuugcgucucugggua

SEQ ID NO: 32953 - RNA, 19 nt, Homo sapiens
ggcuuagugugcaacucau

SEQ ID NO: 32954 - RNA, 23 nt, Homo sapiens
cagaagagccaggaucugcugga

SEQ ID NO: 32955 - RNA, 23 nt, Homo sapiens
cgagguugugguggcccugcuca

SEQ ID NO: 32956 - RNA, 21 nt, Homo sapiens
gcaucccugagggagccuuug

SEQ ID NO: 32957 - RNA, 23 nt, Homo sapiens
ucugccuuucuuuaugcccuugg

SEQ ID NO: 32958 - RNA, 21 nt, Homo sapiens
accugagcggcacccuggucu

SEQ ID NO: 32959 - RNA, 21 nt, Homo sapiens
ccaugauguccuuggacucca

SEQ ID NO: 32960 - RNA, 19 nt, Homo sapiens
cuggccucaaguuauuuca

SEQ ID NO: 32961 - RNA, 20 nt, Homo sapiens
ucugcugcaguuaccacagc

SEQ ID NO: 32962 - RNA, 18 nt, Homo sapiens
ccuauccaagaagaccca

SEQ ID NO: 32963 - RNA, 17 nt, Homo sapiens
ucuguuuccauuaucac

SEQ ID NO: 32964 - RNA, 21 nt, Homo sapiens
cuucucauuucccuuaaccuu

SEQ ID NO: 32965 - RNA, 19 nt, Homo sapiens
gcuuacagauuauaccuca

SEQ ID NO: 32966 - RNA, 18 nt, Homo sapiens
acuucaccccauguccca

SEQ ID NO: 32967 - RNA, 24 nt, Homo sapiens
cccagacccguuacccacuacccu

SEQ ID NO: 32968 - RNA, 19 nt, Homo sapiens
cccccccccacuucacccc

SEQ ID NO: 32969 - RNA, 19 nt, Homo sapiens
ggguggggggaugggacug

SEQ ID NO: 32970 - RNA, 23 nt, Homo sapiens
uccuguugugcucagccccaaca

SEQ ID NO: 32971 - RNA, 19 nt, Homo sapiens
cagauuaauguugucaagc

SEQ ID NO: 32972 - RNA, 21 nt, Homo sapiens
auuuggacagaugccugacuc

SEQ ID NO: 32973 - RNA, 16 nt, Homo sapiens
cggcucccuaucuguc

SEQ ID NO: 32974 - RNA, 17 nt, Homo sapiens
auugacauaugguuugc

SEQ ID NO: 32975 - RNA, 21 nt, Homo sapiens
caggcauugcccaaacauuuc

SEQ ID NO: 32976 - RNA, 22 nt, Homo sapiens
cuuacccuugaacgugguucaa

SEQ ID NO: 32977 - RNA, 20 nt, Homo sapiens
gacuaacagcaacuccauca

SEQ ID NO: 32978 - RNA, 21 nt, Homo sapiens
gauugacauaugguuugccag

SEQ ID NO: 32979 - RNA, 21 nt, Homo sapiens
guauguguguaauuauggcua

SEQ ID NO: 32980 - RNA, 18 nt, Homo sapiens
uugcccaaacauuucuuu

SEQ ID NO: 32981 - RNA, 17 nt, Homo sapiens
caucaggaaggaggaug

SEQ ID NO: 32982 - RNA, 24 nt, Homo sapiens
agggcccaaaugcauaaguuucuu

SEQ ID NO: 32983 - RNA, 20 nt, Homo sapiens
caaaugcauaaguuucuuug

SEQ ID NO: 32984 - RNA, 16 nt, Homo sapiens
ugauugcccuucaucc

SEQ ID NO: 32985 - RNA, 19 nt, Homo sapiens
uugaauuucuaagaagccu

SEQ ID NO: 32986 - RNA, 19 nt, Homo sapiens
aagcaauucucuugccuca

SEQ ID NO: 32987 - RNA, 21 nt, Homo sapiens
aucuuggcucacugcaaccuc

SEQ ID NO: 32988 - RNA, 18 nt, Homo sapiens
ccugcaaccuccaccucc

SEQ ID NO: 32989 - RNA, 19 nt, Homo sapiens
cugcaaccuccaccuccca

SEQ ID NO: 32990 - RNA, 16 nt, Homo sapiens
ggcccuugugggguga

SEQ ID NO: 32991 - RNA, 18 nt, Homo sapiens
uccaccucccagguucaa

SEQ ID NO: 32992 - RNA, 21 nt, Homo sapiens
ugacuugcccagggucacuca

SEQ ID NO: 32993 - RNA, 23 nt, Homo sapiens
acaacagaaaauacaacuccugg

SEQ ID NO: 32994 - RNA, 22 nt, Homo sapiens
acaggguagaauuagagacaau

SEQ ID NO: 32995 - RNA, 19 nt, Homo sapiens
agucacagaccuugccuca

SEQ ID NO: 32996 - RNA, 19 nt, Homo sapiens
auaagcacugcacaugaga

SEQ ID NO: 32997 - RNA, 20 nt, Homo sapiens
ccacauuucucuuucucuuu

SEQ ID NO: 32998 - RNA, 18 nt, Homo sapiens
cuucccccuuuccuuucc

SEQ ID NO: 32999 - RNA, 17 nt, Homo sapiens
ugauaauuuagcagcaa

SEQ ID NO: 33000 - RNA, 20 nt, Homo sapiens
uguguaucuaucauuagcua

SEQ ID NO: 33001 - RNA, 23 nt, Homo sapiens
uguuuuuucaagucuuccaggua

SEQ ID NO: 33002 - RNA, 19 nt, Homo sapiens
agauuucgccauauugcuc

SEQ ID NO: 33003 - RNA, 20 nt, Homo sapiens
gcugugaucacaguuguaug

SEQ ID NO: 33004 - RNA, 23 nt, Homo sapiens
ccaccagccugaccucauacacu

SEQ ID NO: 33005 - RNA, 18 nt, Homo sapiens
ccauugaguuuugaucag

SEQ ID NO: 33006 - RNA, 18 nt, Homo sapiens
gaugcuagaauccccccu

SEQ ID NO: 33007 - RNA, 19 nt, Homo sapiens
gcaagagcacaucaacggg

SEQ ID NO: 33008 - RNA, 20 nt, Homo sapiens
gcugguucacuagugucaga

SEQ ID NO: 33009 - RNA, 18 nt, Homo sapiens
ggauugucaauccuuuaa

SEQ ID NO: 33010 - RNA, 24 nt, Homo sapiens
uaguacaccuuagcgcugagacug

SEQ ID NO: 33011 - RNA, 23 nt, Homo sapiens
uggcucucuucagcauguaauug

SEQ ID NO: 33012 - RNA, 24 nt, Homo sapiens
cuuaaguaacaaaguaaucacuuu

SEQ ID NO: 33013 - RNA, 22 nt, Homo sapiens
gaagaaauuauuugacauuuuu

SEQ ID NO: 33014 - RNA, 24 nt, Homo sapiens
gaaucauaguugccugcauauaug

SEQ ID NO: 33015 - RNA, 24 nt, Homo sapiens
accugggcuguggggaacuggucu

SEQ ID NO: 33016 - RNA, 22 nt, Homo sapiens
cccgccgcccguguucuccugg

SEQ ID NO: 33017 - RNA, 21 nt, Homo sapiens
ugcauccgcagcguggggcug

SEQ ID NO: 33018 - RNA, 19 nt, Homo sapiens
gcagaggaggaagcccuuc

SEQ ID NO: 33019 - RNA, 21 nt, Homo sapiens
ucaacagcaaaauuaacccgc

SEQ ID NO: 33020 - RNA, 20 nt, Homo sapiens
ugaaggagaggauucaggua

SEQ ID NO: 33021 - RNA, 21 nt, Homo sapiens
gccagucaccucccuuuuuua

SEQ ID NO: 33022 - RNA, 19 nt, Homo sapiens
acuuuuuggaaaacugcca

SEQ ID NO: 33023 - RNA, 20 nt, Homo sapiens
cucugaugggcugcuagugg

SEQ ID NO: 33024 - RNA, 21 nt, Homo sapiens
ugacuaaaaggcuuugguuca

SEQ ID NO: 33025 - RNA, 22 nt, Homo sapiens
ugccaaacuguuuuccacgaca

SEQ ID NO: 33026 - RNA, 23 nt, Homo sapiens
caaccugauucugaugacugcgg

SEQ ID NO: 33027 - RNA, 17 nt, Homo sapiens
gaaugcacugcuugcca

SEQ ID NO: 33028 - RNA, 23 nt, Homo sapiens
ggcgugagccaccacgcccggcc

SEQ ID NO: 33029 - RNA, 21 nt, Homo sapiens
acugacucccccaucagcuca

SEQ ID NO: 33030 - RNA, 23 nt, Homo sapiens
ccccaccccgagaacccucagcu

SEQ ID NO: 33031 - RNA, 19 nt, Homo sapiens
ccucagcucucaaagguca

SEQ ID NO: 33032 - RNA, 24 nt, Homo sapiens
cccagcucaaggagcuuaugcagg

SEQ ID NO: 33033 - RNA, 22 nt, Homo sapiens
ccgcccucaguaagcagcuugc

SEQ ID NO: 33034 - RNA, 19 nt, Homo sapiens
gaauucaagagccugugga

SEQ ID NO: 33035 - RNA, 20 nt, Homo sapiens
gccagccgucuccuacucca

SEQ ID NO: 33036 - RNA, 16 nt, Homo sapiens
gccguccuggacucca

SEQ ID NO: 33037 - RNA, 19 nt, Homo sapiens
gcuguccggcagugccagc

SEQ ID NO: 33038 - RNA, 22 nt, Homo sapiens
ggagccugcaaacccugcagug

SEQ ID NO: 33039 - RNA, 18 nt, Homo sapiens
ggccauggucaguguguu

SEQ ID NO: 33040 - RNA, 21 nt, Homo sapiens
guuacagcagcccucaccuca

SEQ ID NO: 33041 - RNA, 17 nt, Homo sapiens
ucccuuccauucuugaa

SEQ ID NO: 33042 - RNA, 18 nt, Homo sapiens
uucugauaccaccagguu

SEQ ID NO: 33043 - RNA, 21 nt, Homo sapiens
agaaaggaucuccagccuccc

SEQ ID NO: 33044 - RNA, 18 nt, Homo sapiens
ccucaaaauuuaaacuga

SEQ ID NO: 33045 - RNA, 20 nt, Homo sapiens
cgcgcggcgccgcgcucggc

SEQ ID NO: 33046 - RNA, 18 nt, Homo sapiens
gguaaaaggguaguugug

SEQ ID NO: 33047 - RNA, 18 nt, Homo sapiens
agaauaauggcuacuucu

SEQ ID NO: 33048 - RNA, 24 nt, Homo sapiens
cgcgcgccccgggcccggccgcug

SEQ ID NO: 33049 - RNA, 16 nt, Homo sapiens
gagcuugcuuuccaca

SEQ ID NO: 33050 - RNA, 16 nt, Homo sapiens
gcaccccgccgcuucc

SEQ ID NO: 33051 - RNA, 21 nt, Homo sapiens
gccccggcggcggccuggccu

SEQ ID NO: 33052 - RNA, 23 nt, Homo sapiens
ggaggaggggacuuuuagagcca

SEQ ID NO: 33053 - RNA, 19 nt, Homo sapiens
gggggaagaggcuggcaga

SEQ ID NO: 33054 - RNA, 18 nt, Homo sapiens
acaccugcacuagagaac

SEQ ID NO: 33055 - RNA, 23 nt, Homo sapiens
acggcgcucucuggacuaccccu

SEQ ID NO: 33056 - RNA, 19 nt, Homo sapiens
aguccuuccacgcccuaga

SEQ ID NO: 33057 - RNA, 18 nt, Homo sapiens
auuacacaagacaaagaa

SEQ ID NO: 33058 - RNA, 23 nt, Homo sapiens
ggcaggaaucccgcccugcagug

SEQ ID NO: 33059 - RNA, 20 nt, Homo sapiens
uggaggucuggacuaccccu

SEQ ID NO: 33060 - RNA, 23 nt, Homo sapiens
uggauggauuugauguaaaauua

SEQ ID NO: 33061 - RNA, 19 nt, Homo sapiens
acagccaaagaaggaauug

SEQ ID NO: 33062 - RNA, 21 nt, Homo sapiens
gauggcuucccuucuggaaca

SEQ ID NO: 33063 - RNA, 16 nt, Homo sapiens
ugaagagauuauggag

SEQ ID NO: 33064 - RNA, 24 nt, Homo sapiens
uccauuucuaccuuguaugccuca

SEQ ID NO: 33065 - RNA, 18 nt, Homo sapiens
accuaugcucaugcacau

SEQ ID NO: 33066 - RNA, 19 nt, Homo sapiens
agacauacacaugcacuca

SEQ ID NO: 33067 - RNA, 21 nt, Homo sapiens
aggauugucaccuucacccca

SEQ ID NO: 33068 - RNA, 19 nt, Homo sapiens
auguucccacacucucuua

SEQ ID NO: 33069 - RNA, 18 nt, Homo sapiens
caaacguauuuaacacag

SEQ ID NO: 33070 - RNA, 22 nt, Homo sapiens
cugacauacacucauggacuca

SEQ ID NO: 33071 - RNA, 17 nt, Homo sapiens
gcauacacaccaacaca

SEQ ID NO: 33072 - RNA, 17 nt, Homo sapiens
gcgcgccuguauaugug

SEQ ID NO: 33073 - RNA, 24 nt, Homo sapiens
guguggcaggcacacagcuuugaa

SEQ ID NO: 33074 - RNA, 16 nt, Homo sapiens
ugagcacgcacgugua

SEQ ID NO: 33075 - RNA, 21 nt, Homo sapiens
aaaaucagacaaaaguuuuaa

SEQ ID NO: 33076 - RNA, 23 nt, Homo sapiens
guaguuuugaguaguauuuuguu

SEQ ID NO: 33077 - RNA, 20 nt, Homo sapiens
ugagagucugaaaguggcca

SEQ ID NO: 33078 - RNA, 20 nt, Homo sapiens
uucccaccuccauuucaaua

SEQ ID NO: 33079 - RNA, 19 nt, Homo sapiens
aagcaauucuccugccuca

SEQ ID NO: 33080 - RNA, 19 nt, Homo sapiens
aagcaauucuccugccuca

SEQ ID NO: 33081 - RNA, 20 nt, Homo sapiens
agucucacucugucgcccag

SEQ ID NO: 33082 - RNA, 20 nt, Homo sapiens
cagagccaggagacagaucc

SEQ ID NO: 33083 - RNA, 23 nt, Homo sapiens
cauuccguuuucuaguucauuga

SEQ ID NO: 33084 - RNA, 18 nt, Homo sapiens
ccaaaucucuucuguucc

SEQ ID NO: 33085 - RNA, 19 nt, Homo sapiens
ccaggcucgugucuaccca

SEQ ID NO: 33086 - RNA, 19 nt, Homo sapiens
ccaguugcucaccaugaga

SEQ ID NO: 33087 - RNA, 18 nt, Homo sapiens
cucauucccuucuuucca

SEQ ID NO: 33088 - RNA, 17 nt, Homo sapiens
cucccaaaccagagcca

SEQ ID NO: 33089 - RNA, 20 nt, Homo sapiens
gacugcagcacauuacugcc

SEQ ID NO: 33090 - RNA, 20 nt, Homo sapiens
ggauucaaacccaguuccuc

SEQ ID NO: 33091 - RNA, 18 nt, Homo sapiens
uccgccucccagguucaa

SEQ ID NO: 33092 - RNA, 20 nt, Homo sapiens
uggccaggcuggucuugaac

SEQ ID NO: 33093 - RNA, 23 nt, Homo sapiens
uugccccccucucucuccaucuc

SEQ ID NO: 33094 - RNA, 17 nt, Homo sapiens
gugcaaccucaccgcca

SEQ ID NO: 33095 - RNA, 23 nt, Homo sapiens
acaaagcauauuaaauggcaaua

SEQ ID NO: 33096 - RNA, 21 nt, Homo sapiens
aucccaccucaucccacuuuu

SEQ ID NO: 33097 - RNA, 17 nt, Homo sapiens
uuccaaauuuuaagcug

SEQ ID NO: 33098 - RNA, 19 nt, Homo sapiens
gaguccuucgguggccuca

SEQ ID NO: 33099 - RNA, 16 nt, Homo sapiens
guccccacggugacug

SEQ ID NO: 33100 - RNA, 19 nt, Homo sapiens
caacccucaccuucccucc

SEQ ID NO: 33101 - RNA, 20 nt, Homo sapiens
cccucaccuucccucccuua

SEQ ID NO: 33102 - RNA, 22 nt, Homo sapiens
gcgagcagcgcagggcggccuc

SEQ ID NO: 33103 - RNA, 19 nt, Homo sapiens
aaauaccuaaccaguacuu

SEQ ID NO: 33104 - RNA, 21 nt, Homo sapiens
aaauaccuaaccaguacuucu

SEQ ID NO: 33105 - RNA, 18 nt, Homo sapiens
cccagauuuugguuucca

SEQ ID NO: 33106 - RNA, 21 nt, Homo sapiens
cccagauuuugguuuccaaua

SEQ ID NO: 33107 - RNA, 21 nt, Homo sapiens
cuuuagaaagcauguaaagua

SEQ ID NO: 33108 - RNA, 20 nt, Homo sapiens
ugcccagauuuugguuucca

SEQ ID NO: 33109 - RNA, 20 nt, Homo sapiens
ugguauccuacauggaauua

SEQ ID NO: 33110 - RNA, 22 nt, Homo sapiens
agagaaucaugccuccccaucu

SEQ ID NO: 33111 - RNA, 23 nt, Homo sapiens
ccucaacgaguuucuuuggucuu

SEQ ID NO: 33112 - RNA, 21 nt, Homo sapiens
ccuuauguuugauacucucuc

SEQ ID NO: 33113 - RNA, 19 nt, Homo sapiens
ucaguaccaauggcugugc

SEQ ID NO: 33114 - RNA, 19 nt, Homo sapiens
ugauguccagugugugcug

SEQ ID NO: 33115 - RNA, 19 nt, Homo sapiens
ggccagcuaucuccuuuca

SEQ ID NO: 33116 - RNA, 19 nt, Homo sapiens
cacccacacccccauuugg

SEQ ID NO: 33117 - RNA, 17 nt, Homo sapiens
cagggggauuacuuccc

SEQ ID NO: 33118 - RNA, 22 nt, Homo sapiens
ccccaacccccaccagaccuca

SEQ ID NO: 33119 - RNA, 21 nt, Homo sapiens
ccugcccuagacccugccaga

SEQ ID NO: 33120 - RNA, 27 nt, Homo sapiens
agccuuuguuguccucccauccaucca

SEQ ID NO: 33121 - RNA, 21 nt, Homo sapiens
ucuucaggagagggccugugg

SEQ ID NO: 33122 - RNA, 24 nt, Homo sapiens
ugagucugcuucagucuggagcug

SEQ ID NO: 33123 - RNA, 21 nt, Homo sapiens
aaaggacaaacucacuccccc

SEQ ID NO: 33124 - RNA, 18 nt, Homo sapiens
gcucugcagagcuuuuaa

SEQ ID NO: 33125 - RNA, 17 nt, Homo sapiens
guacccaguaucagcaa

SEQ ID NO: 33126 - RNA, 17 nt, Homo sapiens
guccauuccugcuccca

SEQ ID NO: 33127 - RNA, 19 nt, Homo sapiens
uaauuuuucuaugcagcua

SEQ ID NO: 33128 - RNA, 19 nt, Homo sapiens
uauagugucaaaagugucu

SEQ ID NO: 33129 - RNA, 21 nt, Homo sapiens
uaugaugguagagccucgcaa

SEQ ID NO: 33130 - RNA, 18 nt, Homo sapiens
ucugcugauaccuugaug

SEQ ID NO: 33131 - RNA, 21 nt, Homo sapiens
aaaugcagugauuaugcaugu

SEQ ID NO: 33132 - RNA, 20 nt, Homo sapiens
accauuguuauuuccacuuu

SEQ ID NO: 33133 - RNA, 19 nt, Homo sapiens
cacuuucuccaauacuugu

SEQ ID NO: 33134 - RNA, 22 nt, Homo sapiens
uugauauaaauguucuuaaacu

SEQ ID NO: 33135 - RNA, 21 nt, Homo sapiens
gacagagaucagaauacauug

SEQ ID NO: 33136 - RNA, 21 nt, Homo sapiens
ccaaacuuauauauauacucc

SEQ ID NO: 33137 - RNA, 19 nt, Homo sapiens
ccagaaaugacacucacag

SEQ ID NO: 33138 - RNA, 18 nt, Homo sapiens
cuguggcauugcuuccuu

SEQ ID NO: 33139 - RNA, 18 nt, Homo sapiens
guuuuggcauacaguuua

SEQ ID NO: 33140 - RNA, 19 nt, Homo sapiens
uaaaugggugagauggaac

SEQ ID NO: 33141 - RNA, 18 nt, Homo sapiens
uggguggaucacuugaag

SEQ ID NO: 33142 - RNA, 22 nt, Homo sapiens
uccucuggcccuccuucccuca

SEQ ID NO: 33143 - RNA, 18 nt, Homo sapiens
ugaaauuaaaaaagugga

SEQ ID NO: 33144 - RNA, 19 nt, Homo sapiens
uucaauuucaaauugcacc

SEQ ID NO: 33145 - RNA, 21 nt, Homo sapiens
acuugaacuguggagaggcuu

SEQ ID NO: 33146 - RNA, 18 nt, Homo sapiens
agcaaaacaguauccuga

SEQ ID NO: 33147 - RNA, 18 nt, Homo sapiens
agugugcuccagcauuaa

SEQ ID NO: 33148 - RNA, 23 nt, Homo sapiens
auuuuuauugugguguuugguuc

SEQ ID NO: 33149 - RNA, 22 nt, Homo sapiens
cgagaaaagagcccauuugcag

SEQ ID NO: 33150 - RNA, 20 nt, Homo sapiens
gcacuggagccaugcugcua

SEQ ID NO: 33151 - RNA, 18 nt, Homo sapiens
guagauuuacugcagagc

SEQ ID NO: 33152 - RNA, 25 nt, Homo sapiens
guuuauuaagaguguacucacugua

SEQ ID NO: 33153 - RNA, 25 nt, Homo sapiens
ucugcauuauguccagauugcuuuu

SEQ ID NO: 33154 - RNA, 20 nt, Homo sapiens
ugaaauugagucugaccuca

SEQ ID NO: 33155 - RNA, 22 nt, Homo sapiens
ugcaaauuaacauagucucuua

SEQ ID NO: 33156 - RNA, 18 nt, Homo sapiens
ugcuguuagauaccacua

SEQ ID NO: 33157 - RNA, 22 nt, Homo sapiens
ugcuuuuuaaaaaauaaaugcu

SEQ ID NO: 33158 - RNA, 16 nt, Homo sapiens
uggaguguuuuuggag

SEQ ID NO: 33159 - RNA, 26 nt, Homo sapiens
uuaguguguaaagaaugcauucuuca

SEQ ID NO: 33160 - RNA, 18 nt, Homo sapiens
uucuuuauggaguguuuu

SEQ ID NO: 33161 - RNA, 18 nt, Homo sapiens
aaacacagaccuugguga

SEQ ID NO: 33162 - RNA, 26 nt, Homo sapiens
auuugaacucgguaguuguuugaccu

SEQ ID NO: 33163 - RNA, 21 nt, Homo sapiens
ugcccagucugggauggcuca

SEQ ID NO: 33164 - RNA, 26 nt, Homo sapiens
gcuuggaccgcgauggggcugggccc

SEQ ID NO: 33165 - RNA, 21 nt, Homo sapiens
aucugaauccuggugccuggc

SEQ ID NO: 33166 - RNA, 16 nt, Homo sapiens
cagagaucgcccuuug

SEQ ID NO: 33167 - RNA, 22 nt, Homo sapiens
cuaacugugcccucgaccacuu

SEQ ID NO: 33168 - RNA, 19 nt, Homo sapiens
cuguggucccagguacuca

SEQ ID NO: 33169 - RNA, 22 nt, Homo sapiens
gcacagccuccccuccuaucca

SEQ ID NO: 33170 - RNA, 22 nt, Homo sapiens
uaaaugauagagcaugaggcug

SEQ ID NO: 33171 - RNA, 18 nt, Homo sapiens
ucuguucugugucugcug

SEQ ID NO: 33172 - RNA, 20 nt, Homo sapiens
ugcuccaccucuucaucucu

SEQ ID NO: 33173 - RNA, 19 nt, Homo sapiens
aaacuccugaccucaggug

SEQ ID NO: 33174 - RNA, 19 nt, Homo sapiens
aaagacuccaggaagcgua

SEQ ID NO: 33175 - RNA, 19 nt, Homo sapiens
auuucagucguaacgcauc

SEQ ID NO: 33176 - RNA, 22 nt, Homo sapiens
ccuauuuuucuuugguuugcaa

SEQ ID NO: 33177 - RNA, 18 nt, Homo sapiens
ccugguggcuguuuggcu

SEQ ID NO: 33178 - RNA, 22 nt, Homo sapiens
ccuuagaccaaaggcaacacaa

SEQ ID NO: 33179 - RNA, 18 nt, Homo sapiens
gaagugugccucguggaa

SEQ ID NO: 33180 - RNA, 17 nt, Homo sapiens
ggaggaggcguguucca

SEQ ID NO: 33181 - RNA, 20 nt, Homo sapiens
guccugcagugucugugagc

SEQ ID NO: 33182 - RNA, 19 nt, Homo sapiens
ucuccugcuuuauguuuuu

SEQ ID NO: 33183 - RNA, 26 nt, Homo sapiens
ugagauuggaaugauugaguucaguu

SEQ ID NO: 33184 - RNA, 18 nt, Homo sapiens
cccaccccuggcugugac

SEQ ID NO: 33185 - RNA, 22 nt, Homo sapiens
gccugcguccugccaggaguca

SEQ ID NO: 33186 - RNA, 20 nt, Homo sapiens
aagacaccugucaaauguca

SEQ ID NO: 33187 - RNA, 19 nt, Homo sapiens
aagaccuaucaugccaaga

SEQ ID NO: 33188 - RNA, 22 nt, Homo sapiens
acucgccucugcuccugugguc

SEQ ID NO: 33189 - RNA, 17 nt, Homo sapiens
acugugcucagauuccc

SEQ ID NO: 33190 - RNA, 21 nt, Homo sapiens
aggcccucggcucggccgaga

SEQ ID NO: 33191 - RNA, 19 nt, Homo sapiens
cccaguggccucgucccag

SEQ ID NO: 33192 - RNA, 17 nt, Homo sapiens
cccccugggauggcuca

SEQ ID NO: 33193 - RNA, 17 nt, Homo sapiens
cgcuagcagcugugaug

SEQ ID NO: 33194 - RNA, 21 nt, Homo sapiens
ggccccucucugggcagucag

SEQ ID NO: 33195 - RNA, 18 nt, Homo sapiens
agaugauuacugcuuuga

SEQ ID NO: 33196 - RNA, 23 nt, Homo sapiens
uacagaucauucauauguguaca

SEQ ID NO: 33197 - RNA, 20 nt, Homo sapiens
cgcccugcaagcucaugcaa

SEQ ID NO: 33198 - RNA, 22 nt, Homo sapiens
uaaguggggcuguaucaggcug

SEQ ID NO: 33199 - RNA, 20 nt, Homo sapiens
uccugcggcagaguuguuca

SEQ ID NO: 33200 - RNA, 17 nt, Homo sapiens
acuucuggguauauauc

SEQ ID NO: 33201 - RNA, 18 nt, Homo sapiens
uguccuuaaguugggagc

SEQ ID NO: 33202 - RNA, 17 nt, Homo sapiens
cccuccucccugcuccu

SEQ ID NO: 33203 - RNA, 20 nt, Homo sapiens
cccuggugaggaagaucugc

SEQ ID NO: 33204 - RNA, 16 nt, Homo sapiens
gcagacaccuguucca

SEQ ID NO: 33205 - RNA, 21 nt, Homo sapiens
gcggaggagaggaaggccuac

SEQ ID NO: 33206 - RNA, 27 nt, Homo sapiens
agcugcacagcggcuaacuagcuuuau

SEQ ID NO: 33207 - RNA, 17 nt, Homo sapiens
auauaccuuucuaauca

SEQ ID NO: 33208 - RNA, 20 nt, Homo sapiens
cccucaguauuaugaucuca

SEQ ID NO: 33209 - RNA, 17 nt, Homo sapiens
gaaaucucacacauuuc

SEQ ID NO: 33210 - RNA, 18 nt, Homo sapiens
ucacagucucucuaauca

SEQ ID NO: 33211 - RNA, 18 nt, Homo sapiens
aagucuucaguaacacua

SEQ ID NO: 33212 - RNA, 22 nt, Homo sapiens
aauguggcaaauuuuucagaca

SEQ ID NO: 33213 - RNA, 18 nt, Homo sapiens
cccuuaaggaacaucaga

SEQ ID NO: 33214 - RNA, 16 nt, Homo sapiens
cuggcccaacaaacua

SEQ ID NO: 33215 - RNA, 17 nt, Homo sapiens
aaccaaagguuuacuuu

SEQ ID NO: 33216 - RNA, 18 nt, Homo sapiens
caagagcauaggaguuuu

SEQ ID NO: 33217 - RNA, 19 nt, Homo sapiens
caugagaacuagaaaggaa

SEQ ID NO: 33218 - RNA, 22 nt, Homo sapiens
ccagauuaagguauuugucuaa

SEQ ID NO: 33219 - RNA, 18 nt, Homo sapiens
gccucagucaugaaauug

SEQ ID NO: 33220 - RNA, 17 nt, Homo sapiens
ucuguaauugcuauugc

SEQ ID NO: 33221 - RNA, 18 nt, Homo sapiens
uggguggaucaccugagg

SEQ ID NO: 33222 - RNA, 19 nt, Homo sapiens
uuauacauuuuagggguag

SEQ ID NO: 33223 - RNA, 23 nt, Homo sapiens
uugaauuuuuaaaguaaagcuca

SEQ ID NO: 33224 - RNA, 24 nt, Homo sapiens
uuuagugugccuggggucacuuuu

SEQ ID NO: 33225 - RNA, 21 nt, Homo sapiens
accugagccgcaacacugccg

SEQ ID NO: 33226 - RNA, 24 nt, Homo sapiens
accuggacacagacuugccggcuc

SEQ ID NO: 33227 - RNA, 21 nt, Homo sapiens
acugcagugcaggcagucuga

SEQ ID NO: 33228 - RNA, 23 nt, Homo sapiens
auccgggguuccagccccugaug

SEQ ID NO: 33229 - RNA, 18 nt, Homo sapiens
caacaucaucauuacuaa

SEQ ID NO: 33230 - RNA, 21 nt, Homo sapiens
ccgcgggaggucucaccaacu

SEQ ID NO: 33231 - RNA, 17 nt, Homo sapiens
ggccaacagcugugaac

SEQ ID NO: 33232 - RNA, 21 nt, Homo sapiens
ggccuuggaaaaucccauuca

SEQ ID NO: 33233 - RNA, 23 nt, Homo sapiens
ucuuggucaaaggggcuugggga

SEQ ID NO: 33234 - RNA, 17 nt, Homo sapiens
gaaaaugucacaucuau

SEQ ID NO: 33235 - RNA, 17 nt, Homo sapiens
uuaacaaggcuaguuca

SEQ ID NO: 33236 - RNA, 19 nt, Homo sapiens
agaauacagagagcuuacc

SEQ ID NO: 33237 - RNA, 21 nt, Homo sapiens
cuuuuuccaugcguuaacuuu

SEQ ID NO: 33238 - RNA, 21 nt, Homo sapiens
aacccguggacuaagaacgca

SEQ ID NO: 33239 - RNA, 23 nt, Homo sapiens
ccccauugcccagcacugucuca

SEQ ID NO: 33240 - RNA, 20 nt, Homo sapiens
ccuucccccuccucucucca

SEQ ID NO: 33241 - RNA, 18 nt, Homo sapiens
cucccccucaagccaacu

SEQ ID NO: 33242 - RNA, 17 nt, Homo sapiens
uaaacagcgcaaaggca

SEQ ID NO: 33243 - RNA, 18 nt, Homo sapiens
auugacagcacauauacc

SEQ ID NO: 33244 - RNA, 21 nt, Homo sapiens
cuaaauguauuacuucugaua

SEQ ID NO: 33245 - RNA, 16 nt, Homo sapiens
gcauucucuucuguga

SEQ ID NO: 33246 - RNA, 20 nt, Homo sapiens
ucuuuuugugguugcuggcu

SEQ ID NO: 33247 - RNA, 22 nt, Homo sapiens
caaggaccccaucaaguguaca

SEQ ID NO: 33248 - RNA, 19 nt, Homo sapiens
ccugacaugguacugugca

SEQ ID NO: 33249 - RNA, 23 nt, Homo sapiens
gucauuuauugcccaaguuuaca

SEQ ID NO: 33250 - RNA, 23 nt, Homo sapiens
ugaaggaaucuuccuggaguuca

SEQ ID NO: 33251 - RNA, 18 nt, Homo sapiens
ugcgugugugcuuguggg

SEQ ID NO: 33252 - RNA, 19 nt, Homo sapiens
ggacgguaucccgagccca

SEQ ID NO: 33253 - RNA, 20 nt, Homo sapiens
uccaguugggcagcagggaa

SEQ ID NO: 33254 - RNA, 22 nt, Homo sapiens
aaggacccaggauuugaaccca

SEQ ID NO: 33255 - RNA, 15 nt, Homo sapiens
caagagagcauccag

SEQ ID NO: 33256 - RNA, 19 nt, Homo sapiens
cccagaggaaguucuccag

SEQ ID NO: 33257 - RNA, 17 nt, Homo sapiens
cugcagccacguggcca

SEQ ID NO: 33258 - RNA, 18 nt, Homo sapiens
ggagggggcuguguugug

SEQ ID NO: 33259 - RNA, 17 nt, Homo sapiens
ucucuacguuaacguuu

SEQ ID NO: 33260 - RNA, 19 nt, Homo sapiens
aaacacaggucaucaguga

SEQ ID NO: 33261 - RNA, 19 nt, Homo sapiens
acaaaaaauuagccagguu

SEQ ID NO: 33262 - RNA, 17 nt, Homo sapiens
aggcagaaggaucacuu

SEQ ID NO: 33263 - RNA, 23 nt, Homo sapiens
gaaacuccaucuccaacaaaaca

SEQ ID NO: 33264 - RNA, 18 nt, Homo sapiens
uccuuuaaugauugugcu

SEQ ID NO: 33265 - RNA, 18 nt, Homo sapiens
ucugucuuuuaagugacc

SEQ ID NO: 33266 - RNA, 21 nt, Homo sapiens
uuuaagugaccaucaauucaa

SEQ ID NO: 33267 - RNA, 19 nt, Homo sapiens
ucucaaugcuaacaccaca

SEQ ID NO: 33268 - RNA, 21 nt, Homo sapiens
caacccggcacaccugcuccu

SEQ ID NO: 33269 - RNA, 17 nt, Homo sapiens
cagggcugggucaguua

SEQ ID NO: 33270 - RNA, 20 nt, Homo sapiens
gacagcgguagcaaccagcu

SEQ ID NO: 33271 - RNA, 22 nt, Homo sapiens
acaauugauauauugcuuuauu

SEQ ID NO: 33272 - RNA, 24 nt, Homo sapiens
acgaugcagcccaccauuaacuca

SEQ ID NO: 33273 - RNA, 17 nt, Homo sapiens
uguggugggaaaagcua

SEQ ID NO: 33274 - RNA, 25 nt, Homo sapiens
uuaacucauucauguaguuuauuca

SEQ ID NO: 33275 - RNA, 19 nt, Homo sapiens
aagccuccagauguuuuca

SEQ ID NO: 33276 - RNA, 23 nt, Homo sapiens
aucugugaaacccaaacucucaa

SEQ ID NO: 33277 - RNA, 18 nt, Homo sapiens
auguaaccauacacuuua

SEQ ID NO: 33278 - RNA, 18 nt, Homo sapiens
caguuguaaauaaucaga

SEQ ID NO: 33279 - RNA, 21 nt, Homo sapiens
ccuacagagaaaauucugaua

SEQ ID NO: 33280 - RNA, 20 nt, Homo sapiens
cgcuggccgccagcagcuca

SEQ ID NO: 33281 - RNA, 20 nt, Homo sapiens
cuccaagacgagggccucau

SEQ ID NO: 33282 - RNA, 22 nt, Homo sapiens
gaaagucuuauuaaaagccucc

SEQ ID NO: 33283 - RNA, 17 nt, Homo sapiens
ggcgagggcgcuggccg

SEQ ID NO: 33284 - RNA, 21 nt, Homo sapiens
guaaccauacacuuuauucca

SEQ ID NO: 33285 - RNA, 22 nt, Homo sapiens
auaucucagauuugaaaccuca

SEQ ID NO: 33286 - RNA, 23 nt, Homo sapiens
cccagaagagaguccccaaguga

SEQ ID NO: 33287 - RNA, 18 nt, Homo sapiens
gagccccucaucaucccc

SEQ ID NO: 33288 - RNA, 23 nt, Homo sapiens
cagcaagagaagaaucugcucua

SEQ ID NO: 33289 - RNA, 19 nt, Homo sapiens
aaaaaagaggcaaacaaag

SEQ ID NO: 33290 - RNA, 17 nt, Homo sapiens
cccagcgacacuaggga

SEQ ID NO: 33291 - RNA, 25 nt, Homo sapiens
ccuuuaugcguguuguuuucacuuu

SEQ ID NO: 33292 - RNA, 19 nt, Homo sapiens
gucuucauuauuuuccuca

SEQ ID NO: 33293 - RNA, 18 nt, Homo sapiens
uauauguggguguagguc

SEQ ID NO: 33294 - RNA, 22 nt, Homo sapiens
ucucuuccgugucuuugaccuu

SEQ ID NO: 33295 - RNA, 17 nt, Homo sapiens
aaacuacagaguuuaug

SEQ ID NO: 33296 - RNA, 23 nt, Homo sapiens
aagacuacuauacaaacuacaga

SEQ ID NO: 33297 - RNA, 20 nt, Homo sapiens
aggugcgcacuaccacacca

SEQ ID NO: 33298 - RNA, 20 nt, Homo sapiens
auuguucuauuuguauauau

SEQ ID NO: 33299 - RNA, 19 nt, Homo sapiens
aaugcuaaugaacagcuca

SEQ ID NO: 33300 - RNA, 23 nt, Homo sapiens
accuggguguggugcugccuggc

SEQ ID NO: 33301 - RNA, 20 nt, Homo sapiens
acuggucagggaacuguggc

SEQ ID NO: 33302 - RNA, 21 nt, Homo sapiens
agaaagcccaccucuccuccc

SEQ ID NO: 33303 - RNA, 25 nt, Homo sapiens
cccagagacacccaguuucucagug

SEQ ID NO: 33304 - RNA, 22 nt, Homo sapiens
ccuagggggcugggguugcugc

SEQ ID NO: 33305 - RNA, 19 nt, Homo sapiens
cuuccagugugaauuuugg

SEQ ID NO: 33306 - RNA, 23 nt, Homo sapiens
acuacuacuaacuugcucuguga

SEQ ID NO: 33307 - RNA, 20 nt, Homo sapiens
acuguauacaguauacuuua

SEQ ID NO: 33308 - RNA, 22 nt, Homo sapiens
agccaagauugaaaacaguguu

SEQ ID NO: 33309 - RNA, 21 nt, Homo sapiens
cauguggccugugggcugcaa

SEQ ID NO: 33310 - RNA, 19 nt, Homo sapiens
cuccugcuuaucuugcaca

SEQ ID NO: 33311 - RNA, 19 nt, Homo sapiens
ggagcuuuuagaacuccca

SEQ ID NO: 33312 - RNA, 22 nt, Homo sapiens
uaauuggucugacauggaguug

SEQ ID NO: 33313 - RNA, 18 nt, Homo sapiens
ucugauguaguuugugga

SEQ ID NO: 33314 - RNA, 17 nt, Homo sapiens
ugaccaagucauuugac

SEQ ID NO: 33315 - RNA, 19 nt, Homo sapiens
uuuugguccaguucuaaca

SEQ ID NO: 33316 - RNA, 22 nt, Homo sapiens
aauggucacaugccaucucuuc

SEQ ID NO: 33317 - RNA, 21 nt, Homo sapiens
caucuaagaagaaauagauca

SEQ ID NO: 33318 - RNA, 19 nt, Homo sapiens
uaaagaacuuuccucagga

SEQ ID NO: 33319 - RNA, 18 nt, Homo sapiens
uacagguuacaucauugc

SEQ ID NO: 33320 - RNA, 20 nt, Homo sapiens
uuuuuugucuuugccacuac

SEQ ID NO: 33321 - RNA, 19 nt, Homo sapiens
acuuuuaaaagauacccuc

SEQ ID NO: 33322 - RNA, 20 nt, Homo sapiens
aguccucgcaggagacacca

SEQ ID NO: 33323 - RNA, 19 nt, Homo sapiens
cuugauaauugguuccucc

SEQ ID NO: 33324 - RNA, 19 nt, Homo sapiens
uaguugcacaguaugugua

SEQ ID NO: 33325 - RNA, 19 nt, Homo sapiens
ugcacuauuggagcccugg

SEQ ID NO: 33326 - RNA, 16 nt, Homo sapiens
aucacuuacagaacca

SEQ ID NO: 33327 - RNA, 16 nt, Homo sapiens
gcuuggacgcgcugcu

SEQ ID NO: 33328 - RNA, 24 nt, Homo sapiens
ugcuguaaagcaaaauauuuguga

SEQ ID NO: 33329 - RNA, 22 nt, Homo sapiens
ccugagaugguccacucugugg

SEQ ID NO: 33330 - RNA, 19 nt, Homo sapiens
ggguucccguauggaacug

SEQ ID NO: 33331 - RNA, 20 nt, Homo sapiens
ugcucugcgggagaaaagcc

SEQ ID NO: 33332 - RNA, 21 nt, Homo sapiens
aggccagcauucagccugaga

SEQ ID NO: 33333 - RNA, 16 nt, Homo sapiens
ccagggaagcccccug

SEQ ID NO: 33334 - RNA, 19 nt, Homo sapiens
ccugaaucauacccuugga

SEQ ID NO: 33335 - RNA, 19 nt, Homo sapiens
acccgugcaccuguccugc

SEQ ID NO: 33336 - RNA, 25 nt, Homo sapiens
cuuugagggacugggggacuugggg

SEQ ID NO: 33337 - RNA, 23 nt, Homo sapiens
acuuuuucagugguucuuggucc

SEQ ID NO: 33338 - RNA, 18 nt, Homo sapiens
ccgccucauucccacccc

SEQ ID NO: 33339 - RNA, 18 nt, Homo sapiens
ccucauucccacccccaa

SEQ ID NO: 33340 - RNA, 21 nt, Homo sapiens
cucauuugauguauuaaucau

SEQ ID NO: 33341 - RNA, 18 nt, Homo sapiens
gcuucuuccaguucauuu

SEQ ID NO: 33342 - RNA, 18 nt, Homo sapiens
guuuucuaaaucauuuuu

SEQ ID NO: 33343 - RNA, 22 nt, Homo sapiens
uuucccauuucugcauuaaaua

SEQ ID NO: 33344 - RNA, 22 nt, Homo sapiens
agaagagaucccccguccccca

SEQ ID NO: 33345 - RNA, 20 nt, Homo sapiens
agauaaagguuggggacagg

SEQ ID NO: 33346 - RNA, 18 nt, Homo sapiens
agauguauaugcuuucua

SEQ ID NO: 33347 - RNA, 26 nt, Homo sapiens
auagagcugcauugucggugauucca

SEQ ID NO: 33348 - RNA, 20 nt, Homo sapiens
uccauuuucuauuaccugga

SEQ ID NO: 33349 - RNA, 25 nt, Homo sapiens
acaugguccgugccaugucaccucc

SEQ ID NO: 33350 - RNA, 17 nt, Homo sapiens
acccaguguacacacca

SEQ ID NO: 33351 - RNA, 19 nt, Homo sapiens
agucuccuacccucucagc

SEQ ID NO: 33352 - RNA, 21 nt, Homo sapiens
caccugcaccgcccugcucuu

SEQ ID NO: 33353 - RNA, 24 nt, Homo sapiens
caguguacacaccaccuacgugca

SEQ ID NO: 33354 - RNA, 19 nt, Homo sapiens
cuccauagggaaaggcuuc

SEQ ID NO: 33355 - RNA, 19 nt, Homo sapiens
cugagagcagaggccgugc

SEQ ID NO: 33356 - RNA, 22 nt, Homo sapiens
gccuccagcugaccucuggcuc

SEQ ID NO: 33357 - RNA, 26 nt, Homo sapiens
gcuugagcccuguuucuuccuggccu

SEQ ID NO: 33358 - RNA, 20 nt, Homo sapiens
gugugccaggccaggacagc

SEQ ID NO: 33359 - RNA, 18 nt, Homo sapiens
ugggugcagcgugaggcu

SEQ ID NO: 33360 - RNA, 22 nt, Homo sapiens
gccaugagggagguucuggggg

SEQ ID NO: 33361 - RNA, 21 nt, Homo sapiens
agcaccauguuuuuucuauga

SEQ ID NO: 33362 - RNA, 17 nt, Homo sapiens
ccccagcacagaugcca

SEQ ID NO: 33363 - RNA, 19 nt, Homo sapiens
ccuuggcccgggccugugg

SEQ ID NO: 33364 - RNA, 18 nt, Homo sapiens
cucacccucaccaucuga

SEQ ID NO: 33365 - RNA, 24 nt, Homo sapiens
ggacaaggaaaggaucagauaccu

SEQ ID NO: 33366 - RNA, 17 nt, Homo sapiens
ugucuguggcugaagga

SEQ ID NO: 33367 - RNA, 18 nt, Homo sapiens
aucuuaccauuauuuuac

SEQ ID NO: 33368 - RNA, 25 nt, Homo sapiens
caaaaacaaaacaccagggacacau

SEQ ID NO: 33369 - RNA, 20 nt, Homo sapiens
uaagaaauaaaagugcuucu

SEQ ID NO: 33370 - RNA, 22 nt, Homo sapiens
ucuaagaaauaaaagugcuucu

SEQ ID NO: 33371 - RNA, 20 nt, Homo sapiens
agcugugugaacuuagcuuu

SEQ ID NO: 33372 - RNA, 22 nt, Homo sapiens
cuaccagacuucaaaauuuacu

SEQ ID NO: 33373 - RNA, 22 nt, Homo sapiens
ggaucaaacacaaagggcauca

SEQ ID NO: 33374 - RNA, 17 nt, Homo sapiens
agaaacuuacugugcug

SEQ ID NO: 33375 - RNA, 18 nt, Homo sapiens
agggccagcaaagaauua

SEQ ID NO: 33376 - RNA, 16 nt, Homo sapiens
agugauucugauacac

SEQ ID NO: 33377 - RNA, 17 nt, Homo sapiens
guagguggggaagaugu

SEQ ID NO: 33378 - RNA, 21 nt, Homo sapiens
ucugaaggugcuuuuuccaca

SEQ ID NO: 33379 - RNA, 25 nt, Homo sapiens
uuucuuucagucauugucuuaguuu

SEQ ID NO: 33380 - RNA, 18 nt, Homo sapiens
gcgcgccgggagcugcug

SEQ ID NO: 33381 - RNA, 19 nt, Homo sapiens
guuacacccuggcacuguu

SEQ ID NO: 33382 - RNA, 17 nt, Homo sapiens
ucauaauucagcauuaa

SEQ ID NO: 33383 - RNA, 19 nt, Homo sapiens
ugagccuaccgccgccaga

SEQ ID NO: 33384 - RNA, 17 nt, Homo sapiens
ccugcaccagcauguca

SEQ ID NO: 33385 - RNA, 18 nt, Homo sapiens
cugugccucuccucauuc

SEQ ID NO: 33386 - RNA, 18 nt, Homo sapiens
gggaaugggauauugaca

SEQ ID NO: 33387 - RNA, 23 nt, Homo sapiens
uauacuuagauauagugcauugu

SEQ ID NO: 33388 - RNA, 20 nt, Homo sapiens
ucaguccaguugaagaauug

SEQ ID NO: 33389 - RNA, 22 nt, Homo sapiens
accacacagcaucaucgcccca

SEQ ID NO: 33390 - RNA, 18 nt, Homo sapiens
aucaaaccccaggucugc

SEQ ID NO: 33391 - RNA, 19 nt, Homo sapiens
ccugggccagcucuggcuu

SEQ ID NO: 33392 - RNA, 20 nt, Homo sapiens
cucucucccuuuucaguguc

SEQ ID NO: 33393 - RNA, 22 nt, Homo sapiens
accacacagcaucaucgcccca

SEQ ID NO: 33394 - RNA, 22 nt, Homo sapiens
acuugcugucggccuuuggcuu

SEQ ID NO: 33395 - RNA, 18 nt, Homo sapiens
agcuggacuugccgcugu

SEQ ID NO: 33396 - RNA, 18 nt, Homo sapiens
aucaaaccccaggucugc

SEQ ID NO: 33397 - RNA, 22 nt, Homo sapiens
ccaauucugguuucacauucag

SEQ ID NO: 33398 - RNA, 18 nt, Homo sapiens
ccaggaguuuugaccagg

SEQ ID NO: 33399 - RNA, 19 nt, Homo sapiens
ccugggccagcucuggcuu

SEQ ID NO: 33400 - RNA, 20 nt, Homo sapiens
cucucucccuuuucaguguc

SEQ ID NO: 33401 - RNA, 18 nt, Homo sapiens
ucugucacugccaccgua

SEQ ID NO: 33402 - RNA, 22 nt, Homo sapiens
aauggucauaucaaauguucuu

SEQ ID NO: 33403 - RNA, 17 nt, Homo sapiens
uuccagacguuguucca

SEQ ID NO: 33404 - RNA, 23 nt, Homo sapiens
gaaaaagaguuaagggaaaucua

SEQ ID NO: 33405 - RNA, 21 nt, Homo sapiens
gugcagcuguuguuggauuuu

SEQ ID NO: 33406 - RNA, 21 nt, Homo sapiens
guuuccaguggacacaaggug

SEQ ID NO: 33407 - RNA, 20 nt, Homo sapiens
cccuggugacggccaccugc

SEQ ID NO: 33408 - RNA, 20 nt, Homo sapiens
cgagccgcugccuccgcucc

SEQ ID NO: 33409 - RNA, 20 nt, Homo sapiens
uccuggcgccggacgugugg

SEQ ID NO: 33410 - RNA, 21 nt, Homo sapiens
uuccagaagcacuugcuucag

SEQ ID NO: 33411 - RNA, 20 nt, Homo sapiens
gaccccgagagcggcggcgc

SEQ ID NO: 33412 - RNA, 19 nt, Homo sapiens
aacaaauccucugaccuca

SEQ ID NO: 33413 - RNA, 19 nt, Homo sapiens
uagaaagugcuuugaaaua

SEQ ID NO: 33414 - RNA, 18 nt, Homo sapiens
uggguaauuggugcuggc

SEQ ID NO: 33415 - RNA, 20 nt, Homo sapiens
acagagaauccugccuuggu

SEQ ID NO: 33416 - RNA, 19 nt, Homo sapiens
auguuugguagcucucuga

SEQ ID NO: 33417 - RNA, 21 nt, Homo sapiens
caaacuuguuuuuguacuguc

SEQ ID NO: 33418 - RNA, 22 nt, Homo sapiens
ccacccccucccacagcccacc

SEQ ID NO: 33419 - RNA, 16 nt, Homo sapiens
cuuuuuccacuuugca

SEQ ID NO: 33420 - RNA, 21 nt, Homo sapiens
gaaagaacagaaauuugcaca

SEQ ID NO: 33421 - RNA, 20 nt, Homo sapiens
gaaagcccaaauuacaccuc

SEQ ID NO: 33422 - RNA, 24 nt, Homo sapiens
gaauccuagaaaaauaaucccuaa

SEQ ID NO: 33423 - RNA, 18 nt, Homo sapiens
gcccaccuccacuuuuga

SEQ ID NO: 33424 - RNA, 24 nt, Homo sapiens
gcucucuagcucuugcacucugaa

SEQ ID NO: 33425 - RNA, 19 nt, Homo sapiens
ucuagcucuugcacucuga

SEQ ID NO: 33426 - RNA, 18 nt, Homo sapiens
ucuauggaaaacuacuca

SEQ ID NO: 33427 - RNA, 19 nt, Homo sapiens
ucucccagaacacaguguu

SEQ ID NO: 33428 - RNA, 18 nt, Homo sapiens
ugcaagguggccuacuca

SEQ ID NO: 33429 - RNA, 20 nt, Homo sapiens
aggcacaucccaccuuaccu

SEQ ID NO: 33430 - RNA, 25 nt, Homo sapiens
ccucucacuuggcugauuugaccuu

SEQ ID NO: 33431 - RNA, 26 nt, Homo sapiens
ccucuugaucuguuguuuauggccuu

SEQ ID NO: 33432 - RNA, 24 nt, Homo sapiens
cuugucccucaguggggguucucu

SEQ ID NO: 33433 - RNA, 20 nt, Homo sapiens
gcguaucuugccauguguca

SEQ ID NO: 33434 - RNA, 18 nt, Homo sapiens
ugguguaugagguucuga

SEQ ID NO: 33435 - RNA, 19 nt, Homo sapiens
aggcgcaaagcuucgguga

SEQ ID NO: 33436 - RNA, 21 nt, Homo sapiens
cgcagacgcgccccgccccuc

SEQ ID NO: 33437 - RNA, 25 nt, Homo sapiens
cucaaacgcaaagaaaacugcaggu

SEQ ID NO: 33438 - RNA, 21 nt, Homo sapiens
gcccauggagcacuguccuca

SEQ ID NO: 33439 - RNA, 23 nt, Homo sapiens
agaaagguggccuuggacaaaac

SEQ ID NO: 33440 - RNA, 19 nt, Homo sapiens
cugagccccaggucugucu

SEQ ID NO: 33441 - RNA, 15 nt, Homo sapiens
gccaugccugccucu

SEQ ID NO: 33442 - RNA, 19 nt, Homo sapiens
ggcaugcauaugugagaua

SEQ ID NO: 33443 - RNA, 17 nt, Homo sapiens
uuggcucuguccagcaa

SEQ ID NO: 33444 - RNA, 21 nt, Homo sapiens
cccuagaccagcuccucucca

SEQ ID NO: 33445 - RNA, 19 nt, Homo sapiens
gacucgcguucccuccagc

SEQ ID NO: 33446 - RNA, 19 nt, Homo sapiens
uggcgucucggcguggaac

SEQ ID NO: 33447 - RNA, 21 nt, Homo sapiens
gcaucuuacccauuuucuuca

SEQ ID NO: 33448 - RNA, 18 nt, Homo sapiens
uccgccuccuggguucaa

SEQ ID NO: 33449 - RNA, 21 nt, Homo sapiens
uucaagugauucuccugccac

SEQ ID NO: 33450 - RNA, 25 nt, Homo sapiens
accuggguccaguguagccuggcuc

SEQ ID NO: 33451 - RNA, 26 nt, Homo sapiens
auggcccacauuuuggcaugagggug

SEQ ID NO: 33452 - RNA, 18 nt, Homo sapiens
cagcaaagccucauggca

SEQ ID NO: 33453 - RNA, 18 nt, Homo sapiens
caggugagaaauugugcu

SEQ ID NO: 33454 - RNA, 19 nt, Homo sapiens
ccacuucccagccgcccca

SEQ ID NO: 33455 - RNA, 19 nt, Homo sapiens
cugccugacccuccacugc

SEQ ID NO: 33456 - RNA, 22 nt, Homo sapiens
gccucagcccacaccugccuca

SEQ ID NO: 33457 - RNA, 21 nt, Homo sapiens
gccugggcccccagcuuggcc

SEQ ID NO: 33458 - RNA, 20 nt, Homo sapiens
gcuaaccuuggccaccacca

SEQ ID NO: 33459 - RNA, 16 nt, Homo sapiens
ugcuccucugcccuca

SEQ ID NO: 33460 - RNA, 19 nt, Homo sapiens
acacugaugauaccuccaa

SEQ ID NO: 33461 - RNA, 17 nt, Homo sapiens
ccaacucaaacacuuuu

SEQ ID NO: 33462 - RNA, 23 nt, Homo sapiens
gcucauaugaacacugcucugaa

SEQ ID NO: 33463 - RNA, 21 nt, Homo sapiens
uaccaacauuuaaagcuuaaa

SEQ ID NO: 33464 - RNA, 17 nt, Homo sapiens
caaauauguauaccugg

SEQ ID NO: 33465 - RNA, 20 nt, Homo sapiens
cagaucugccaucgaucgca

SEQ ID NO: 33466 - RNA, 21 nt, Homo sapiens
cuuaaacuuccacaucacugc

SEQ ID NO: 33467 - RNA, 16 nt, Homo sapiens
cuuauucucucuuucu

SEQ ID NO: 33468 - RNA, 18 nt, Homo sapiens
cuuuccggccugcuccag

SEQ ID NO: 33469 - RNA, 20 nt, Homo sapiens
uccagaaagucacacucuca

SEQ ID NO: 33470 - RNA, 23 nt, Homo sapiens
uucauuguguuguacuggaugca

SEQ ID NO: 33471 - RNA, 19 nt, Homo sapiens
uuucuauaccacugucauu

SEQ ID NO: 33472 - RNA, 22 nt, Homo sapiens
cuaaaagauggaauauuugcgg

SEQ ID NO: 33473 - RNA, 20 nt, Homo sapiens
acaucuuuuaacuucucagu

SEQ ID NO: 33474 - RNA, 23 nt, Homo sapiens
cugagauaugcaaaauacucauu

SEQ ID NO: 33475 - RNA, 21 nt, Homo sapiens
cugcuuaauggaaaaaauacu

SEQ ID NO: 33476 - RNA, 25 nt, Homo sapiens
gaccucacuaaacuguuuaugugac

SEQ ID NO: 33477 - RNA, 20 nt, Homo sapiens
gacuuuaggauuaacuugua

SEQ ID NO: 33478 - RNA, 20 nt, Homo sapiens
guuucuggcucuuagacuca

SEQ ID NO: 33479 - RNA, 18 nt, Homo sapiens
uuucuuauaccaauguga

SEQ ID NO: 33480 - RNA, 21 nt, Homo sapiens
acagaaaaccuauacucuuug

SEQ ID NO: 33481 - RNA, 18 nt, Homo sapiens
aggaccuagacuacuucu

SEQ ID NO: 33482 - RNA, 17 nt, Homo sapiens
auaauaugagccagagc

SEQ ID NO: 33483 - RNA, 21 nt, Homo sapiens
augcaguuucuucauacuucu

SEQ ID NO: 33484 - RNA, 19 nt, Homo sapiens
gaacaguguacucuucuga

SEQ ID NO: 33485 - RNA, 24 nt, Homo sapiens
gagauucuggccucugcauauucu

SEQ ID NO: 33486 - RNA, 16 nt, Homo sapiens
gauggauggagcacuc

SEQ ID NO: 33487 - RNA, 21 nt, Homo sapiens
gugcaauacauuggugaguuc

SEQ ID NO: 33488 - RNA, 20 nt, Homo sapiens
uuugggaagauuuuuguuca

SEQ ID NO: 33489 - RNA, 19 nt, Homo sapiens
uuuuucauggcuuuguuuu

SEQ ID NO: 33490 - RNA, 17 nt, Homo sapiens
ccaaagauccucucacc

SEQ ID NO: 33491 - RNA, 22 nt, Homo sapiens
ucucuuuugaguuuuauaccuu

SEQ ID NO: 33492 - RNA, 20 nt, Homo sapiens
gaugaaaacauaaugccuua

SEQ ID NO: 33493 - RNA, 16 nt, Homo sapiens
gugcuauuuuuuguaa

SEQ ID NO: 33494 - RNA, 18 nt, Homo sapiens
uacacauacauacacaca

SEQ ID NO: 33495 - RNA, 19 nt, Homo sapiens
uccugaauacacuauuuug

SEQ ID NO: 33496 - RNA, 19 nt, Homo sapiens
uguuuauggacacaugaaa

SEQ ID NO: 33497 - RNA, 21 nt, Homo sapiens
aaauguguuccuaagaagaca

SEQ ID NO: 33498 - RNA, 19 nt, Homo sapiens
acacagugaaaauccagga

SEQ ID NO: 33499 - RNA, 17 nt, Homo sapiens
acauuauauuacuaaua

SEQ ID NO: 33500 - RNA, 18 nt, Homo sapiens
gauguaauaacuacuuug

SEQ ID NO: 33501 - RNA, 19 nt, Homo sapiens
uugaugauuucgugaaaua

SEQ ID NO: 33502 - RNA, 16 nt, Homo sapiens
cugaugaaaccuugaa

SEQ ID NO: 33503 - RNA, 17 nt, Homo sapiens
uccuggcuccuucacca

SEQ ID NO: 33504 - RNA, 22 nt, Homo sapiens
acaaaaucaugauuaguuacaa

SEQ ID NO: 33505 - RNA, 17 nt, Homo sapiens
agagagagaaaaacacc

SEQ ID NO: 33506 - RNA, 21 nt, Homo sapiens
aaaaacagcuguaacaaagaa

SEQ ID NO: 33507 - RNA, 18 nt, Homo sapiens
acacaccaauauacauca

SEQ ID NO: 33508 - RNA, 22 nt, Homo sapiens
agagaaaagaacagcucccgac

SEQ ID NO: 33509 - RNA, 19 nt, Homo sapiens
auugcauuccucuaugaug

SEQ ID NO: 33510 - RNA, 22 nt, Homo sapiens
caucuuggcucagucucccuca

SEQ ID NO: 33511 - RNA, 21 nt, Homo sapiens
cauuuuuaaaauguaaaaaug

SEQ ID NO: 33512 - RNA, 22 nt, Homo sapiens
ccauaacaauaaccugcuguua

SEQ ID NO: 33513 - RNA, 18 nt, Homo sapiens
gugaugacaauauggguu

SEQ ID NO: 33514 - RNA, 19 nt, Homo sapiens
guugauggaaaauggacua

SEQ ID NO: 33515 - RNA, 20 nt, Homo sapiens
ugggcauauugcaaugauga

SEQ ID NO: 33516 - RNA, 19 nt, Homo sapiens
uguauauauacacaguaga

SEQ ID NO: 33517 - RNA, 18 nt, Homo sapiens
agugccaaaaaauuguau

SEQ ID NO: 33518 - RNA, 20 nt, Homo sapiens
guauguguuguugcuugacu

SEQ ID NO: 33519 - RNA, 24 nt, Homo sapiens
uuggagucauuguggguuauuuuu

SEQ ID NO: 33520 - RNA, 19 nt, Homo sapiens
ccguagaaaguacuuuguc

SEQ ID NO: 33521 - RNA, 21 nt, Homo sapiens
uauuggauaugucauuucugu

SEQ ID NO: 33522 - RNA, 18 nt, Homo sapiens
aaacauguaacucugcuu

SEQ ID NO: 33523 - RNA, 21 nt, Homo sapiens
acuugucaucugacaaccacu

SEQ ID NO: 33524 - RNA, 22 nt, Homo sapiens
aucuuggcucacugcaaccucu

SEQ ID NO: 33525 - RNA, 19 nt, Homo sapiens
cauaccccuggccauaggc

SEQ ID NO: 33526 - RNA, 19 nt, Homo sapiens
ccguagaaaguacuuuguc

SEQ ID NO: 33527 - RNA, 20 nt, Homo sapiens
ccucugccucccagguucaa

SEQ ID NO: 33528 - RNA, 19 nt, Homo sapiens
cugcaaccucugccuccca

SEQ ID NO: 33529 - RNA, 19 nt, Homo sapiens
cuuuuccuucuuacuguga

SEQ ID NO: 33530 - RNA, 23 nt, Homo sapiens
guauguaugagugugugcauuug

SEQ ID NO: 33531 - RNA, 24 nt, Homo sapiens
ugggcaauuguaacacaauggcaa

SEQ ID NO: 33532 - RNA, 21 nt, Homo sapiens
cuuguggugugaccauguuca

SEQ ID NO: 33533 - RNA, 18 nt, Homo sapiens
ucuuugcauuguuccucc

SEQ ID NO: 33534 - RNA, 20 nt, Homo sapiens
uugcucgccgcagccgccuc

SEQ ID NO: 33535 - RNA, 19 nt, Homo sapiens
aaacuccugaccucaggug

SEQ ID NO: 33536 - RNA, 19 nt, Homo sapiens
aaaucaacucaauauauca

SEQ ID NO: 33537 - RNA, 18 nt, Homo sapiens
agguaaaauacuagucag

SEQ ID NO: 33538 - RNA, 25 nt, Homo sapiens
auuucaugcuuggucaaaaacauca

SEQ ID NO: 33539 - RNA, 17 nt, Homo sapiens
ucaagugauucuugugc

SEQ ID NO: 33540 - RNA, 18 nt, Homo sapiens
ugaagagauuaccuagag

SEQ ID NO: 33541 - RNA, 20 nt, Homo sapiens
uguuaaaacaagugauuucc

SEQ ID NO: 33542 - RNA, 23 nt, Homo sapiens
aagugaaaccuuauacccauuaa

SEQ ID NO: 33543 - RNA, 18 nt, Homo sapiens
cauugauagacaugugug

SEQ ID NO: 33544 - RNA, 19 nt, Homo sapiens
ccuuggcaucauguccuca

SEQ ID NO: 33545 - RNA, 24 nt, Homo sapiens
uucuccacauuuuugccaacgcuu

SEQ ID NO: 33546 - RNA, 20 nt, Homo sapiens
uuucccuaauuaaugguguu

SEQ ID NO: 33547 - RNA, 21 nt, Homo sapiens
accauuagcaagauuaaccaa

SEQ ID NO: 33548 - RNA, 20 nt, Homo sapiens
agcccuaaacacugauguca

SEQ ID NO: 33549 - RNA, 19 nt, Homo sapiens
augcuugcuccccacacua

SEQ ID NO: 33550 - RNA, 17 nt, Homo sapiens
cauuauuucuaacacuu

SEQ ID NO: 33551 - RNA, 18 nt, Homo sapiens
cugggcaguucgggcuuu

SEQ ID NO: 33552 - RNA, 22 nt, Homo sapiens
gaaccaggagaaaggggugagg

SEQ ID NO: 33553 - RNA, 21 nt, Homo sapiens
ggaacagcagccgggcugugg

SEQ ID NO: 33554 - RNA, 18 nt, Homo sapiens
ggacauggccccuggcug

SEQ ID NO: 33555 - RNA, 20 nt, Homo sapiens
gggggugcgggugugugcug

SEQ ID NO: 33556 - RNA, 20 nt, Homo sapiens
ucccgcuucccaccugcauc

SEQ ID NO: 33557 - RNA, 17 nt, Homo sapiens
uuuugggaugaaauguc

SEQ ID NO: 33558 - RNA, 15 nt, Homo sapiens
accuguugucuguua

SEQ ID NO: 33559 - RNA, 22 nt, Homo sapiens
aucucgguucacugcaaccucu

SEQ ID NO: 33560 - RNA, 23 nt, Homo sapiens
ccauuuccaaagaacccaaguag

SEQ ID NO: 33561 - RNA, 19 nt, Homo sapiens
ccucauguccucgccucug

SEQ ID NO: 33562 - RNA, 20 nt, Homo sapiens
ccucugccucccagguucaa

SEQ ID NO: 33563 - RNA, 19 nt, Homo sapiens
cugcaaccucugccuccca

SEQ ID NO: 33564 - RNA, 21 nt, Homo sapiens
gcuccucauguccucgccucu

SEQ ID NO: 33565 - RNA, 23 nt, Homo sapiens
uuuaagugaucuuuugugauuuu

SEQ ID NO: 33566 - RNA, 18 nt, Homo sapiens
caauauauagugauaaug

SEQ ID NO: 33567 - RNA, 21 nt, Homo sapiens
cuuuggugguggaagaaagaa

SEQ ID NO: 33568 - RNA, 21 nt, Homo sapiens
acuuuagaaaagaucaucuuc

SEQ ID NO: 33569 - RNA, 16 nt, Homo sapiens
aguacuacaguuuuca

SEQ ID NO: 33570 - RNA, 22 nt, Homo sapiens
caguguuuuaccguccccagcc

SEQ ID NO: 33571 - RNA, 21 nt, Homo sapiens
uggacacauggaagggagcca

SEQ ID NO: 33572 - RNA, 19 nt, Homo sapiens
acagcaacaggcccaguga

SEQ ID NO: 33573 - RNA, 19 nt, Homo sapiens
ccuuccccuccagugcgca

SEQ ID NO: 33574 - RNA, 22 nt, Homo sapiens
cuuucugggaauaaacaucaca

SEQ ID NO: 33575 - RNA, 22 nt, Homo sapiens
guguccagaauugguggguucu

SEQ ID NO: 33576 - RNA, 19 nt, Homo sapiens
uggguggaucacuugaagc

SEQ ID NO: 33577 - RNA, 18 nt, Homo sapiens
caccacacaccggaccac

SEQ ID NO: 33578 - RNA, 19 nt, Homo sapiens
acgcgauucuccugccuca

SEQ ID NO: 33579 - RNA, 19 nt, Homo sapiens
augacguggugggcuacgu

SEQ ID NO: 33580 - RNA, 22 nt, Homo sapiens
cccuuccccaccccccgggccu

SEQ ID NO: 33581 - RNA, 19 nt, Homo sapiens
cgcagggcagagccggcca

SEQ ID NO: 33582 - RNA, 22 nt, Homo sapiens
cuuuacacccccaccugccucu

SEQ ID NO: 33583 - RNA, 19 nt, Homo sapiens
gccucgccuucccacccca

SEQ ID NO: 33584 - RNA, 19 nt, Homo sapiens
gggcagagccggccaccua

SEQ ID NO: 33585 - RNA, 15 nt, Homo sapiens
gggcgagggggugca

SEQ ID NO: 33586 - RNA, 19 nt, Homo sapiens
gugcuuugguguauugagu

SEQ ID NO: 33587 - RNA, 19 nt, Homo sapiens
gugcuuugguguauugagu

SEQ ID NO: 33588 - RNA, 19 nt, Homo sapiens
gugcuuugguguauugagu

SEQ ID NO: 33589 - RNA, 19 nt, Homo sapiens
gugcuuugguguauugagu

SEQ ID NO: 33590 - RNA, 19 nt, Homo sapiens
gugcuuugguguauugagu

SEQ ID NO: 33591 - RNA, 19 nt, Homo sapiens
gugcuuugguguauugagu

SEQ ID NO: 33592 - RNA, 19 nt, Homo sapiens
gugcuuugguguauugagu

SEQ ID NO: 33593 - RNA, 19 nt, Homo sapiens
gugcuuugguguauugagu

SEQ ID NO: 33594 - RNA, 19 nt, Homo sapiens
gugcuuugguguauugagu

SEQ ID NO: 33595 - RNA, 19 nt, Homo sapiens
gugcuuugguguauugagu

SEQ ID NO: 33596 - RNA, 19 nt, Homo sapiens
gugcuuugguguauugagu

SEQ ID NO: 33597 - RNA, 19 nt, Homo sapiens
gugcuuugguguauugagu

SEQ ID NO: 33598 - RNA, 19 nt, Homo sapiens
gugcuuugguguauugagu

SEQ ID NO: 33599 - RNA, 19 nt, Homo sapiens
gugcuuugguguauugagu

SEQ ID NO: 33600 - RNA, 19 nt, Homo sapiens
gugcuuugguguauugagu

SEQ ID NO: 33601 - RNA, 19 nt, Homo sapiens
gugcuuugguguauugagu

SEQ ID NO: 33602 - RNA, 19 nt, Homo sapiens
gugcuuugguguauugagu

SEQ ID NO: 33603 - RNA, 19 nt, Homo sapiens
gugcuuugguguauugagu

SEQ ID NO: 33604 - RNA, 19 nt, Homo sapiens
gugcuuugguguauugagu

SEQ ID NO: 33605 - RNA, 19 nt, Homo sapiens
gugcuuugguguauugagu

SEQ ID NO: 33606 - RNA, 19 nt, Homo sapiens
gugcuuugguguauugagu

SEQ ID NO: 33607 - RNA, 25 nt, Homo sapiens
ugggcagcugcuacucagugccaac

SEQ ID NO: 33608 - RNA, 20 nt, Homo sapiens
agcuucuuguauuggcagug

SEQ ID NO: 33609 - RNA, 22 nt, Homo sapiens
ccaccucuuccugaaaguccuc

SEQ ID NO: 33610 - RNA, 21 nt, Homo sapiens
cucugggacuaagccugcgag

SEQ ID NO: 33611 - RNA, 20 nt, Homo sapiens
gacgacaggaaauggugaca

SEQ ID NO: 33612 - RNA, 19 nt, Homo sapiens
gccagaugccucucaggag

SEQ ID NO: 33613 - RNA, 21 nt, Homo sapiens
gcuccccuguuuucuuccucu

SEQ ID NO: 33614 - RNA, 21 nt, Homo sapiens
gcucugggacuaagccugcga

SEQ ID NO: 33615 - RNA, 21 nt, Homo sapiens
ugggggcggcggggcuaggac

SEQ ID NO: 33616 - RNA, 19 nt, Homo sapiens
aacagauuagaggccauug

SEQ ID NO: 33617 - RNA, 18 nt, Homo sapiens
ccagaaaggccuuaauga

SEQ ID NO: 33618 - RNA, 18 nt, Homo sapiens
cgauggucuccauguauu

SEQ ID NO: 33619 - RNA, 19 nt, Homo sapiens
gucuucuguccugaucagg

SEQ ID NO: 33620 - RNA, 25 nt, Homo sapiens
ugacccagcagagcacucccuccca

SEQ ID NO: 33621 - RNA, 19 nt, Homo sapiens
aggcuaaccuuucuaagcu

SEQ ID NO: 33622 - RNA, 17 nt, Homo sapiens
aucguaagaaugacuga

SEQ ID NO: 33623 - RNA, 22 nt, Homo sapiens
ccagauuaaugcauaaagccaa

SEQ ID NO: 33624 - RNA, 15 nt, Homo sapiens
cccaguugccuuuaa

SEQ ID NO: 33625 - RNA, 17 nt, Homo sapiens
gcauugcacccuggugu

SEQ ID NO: 33626 - RNA, 21 nt, Homo sapiens
ccaacugagacucccaucuuu

SEQ ID NO: 33627 - RNA, 19 nt, Homo sapiens
cuuuuccuguuuuaucuca

SEQ ID NO: 33628 - RNA, 19 nt, Homo sapiens
uggccaccuccucugagaa

SEQ ID NO: 33629 - RNA, 20 nt, Homo sapiens
ccagaugcccgccccgcccc

SEQ ID NO: 33630 - RNA, 20 nt, Homo sapiens
ccagccccuagccccacucc

SEQ ID NO: 33631 - RNA, 22 nt, Homo sapiens
cccauacugggaggcuggcgag

SEQ ID NO: 33632 - RNA, 17 nt, Homo sapiens
cugaaaugguucccacc

SEQ ID NO: 33633 - RNA, 18 nt, Homo sapiens
gcccagccccuagcccca

SEQ ID NO: 33634 - RNA, 24 nt, Homo sapiens
uccugauggcuguggagucugugg

SEQ ID NO: 33635 - RNA, 22 nt, Homo sapiens
ugucugagccccggcugugaug

SEQ ID NO: 33636 - RNA, 22 nt, Homo sapiens
ggugauugugaagugcugacca

SEQ ID NO: 33637 - RNA, 20 nt, Homo sapiens
uccucuuauuuaguguuacc

SEQ ID NO: 33638 - RNA, 23 nt, Homo sapiens
uuaaaaauaauagggaauguggu

SEQ ID NO: 33639 - RNA, 21 nt, Homo sapiens
ccacauucauuccuccauuuc

SEQ ID NO: 33640 - RNA, 18 nt, Homo sapiens
ccaguagagcugcccuuc

SEQ ID NO: 33641 - RNA, 19 nt, Homo sapiens
cuggagauaaguaauggug

SEQ ID NO: 33642 - RNA, 17 nt, Homo sapiens
gaccagccacaccaagu

SEQ ID NO: 33643 - RNA, 18 nt, Homo sapiens
gagcaggacguugagaua

SEQ ID NO: 33644 - RNA, 18 nt, Homo sapiens
guacauucacugcugcca

SEQ ID NO: 33645 - RNA, 22 nt, Homo sapiens
uagauccuugaaagcaauguca

SEQ ID NO: 33646 - RNA, 23 nt, Homo sapiens
uccauacagcaagacaccuggca

SEQ ID NO: 33647 - RNA, 22 nt, Homo sapiens
ucugcgaaggccccugauggag

SEQ ID NO: 33648 - RNA, 21 nt, Homo sapiens
uggggucaugagagcuaguua

SEQ ID NO: 33649 - RNA, 16 nt, Homo sapiens
uuucuuccuaguauca

SEQ ID NO: 33650 - RNA, 18 nt, Homo sapiens
agcuggucugacacuacg

SEQ ID NO: 33651 - RNA, 18 nt, Homo sapiens
cagaaggccauugaugaa

SEQ ID NO: 33652 - RNA, 20 nt, Homo sapiens
cccuccccagugucuuccca

SEQ ID NO: 33653 - RNA, 22 nt, Homo sapiens
gagaccauccugcccauccgag

SEQ ID NO: 33654 - RNA, 24 nt, Homo sapiens
gccuccuguugaccagccugguuu

SEQ ID NO: 33655 - RNA, 19 nt, Homo sapiens
ugcugcuguccagcugcua

SEQ ID NO: 33656 - RNA, 19 nt, Homo sapiens
aagcaauucuccugccuca

SEQ ID NO: 33657 - RNA, 17 nt, Homo sapiens
caaggcugccugccuca

SEQ ID NO: 33658 - RNA, 21 nt, Homo sapiens
cagaaagucacagcacaugug

SEQ ID NO: 33659 - RNA, 18 nt, Homo sapiens
caguggugcaaucucacc

SEQ ID NO: 33660 - RNA, 19 nt, Homo sapiens
cuucugugacuaauuuuua

SEQ ID NO: 33661 - RNA, 18 nt, Homo sapiens
gguaugagcagccucuca

SEQ ID NO: 33662 - RNA, 18 nt, Homo sapiens
uccgccuccuggguucaa

SEQ ID NO: 33663 - RNA, 20 nt, Homo sapiens
aguuuaagacuuuugucaug

SEQ ID NO: 33664 - RNA, 21 nt, Homo sapiens
ccaaagguagaccugcuguua

SEQ ID NO: 33665 - RNA, 17 nt, Homo sapiens
ccucuuuaacucaguua

SEQ ID NO: 33666 - RNA, 20 nt, Homo sapiens
cugcuagagccuacugugaa

SEQ ID NO: 33667 - RNA, 24 nt, Homo sapiens
gcuagucaguaugcaccaccacag

SEQ ID NO: 33668 - RNA, 19 nt, Homo sapiens
cgcccccaccuccacccuc

SEQ ID NO: 33669 - RNA, 19 nt, Homo sapiens
uugcaagauuccaaguucu

SEQ ID NO: 33670 - RNA, 26 nt, Homo sapiens
aucugggugccaucauuuucugguuc

SEQ ID NO: 33671 - RNA, 23 nt, Homo sapiens
agcucuucaacuaugucuuugaa

SEQ ID NO: 33672 - RNA, 24 nt, Homo sapiens
aggauggaaucaaacaauaugcaa

SEQ ID NO: 33673 - RNA, 21 nt, Homo sapiens
auugacauuccaguagagcaa

SEQ ID NO: 33674 - RNA, 22 nt, Homo sapiens
gcaaauacuucagugccugcua

SEQ ID NO: 33675 - RNA, 19 nt, Homo sapiens
gcaggcuugcaaccucuca

SEQ ID NO: 33676 - RNA, 21 nt, Homo sapiens
uucuggccucaguucugugag

SEQ ID NO: 33677 - RNA, 18 nt, Homo sapiens
aggggauuauucaaagua

SEQ ID NO: 33678 - RNA, 16 nt, Homo sapiens
ugaagagauugaaaga

SEQ ID NO: 33679 - RNA, 16 nt, Homo sapiens
ugcaacauuucucuga

SEQ ID NO: 33680 - RNA, 22 nt, Homo sapiens
aaacuuguggggaaccacauug

SEQ ID NO: 33681 - RNA, 21 nt, Homo sapiens
caugaucuguaccuaagcuca

SEQ ID NO: 33682 - RNA, 20 nt, Homo sapiens
cggaguguggagcuggacca

SEQ ID NO: 33683 - RNA, 17 nt, Homo sapiens
agauggauuuuaucugg

SEQ ID NO: 33684 - RNA, 17 nt, Homo sapiens
cccaucucaccacacug

SEQ ID NO: 33685 - RNA, 21 nt, Homo sapiens
gcuguuuugucugacaccaga

SEQ ID NO: 33686 - RNA, 24 nt, Homo sapiens
guguguccauuagacauuuggcua

SEQ ID NO: 33687 - RNA, 20 nt, Homo sapiens
agguagccugagccuaguua

SEQ ID NO: 33688 - RNA, 21 nt, Homo sapiens
cagaugccuuaaugugaagcu

SEQ ID NO: 33689 - RNA, 20 nt, Homo sapiens
cuuaacauuuaaaacugaua

SEQ ID NO: 33690 - RNA, 19 nt, Homo sapiens
ugcuaacaucacugucaua

SEQ ID NO: 33691 - RNA, 24 nt, Homo sapiens
uuucuuuaugguuuuaaaacucuu

SEQ ID NO: 33692 - RNA, 17 nt, Homo sapiens
ugguggaaggcuuggag

SEQ ID NO: 33693 - RNA, 24 nt, Homo sapiens
uuaaaaacuacauacaaaguugug

SEQ ID NO: 33694 - RNA, 22 nt, Homo sapiens
cauccaguauuuaacccagcca

SEQ ID NO: 33695 - RNA, 16 nt, Homo sapiens
gcugcaacaugggcgg

SEQ ID NO: 33696 - RNA, 18 nt, Homo sapiens
guagauacuggaaaugua

SEQ ID NO: 33697 - RNA, 18 nt, Homo sapiens
ucuauuuugaaaguggua

SEQ ID NO: 33698 - RNA, 21 nt, Homo sapiens
caauuuguugugauuuucagc

SEQ ID NO: 33699 - RNA, 19 nt, Homo sapiens
cagaaaaaugauuguuuca

SEQ ID NO: 33700 - RNA, 20 nt, Homo sapiens
ccagaaaaaugauuguuuca

SEQ ID NO: 33701 - RNA, 18 nt, Homo sapiens
cuuuuauaucccauuuug

SEQ ID NO: 33702 - RNA, 17 nt, Homo sapiens
caaaaauacuguccugg

SEQ ID NO: 33703 - RNA, 18 nt, Homo sapiens
cccuaccagaugccagca

SEQ ID NO: 33704 - RNA, 16 nt, Homo sapiens
ccuuuuuuccccuacc

SEQ ID NO: 33705 - RNA, 21 nt, Homo sapiens
gccuguuccgccggagcagca

SEQ ID NO: 33706 - RNA, 22 nt, Homo sapiens
gagccaagaucaugccacugca

SEQ ID NO: 33707 - RNA, 21 nt, Homo sapiens
acgaggguggcccaccucuca

SEQ ID NO: 33708 - RNA, 21 nt, Homo sapiens
agccuucccuuuggaauccca

SEQ ID NO: 33709 - RNA, 21 nt, Homo sapiens
gagcuacuaaacgcucaguga

SEQ ID NO: 33710 - RNA, 18 nt, Homo sapiens
ucccuggcuuagccguca

SEQ ID NO: 33711 - RNA, 20 nt, Homo sapiens
uucuaaaucccagcaaccaa

SEQ ID NO: 33712 - RNA, 17 nt, Homo sapiens
agagguuaucuuaccau

SEQ ID NO: 33713 - RNA, 18 nt, Homo sapiens
cagaucuacaauuugcua

SEQ ID NO: 33714 - RNA, 18 nt, Homo sapiens
cuuuuugaaaugcaguuu

SEQ ID NO: 33715 - RNA, 22 nt, Homo sapiens
uacuguaaaacaguuuuauaca

SEQ ID NO: 33716 - RNA, 20 nt, Homo sapiens
uaggaaacuuuugcaguuug

SEQ ID NO: 33717 - RNA, 16 nt, Homo sapiens
uucacugaagccuaug

SEQ ID NO: 33718 - RNA, 18 nt, Homo sapiens
augcaacaacaacacaca

SEQ ID NO: 33719 - RNA, 24 nt, Homo sapiens
caguacuuuguccauuugggaccu

SEQ ID NO: 33720 - RNA, 20 nt, Homo sapiens
gcgcgccucugccgagcgca

SEQ ID NO: 33721 - RNA, 22 nt, Homo sapiens
accuggcaugacuguuuguuuc

SEQ ID NO: 33722 - RNA, 20 nt, Homo sapiens
acgaaaggggguggccuuga

SEQ ID NO: 33723 - RNA, 21 nt, Homo sapiens
ccugugugccccagcaaucua

SEQ ID NO: 33724 - RNA, 22 nt, Homo sapiens
cuugccuuuuaggauguucuua

SEQ ID NO: 33725 - RNA, 21 nt, Homo sapiens
ugauguucuuccuggaauuca

SEQ ID NO: 33726 - RNA, 20 nt, Homo sapiens
uuccugugcucaucuccgga

SEQ ID NO: 33727 - RNA, 24 nt, Homo sapiens
uuguuucucaucuucauaauacca

SEQ ID NO: 33728 - RNA, 21 nt, Homo sapiens
uuucacugugaauucacuuuu

SEQ ID NO: 33729 - RNA, 19 nt, Homo sapiens
gccugggcagagggcccgg

SEQ ID NO: 33730 - RNA, 22 nt, Homo sapiens
aggucucacuguguugcccacg

SEQ ID NO: 33731 - RNA, 18 nt, Homo sapiens
ccacagugccuugaucag

SEQ ID NO: 33732 - RNA, 19 nt, Homo sapiens
cuucaaggcuguuuugacu

SEQ ID NO: 33733 - RNA, 21 nt, Homo sapiens
gccgagugacaggccgcagcc

SEQ ID NO: 33734 - RNA, 17 nt, Homo sapiens
gccuccgccccggccuc

SEQ ID NO: 33735 - RNA, 18 nt, Homo sapiens
ggcuucugcgaguccucg

SEQ ID NO: 33736 - RNA, 20 nt, Homo sapiens
guacggccgcucugcugcua

SEQ ID NO: 33737 - RNA, 18 nt, Homo sapiens
uggagaggagucuauuca

SEQ ID NO: 33738 - RNA, 22 nt, Homo sapiens
gcucuacuucagguuucacucc

SEQ ID NO: 33739 - RNA, 20 nt, Homo sapiens
acgugcuuuuauuauaucca

SEQ ID NO: 33740 - RNA, 22 nt, Homo sapiens
agaagagagagcagagccccuu

SEQ ID NO: 33741 - RNA, 19 nt, Homo sapiens
aggcaaggcccuuucugua

SEQ ID NO: 33742 - RNA, 21 nt, Homo sapiens
aggcuaggauugggcuaguua

SEQ ID NO: 33743 - RNA, 19 nt, Homo sapiens
ccaagauugcacuacugca

SEQ ID NO: 33744 - RNA, 19 nt, Homo sapiens
ccaagccaccugcuuccuc

SEQ ID NO: 33745 - RNA, 19 nt, Homo sapiens
gaaaguggcuugccaaaac

SEQ ID NO: 33746 - RNA, 20 nt, Homo sapiens
uaggacuugaagucuaguua

SEQ ID NO: 33747 - RNA, 20 nt, Homo sapiens
uccaccagcggauucugaga

SEQ ID NO: 33748 - RNA, 18 nt, Homo sapiens
ugaguggaucaccugagg

SEQ ID NO: 33749 - RNA, 23 nt, Homo sapiens
aaaauuccaaugacugugcugug

SEQ ID NO: 33750 - RNA, 21 nt, Homo sapiens
accagagaaacagagaugggc

SEQ ID NO: 33751 - RNA, 18 nt, Homo sapiens
ccugcaaccuccaccucc

SEQ ID NO: 33752 - RNA, 19 nt, Homo sapiens
ggcaugcaccaccacgcca

SEQ ID NO: 33753 - RNA, 18 nt, Homo sapiens
guccacugagaaauuaga

SEQ ID NO: 33754 - RNA, 18 nt, Homo sapiens
uccaccuccuggguucaa

SEQ ID NO: 33755 - RNA, 19 nt, Homo sapiens
aacccugucccaccccacc

SEQ ID NO: 33756 - RNA, 21 nt, Homo sapiens
aaucgccacccccuccugcca

SEQ ID NO: 33757 - RNA, 19 nt, Homo sapiens
cguccccacugggcccaca

SEQ ID NO: 33758 - RNA, 21 nt, Homo sapiens
cucccugauggccaugcugag

SEQ ID NO: 33759 - RNA, 22 nt, Homo sapiens
gagcagccccagcgccucaucu

SEQ ID NO: 33760 - RNA, 20 nt, Homo sapiens
gaggugggacuggccucucc

SEQ ID NO: 33761 - RNA, 18 nt, Homo sapiens
ccccaccagguggcagca

SEQ ID NO: 33762 - RNA, 22 nt, Homo sapiens
ccgcgaguucaaccgcaaccag

SEQ ID NO: 33763 - RNA, 16 nt, Homo sapiens
ugagauccauucuucc

SEQ ID NO: 33764 - RNA, 21 nt, Homo sapiens
uuuuggcuuucgagggccugu

SEQ ID NO: 33765 - RNA, 21 nt, Homo sapiens
ggccucaaaguucuucuuuac

SEQ ID NO: 33766 - RNA, 18 nt, Homo sapiens
guguguaugaaaagcuug

SEQ ID NO: 33767 - RNA, 16 nt, Homo sapiens
uuuuuaacauguaguu

SEQ ID NO: 33768 - RNA, 16 nt, Homo sapiens
gcuguucagggugaca

SEQ ID NO: 33769 - RNA, 19 nt, Homo sapiens
uucuucaguccuuaagcuu

SEQ ID NO: 33770 - RNA, 18 nt, Homo sapiens
accaaggcaggccuguua

SEQ ID NO: 33771 - RNA, 18 nt, Homo sapiens
caucagaggacacacuca

SEQ ID NO: 33772 - RNA, 17 nt, Homo sapiens
cuacugauguuuugaug

SEQ ID NO: 33773 - RNA, 19 nt, Homo sapiens
cacuuucacaaaaaacguu

SEQ ID NO: 33774 - RNA, 21 nt, Homo sapiens
uccacccugccucugacagca

SEQ ID NO: 33775 - RNA, 18 nt, Homo sapiens
agugagaguggcgcccca

SEQ ID NO: 33776 - RNA, 19 nt, Homo sapiens
cacuuucacaaaaaacguu

SEQ ID NO: 33777 - RNA, 22 nt, Homo sapiens
uaguuuugaaagccucaccucu

SEQ ID NO: 33778 - RNA, 21 nt, Homo sapiens
uccacccugccucugacagca

SEQ ID NO: 33779 - RNA, 22 nt, Homo sapiens
ccaagguucccucucuguuccu

SEQ ID NO: 33780 - RNA, 21 nt, Homo sapiens
ccugcugcuucuuauucccca

SEQ ID NO: 33781 - RNA, 18 nt, Homo sapiens
cuagaaugcucugaucca

SEQ ID NO: 33782 - RNA, 22 nt, Homo sapiens
gacccuggaacccuacacuuga

SEQ ID NO: 33783 - RNA, 19 nt, Homo sapiens
gcacagcagccauaccccu

SEQ ID NO: 33784 - RNA, 20 nt, Homo sapiens
gucaagaguauuugaucaga

SEQ ID NO: 33785 - RNA, 20 nt, Homo sapiens
ucaccaucauuaccaccauc

SEQ ID NO: 33786 - RNA, 24 nt, Homo sapiens
ucugaagacagcacagcagccaua

SEQ ID NO: 33787 - RNA, 24 nt, Homo sapiens
aauuguguuuguuuuaaggaauga

SEQ ID NO: 33788 - RNA, 16 nt, Homo sapiens
acuugacccuauuuga

SEQ ID NO: 33789 - RNA, 20 nt, Homo sapiens
agcuacagugaucuuagcuu

SEQ ID NO: 33790 - RNA, 18 nt, Homo sapiens
caaccucaagcucuuuua

SEQ ID NO: 33791 - RNA, 21 nt, Homo sapiens
caugaucuacaaacauggucu

SEQ ID NO: 33792 - RNA, 22 nt, Homo sapiens
cuucuaaucuuggccuccauca

SEQ ID NO: 33793 - RNA, 23 nt, Homo sapiens
ggaaacugaaacucuguggaaua

SEQ ID NO: 33794 - RNA, 20 nt, Homo sapiens
uguaauucagcuucucagau

SEQ ID NO: 33795 - RNA, 24 nt, Homo sapiens
ggccaaaauaugcuauauuuguau

SEQ ID NO: 33796 - RNA, 22 nt, Homo sapiens
uuuugguggcaugcuugcugag

SEQ ID NO: 33797 - RNA, 19 nt, Homo sapiens
aagggaaaaaguuguauca

SEQ ID NO: 33798 - RNA, 16 nt, Homo sapiens
auaucuuaagaaugug

SEQ ID NO: 33799 - RNA, 23 nt, Homo sapiens
caagagggcuuuauuacaccuca

SEQ ID NO: 33800 - RNA, 17 nt, Homo sapiens
ccagaaguggugcgcca

SEQ ID NO: 33801 - RNA, 22 nt, Homo sapiens
gacacauaucauucugugauua

SEQ ID NO: 33802 - RNA, 15 nt, Homo sapiens
uguccagaagaguca

SEQ ID NO: 33803 - RNA, 23 nt, Homo sapiens
aaccaaggcugcuguucauccca

SEQ ID NO: 33804 - RNA, 24 nt, Homo sapiens
cccaaggcaucuuaccaacagcug

SEQ ID NO: 33805 - RNA, 17 nt, Homo sapiens
cugagcccucccagggc

SEQ ID NO: 33806 - RNA, 18 nt, Homo sapiens
ggacacccugggcuacaa

SEQ ID NO: 33807 - RNA, 24 nt, Homo sapiens
ucuguauggcacaaacuuuccucc

SEQ ID NO: 33808 - RNA, 24 nt, Homo sapiens
agugcuuggacggaacccggcgcu

SEQ ID NO: 33809 - RNA, 21 nt, Homo sapiens
aaagagaccugagguucaucc

SEQ ID NO: 33810 - RNA, 20 nt, Homo sapiens
aaaugguugacaccuuuaca

SEQ ID NO: 33811 - RNA, 21 nt, Homo sapiens
cucauuugacacacuauuaga

SEQ ID NO: 33812 - RNA, 19 nt, Homo sapiens
ggaauuuucuagaaucuca

SEQ ID NO: 33813 - RNA, 19 nt, Homo sapiens
guccuccaagagaacccug

SEQ ID NO: 33814 - RNA, 22 nt, Homo sapiens
cccuugcuuccaaagcgaacca

SEQ ID NO: 33815 - RNA, 25 nt, Homo sapiens
aaaacggggcacccacucccaccuc

SEQ ID NO: 33816 - RNA, 17 nt, Homo sapiens
caaacauggaccuguug

SEQ ID NO: 33817 - RNA, 19 nt, Homo sapiens
ccaccugcccucuccccca

SEQ ID NO: 33818 - RNA, 19 nt, Homo sapiens
ccuacgugcggcccggugg

SEQ ID NO: 33819 - RNA, 22 nt, Homo sapiens
ccuggagaggcggacgaugggc

SEQ ID NO: 33820 - RNA, 21 nt, Homo sapiens
gccugggaugaugcuuggucu

SEQ ID NO: 33821 - RNA, 19 nt, Homo sapiens
ggcacccacucccaccucc

SEQ ID NO: 33822 - RNA, 19 nt, Homo sapiens
gguagaaucaguagagcca

SEQ ID NO: 33823 - RNA, 17 nt, Homo sapiens
uaaaaaaagcaaagaug

SEQ ID NO: 33824 - RNA, 18 nt, Homo sapiens
ucuaacuaauaccccccu

SEQ ID NO: 33825 - RNA, 18 nt, Homo sapiens
ucuguuaccuguuugcug

SEQ ID NO: 33826 - RNA, 18 nt, Homo sapiens
uuccugucccaucauuac

SEQ ID NO: 33827 - RNA, 19 nt, Homo sapiens
uugaggccaccaagcuccu

SEQ ID NO: 33828 - RNA, 21 nt, Homo sapiens
uugggaacagccccugugaca

SEQ ID NO: 33829 - RNA, 18 nt, Homo sapiens
auauaccaagaacauuca

SEQ ID NO: 33830 - RNA, 19 nt, Homo sapiens
caggugcaaaggcagcuua

SEQ ID NO: 33831 - RNA, 20 nt, Homo sapiens
ccauauucaauaucauacca

SEQ ID NO: 33832 - RNA, 24 nt, Homo sapiens
gcuguaauguuuuuaaaugcagug

SEQ ID NO: 33833 - RNA, 20 nt, Homo sapiens
gcuuagcaaaauacuuuuaa

SEQ ID NO: 33834 - RNA, 22 nt, Homo sapiens
uaagaacauaguacgccagugu

SEQ ID NO: 33835 - RNA, 17 nt, Homo sapiens
uagucaaacccagggua

SEQ ID NO: 33836 - RNA, 20 nt, Homo sapiens
uugaaaauugauuuaccuca

SEQ ID NO: 33837 - RNA, 24 nt, Homo sapiens
uuuuauagauuuaauaucauaaca

SEQ ID NO: 33838 - RNA, 22 nt, Homo sapiens
uuuuggugaaccugacuugugg

SEQ ID NO: 33839 - RNA, 21 nt, Homo sapiens
cacacucaaaguugucucuuu

SEQ ID NO: 33840 - RNA, 20 nt, Homo sapiens
cugcuucaucuuuuaucuca

SEQ ID NO: 33841 - RNA, 18 nt, Homo sapiens
acaaacacaucugcccaa

SEQ ID NO: 33842 - RNA, 17 nt, Homo sapiens
aguuccuuuucuguccu

SEQ ID NO: 33843 - RNA, 17 nt, Homo sapiens
aguuuucuauuucccca

SEQ ID NO: 33844 - RNA, 19 nt, Homo sapiens
auuacugcccuauguuguc

SEQ ID NO: 33845 - RNA, 17 nt, Homo sapiens
caaacacaucugcccaa

SEQ ID NO: 33846 - RNA, 22 nt, Homo sapiens
cucccucucucuucucuuucuc

SEQ ID NO: 33847 - RNA, 21 nt, Homo sapiens
cucucucucucucccucucuc

SEQ ID NO: 33848 - RNA, 22 nt, Homo sapiens
gguuguucauuuuuuuuuucaa

SEQ ID NO: 33849 - RNA, 18 nt, Homo sapiens
uaguguguaaguuuucua

SEQ ID NO: 33850 - RNA, 19 nt, Homo sapiens
ugaacccaacuuuucccca

SEQ ID NO: 33851 - RNA, 18 nt, Homo sapiens
aucccauaccagcaccgu

SEQ ID NO: 33852 - RNA, 18 nt, Homo sapiens
cccaggcaucccauacca

SEQ ID NO: 33853 - RNA, 20 nt, Homo sapiens
ccccggccgccccucgcagc

SEQ ID NO: 33854 - RNA, 17 nt, Homo sapiens
gcccgaggcgcagggga

SEQ ID NO: 33855 - RNA, 27 nt, Homo sapiens
gguugauuuuugugguguuuuguuuaa

SEQ ID NO: 33856 - RNA, 24 nt, Homo sapiens
uuuugugguguuuuguuuaauaga

SEQ ID NO: 33857 - RNA, 20 nt, Homo sapiens
gucuuccaacugaaaucuca

SEQ ID NO: 33858 - RNA, 23 nt, Homo sapiens
uaucuccaacuuccuaaaggcuu

SEQ ID NO: 33859 - RNA, 23 nt, Homo sapiens
aagcaucugggaucaccccacuc

SEQ ID NO: 33860 - RNA, 24 nt, Homo sapiens
acaccugucccccuuccccaacca

SEQ ID NO: 33861 - RNA, 19 nt, Homo sapiens
caccaccgcugccaacccu

SEQ ID NO: 33862 - RNA, 21 nt, Homo sapiens
ccuuccccaaccauggcccca

SEQ ID NO: 33863 - RNA, 18 nt, Homo sapiens
gacuguccuugggaguuu

SEQ ID NO: 33864 - RNA, 17 nt, Homo sapiens
ugcagaauccagccccu

SEQ ID NO: 33865 - RNA, 24 nt, Homo sapiens
acuugggccuucaugccauggccu

SEQ ID NO: 33866 - RNA, 20 nt, Homo sapiens
agaauuuccccccaguuccc

SEQ ID NO: 33867 - RNA, 20 nt, Homo sapiens
auguggcccacaguagguga

SEQ ID NO: 33868 - RNA, 21 nt, Homo sapiens
guccuccaugaggacauggga

SEQ ID NO: 33869 - RNA, 22 nt, Homo sapiens
ugugguaucucccccuaccaca

SEQ ID NO: 33870 - RNA, 19 nt, Homo sapiens
acuuggcacugcgcacaca

SEQ ID NO: 33871 - RNA, 24 nt, Homo sapiens
agaaggacuguaucuacaccuguu

SEQ ID NO: 33872 - RNA, 18 nt, Homo sapiens
ccaagacacuaugccaau

SEQ ID NO: 33873 - RNA, 23 nt, Homo sapiens
ccaggacgaccagugcauccuca

SEQ ID NO: 33874 - RNA, 21 nt, Homo sapiens
ccuacccuccccagcuuucca

SEQ ID NO: 33875 - RNA, 20 nt, Homo sapiens
ccuuccccuuccuucuuucc

SEQ ID NO: 33876 - RNA, 20 nt, Homo sapiens
gccauaguagggguucuggg

SEQ ID NO: 33877 - RNA, 22 nt, Homo sapiens
gccuggaccuuguucuuggcuc

SEQ ID NO: 33878 - RNA, 24 nt, Homo sapiens
guauguguggacauguguucacug

SEQ ID NO: 33879 - RNA, 18 nt, Homo sapiens
cacugccugccuugcucc

SEQ ID NO: 33880 - RNA, 19 nt, Homo sapiens
cagcugcaacagacauccu

SEQ ID NO: 33881 - RNA, 17 nt, Homo sapiens
ccaccccauaccugcug

SEQ ID NO: 33882 - RNA, 18 nt, Homo sapiens
ccaguauuuaucucugga

SEQ ID NO: 33883 - RNA, 17 nt, Homo sapiens
cugagauacccauugcu

SEQ ID NO: 33884 - RNA, 22 nt, Homo sapiens
ggaaagacugagaugguugcca

SEQ ID NO: 33885 - RNA, 21 nt, Homo sapiens
guccugaaaccgaauggcaga

SEQ ID NO: 33886 - RNA, 23 nt, Homo sapiens
ucacugggcccacagcugggcaa

SEQ ID NO: 33887 - RNA, 23 nt, Homo sapiens
uccaaguuguuuacucuguuccu

SEQ ID NO: 33888 - RNA, 27 nt, Homo sapiens
auggacagcuuuccuaacaagagauua

SEQ ID NO: 33889 - RNA, 19 nt, Homo sapiens
ccauaauuaacaucacuua

SEQ ID NO: 33890 - RNA, 25 nt, Homo sapiens
aaauaugggcuccugauggaccuca

SEQ ID NO: 33891 - RNA, 17 nt, Homo sapiens
acuucuggaaacuucca

SEQ ID NO: 33892 - RNA, 19 nt, Homo sapiens
auuccaguaaugucauuga

SEQ ID NO: 33893 - RNA, 23 nt, Homo sapiens
uggauccaacccagaugagacug

SEQ ID NO: 33894 - RNA, 20 nt, Homo sapiens
uuuccaugccgaacaacuca

SEQ ID NO: 33895 - RNA, 26 nt, Homo sapiens
aacccaggggucugagcauggagcua

SEQ ID NO: 33896 - RNA, 19 nt, Homo sapiens
aagaccuucaagcuuccaa

SEQ ID NO: 33897 - RNA, 22 nt, Homo sapiens
aggcugucagacugaccuguaa

SEQ ID NO: 33898 - RNA, 20 nt, Homo sapiens
agugaggaagggcauguugu

SEQ ID NO: 33899 - RNA, 23 nt, Homo sapiens
caucucauaaaugucacucuuua

SEQ ID NO: 33900 - RNA, 22 nt, Homo sapiens
ccaccgccgcgaugcucgcccg

SEQ ID NO: 33901 - RNA, 24 nt, Homo sapiens
uuccauuggacuggaggcuugugg

SEQ ID NO: 33902 - RNA, 19 nt, Homo sapiens
aucucucagaccaaucuca

SEQ ID NO: 33903 - RNA, 19 nt, Homo sapiens
cacuuuccuuucccacuca

SEQ ID NO: 33904 - RNA, 19 nt, Homo sapiens
cagaaccagcaagugcucc

SEQ ID NO: 33905 - RNA, 19 nt, Homo sapiens
caugaauguuugaaaggaa

SEQ ID NO: 33906 - RNA, 18 nt, Homo sapiens
caugguaaaauguucucu

SEQ ID NO: 33907 - RNA, 21 nt, Homo sapiens
ccagggcucuggaucucauca

SEQ ID NO: 33908 - RNA, 22 nt, Homo sapiens
uuguuucuuuuucuacauagca

SEQ ID NO: 33909 - RNA, 23 nt, Homo sapiens
uuuuggugacuuaagcuuaugaa

SEQ ID NO: 33910 - RNA, 20 nt, Homo sapiens
uccaccugaaacuuggugau

SEQ ID NO: 33911 - RNA, 19 nt, Homo sapiens
acuaaaauucuacuggaga

SEQ ID NO: 33912 - RNA, 19 nt, Homo sapiens
cugccacagccugccucca

SEQ ID NO: 33913 - RNA, 17 nt, Homo sapiens
cuugacucggugucaga

SEQ ID NO: 33914 - RNA, 22 nt, Homo sapiens
gauguuugaaaacaguuccucu

SEQ ID NO: 33915 - RNA, 18 nt, Homo sapiens
caaguucuuggccugccu

SEQ ID NO: 33916 - RNA, 16 nt, Homo sapiens
cccgcuuccugccauc

SEQ ID NO: 33917 - RNA, 16 nt, Homo sapiens
gcgccugggauucuga

SEQ ID NO: 33918 - RNA, 18 nt, Homo sapiens
uuagcacagaguuccuca

SEQ ID NO: 33919 - RNA, 24 nt, Homo sapiens
agcuggggcagggggccgugccca

SEQ ID NO: 33920 - RNA, 24 nt, Homo sapiens
gcccaccccacccacuguggucug

SEQ ID NO: 33921 - RNA, 23 nt, Homo sapiens
cccuccccggaggcgccugugga

SEQ ID NO: 33922 - RNA, 22 nt, Homo sapiens
agccaucguggcccacuugaca

SEQ ID NO: 33923 - RNA, 19 nt, Homo sapiens
gccgcggcccgccuggccu

SEQ ID NO: 33924 - RNA, 18 nt, Homo sapiens
ucuuccucucuucuccuc

SEQ ID NO: 33925 - RNA, 17 nt, Homo sapiens
uuuauacacccggcacc

SEQ ID NO: 33926 - RNA, 20 nt, Homo sapiens
aaacacauguuuuuuucuga

SEQ ID NO: 33927 - RNA, 19 nt, Homo sapiens
aaagaagaaacugcuccug

SEQ ID NO: 33928 - RNA, 21 nt, Homo sapiens
accagaaggaacuucauccug

SEQ ID NO: 33929 - RNA, 22 nt, Homo sapiens
agcuccuccucauguuucaaca

SEQ ID NO: 33930 - RNA, 22 nt, Homo sapiens
cacccaccaucccuccagccca

SEQ ID NO: 33931 - RNA, 19 nt, Homo sapiens
cccucacaaccucccuuua

SEQ ID NO: 33932 - RNA, 18 nt, Homo sapiens
cuugaagaaacccagggc

SEQ ID NO: 33933 - RNA, 23 nt, Homo sapiens
gaugguguccacauuuuacccca

SEQ ID NO: 33934 - RNA, 19 nt, Homo sapiens
gcucagccgcccugccucc

SEQ ID NO: 33935 - RNA, 18 nt, Homo sapiens
ggccugcaaaucccauuu

SEQ ID NO: 33936 - RNA, 22 nt, Homo sapiens
gggugaugauaaacuguggcca

SEQ ID NO: 33937 - RNA, 18 nt, Homo sapiens
ucccaggcagagcugcag

SEQ ID NO: 33938 - RNA, 24 nt, Homo sapiens
ugagaucucgaguuuggguuuguu

SEQ ID NO: 33939 - RNA, 19 nt, Homo sapiens
uuugaguccaggccugccu

SEQ ID NO: 33940 - RNA, 22 nt, Homo sapiens
uuugcuugaacagcccucuucu

SEQ ID NO: 33941 - RNA, 22 nt, Homo sapiens
acuauguaauggcuauauuuca

SEQ ID NO: 33942 - RNA, 17 nt, Homo sapiens
agcauuaaucccaaagg

SEQ ID NO: 33943 - RNA, 17 nt, Homo sapiens
gaagaccacagcauuaa

SEQ ID NO: 33944 - RNA, 20 nt, Homo sapiens
gucucuugaguuucaacaga

SEQ ID NO: 33945 - RNA, 23 nt, Homo sapiens
uaggugggaaaaccauggugcug

SEQ ID NO: 33946 - RNA, 19 nt, Homo sapiens
ccugcuuccacuccccuca

SEQ ID NO: 33947 - RNA, 17 nt, Homo sapiens
ggagagaaaggcuccuu

SEQ ID NO: 33948 - RNA, 16 nt, Homo sapiens
uggacgacggcucugg

SEQ ID NO: 33949 - RNA, 19 nt, Homo sapiens
augaaguuccugugaacau

SEQ ID NO: 33950 - RNA, 21 nt, Homo sapiens
ugaugccauugauauaucuaa

SEQ ID NO: 33951 - RNA, 18 nt, Homo sapiens
agauggguccuagccuga

SEQ ID NO: 33952 - RNA, 20 nt, Homo sapiens
aguuucacucuguugcccag

SEQ ID NO: 33953 - RNA, 19 nt, Homo sapiens
cugcaaccuccgccuccca

SEQ ID NO: 33954 - RNA, 20 nt, Homo sapiens
cuucagcugcccuuggucuu

SEQ ID NO: 33955 - RNA, 19 nt, Homo sapiens
gaguccaagauaccacuga

SEQ ID NO: 33956 - RNA, 19 nt, Homo sapiens
uaggaaauaguccacuugc

SEQ ID NO: 33957 - RNA, 18 nt, Homo sapiens
uccgccucccagguucaa

SEQ ID NO: 33958 - RNA, 21 nt, Homo sapiens
ugcccugggucaauucuccuu

SEQ ID NO: 33959 - RNA, 21 nt, Homo sapiens
uggccuuuaccuauuucuuca

SEQ ID NO: 33960 - RNA, 17 nt, Homo sapiens
auauaaagguuugguga

SEQ ID NO: 33961 - RNA, 19 nt, Homo sapiens
cacaacuaugaacauuucu

SEQ ID NO: 33962 - RNA, 22 nt, Homo sapiens
ggugaaugagcuggccagccca

SEQ ID NO: 33963 - RNA, 18 nt, Homo sapiens
aaaacugcaagaauauca

SEQ ID NO: 33964 - RNA, 18 nt, Homo sapiens
agggaaaacuaauaaagc

SEQ ID NO: 33965 - RNA, 18 nt, Homo sapiens
aguacuacagccuuccag

SEQ ID NO: 33966 - RNA, 18 nt, Homo sapiens
aucuugcaaauaaucaga

SEQ ID NO: 33967 - RNA, 17 nt, Homo sapiens
gcaaaagcuuugugaug

SEQ ID NO: 33968 - RNA, 20 nt, Homo sapiens
gcaccaaucuacaacuaugu

SEQ ID NO: 33969 - RNA, 22 nt, Homo sapiens
gcaucccaaggccacuaacaca

SEQ ID NO: 33970 - RNA, 20 nt, Homo sapiens
ggaaaacuaauaaagccaca

SEQ ID NO: 33971 - RNA, 17 nt, Homo sapiens
ggaucccacggacuguu

SEQ ID NO: 33972 - RNA, 17 nt, Homo sapiens
uauuguuuuucccauug

SEQ ID NO: 33973 - RNA, 19 nt, Homo sapiens
ucuggggauuguuuggccu

SEQ ID NO: 33974 - RNA, 19 nt, Homo sapiens
caaauaaaaguucauuucc

SEQ ID NO: 33975 - RNA, 19 nt, Homo sapiens
cucuggaagcagcguguga

SEQ ID NO: 33976 - RNA, 18 nt, Homo sapiens
gucuaaugcagucaggag

SEQ ID NO: 33977 - RNA, 23 nt, Homo sapiens
accaacucuguuuccucauugcc

SEQ ID NO: 33978 - RNA, 19 nt, Homo sapiens
cauuuucuuuucaaaauua

SEQ ID NO: 33979 - RNA, 22 nt, Homo sapiens
ccuaggcaauccauugacauuu

SEQ ID NO: 33980 - RNA, 21 nt, Homo sapiens
cuccccacucaggcaucugau

SEQ ID NO: 33981 - RNA, 20 nt, Homo sapiens
uagaauuuucuacccuuggc

SEQ ID NO: 33982 - RNA, 22 nt, Homo sapiens
ucacaccaacucuguuuccuca

SEQ ID NO: 33983 - RNA, 17 nt, Homo sapiens
caguaccagcauaugcu

SEQ ID NO: 33984 - RNA, 19 nt, Homo sapiens
guaccagcauaugcucuga

SEQ ID NO: 33985 - RNA, 19 nt, Homo sapiens
aagaacuugucaaucgccu

SEQ ID NO: 33986 - RNA, 20 nt, Homo sapiens
aagggaaggaagagguccca

SEQ ID NO: 33987 - RNA, 20 nt, Homo sapiens
aaaaucucaguugucuuuga

SEQ ID NO: 33988 - RNA, 22 nt, Homo sapiens
aauugaauauuguuuugucuca

SEQ ID NO: 33989 - RNA, 24 nt, Homo sapiens
cugagguuaaugugaacacugcuu

SEQ ID NO: 33990 - RNA, 18 nt, Homo sapiens
uuuuugugauuuacuuuu

SEQ ID NO: 33991 - RNA, 17 nt, Homo sapiens
gccugucacccauccua

SEQ ID NO: 33992 - RNA, 20 nt, Homo sapiens
aaccucguuauaucuccugc

SEQ ID NO: 33993 - RNA, 23 nt, Homo sapiens
ccugcuucccuuccaccaccuca

SEQ ID NO: 33994 - RNA, 23 nt, Homo sapiens
uagacuugaagaacaugaaccug

SEQ ID NO: 33995 - RNA, 23 nt, Homo sapiens
ugauucaguggucagaucaucca

SEQ ID NO: 33996 - RNA, 18 nt, Homo sapiens
aguagugaccgugcuuua

SEQ ID NO: 33997 - RNA, 18 nt, Homo sapiens
gugagcaguguuuggcua

SEQ ID NO: 33998 - RNA, 21 nt, Homo sapiens
uuuaaaaaacggugccaggua

SEQ ID NO: 33999 - RNA, 18 nt, Homo sapiens
ccaaaagccacguuguuu

SEQ ID NO: 34000 - RNA, 18 nt, Homo sapiens
cuuuuuacaaauaaugcu

SEQ ID NO: 34001 - RNA, 21 nt, Homo sapiens
uugccuugucuuggauccuca

SEQ ID NO: 34002 - RNA, 18 nt, Homo sapiens
accgcagaguuguauaau

SEQ ID NO: 34003 - RNA, 21 nt, Homo sapiens
ccaggcauacacaggaagcca

SEQ ID NO: 34004 - RNA, 16 nt, Homo sapiens
uccugcaguuucugaa

SEQ ID NO: 34005 - RNA, 16 nt, Homo sapiens
aaacccagccccuugc

SEQ ID NO: 34006 - RNA, 18 nt, Homo sapiens
ccagccccuugcccaccu

SEQ ID NO: 34007 - RNA, 17 nt, Homo sapiens
cuuugggaguuugugaa

SEQ ID NO: 34008 - RNA, 21 nt, Homo sapiens
gccccuugcccaccugccucu

SEQ ID NO: 34009 - RNA, 18 nt, Homo sapiens
ccugauuccugaaucauu

SEQ ID NO: 34010 - RNA, 20 nt, Homo sapiens
cgagcuguagccacccugcu

SEQ ID NO: 34011 - RNA, 19 nt, Homo sapiens
ucuggacuguuuuaauuuu

SEQ ID NO: 34012 - RNA, 18 nt, Homo sapiens
uggaagcugaaacaccag

SEQ ID NO: 34013 - RNA, 22 nt, Homo sapiens
ccagcaccuugugcccuugcca

SEQ ID NO: 34014 - RNA, 20 nt, Homo sapiens
agacucugauucuacaguga

SEQ ID NO: 34015 - RNA, 19 nt, Homo sapiens
cuguauugaaucagaaugc

SEQ ID NO: 34016 - RNA, 22 nt, Homo sapiens
ggaacaguauuacaguguccua

SEQ ID NO: 34017 - RNA, 21 nt, Homo sapiens
aagcaugcaaaaacacauuga

SEQ ID NO: 34018 - RNA, 22 nt, Homo sapiens
accugagcuggggccugugcuu

SEQ ID NO: 34019 - RNA, 19 nt, Homo sapiens
agucagucacaaucucccc

SEQ ID NO: 34020 - RNA, 19 nt, Homo sapiens
aucacaacgccccuaucca

SEQ ID NO: 34021 - RNA, 19 nt, Homo sapiens
cagucuggcaagcauugua

SEQ ID NO: 34022 - RNA, 19 nt, Homo sapiens
ccucaaucaccucauacca

SEQ ID NO: 34023 - RNA, 16 nt, Homo sapiens
cuugucucagaucucu

SEQ ID NO: 34024 - RNA, 19 nt, Homo sapiens
uagcuucuggacuaacauc

SEQ ID NO: 34025 - RNA, 24 nt, Homo sapiens
ucuguagaagccucuaucuccucu

SEQ ID NO: 34026 - RNA, 22 nt, Homo sapiens
uggacacaguccaacgugagcu

SEQ ID NO: 34027 - RNA, 21 nt, Homo sapiens
cuaacuuuuuuuuuugugauu

SEQ ID NO: 34028 - RNA, 19 nt, Homo sapiens
cuaagaaauuaucuuuuga

SEQ ID NO: 34029 - RNA, 24 nt, Homo sapiens
gcuuggaaugacuuguuuugguuu

SEQ ID NO: 34030 - RNA, 19 nt, Homo sapiens
uauugucugaaagaaucuu

SEQ ID NO: 34031 - RNA, 21 nt, Homo sapiens
ucaugaguugcuguggcauuu

SEQ ID NO: 34032 - RNA, 23 nt, Homo sapiens
ugcaaauuugauaauucuccuga

SEQ ID NO: 34033 - RNA, 20 nt, Homo sapiens
ugcucuucuaaaauguuuca

SEQ ID NO: 34034 - RNA, 19 nt, Homo sapiens
auuauuuggccucacauca

SEQ ID NO: 34035 - RNA, 22 nt, Homo sapiens
aggagagagaggcagaagaacc

SEQ ID NO: 34036 - RNA, 25 nt, Homo sapiens
gaggcagaagaacccuggccugaga

SEQ ID NO: 34037 - RNA, 19 nt, Homo sapiens
gccacccugaggccucugg

SEQ ID NO: 34038 - RNA, 15 nt, Homo sapiens
gucugaucugugaau

SEQ ID NO: 34039 - RNA, 20 nt, Homo sapiens
uagagcuuucuuucacaaaa

SEQ ID NO: 34040 - RNA, 18 nt, Homo sapiens
ucaaaaaacaaaaaccca

SEQ ID NO: 34041 - RNA, 18 nt, Homo sapiens
uccaaaacaaauuccucc

SEQ ID NO: 34042 - RNA, 17 nt, Homo sapiens
cccgcccagccagcagc

SEQ ID NO: 34043 - RNA, 21 nt, Homo sapiens
ugaaugggguggaugagacug

SEQ ID NO: 34044 - RNA, 21 nt, Homo sapiens
uucaaaaaaaaaguuccggau

SEQ ID NO: 34045 - RNA, 17 nt, Homo sapiens
aaaaacaaacaaacaaa

SEQ ID NO: 34046 - RNA, 20 nt, Homo sapiens
aggaaacuccaaacagauca

SEQ ID NO: 34047 - RNA, 19 nt, Homo sapiens
gauacagggugaaaaugaa

SEQ ID NO: 34048 - RNA, 20 nt, Homo sapiens
gcuuuagcuggguucaguca

SEQ ID NO: 34049 - RNA, 20 nt, Homo sapiens
guugaagcgucagucuuuga

SEQ ID NO: 34050 - RNA, 19 nt, Homo sapiens
uaaaacaugccauacauug

SEQ ID NO: 34051 - RNA, 18 nt, Homo sapiens
uauugaauauguguacac

SEQ ID NO: 34052 - RNA, 18 nt, Homo sapiens
uuuucuaaucacagcagu

SEQ ID NO: 34053 - RNA, 20 nt, Homo sapiens
acuugaugcacaacaucaca

SEQ ID NO: 34054 - RNA, 18 nt, Homo sapiens
ccugcaaccuccaccucc

SEQ ID NO: 34055 - RNA, 19 nt, Homo sapiens
gacugugccuguuauuguu

SEQ ID NO: 34056 - RNA, 18 nt, Homo sapiens
gccuuaacaguggaguug

SEQ ID NO: 34057 - RNA, 21 nt, Homo sapiens
guccucaacaagcacgagcug

SEQ ID NO: 34058 - RNA, 18 nt, Homo sapiens
uccaccucccggguucaa

SEQ ID NO: 34059 - RNA, 18 nt, Homo sapiens
ugggugggucaccugagg

SEQ ID NO: 34060 - RNA, 21 nt, Homo sapiens
uucucuacuaaaaaaauacaa

SEQ ID NO: 34061 - RNA, 17 nt, Homo sapiens
aacuacaaucugagcaa

SEQ ID NO: 34062 - RNA, 18 nt, Homo sapiens
cagaauuucacaacaaua

SEQ ID NO: 34063 - RNA, 19 nt, Homo sapiens
aagcaauucucccaccuca

SEQ ID NO: 34064 - RNA, 21 nt, Homo sapiens
cacguggccauuuuccuucaa

SEQ ID NO: 34065 - RNA, 22 nt, Homo sapiens
gccuggguugugacuucuacug

SEQ ID NO: 34066 - RNA, 18 nt, Homo sapiens
guguuauuuaagagauca

SEQ ID NO: 34067 - RNA, 22 nt, Homo sapiens
uaggugcccugcauuccaccca

SEQ ID NO: 34068 - RNA, 22 nt, Homo sapiens
acaaauuuggugccacauuauc

SEQ ID NO: 34069 - RNA, 20 nt, Homo sapiens
acauauauuaagacauauca

SEQ ID NO: 34070 - RNA, 18 nt, Homo sapiens
caaacugggggcuuguua

SEQ ID NO: 34071 - RNA, 18 nt, Homo sapiens
caccuguuucagcaguua

SEQ ID NO: 34072 - RNA, 19 nt, Homo sapiens
cacuuucauuuuucaucug

SEQ ID NO: 34073 - RNA, 19 nt, Homo sapiens
ccaaucagaggcacuuuca

SEQ ID NO: 34074 - RNA, 25 nt, Homo sapiens
cucugguacagacaaaugccaugaa

SEQ ID NO: 34075 - RNA, 24 nt, Homo sapiens
gcuuggauugcugaccucugacuu

SEQ ID NO: 34076 - RNA, 22 nt, Homo sapiens
guuuguguuauucaccacugua

SEQ ID NO: 34077 - RNA, 18 nt, Homo sapiens
uccugaccucaugaucca

SEQ ID NO: 34078 - RNA, 25 nt, Homo sapiens
uucaaaaaccugacauuaauagcua

SEQ ID NO: 34079 - RNA, 17 nt, Homo sapiens
acacacacuauauacau

SEQ ID NO: 34080 - RNA, 22 nt, Homo sapiens
accuugugaucccccugccucg

SEQ ID NO: 34081 - RNA, 19 nt, Homo sapiens
auauauuaacauggcuuca

SEQ ID NO: 34082 - RNA, 20 nt, Homo sapiens
ccucugccucccagguucag

SEQ ID NO: 34083 - RNA, 18 nt, Homo sapiens
ccugcaaccuccaccucc

SEQ ID NO: 34084 - RNA, 19 nt, Homo sapiens
cugcaaccuccaccuccca

SEQ ID NO: 34085 - RNA, 22 nt, Homo sapiens
cugguuauauuccaccauaaca

SEQ ID NO: 34086 - RNA, 24 nt, Homo sapiens
gacuuacuagguuugggcauuuca

SEQ ID NO: 34087 - RNA, 17 nt, Homo sapiens
gcgauuccccugccuca

SEQ ID NO: 34088 - RNA, 18 nt, Homo sapiens
uccaccucccagguucaa

SEQ ID NO: 34089 - RNA, 19 nt, Homo sapiens
uucuguauguagacguaga

SEQ ID NO: 34090 - RNA, 22 nt, Homo sapiens
aaugugggaagacuuuuagaca

SEQ ID NO: 34091 - RNA, 21 nt, Homo sapiens
aucuuggcucacugcaaccuc

SEQ ID NO: 34092 - RNA, 22 nt, Homo sapiens
auucacaccuuauucaacauca

SEQ ID NO: 34093 - RNA, 20 nt, Homo sapiens
cacucacuuuccacagaugc

SEQ ID NO: 34094 - RNA, 19 nt, Homo sapiens
auccuucauuuccaaguca

SEQ ID NO: 34095 - RNA, 18 nt, Homo sapiens
acaccagaucacugugca

SEQ ID NO: 34096 - RNA, 21 nt, Homo sapiens
accaaaagaucugugaucaga

SEQ ID NO: 34097 - RNA, 19 nt, Homo sapiens
caauguagacaaugugaua

SEQ ID NO: 34098 - RNA, 23 nt, Homo sapiens
ccuugcgcagacauugguuuuga

SEQ ID NO: 34099 - RNA, 24 nt, Homo sapiens
cuucucauugcuguaucaucccaa

SEQ ID NO: 34100 - RNA, 18 nt, Homo sapiens
ucagaccccuccagacau

SEQ ID NO: 34101 - RNA, 19 nt, Homo sapiens
agauccuuuuacaucauca

SEQ ID NO: 34102 - RNA, 21 nt, Homo sapiens
agugaguuuccucauuucauc

SEQ ID NO: 34103 - RNA, 18 nt, Homo sapiens
caagcccuccuuuccccu

SEQ ID NO: 34104 - RNA, 20 nt, Homo sapiens
cagaucccauccugcuccuc

SEQ ID NO: 34105 - RNA, 20 nt, Homo sapiens
cagaucccauccugcuccuc

SEQ ID NO: 34106 - RNA, 20 nt, Homo sapiens
cagaucccauccugcuccuc

SEQ ID NO: 34107 - RNA, 20 nt, Homo sapiens
cagaucccauccugcuccuc

SEQ ID NO: 34108 - RNA, 20 nt, Homo sapiens
cagaucccauccugcuccuc

SEQ ID NO: 34109 - RNA, 20 nt, Homo sapiens
cagaucccauccugcuccuc

SEQ ID NO: 34110 - RNA, 23 nt, Homo sapiens
ccuccuuuccccugggggcccuc

SEQ ID NO: 34111 - RNA, 19 nt, Homo sapiens
cuacaaauuuaggauuguu

SEQ ID NO: 34112 - RNA, 20 nt, Homo sapiens
cugucuucuguuguguccca

SEQ ID NO: 34113 - RNA, 17 nt, Homo sapiens
gggaggggugacagcca

SEQ ID NO: 34114 - RNA, 18 nt, Homo sapiens
uaaguuuuuagugagugu

SEQ ID NO: 34115 - RNA, 20 nt, Homo sapiens
uagauccuuuuacaucauca

SEQ ID NO: 34116 - RNA, 19 nt, Homo sapiens
aauaaggaacaccuuauua

SEQ ID NO: 34117 - RNA, 20 nt, Homo sapiens
aggaaacuugguuuuuuggc

SEQ ID NO: 34118 - RNA, 25 nt, Homo sapiens
cauggauuugcucacugguuacuca

SEQ ID NO: 34119 - RNA, 21 nt, Homo sapiens
ccagugggaaaaacauucuuc

SEQ ID NO: 34120 - RNA, 19 nt, Homo sapiens
ccauucuuaacucaugcca

SEQ ID NO: 34121 - RNA, 23 nt, Homo sapiens
ggagagaaggcuggaggcugaca

SEQ ID NO: 34122 - RNA, 21 nt, Homo sapiens
ggucacugauaccagauccca

SEQ ID NO: 34123 - RNA, 22 nt, Homo sapiens
ucaccauuucacacccaccucc

SEQ ID NO: 34124 - RNA, 23 nt, Homo sapiens
ucacuuucuguuagcucccucca

SEQ ID NO: 34125 - RNA, 18 nt, Homo sapiens
uggauggaucucuugagg

SEQ ID NO: 34126 - RNA, 21 nt, Homo sapiens
uuccuugacugcucuucacca

SEQ ID NO: 34127 - RNA, 21 nt, Homo sapiens
uuggaaugaaugcugguacuu

SEQ ID NO: 34128 - RNA, 20 nt, Homo sapiens
uugguuccuagaguagagua

SEQ ID NO: 34129 - RNA, 20 nt, Homo sapiens
ccuccucgcguucuucccca

SEQ ID NO: 34130 - RNA, 21 nt, Homo sapiens
cgcguacgagugucuacgggc

SEQ ID NO: 34131 - RNA, 20 nt, Homo sapiens
ggaagaggggguggccgcca

SEQ ID NO: 34132 - RNA, 17 nt, Homo sapiens
ucguuuccccucgcaaa

SEQ ID NO: 34133 - RNA, 15 nt, Homo sapiens
agagagggaaagacc

SEQ ID NO: 34134 - RNA, 20 nt, Homo sapiens
aucagaacuuggauuuuauc

SEQ ID NO: 34135 - RNA, 19 nt, Homo sapiens
cauuccccuuugcagcuau

SEQ ID NO: 34136 - RNA, 20 nt, Homo sapiens
ccucugcccuccagguucaa

SEQ ID NO: 34137 - RNA, 18 nt, Homo sapiens
ggagcuuuggaaacuuca

SEQ ID NO: 34138 - RNA, 21 nt, Homo sapiens
ccuguggcugccugcacccca

SEQ ID NO: 34139 - RNA, 20 nt, Homo sapiens
gcacccauaccuaggacccc

SEQ ID NO: 34140 - RNA, 20 nt, Homo sapiens
ccuggccagccuuccugccu

SEQ ID NO: 34141 - RNA, 22 nt, Homo sapiens
ucaccccaccacacgcagacuc

SEQ ID NO: 34142 - RNA, 20 nt, Homo sapiens
ugcaggggcugcacauccca

SEQ ID NO: 34143 - RNA, 22 nt, Homo sapiens
aaggugucaauggggaguguca

SEQ ID NO: 34144 - RNA, 20 nt, Homo sapiens
aauccugcugucagagcuca

SEQ ID NO: 34145 - RNA, 19 nt, Homo sapiens
augucuaauaaaugauguc

SEQ ID NO: 34146 - RNA, 22 nt, Homo sapiens
caccaccaccacugcccaucuu

SEQ ID NO: 34147 - RNA, 23 nt, Homo sapiens
caguuccccccacccucacccca

SEQ ID NO: 34148 - RNA, 22 nt, Homo sapiens
ccccaccccccacccugccagc

SEQ ID NO: 34149 - RNA, 16 nt, Homo sapiens
ccuuuugaagagcuca

SEQ ID NO: 34150 - RNA, 21 nt, Homo sapiens
gcaguuuuaagggugaugugu

SEQ ID NO: 34151 - RNA, 22 nt, Homo sapiens
gggcuacaugugcaucaacaua

SEQ ID NO: 34152 - RNA, 16 nt, Homo sapiens
gugaccaccuuuugaa

SEQ ID NO: 34153 - RNA, 20 nt, Homo sapiens
uagaugcuuggcaugagguu

SEQ ID NO: 34154 - RNA, 24 nt, Homo sapiens
uaugucuaauaaaugauguccucu

SEQ ID NO: 34155 - RNA, 22 nt, Homo sapiens
uccacagacacacuaggaaagc

SEQ ID NO: 34156 - RNA, 20 nt, Homo sapiens
uuucuucauggcugccgcac

SEQ ID NO: 34157 - RNA, 16 nt, Homo sapiens
aaacaaccccccaagc

SEQ ID NO: 34158 - RNA, 22 nt, Homo sapiens
acaaaacaggcgaaauaccuca

SEQ ID NO: 34159 - RNA, 21 nt, Homo sapiens
acccacacaccauucagaaca

SEQ ID NO: 34160 - RNA, 18 nt, Homo sapiens
auguccaguagcauuucu

SEQ ID NO: 34161 - RNA, 19 nt, Homo sapiens
caugaagcaaaaucucuaa

SEQ ID NO: 34162 - RNA, 19 nt, Homo sapiens
cccacccacacaccauuca

SEQ ID NO: 34163 - RNA, 18 nt, Homo sapiens
ccuuuaaaaaacaucuga

SEQ ID NO: 34164 - RNA, 19 nt, Homo sapiens
gaaugaucacuauguuaaa

SEQ ID NO: 34165 - RNA, 21 nt, Homo sapiens
guugaaaauucccuuuggucu

SEQ ID NO: 34166 - RNA, 19 nt, Homo sapiens
uagaucagagcuacaaguu

SEQ ID NO: 34167 - RNA, 22 nt, Homo sapiens
uccucccggcuuccgccgccgc

SEQ ID NO: 34168 - RNA, 18 nt, Homo sapiens
ccugcaaccuccaccucc

SEQ ID NO: 34169 - RNA, 21 nt, Homo sapiens
cucaccguggaaguuugugag

SEQ ID NO: 34170 - RNA, 18 nt, Homo sapiens
gaccuagaugagagucca

SEQ ID NO: 34171 - RNA, 21 nt, Homo sapiens
uuaggaaaugucuagaccucc

SEQ ID NO: 34172 - RNA, 20 nt, Homo sapiens
uuugauguaauauggacauc

SEQ ID NO: 34173 - RNA, 19 nt, Homo sapiens
ccacccucucccagaggac

SEQ ID NO: 34174 - RNA, 20 nt, Homo sapiens
ccccaggccacccucuccca

SEQ ID NO: 34175 - RNA, 18 nt, Homo sapiens
gccuccugucccucuguc

SEQ ID NO: 34176 - RNA, 19 nt, Homo sapiens
uggaggcagaagggaccca

SEQ ID NO: 34177 - RNA, 22 nt, Homo sapiens
gcucagugacaagggcuuugaa

SEQ ID NO: 34178 - RNA, 20 nt, Homo sapiens
ugcuagguucacacccuccu

SEQ ID NO: 34179 - RNA, 24 nt, Homo sapiens
uggcacugcuagguucacacccuc

SEQ ID NO: 34180 - RNA, 16 nt, Homo sapiens
uuaaccaugggcagga

SEQ ID NO: 34181 - RNA, 18 nt, Homo sapiens
uugcuugcugccuggcuc

SEQ ID NO: 34182 - RNA, 21 nt, Homo sapiens
acaaugauuuguacugucuaa

SEQ ID NO: 34183 - RNA, 18 nt, Homo sapiens
acauugggaacauauuuc

SEQ ID NO: 34184 - RNA, 18 nt, Homo sapiens
auacccaaauacacagca

SEQ ID NO: 34185 - RNA, 19 nt, Homo sapiens
ccaguagagaaaugcacuu

SEQ ID NO: 34186 - RNA, 18 nt, Homo sapiens
cuugaagccccuuggcuu

SEQ ID NO: 34187 - RNA, 20 nt, Homo sapiens
gaguaaaagucuaccccucu

SEQ ID NO: 34188 - RNA, 20 nt, Homo sapiens
gccuucccacaagggcccgg

SEQ ID NO: 34189 - RNA, 20 nt, Homo sapiens
uggagagguagggccagagg

SEQ ID NO: 34190 - RNA, 20 nt, Homo sapiens
uuauuaccugccuuagcuuu

SEQ ID NO: 34191 - RNA, 21 nt, Homo sapiens
ccuauggaaaaccuguggaua

SEQ ID NO: 34192 - RNA, 19 nt, Homo sapiens
aucuuagcgccuccugcca

SEQ ID NO: 34193 - RNA, 17 nt, Homo sapiens
aguuuguggcauacaac

SEQ ID NO: 34194 - RNA, 16 nt, Homo sapiens
cagcaucugccucuau

SEQ ID NO: 34195 - RNA, 15 nt, Homo sapiens
ugguguuguauacuu

SEQ ID NO: 34196 - RNA, 20 nt, Homo sapiens
caacuccauccacggauccc

SEQ ID NO: 34197 - RNA, 19 nt, Homo sapiens
caggguguguuucccccac

SEQ ID NO: 34198 - RNA, 19 nt, Homo sapiens
ccucaacccugaggaguca

SEQ ID NO: 34199 - RNA, 21 nt, Homo sapiens
gcccccacccucucucccuca

SEQ ID NO: 34200 - RNA, 18 nt, Homo sapiens
guggguugcagugucagg

SEQ ID NO: 34201 - RNA, 19 nt, Homo sapiens
ugggaccaguguguagcug

SEQ ID NO: 34202 - RNA, 20 nt, Homo sapiens
acaaaacagaacaagucuca

SEQ ID NO: 34203 - RNA, 24 nt, Homo sapiens
cacuugguuuuaauaaauuacuca

SEQ ID NO: 34204 - RNA, 17 nt, Homo sapiens
ccuggcgguggggccug

SEQ ID NO: 34205 - RNA, 20 nt, Homo sapiens
cuguuauauacucagugcaa

SEQ ID NO: 34206 - RNA, 17 nt, Homo sapiens
gucaucuaaaagcuuuu

SEQ ID NO: 34207 - RNA, 20 nt, Homo sapiens
ucagauguguuugguaauca

SEQ ID NO: 34208 - RNA, 19 nt, Homo sapiens
ugaacauaaguucauuucc

SEQ ID NO: 34209 - RNA, 16 nt, Homo sapiens
ccugaccuccaauaaa

SEQ ID NO: 34210 - RNA, 19 nt, Homo sapiens
ugguuggaguguuuuuaga

SEQ ID NO: 34211 - RNA, 21 nt, Homo sapiens
cagccccuggucugugaucag

SEQ ID NO: 34212 - RNA, 21 nt, Homo sapiens
ccuacucuccuccauucucca

SEQ ID NO: 34213 - RNA, 21 nt, Homo sapiens
cuuaauagaaucuauguggua

SEQ ID NO: 34214 - RNA, 21 nt, Homo sapiens
aaggaccagaugauucacaug

SEQ ID NO: 34215 - RNA, 21 nt, Homo sapiens
aauuaugacaaaaauuacucu

SEQ ID NO: 34216 - RNA, 20 nt, Homo sapiens
agcucauaauuaccaugaca

SEQ ID NO: 34217 - RNA, 20 nt, Homo sapiens
aguacuacuugauuuguguu

SEQ ID NO: 34218 - RNA, 19 nt, Homo sapiens
cugauugcucugauauugu

SEQ ID NO: 34219 - RNA, 18 nt, Homo sapiens
ggaaacagccagaagcca

SEQ ID NO: 34220 - RNA, 21 nt, Homo sapiens
uaauacaacagauagcuuuga

SEQ ID NO: 34221 - RNA, 21 nt, Homo sapiens
ugcucaugguaugucaaaccu

SEQ ID NO: 34222 - RNA, 16 nt, Homo sapiens
ugguaauguccauaga

SEQ ID NO: 34223 - RNA, 24 nt, Homo sapiens
uucuguaaguauguguauuuuaug

SEQ ID NO: 34224 - RNA, 26 nt, Homo sapiens
aaaaaacaauuccaaaugugaaacua

SEQ ID NO: 34225 - RNA, 22 nt, Homo sapiens
gcccuggcuucaggggcuguga

SEQ ID NO: 34226 - RNA, 24 nt, Homo sapiens
gcuugggcugcgugcguucugccu

SEQ ID NO: 34227 - RNA, 20 nt, Homo sapiens
aaugaagcuaaucuucuucc

SEQ ID NO: 34228 - RNA, 21 nt, Homo sapiens
auccaaagcuacccagucccu

SEQ ID NO: 34229 - RNA, 21 nt, Homo sapiens
cggccccuuccccaaauccca

SEQ ID NO: 34230 - RNA, 24 nt, Homo sapiens
gugucuugcugcuuggugggugcu

SEQ ID NO: 34231 - RNA, 17 nt, Homo sapiens
uuuugguguuuauaacu

SEQ ID NO: 34232 - RNA, 16 nt, Homo sapiens
aauaucugccauuuuc

SEQ ID NO: 34233 - RNA, 15 nt, Homo sapiens
aaucauuaccauggc

SEQ ID NO: 34234 - RNA, 20 nt, Homo sapiens
cgcaccacuaauaucugcca

SEQ ID NO: 34235 - RNA, 24 nt, Homo sapiens
cuaucuaucuccccuauucccuca

SEQ ID NO: 34236 - RNA, 19 nt, Homo sapiens
uaagagcaguggcaucaca

SEQ ID NO: 34237 - RNA, 22 nt, Homo sapiens
ucuuagaaucuugcagcaguga

SEQ ID NO: 34238 - RNA, 22 nt, Homo sapiens
uuuugaugauguuucauggugg

SEQ ID NO: 34239 - RNA, 18 nt, Homo sapiens
aggaaccuggacccaguu

SEQ ID NO: 34240 - RNA, 18 nt, Homo sapiens
ccuggacccaguuggcuc

SEQ ID NO: 34241 - RNA, 18 nt, Homo sapiens
ucuuuuucacuuucuugc

SEQ ID NO: 34242 - RNA, 20 nt, Homo sapiens
acccaccagucuuucuggga

SEQ ID NO: 34243 - RNA, 22 nt, Homo sapiens
cccugguggugcaggcugugaa

SEQ ID NO: 34244 - RNA, 20 nt, Homo sapiens
gccacuucugaaggguucug

SEQ ID NO: 34245 - RNA, 18 nt, Homo sapiens
guguaaagaguaucauuc

SEQ ID NO: 34246 - RNA, 19 nt, Homo sapiens
uccccuugcggccccugcu

SEQ ID NO: 34247 - RNA, 22 nt, Homo sapiens
aacacgacacaagcucacuccc

SEQ ID NO: 34248 - RNA, 24 nt, Homo sapiens
auguggcugcuuucugucucugcc

SEQ ID NO: 34249 - RNA, 24 nt, Homo sapiens
ccacuauggugggcuccgucagca

SEQ ID NO: 34250 - RNA, 18 nt, Homo sapiens
cucccagaaccgcagcug

SEQ ID NO: 34251 - RNA, 19 nt, Homo sapiens
gaggacaaucccccaucuc

SEQ ID NO: 34252 - RNA, 22 nt, Homo sapiens
gcaaauacuucaugagcuuagc

SEQ ID NO: 34253 - RNA, 17 nt, Homo sapiens
aaaaacaaacaaacaaa

SEQ ID NO: 34254 - RNA, 23 nt, Homo sapiens
acccagagcugugggaggacccc

SEQ ID NO: 34255 - RNA, 20 nt, Homo sapiens
ccucugccucccagguucaa

SEQ ID NO: 34256 - RNA, 19 nt, Homo sapiens
cugcaaccucugccuccca

SEQ ID NO: 34257 - RNA, 18 nt, Homo sapiens
uccaccucgcagguucaa

SEQ ID NO: 34258 - RNA, 23 nt, Homo sapiens
acauacagucucugucauaacua

SEQ ID NO: 34259 - RNA, 21 nt, Homo sapiens
ugguacgugaauugcuuggua

SEQ ID NO: 34260 - RNA, 20 nt, Homo sapiens
agccuccagaacagaugcca

SEQ ID NO: 34261 - RNA, 24 nt, Homo sapiens
caaauaaugaucaaugcuauuuca

SEQ ID NO: 34262 - RNA, 21 nt, Homo sapiens
ccaucgccagccgggcccuca

SEQ ID NO: 34263 - RNA, 22 nt, Homo sapiens
gccaacauugaaacauaccuuc

SEQ ID NO: 34264 - RNA, 17 nt, Homo sapiens
gccacaucaagucuccu

SEQ ID NO: 34265 - RNA, 19 nt, Homo sapiens
gguuaccauguccaucccc

SEQ ID NO: 34266 - RNA, 18 nt, Homo sapiens
ugcuauuucagugagcaa

SEQ ID NO: 34267 - RNA, 15 nt, Homo sapiens
gauggaaugugaagc

SEQ ID NO: 34268 - RNA, 19 nt, Homo sapiens
ggcauacaucucacacuca

SEQ ID NO: 34269 - RNA, 18 nt, Homo sapiens
uugacacauucaguaacu

SEQ ID NO: 34270 - RNA, 21 nt, Homo sapiens
aaaaacuuccaaugacaagaa

SEQ ID NO: 34271 - RNA, 23 nt, Homo sapiens
accugcucacuguucugucucaa

SEQ ID NO: 34272 - RNA, 24 nt, Homo sapiens
agaccuagugcuguuucuuccaca

SEQ ID NO: 34273 - RNA, 20 nt, Homo sapiens
guguugccuccuaccuugcc

SEQ ID NO: 34274 - RNA, 17 nt, Homo sapiens
uguuucuuccacauauu

SEQ ID NO: 34275 - RNA, 23 nt, Homo sapiens
caaacuggauaaagggugcccaa

SEQ ID NO: 34276 - RNA, 21 nt, Homo sapiens
cccuggcccccagggacugga

SEQ ID NO: 34277 - RNA, 20 nt, Homo sapiens
gccggggacacaccauccug

SEQ ID NO: 34278 - RNA, 21 nt, Homo sapiens
ggacacaccauccugcucgca

SEQ ID NO: 34279 - RNA, 18 nt, Homo sapiens
aaucauaccuacuguaaa

SEQ ID NO: 34280 - RNA, 19 nt, Homo sapiens
gauuaagcuguugaaccua

SEQ ID NO: 34281 - RNA, 25 nt, Homo sapiens
uccccagaccaaaggaaacauuuca

SEQ ID NO: 34282 - RNA, 20 nt, Homo sapiens
ucuuguugucuguggcacuu

SEQ ID NO: 34283 - RNA, 20 nt, Homo sapiens
ugugggcaccuggaaaucua

SEQ ID NO: 34284 - RNA, 19 nt, Homo sapiens
uugccaauauguucauuac

SEQ ID NO: 34285 - RNA, 19 nt, Homo sapiens
aagccaucuuccauaguug

SEQ ID NO: 34286 - RNA, 20 nt, Homo sapiens
agugaauggaaaauaagugu

SEQ ID NO: 34287 - RNA, 21 nt, Homo sapiens
aucaaauucuuuggguaucuc

SEQ ID NO: 34288 - RNA, 19 nt, Homo sapiens
cccacaucgcuccccuuuu

SEQ ID NO: 34289 - RNA, 21 nt, Homo sapiens
cguagauaacaauacacugaa

SEQ ID NO: 34290 - RNA, 18 nt, Homo sapiens
cuguuuugcuacaaccca

SEQ ID NO: 34291 - RNA, 23 nt, Homo sapiens
gcaucaaauucuuuggguaucuc

SEQ ID NO: 34292 - RNA, 21 nt, Homo sapiens
uacugacaggagcagcagcua

SEQ ID NO: 34293 - RNA, 22 nt, Homo sapiens
ugaauggaaaauaaguguggag

SEQ ID NO: 34294 - RNA, 16 nt, Homo sapiens
ugacagaucuuugaua

SEQ ID NO: 34295 - RNA, 19 nt, Homo sapiens
uguauaauucagauuuauc

SEQ ID NO: 34296 - RNA, 19 nt, Homo sapiens
ggcuaaaaaaacuuuguca

SEQ ID NO: 34297 - RNA, 17 nt, Homo sapiens
uagaucaacauuccuca

SEQ ID NO: 34298 - RNA, 19 nt, Homo sapiens
ucaccaaauaaucuuaccu

SEQ ID NO: 34299 - RNA, 20 nt, Homo sapiens
ucugaaccaaaaucuuccca

SEQ ID NO: 34300 - RNA, 18 nt, Homo sapiens
ugcacaucagcugugaug

SEQ ID NO: 34301 - RNA, 22 nt, Homo sapiens
ugugggggugugugugugugug

SEQ ID NO: 34302 - RNA, 18 nt, Homo sapiens
aaagcuaugcuucuguga

SEQ ID NO: 34303 - RNA, 20 nt, Homo sapiens
auacauuagcauguuaaauu

SEQ ID NO: 34304 - RNA, 24 nt, Homo sapiens
gcuucccuguccuugagggcgucu

SEQ ID NO: 34305 - RNA, 20 nt, Homo sapiens
ugcacgggacccagcuccuu

SEQ ID NO: 34306 - RNA, 23 nt, Homo sapiens
aguccccaggccagugcuuggca

SEQ ID NO: 34307 - RNA, 18 nt, Homo sapiens
cacagacccccuugcucc

SEQ ID NO: 34308 - RNA, 18 nt, Homo sapiens
ccaccccuccccgcauug

SEQ ID NO: 34309 - RNA, 17 nt, Homo sapiens
cuuugccacuguccuug

SEQ ID NO: 34310 - RNA, 22 nt, Homo sapiens
gagccaagaucaugccacugca

SEQ ID NO: 34311 - RNA, 21 nt, Homo sapiens
aagaugauuuccauauaccag

SEQ ID NO: 34312 - RNA, 21 nt, Homo sapiens
accauagauaaaagccucaua

SEQ ID NO: 34313 - RNA, 18 nt, Homo sapiens
acccaccgcagcccccug

SEQ ID NO: 34314 - RNA, 19 nt, Homo sapiens
ccauagauaaaagccucau

SEQ ID NO: 34315 - RNA, 19 nt, Homo sapiens
gcccucccucuuaagcuga

SEQ ID NO: 34316 - RNA, 18 nt, Homo sapiens
gucaccauagauaaaagc

SEQ ID NO: 34317 - RNA, 19 nt, Homo sapiens
guucuuccaucuuccgaug

SEQ ID NO: 34318 - RNA, 18 nt, Homo sapiens
caauucacuauuugccca

SEQ ID NO: 34319 - RNA, 20 nt, Homo sapiens
ccccuuuucccugaaccacg

SEQ ID NO: 34320 - RNA, 18 nt, Homo sapiens
gugaugacaauuaaauca

SEQ ID NO: 34321 - RNA, 18 nt, Homo sapiens
uacgaugugugugucaca

SEQ ID NO: 34322 - RNA, 20 nt, Homo sapiens
uuguuuguuagccuugacug

SEQ ID NO: 34323 - RNA, 20 nt, Homo sapiens
caccucccuucccuuuuuua

SEQ ID NO: 34324 - RNA, 21 nt, Homo sapiens
caccucccuuccuuuuuuuca

SEQ ID NO: 34325 - RNA, 23 nt, Homo sapiens
ggcgugagccaccgcgcccggcc

SEQ ID NO: 34326 - RNA, 27 nt, Homo sapiens
ucugggcaguaaaccuagcucauuuuu

SEQ ID NO: 34327 - RNA, 19 nt, Homo sapiens
ugccauuuugauaaugcua

SEQ ID NO: 34328 - RNA, 21 nt, Homo sapiens
ccaggagccacucucccagcu

SEQ ID NO: 34329 - RNA, 24 nt, Homo sapiens
ugccacaucccugucacacaccca

SEQ ID NO: 34330 - RNA, 19 nt, Homo sapiens
aaaacagaagucaaugcaa

SEQ ID NO: 34331 - RNA, 19 nt, Homo sapiens
acaaaugaaaaguugcaua

SEQ ID NO: 34332 - RNA, 20 nt, Homo sapiens
auggcuuuaaaauggagcua

SEQ ID NO: 34333 - RNA, 17 nt, Homo sapiens
cuuuuaggggcugcgga

SEQ ID NO: 34334 - RNA, 21 nt, Homo sapiens
ggcguacacuggcaccuggug

SEQ ID NO: 34335 - RNA, 18 nt, Homo sapiens
uagcauuuuauguacaaa

SEQ ID NO: 34336 - RNA, 20 nt, Homo sapiens
uugccuagaucccccaucuc

SEQ ID NO: 34337 - RNA, 20 nt, Homo sapiens
aaaauuggcaucaauuuuaa

SEQ ID NO: 34338 - RNA, 22 nt, Homo sapiens
aaagugagggaaccauuuccuc

SEQ ID NO: 34339 - RNA, 18 nt, Homo sapiens
acccagcccugucuguua

SEQ ID NO: 34340 - RNA, 20 nt, Homo sapiens
aucacugugugaagcuuuca

SEQ ID NO: 34341 - RNA, 18 nt, Homo sapiens
cucggcucccgcacugcu

SEQ ID NO: 34342 - RNA, 25 nt, Homo sapiens
ccagcgaggccaagaccaccagcca

SEQ ID NO: 34343 - RNA, 21 nt, Homo sapiens
ccuaaagacucaaaguaucuc

SEQ ID NO: 34344 - RNA, 17 nt, Homo sapiens
cucagacauggcugcaa

SEQ ID NO: 34345 - RNA, 19 nt, Homo sapiens
gugcccagagccuuccucc

SEQ ID NO: 34346 - RNA, 21 nt, Homo sapiens
gugucugagcucacuugauug

SEQ ID NO: 34347 - RNA, 19 nt, Homo sapiens
guugcacaaaugugaauac

SEQ ID NO: 34348 - RNA, 21 nt, Homo sapiens
ucucugagaaguagccccucc

SEQ ID NO: 34349 - RNA, 20 nt, Homo sapiens
ugcccagagccuuccuccag

SEQ ID NO: 34350 - RNA, 21 nt, Homo sapiens
ugggugggcccugcggugaac

SEQ ID NO: 34351 - RNA, 19 nt, Homo sapiens
acacaggaguuagaaaugc

SEQ ID NO: 34352 - RNA, 22 nt, Homo sapiens
ccgugauagaaugcagauucaa

SEQ ID NO: 34353 - RNA, 15 nt, Homo sapiens
ccuacagcagaugcc

SEQ ID NO: 34354 - RNA, 19 nt, Homo sapiens
gaauuugggcaagcuauuu

SEQ ID NO: 34355 - RNA, 20 nt, Homo sapiens
uguguaugcuguaguuugug

SEQ ID NO: 34356 - RNA, 20 nt, Homo sapiens
ccucugccuccuggguucaa

SEQ ID NO: 34357 - RNA, 22 nt, Homo sapiens
caggaguucucccaccaccuca

SEQ ID NO: 34358 - RNA, 22 nt, Homo sapiens
aagagacauccgcucccucuca

SEQ ID NO: 34359 - RNA, 26 nt, Homo sapiens
caacuaagcagccucagaucuguaaa

SEQ ID NO: 34360 - RNA, 17 nt, Homo sapiens
gaagaaaccaaucgccc

SEQ ID NO: 34361 - RNA, 19 nt, Homo sapiens
acaagaugccaucugucaa

SEQ ID NO: 34362 - RNA, 23 nt, Homo sapiens
aguggccugaacacacaccuuca

SEQ ID NO: 34363 - RNA, 19 nt, Homo sapiens
ugauugggaaaucugccag

SEQ ID NO: 34364 - RNA, 21 nt, Homo sapiens
agccuucaacaaccaacaacc

SEQ ID NO: 34365 - RNA, 19 nt, Homo sapiens
ccagcacagguagccagca

SEQ ID NO: 34366 - RNA, 19 nt, Homo sapiens
ggaaauucaaaggaaccaa

SEQ ID NO: 34367 - RNA, 22 nt, Homo sapiens
gggaggcauagaagccacacug

SEQ ID NO: 34368 - RNA, 24 nt, Homo sapiens
ucugcccaucacucugguguggua

SEQ ID NO: 34369 - RNA, 15 nt, Homo sapiens
uucucacaacagugu

SEQ ID NO: 34370 - RNA, 22 nt, Homo sapiens
uuugugccccuagauuauuuuu

SEQ ID NO: 34371 - RNA, 21 nt, Homo sapiens
uucuuccuccuucuucuggug

SEQ ID NO: 34372 - RNA, 20 nt, Homo sapiens
gauuuuauuuggaaaggugg

SEQ ID NO: 34373 - RNA, 20 nt, Homo sapiens
ccuuguuugggguucugugg

SEQ ID NO: 34374 - RNA, 22 nt, Homo sapiens
gugcuugggcacuggugggccu

SEQ ID NO: 34375 - RNA, 19 nt, Homo sapiens
ugggguucuguggguuugg

SEQ ID NO: 34376 - RNA, 18 nt, Homo sapiens
aauuugacuuuuguucca

SEQ ID NO: 34377 - RNA, 18 nt, Homo sapiens
agaccugaaaaacuaccu

SEQ ID NO: 34378 - RNA, 18 nt, Homo sapiens
cccccaaauccuguucca

SEQ ID NO: 34379 - RNA, 20 nt, Homo sapiens
ccucugccucccggguucaa

SEQ ID NO: 34380 - RNA, 18 nt, Homo sapiens
ugcccagaacagcgcucc

SEQ ID NO: 34381 - RNA, 18 nt, Homo sapiens
ccuguggguugcuggcuu

SEQ ID NO: 34382 - RNA, 18 nt, Homo sapiens
aaaauugagcccuggcca

SEQ ID NO: 34383 - RNA, 20 nt, Homo sapiens
caccaccacgacagcccuuc

SEQ ID NO: 34384 - RNA, 21 nt, Homo sapiens
ccauggggcuagagacugcca

SEQ ID NO: 34385 - RNA, 21 nt, Homo sapiens
cccacuucccaaauaugccuc

SEQ ID NO: 34386 - RNA, 17 nt, Homo sapiens
cccuacccaaucuuucc

SEQ ID NO: 34387 - RNA, 23 nt, Homo sapiens
ccucccccaaccaccugcccucc

SEQ ID NO: 34388 - RNA, 22 nt, Homo sapiens
cuccgaucucucccaccccacc

SEQ ID NO: 34389 - RNA, 20 nt, Homo sapiens
gcugcuucauccacagaagg

SEQ ID NO: 34390 - RNA, 18 nt, Homo sapiens
ucuugggcaucccccuca

SEQ ID NO: 34391 - RNA, 21 nt, Homo sapiens
aaucaccauucuccuuccucu

SEQ ID NO: 34392 - RNA, 25 nt, Homo sapiens
agccuggccaacauggcaaauccca

SEQ ID NO: 34393 - RNA, 19 nt, Homo sapiens
augaagugaagugaacaca

SEQ ID NO: 34394 - RNA, 18 nt, Homo sapiens
cugggguuauaacugaua

SEQ ID NO: 34395 - RNA, 18 nt, Homo sapiens
auggagucucccucuguc

SEQ ID NO: 34396 - RNA, 26 nt, Homo sapiens
ucauccuccuaaauuucacugucuua

SEQ ID NO: 34397 - RNA, 18 nt, Homo sapiens
ucugcccaccucugccuc

SEQ ID NO: 34398 - RNA, 21 nt, Homo sapiens
aaucagcuccuauugaacuua

SEQ ID NO: 34399 - RNA, 21 nt, Homo sapiens
caugugugcauaucuauagua

SEQ ID NO: 34400 - RNA, 24 nt, Homo sapiens
guauauauuuuguacacuuuguua

SEQ ID NO: 34401 - RNA, 21 nt, Homo sapiens
gugugacaacugaucggguga

SEQ ID NO: 34402 - RNA, 20 nt, Homo sapiens
ucaugcugcuauuccugcaa

SEQ ID NO: 34403 - RNA, 19 nt, Homo sapiens
ugggcuagcacugaaacug

SEQ ID NO: 34404 - RNA, 19 nt, Homo sapiens
acaggauauaaccggaguu

SEQ ID NO: 34405 - RNA, 20 nt, Homo sapiens
agaaugaaauaaaccagagu

SEQ ID NO: 34406 - RNA, 23 nt, Homo sapiens
agaguuagacccgcggggguugg

SEQ ID NO: 34407 - RNA, 17 nt, Homo sapiens
agaucaaagcugcaguu

SEQ ID NO: 34408 - RNA, 19 nt, Homo sapiens
aguggauggaaggggacug

SEQ ID NO: 34409 - RNA, 21 nt, Homo sapiens
caaagcugcaguugcauuuga

SEQ ID NO: 34410 - RNA, 21 nt, Homo sapiens
cacuucgcccuccccauuuga

SEQ ID NO: 34411 - RNA, 16 nt, Homo sapiens
ccccgccccccgcacu

SEQ ID NO: 34412 - RNA, 22 nt, Homo sapiens
uuuugguggugguggcuguugg

SEQ ID NO: 34413 - RNA, 22 nt, Homo sapiens
acaucuucacaccagcaggaca

SEQ ID NO: 34414 - RNA, 23 nt, Homo sapiens
cugcgugagucuguacagggaua

SEQ ID NO: 34415 - RNA, 21 nt, Homo sapiens
gugauacccaaagcugagcag

SEQ ID NO: 34416 - RNA, 19 nt, Homo sapiens
uagcauucccguguacaaa

SEQ ID NO: 34417 - RNA, 20 nt, Homo sapiens
ucgacaucagugauacccaa

SEQ ID NO: 34418 - RNA, 24 nt, Homo sapiens
cagcgaguauaugaacaacaaaga

SEQ ID NO: 34419 - RNA, 17 nt, Homo sapiens
cgcucgauugccagugg

SEQ ID NO: 34420 - RNA, 20 nt, Homo sapiens
ugacacagauauccccacca

SEQ ID NO: 34421 - RNA, 18 nt, Homo sapiens
aaaagacuuuuuuuuaaa

SEQ ID NO: 34422 - RNA, 21 nt, Homo sapiens
gaguuguagauaaaaugucau

SEQ ID NO: 34423 - RNA, 20 nt, Homo sapiens
aggaaauagcccucaagaua

SEQ ID NO: 34424 - RNA, 24 nt, Homo sapiens
uuuuuuuauuuuuggccuugucuu

SEQ ID NO: 34425 - RNA, 18 nt, Homo sapiens
agguguguacaucucuca

SEQ ID NO: 34426 - RNA, 21 nt, Homo sapiens
cuuccaagcacaugcauggca

SEQ ID NO: 34427 - RNA, 20 nt, Homo sapiens
uuugguuggccuucuggucu

SEQ ID NO: 34428 - RNA, 22 nt, Homo sapiens
cacucccuggcacaaugccgua

SEQ ID NO: 34429 - RNA, 20 nt, Homo sapiens
cccagacccaccagacacca

SEQ ID NO: 34430 - RNA, 18 nt, Homo sapiens
gcccacccacuuuccucu

SEQ ID NO: 34431 - RNA, 20 nt, Homo sapiens
gucucucugcuguaccagcu

SEQ ID NO: 34432 - RNA, 18 nt, Homo sapiens
gaacaacgugguuauugu

SEQ ID NO: 34433 - RNA, 20 nt, Homo sapiens
acucuggugauccaaacaaa

SEQ ID NO: 34434 - RNA, 16 nt, Homo sapiens
aggcuggccucuacau

SEQ ID NO: 34435 - RNA, 17 nt, Homo sapiens
augaaugagaguucugg

SEQ ID NO: 34436 - RNA, 21 nt, Homo sapiens
cucuuaccuaaacucugguga

SEQ ID NO: 34437 - RNA, 19 nt, Homo sapiens
gaggcuggccucuacauca

SEQ ID NO: 34438 - RNA, 18 nt, Homo sapiens
gcuugcagguggaacucc

SEQ ID NO: 34439 - RNA, 20 nt, Homo sapiens
acaaaacaaaacaaaacuca

SEQ ID NO: 34440 - RNA, 24 nt, Homo sapiens
cuauuucuguuacacaauuuguua

SEQ ID NO: 34441 - RNA, 19 nt, Homo sapiens
ggaagagaacacacccauc

SEQ ID NO: 34442 - RNA, 18 nt, Homo sapiens
uguaauauuuccaaguca

SEQ ID NO: 34443 - RNA, 25 nt, Homo sapiens
uuuuuucaacuaugucauuaacuuu

SEQ ID NO: 34444 - RNA, 18 nt, Homo sapiens
cauuaauguuugauaagg

SEQ ID NO: 34445 - RNA, 20 nt, Homo sapiens
guaucaagaucagugucaga

SEQ ID NO: 34446 - RNA, 18 nt, Homo sapiens
uaauucucccucuguccu

SEQ ID NO: 34447 - RNA, 21 nt, Homo sapiens
uguccuuuuaagaauuauuuu

SEQ ID NO: 34448 - RNA, 20 nt, Homo sapiens
aagccauauuccagcaguga

SEQ ID NO: 34449 - RNA, 21 nt, Homo sapiens
aagugcuaaaaaauuaaacca

SEQ ID NO: 34450 - RNA, 15 nt, Homo sapiens
caucaagauaccuuu

SEQ ID NO: 34451 - RNA, 23 nt, Homo sapiens
cuuugaccucaauggagguuugc

SEQ ID NO: 34452 - RNA, 22 nt, Homo sapiens
gcaggaggcaagggcugcaaca

SEQ ID NO: 34453 - RNA, 23 nt, Homo sapiens
guuuggggagcagccccuggcuc

SEQ ID NO: 34454 - RNA, 19 nt, Homo sapiens
uaacagucugugcugucca

SEQ ID NO: 34455 - RNA, 21 nt, Homo sapiens
ucacuuccacucauaauccac

SEQ ID NO: 34456 - RNA, 21 nt, Homo sapiens
gccugaacuguggccgugucu

SEQ ID NO: 34457 - RNA, 21 nt, Homo sapiens
gcgaggccacgacaggccuca

SEQ ID NO: 34458 - RNA, 21 nt, Homo sapiens
ggcgcccgcggcggccguggc

SEQ ID NO: 34459 - RNA, 23 nt, Homo sapiens
ggguucucggcggcggcuguggc

SEQ ID NO: 34460 - RNA, 18 nt, Homo sapiens
agaauuuaaaacaccucu

SEQ ID NO: 34461 - RNA, 18 nt, Homo sapiens
uggagccagcaagugcuu

SEQ ID NO: 34462 - RNA, 18 nt, Homo sapiens
gccucuggcugcugguuu

SEQ ID NO: 34463 - RNA, 17 nt, Homo sapiens
acuuuggcccuugguuu

SEQ ID NO: 34464 - RNA, 17 nt, Homo sapiens
uccagaagaagguccag

SEQ ID NO: 34465 - RNA, 23 nt, Homo sapiens
ucugccugcuuuccaccucccca

SEQ ID NO: 34466 - RNA, 18 nt, Homo sapiens
uugcucaucgccugguuc

SEQ ID NO: 34467 - RNA, 18 nt, Homo sapiens
ccacccaucuguuccguu

SEQ ID NO: 34468 - RNA, 16 nt, Homo sapiens
gaguccuggcauuuac

SEQ ID NO: 34469 - RNA, 19 nt, Homo sapiens
auuuguaaauauuguacaa

SEQ ID NO: 34470 - RNA, 21 nt, Homo sapiens
ccugccccgccccucccccca

SEQ ID NO: 34471 - RNA, 20 nt, Homo sapiens
cucucugucugcaccaggga

SEQ ID NO: 34472 - RNA, 25 nt, Homo sapiens
gaaguugaaugcuuaaucccgggaa

SEQ ID NO: 34473 - RNA, 22 nt, Homo sapiens
gggacccugccccgccccuccc

SEQ ID NO: 34474 - RNA, 19 nt, Homo sapiens
ucacccagcagccacugcc

SEQ ID NO: 34475 - RNA, 18 nt, Homo sapiens
uggcaaccacacaacuca

SEQ ID NO: 34476 - RNA, 22 nt, Homo sapiens
acccucacuccuggagauucca

SEQ ID NO: 34477 - RNA, 27 nt, Homo sapiens
auuuaagcuauuaaaauuuguacaaua

SEQ ID NO: 34478 - RNA, 19 nt, Homo sapiens
gucucacucuguugcccag

SEQ ID NO: 34479 - RNA, 18 nt, Homo sapiens
ccaagcaauccucccacc

SEQ ID NO: 34480 - RNA, 16 nt, Homo sapiens
ggcggggucucuguca

SEQ ID NO: 34481 - RNA, 24 nt, Homo sapiens
uccucccaccucagccucuggugu

SEQ ID NO: 34482 - RNA, 24 nt, Homo sapiens
augacuguauaaaacuuguugaca

SEQ ID NO: 34483 - RNA, 18 nt, Homo sapiens
ccacauucaccuuguaaa

SEQ ID NO: 34484 - RNA, 20 nt, Homo sapiens
gaucccaccauuagccugua

SEQ ID NO: 34485 - RNA, 17 nt, Homo sapiens
uuugaucuguguuuguu

SEQ ID NO: 34486 - RNA, 16 nt, Homo sapiens
ugggcgcgacugguuc

SEQ ID NO: 34487 - RNA, 17 nt, Homo sapiens
gaacaugguggaaaaug

SEQ ID NO: 34488 - RNA, 24 nt, Homo sapiens
gauuuuccaaaauuuuggugugaa

SEQ ID NO: 34489 - RNA, 24 nt, Homo sapiens
gcuuccugccacccacccaccucu

SEQ ID NO: 34490 - RNA, 22 nt, Homo sapiens
ucucuuuauagugagaaaauuu

SEQ ID NO: 34491 - RNA, 18 nt, Homo sapiens
ucugucgucucccaucca

SEQ ID NO: 34492 - RNA, 21 nt, Homo sapiens
uuugcuugucugaaacaccuc

SEQ ID NO: 34493 - RNA, 19 nt, Homo sapiens
uuuuguaugugcguguguu

SEQ ID NO: 34494 - RNA, 20 nt, Homo sapiens
aaaccuuuuuucuuaacuuu

SEQ ID NO: 34495 - RNA, 22 nt, Homo sapiens
aacaaaaaggacgaccaugcaa

SEQ ID NO: 34496 - RNA, 20 nt, Homo sapiens
aaggucaccaacagcaaaga

SEQ ID NO: 34497 - RNA, 22 nt, Homo sapiens
accaggaaaauaauauguacca

SEQ ID NO: 34498 - RNA, 20 nt, Homo sapiens
acuugagguuacaaagcuca

SEQ ID NO: 34499 - RNA, 16 nt, Homo sapiens
auauugcuuccucuga

SEQ ID NO: 34500 - RNA, 18 nt, Homo sapiens
auauugcuuccucugaua

SEQ ID NO: 34501 - RNA, 19 nt, Homo sapiens
aucucagcucuggcucuuu

SEQ ID NO: 34502 - RNA, 21 nt, Homo sapiens
cuaucuaucuacaaaucuauc

SEQ ID NO: 34503 - RNA, 20 nt, Homo sapiens
cuggagccaaaauuuugagu

SEQ ID NO: 34504 - RNA, 19 nt, Homo sapiens
cuguagccagacugccucu

SEQ ID NO: 34505 - RNA, 16 nt, Homo sapiens
uggucacggugguggu

SEQ ID NO: 34506 - RNA, 20 nt, Homo sapiens
uucuaccuuccuugugccuu

SEQ ID NO: 34507 - RNA, 25 nt, Homo sapiens
acaaacuccguuaugauauauccua

SEQ ID NO: 34508 - RNA, 22 nt, Homo sapiens
accaggacuauguagaaguaga

SEQ ID NO: 34509 - RNA, 16 nt, Homo sapiens
accauucuuuugcaca

SEQ ID NO: 34510 - RNA, 23 nt, Homo sapiens
auuuguaauuuuucuguacgaua

SEQ ID NO: 34511 - RNA, 21 nt, Homo sapiens
ucccaaaauagaauguuucag

SEQ ID NO: 34512 - RNA, 21 nt, Homo sapiens
uuuguaccacaguauuaaucg

SEQ ID NO: 34513 - RNA, 23 nt, Homo sapiens
aagcaagcgagggacuucacucu

SEQ ID NO: 34514 - RNA, 18 nt, Homo sapiens
acuguggcuguuggguuu

SEQ ID NO: 34515 - RNA, 20 nt, Homo sapiens
cccucccugucagcacagca

SEQ ID NO: 34516 - RNA, 18 nt, Homo sapiens
ccgugugucuugucugug

SEQ ID NO: 34517 - RNA, 19 nt, Homo sapiens
cuggcugggcuuccggugu

SEQ ID NO: 34518 - RNA, 18 nt, Homo sapiens
gcuuugaucccuuggucu

SEQ ID NO: 34519 - RNA, 18 nt, Homo sapiens
uccagaacuuuguucuag

SEQ ID NO: 34520 - RNA, 19 nt, Homo sapiens
uccggcuuggcuguuccag

SEQ ID NO: 34521 - RNA, 23 nt, Homo sapiens
uggggucauagauuguccaguca

SEQ ID NO: 34522 - RNA, 19 nt, Homo sapiens
uuuguucuagauuccuuaa

SEQ ID NO: 34523 - RNA, 18 nt, Homo sapiens
aagcugguccucaaagua

SEQ ID NO: 34524 - RNA, 19 nt, Homo sapiens
gacuucauggcugacuugc

SEQ ID NO: 34525 - RNA, 20 nt, Homo sapiens
uaccaugaaagaaaagauca

SEQ ID NO: 34526 - RNA, 19 nt, Homo sapiens
agcucuaucauauucugaa

SEQ ID NO: 34527 - RNA, 16 nt, Homo sapiens
caaacaaccuuggcug

SEQ ID NO: 34528 - RNA, 18 nt, Homo sapiens
uugagaauguuuguugua

SEQ ID NO: 34529 - RNA, 20 nt, Homo sapiens
augucaaaaaucugcaaacc

SEQ ID NO: 34530 - RNA, 21 nt, Homo sapiens
cucaacauccugaagcugauc

SEQ ID NO: 34531 - RNA, 21 nt, Homo sapiens
ucugggcagaagaccugcgag

SEQ ID NO: 34532 - RNA, 22 nt, Homo sapiens
caaggaaagcuggcaaacacac

SEQ ID NO: 34533 - RNA, 19 nt, Homo sapiens
cucccccacaacuucucca

SEQ ID NO: 34534 - RNA, 20 nt, Homo sapiens
cugcugaacaguagcaauaa

SEQ ID NO: 34535 - RNA, 20 nt, Homo sapiens
gguuuguuuggaguaaccaa

SEQ ID NO: 34536 - RNA, 19 nt, Homo sapiens
uccucucuauuaauaccuc

SEQ ID NO: 34537 - RNA, 18 nt, Homo sapiens
uguguaaaauagccuucc

SEQ ID NO: 34538 - RNA, 18 nt, Homo sapiens
agcagucccccaguguca

SEQ ID NO: 34539 - RNA, 18 nt, Homo sapiens
cagcagcaggacugagaa

SEQ ID NO: 34540 - RNA, 19 nt, Homo sapiens
gagaucaccuccuacacca

SEQ ID NO: 34541 - RNA, 22 nt, Homo sapiens
gcuguaaugcaaauggcuggug

SEQ ID NO: 34542 - RNA, 18 nt, Homo sapiens
uccccggaacaucggcaa

SEQ ID NO: 34543 - RNA, 21 nt, Homo sapiens
uggcugguggaguaugugaug

SEQ ID NO: 34544 - RNA, 19 nt, Homo sapiens
aacagacuccaggcccuga

SEQ ID NO: 34545 - RNA, 21 nt, Homo sapiens
uauccagucacagugaauuug

SEQ ID NO: 34546 - RNA, 23 nt, Homo sapiens
uuuagguaaugauaagcauuuuu

SEQ ID NO: 34547 - RNA, 20 nt, Homo sapiens
caagaaaucuuagaaccagc

SEQ ID NO: 34548 - RNA, 17 nt, Homo sapiens
cacaccaucuccaucuc

SEQ ID NO: 34549 - RNA, 16 nt, Homo sapiens
cccagauugaggaucc

SEQ ID NO: 34550 - RNA, 20 nt, Homo sapiens
cuagacagacugcgggcaca

SEQ ID NO: 34551 - RNA, 22 nt, Homo sapiens
cuggccaagcugaccgauagcu

SEQ ID NO: 34552 - RNA, 20 nt, Homo sapiens
cuuggggcugguuugguuuu

SEQ ID NO: 34553 - RNA, 24 nt, Homo sapiens
cuuugaugauaaaacaagacuugu

SEQ ID NO: 34554 - RNA, 21 nt, Homo sapiens
gacugcaaaguccacauccga

SEQ ID NO: 34555 - RNA, 22 nt, Homo sapiens
uaaaugggagggauugaggcua

SEQ ID NO: 34556 - RNA, 21 nt, Homo sapiens
ugcacacaccaucuccaucuc

SEQ ID NO: 34557 - RNA, 24 nt, Homo sapiens
uuagggagaagauagcauucuuca

SEQ ID NO: 34558 - RNA, 18 nt, Homo sapiens
uuggggcugguuugguuu

SEQ ID NO: 34559 - RNA, 20 nt, Homo sapiens
aaggauuucagcaaaccacc

SEQ ID NO: 34560 - RNA, 19 nt, Homo sapiens
acgaaacugugacuuucca

SEQ ID NO: 34561 - RNA, 18 nt, Homo sapiens
acggcacauagagaugaa

SEQ ID NO: 34562 - RNA, 18 nt, Homo sapiens
ccaucccauagcuccugc

SEQ ID NO: 34563 - RNA, 21 nt, Homo sapiens
cccaccccccagcgucaucuc

SEQ ID NO: 34564 - RNA, 23 nt, Homo sapiens
gggacgggggcacccacuuccuu

SEQ ID NO: 34565 - RNA, 17 nt, Homo sapiens
ugaagaggagauccagg

SEQ ID NO: 34566 - RNA, 20 nt, Homo sapiens
uuucagcaaaccaccaccuc

SEQ ID NO: 34567 - RNA, 23 nt, Homo sapiens
aucuccacccauuaaacaugaag

SEQ ID NO: 34568 - RNA, 23 nt, Homo sapiens
gcccaguguggugugucuggcuu

SEQ ID NO: 34569 - RNA, 21 nt, Homo sapiens
caguaguuuuauuuccacagc

SEQ ID NO: 34570 - RNA, 21 nt, Homo sapiens
ucuguguagcaccauucacca

SEQ ID NO: 34571 - RNA, 23 nt, Homo sapiens
ugaauguaacuccuggugugaag

SEQ ID NO: 34572 - RNA, 24 nt, Homo sapiens
aaggcauccacauuuaagucacca

SEQ ID NO: 34573 - RNA, 18 nt, Homo sapiens
acccuugauggcuaauca

SEQ ID NO: 34574 - RNA, 19 nt, Homo sapiens
agagaagcuagacagaagg

SEQ ID NO: 34575 - RNA, 16 nt, Homo sapiens
caagaacaaaaaacca

SEQ ID NO: 34576 - RNA, 21 nt, Homo sapiens
ccaaacaaacaaacaaacaaa

SEQ ID NO: 34577 - RNA, 19 nt, Homo sapiens
ccuccuugaccaaaccuca

SEQ ID NO: 34578 - RNA, 19 nt, Homo sapiens
gaccaaggcauccacauuu

SEQ ID NO: 34579 - RNA, 23 nt, Homo sapiens
gccaccucugagugcucugagga

SEQ ID NO: 34580 - RNA, 22 nt, Homo sapiens
ucccucugagcccacgauugga

SEQ ID NO: 34581 - RNA, 23 nt, Homo sapiens
ucugaggaaaacauggcacucuu

SEQ ID NO: 34582 - RNA, 19 nt, Homo sapiens
ugaacaaugagaucacaug

SEQ ID NO: 34583 - RNA, 21 nt, Homo sapiens
ccaggcauuuaaaauaccuaa

SEQ ID NO: 34584 - RNA, 20 nt, Homo sapiens
uaaaccugcagaaaauccuu

SEQ ID NO: 34585 - RNA, 17 nt, Homo sapiens
uagcacaauuccuggca

SEQ ID NO: 34586 - RNA, 23 nt, Homo sapiens
uuucacaaaaucaaaauauugua

SEQ ID NO: 34587 - RNA, 20 nt, Homo sapiens
cuaugauugcuuuguguuca

SEQ ID NO: 34588 - RNA, 20 nt, Homo sapiens
ugaauuucaaaaugaagcug

SEQ ID NO: 34589 - RNA, 18 nt, Homo sapiens
ugauucggcuucacuuug

SEQ ID NO: 34590 - RNA, 21 nt, Homo sapiens
ugcuguuagccaugucuauug

SEQ ID NO: 34591 - RNA, 24 nt, Homo sapiens
uggugugccccuugagugaggcua

SEQ ID NO: 34592 - RNA, 18 nt, Homo sapiens
accgcggacuugcccuga

SEQ ID NO: 34593 - RNA, 22 nt, Homo sapiens
aucuaagauucauagcucagcu

SEQ ID NO: 34594 - RNA, 19 nt, Homo sapiens
cacucuguacccaccauuc

SEQ ID NO: 34595 - RNA, 19 nt, Homo sapiens
ccacucuguacccaccauu

SEQ ID NO: 34596 - RNA, 17 nt, Homo sapiens
cuccaaagggaaaucuu

SEQ ID NO: 34597 - RNA, 19 nt, Homo sapiens
cuuguaacagaacaccucu

SEQ ID NO: 34598 - RNA, 21 nt, Homo sapiens
gaaaaagauuuagacauacua

SEQ ID NO: 34599 - RNA, 20 nt, Homo sapiens
gaagguuggucauuucucug

SEQ ID NO: 34600 - RNA, 18 nt, Homo sapiens
gauacugaagaaacuccc

SEQ ID NO: 34601 - RNA, 18 nt, Homo sapiens
ggcccuuuuccugugacg

SEQ ID NO: 34602 - RNA, 21 nt, Homo sapiens
ugaagaaacucccccaaccca

SEQ ID NO: 34603 - RNA, 23 nt, Homo sapiens
cugcacacuuggacagcagggug

SEQ ID NO: 34604 - RNA, 26 nt, Homo sapiens
gagaugggaugucuuugcauaucucu

SEQ ID NO: 34605 - RNA, 20 nt, Homo sapiens
ugucugugaaagugccaaga

SEQ ID NO: 34606 - RNA, 20 nt, Homo sapiens
agcuacagcucuacaaccag

SEQ ID NO: 34607 - RNA, 20 nt, Homo sapiens
cgcauccugcaccuccucac

SEQ ID NO: 34608 - RNA, 19 nt, Homo sapiens
ugcaaagccagaaacuucu

SEQ ID NO: 34609 - RNA, 19 nt, Homo sapiens
aaacuccugaccucaggug

SEQ ID NO: 34610 - RNA, 19 nt, Homo sapiens
cagaaaauuauccuuuuca

SEQ ID NO: 34611 - RNA, 18 nt, Homo sapiens
ggagcuauaccaaaaucu

SEQ ID NO: 34612 - RNA, 18 nt, Homo sapiens
ggugauccgcccgccucc

SEQ ID NO: 34613 - RNA, 18 nt, Homo sapiens
uccgccucccggguucaa

SEQ ID NO: 34614 - RNA, 23 nt, Homo sapiens
uggggucaguugggugcccaguu

SEQ ID NO: 34615 - RNA, 16 nt, Homo sapiens
cuuuucuagcagcugc

SEQ ID NO: 34616 - RNA, 19 nt, Homo sapiens
gcugcuuagaaauacggcu

SEQ ID NO: 34617 - RNA, 21 nt, Homo sapiens
ucaguuaagaaaucuacuuua

SEQ ID NO: 34618 - RNA, 17 nt, Homo sapiens
acagauaacucaaaccu

SEQ ID NO: 34619 - RNA, 19 nt, Homo sapiens
acugccaggcuugcuccuc

SEQ ID NO: 34620 - RNA, 18 nt, Homo sapiens
agcacucggaauuccuga

SEQ ID NO: 34621 - RNA, 19 nt, Homo sapiens
auauagaaacauauggaua

SEQ ID NO: 34622 - RNA, 19 nt, Homo sapiens
auuucuuuggcucuugaca

SEQ ID NO: 34623 - RNA, 23 nt, Homo sapiens
auuugaacacauuucuuuggcuc

SEQ ID NO: 34624 - RNA, 17 nt, Homo sapiens
cauuacuuuagguucaa

SEQ ID NO: 34625 - RNA, 22 nt, Homo sapiens
ccauuacaugcacauguacuca

SEQ ID NO: 34626 - RNA, 22 nt, Homo sapiens
ccucuaagacuguguuggucuu

SEQ ID NO: 34627 - RNA, 19 nt, Homo sapiens
uaaaacaucaucaacauaa

SEQ ID NO: 34628 - RNA, 17 nt, Homo sapiens
uccuggaaaaacuauaa

SEQ ID NO: 34629 - RNA, 21 nt, Homo sapiens
ucugcuuuaaugugcauggug

SEQ ID NO: 34630 - RNA, 23 nt, Homo sapiens
ugcugaaauuaggaaccacaggu

SEQ ID NO: 34631 - RNA, 19 nt, Homo sapiens
uggaugccaaaugagacug

SEQ ID NO: 34632 - RNA, 19 nt, Homo sapiens
aagaggaauuaccaccuca

SEQ ID NO: 34633 - RNA, 20 nt, Homo sapiens
cagaaaagaagauccuauca

SEQ ID NO: 34634 - RNA, 19 nt, Homo sapiens
ccacacauuuggcacuguu

SEQ ID NO: 34635 - RNA, 18 nt, Homo sapiens
ccagaagaggcaucucca

SEQ ID NO: 34636 - RNA, 24 nt, Homo sapiens
ccaugacacugacaagaggaauua

SEQ ID NO: 34637 - RNA, 22 nt, Homo sapiens
cccacuuuggcauuuuccuaac

SEQ ID NO: 34638 - RNA, 23 nt, Homo sapiens
cugauauaacucaggcugcaauu

SEQ ID NO: 34639 - RNA, 19 nt, Homo sapiens
uaacagucugagacuccuc

SEQ ID NO: 34640 - RNA, 21 nt, Homo sapiens
ccaggggccacccgccuggca

SEQ ID NO: 34641 - RNA, 20 nt, Homo sapiens
ccucccccugccucuccucc

SEQ ID NO: 34642 - RNA, 22 nt, Homo sapiens
cgucuccacaagaguuuacaaa

SEQ ID NO: 34643 - RNA, 21 nt, Homo sapiens
cuuagcgcuuuuaaguuauuu

SEQ ID NO: 34644 - RNA, 25 nt, Homo sapiens
gccugggcuucucuauucuuggccc

SEQ ID NO: 34645 - RNA, 25 nt, Homo sapiens
ugaauggguccggugcuuggagcug

SEQ ID NO: 34646 - RNA, 22 nt, Homo sapiens
ccucuucgugguuguguuucuc

SEQ ID NO: 34647 - RNA, 20 nt, Homo sapiens
gggcaucugaagcuuuacca

SEQ ID NO: 34648 - RNA, 17 nt, Homo sapiens
ucucuggaaggccccuu

SEQ ID NO: 34649 - RNA, 24 nt, Homo sapiens
cuauuuauaguugccuuuggccuu

SEQ ID NO: 34650 - RNA, 20 nt, Homo sapiens
gaaggaucccucuccucucu

SEQ ID NO: 34651 - RNA, 22 nt, Homo sapiens
uguuggcucccgugucugcuga

SEQ ID NO: 34652 - RNA, 19 nt, Homo sapiens
aagcaauucuccugccuca

SEQ ID NO: 34653 - RNA, 20 nt, Homo sapiens
gacggggucucacucugucg

SEQ ID NO: 34654 - RNA, 24 nt, Homo sapiens
ucaagcgauccucccaccaccuca

SEQ ID NO: 34655 - RNA, 18 nt, Homo sapiens
uccgccucccggguucaa

SEQ ID NO: 34656 - RNA, 20 nt, Homo sapiens
aaguuugugugaaagaugug

SEQ ID NO: 34657 - RNA, 23 nt, Homo sapiens
acaccuguuuacaaaaagaauca

SEQ ID NO: 34658 - RNA, 18 nt, Homo sapiens
accaugcucuuccacaca

SEQ ID NO: 34659 - RNA, 20 nt, Homo sapiens
agcagcacagaaacaagcua

SEQ ID NO: 34660 - RNA, 18 nt, Homo sapiens
gauccugaaagcagacug

SEQ ID NO: 34661 - RNA, 19 nt, Homo sapiens
uaaaaacuaccuaaacacu

SEQ ID NO: 34662 - RNA, 18 nt, Homo sapiens
uucaaacaucuguggugu

SEQ ID NO: 34663 - RNA, 25 nt, Homo sapiens
ccauuaacccacuuugcuugucuca

SEQ ID NO: 34664 - RNA, 20 nt, Homo sapiens
ccuaggaaaugacuguccca

SEQ ID NO: 34665 - RNA, 22 nt, Homo sapiens
cgggcggggguggccgcgacca

SEQ ID NO: 34666 - RNA, 18 nt, Homo sapiens
gcacuuguaugaugcuuu

SEQ ID NO: 34667 - RNA, 16 nt, Homo sapiens
gcgccaccauuaaccc

SEQ ID NO: 34668 - RNA, 23 nt, Homo sapiens
guuuuagcgccaccauuaaccca

SEQ ID NO: 34669 - RNA, 20 nt, Homo sapiens
uaaucucaucacggauaugu

SEQ ID NO: 34670 - RNA, 20 nt, Homo sapiens
ugaagagauuuuggugagga

SEQ ID NO: 34671 - RNA, 21 nt, Homo sapiens
aauacaaaaaugaguuuugca

SEQ ID NO: 34672 - RNA, 21 nt, Homo sapiens
accaauucuuagaaacacuuu

SEQ ID NO: 34673 - RNA, 22 nt, Homo sapiens
aucuaaguuaugaaauccaaca

SEQ ID NO: 34674 - RNA, 23 nt, Homo sapiens
ccuuuucauauauuuauaacuuu

SEQ ID NO: 34675 - RNA, 19 nt, Homo sapiens
gaauaguuuccugauguca

SEQ ID NO: 34676 - RNA, 20 nt, Homo sapiens
ugaauuuuuaaggcuuuccu

SEQ ID NO: 34677 - RNA, 22 nt, Homo sapiens
aguccucuuucuuuauccuuag

SEQ ID NO: 34678 - RNA, 17 nt, Homo sapiens
uccuguuuuucauucuc

SEQ ID NO: 34679 - RNA, 18 nt, Homo sapiens
ggacucuaagugagacug

SEQ ID NO: 34680 - RNA, 21 nt, Homo sapiens
uuucuuuauguguuugcugua

SEQ ID NO: 34681 - RNA, 22 nt, Homo sapiens
gcgcggaggagcagcggccggg

SEQ ID NO: 34682 - RNA, 24 nt, Homo sapiens
ggccggguguccacccccauccug

SEQ ID NO: 34683 - RNA, 23 nt, Homo sapiens
uguccacccccauccugcgccca

SEQ ID NO: 34684 - RNA, 19 nt, Homo sapiens
cauuuucucguuauauuca

SEQ ID NO: 34685 - RNA, 21 nt, Homo sapiens
ccaaaucacuuuuccaucucu

SEQ ID NO: 34686 - RNA, 18 nt, Homo sapiens
gaguuucagauccacacu

SEQ ID NO: 34687 - RNA, 19 nt, Homo sapiens
gccacugauuuuugaggaa

SEQ ID NO: 34688 - RNA, 24 nt, Homo sapiens
uauccauuacaguaaaggauuuca

SEQ ID NO: 34689 - RNA, 21 nt, Homo sapiens
uucauuggcuucaaaauccaa

SEQ ID NO: 34690 - RNA, 19 nt, Homo sapiens
aacuuuggaaaguguguua

SEQ ID NO: 34691 - RNA, 22 nt, Homo sapiens
acucauuuggaugauucuguga

SEQ ID NO: 34692 - RNA, 19 nt, Homo sapiens
gucagauugugucaaguca

SEQ ID NO: 34693 - RNA, 16 nt, Homo sapiens
ucaaggaacuugcaaa

SEQ ID NO: 34694 - RNA, 21 nt, Homo sapiens
uuuuguuaauaugcaguuuua

SEQ ID NO: 34695 - RNA, 18 nt, Homo sapiens
aaauguguuuacugcuuu

SEQ ID NO: 34696 - RNA, 19 nt, Homo sapiens
auucaaguggagaggguua

SEQ ID NO: 34697 - RNA, 18 nt, Homo sapiens
gaaaacuccaggcaucga

SEQ ID NO: 34698 - RNA, 26 nt, Homo sapiens
ugaaaagaucaccuuaagugaaauua

SEQ ID NO: 34699 - RNA, 19 nt, Homo sapiens
uguagguguugugagcuuu

SEQ ID NO: 34700 - RNA, 16 nt, Homo sapiens
uugaggagacaaguga

SEQ ID NO: 34701 - RNA, 17 nt, Homo sapiens
aaaaaugaaaguguggu

SEQ ID NO: 34702 - RNA, 15 nt, Homo sapiens
gucccuuucugccuu

SEQ ID NO: 34703 - RNA, 21 nt, Homo sapiens
ugggcauucaguauucugaga

SEQ ID NO: 34704 - RNA, 19 nt, Homo sapiens
ccccaaguccccccugcag

SEQ ID NO: 34705 - RNA, 17 nt, Homo sapiens
ccucuccccuugccccg

SEQ ID NO: 34706 - RNA, 20 nt, Homo sapiens
ccuuccccccaagucccccc

SEQ ID NO: 34707 - RNA, 18 nt, Homo sapiens
ucccuaccagugucuugu

SEQ ID NO: 34708 - RNA, 19 nt, Homo sapiens
acagaagagucuuguucca

SEQ ID NO: 34709 - RNA, 19 nt, Homo sapiens
aggugaagaggcacuuuca

SEQ ID NO: 34710 - RNA, 17 nt, Homo sapiens
auccuagaaggcuaaca

SEQ ID NO: 34711 - RNA, 18 nt, Homo sapiens
caucggauaaaagaggau

SEQ ID NO: 34712 - RNA, 24 nt, Homo sapiens
gcuugcggcaguacaaugccccca

SEQ ID NO: 34713 - RNA, 21 nt, Homo sapiens
guuagagaggaaaacaucgga

SEQ ID NO: 34714 - RNA, 18 nt, Homo sapiens
guuccucccugcucugca

SEQ ID NO: 34715 - RNA, 21 nt, Homo sapiens
ucacggcaaagagagccaccu

SEQ ID NO: 34716 - RNA, 21 nt, Homo sapiens
cucaccuccccagcggcuccu

SEQ ID NO: 34717 - RNA, 22 nt, Homo sapiens
cgaauuguccgugcucacucca

SEQ ID NO: 34718 - RNA, 22 nt, Homo sapiens
gccgccucagggacuuggagga

SEQ ID NO: 34719 - RNA, 22 nt, Homo sapiens
ucaaacaauauuuaucacacau

SEQ ID NO: 34720 - RNA, 23 nt, Homo sapiens
ccaaccacagguaaaccacaaca

SEQ ID NO: 34721 - RNA, 22 nt, Homo sapiens
gaaggaucagaccaccaccccu

SEQ ID NO: 34722 - RNA, 20 nt, Homo sapiens
gccuugccaccccucugagg

SEQ ID NO: 34723 - RNA, 19 nt, Homo sapiens
ggaugggcugaaggggcug

SEQ ID NO: 34724 - RNA, 26 nt, Homo sapiens
ggccgucccagacccccgcuuccccu

SEQ ID NO: 34725 - RNA, 21 nt, Homo sapiens
ggccuccacaaaggccuggca

SEQ ID NO: 34726 - RNA, 20 nt, Homo sapiens
gucugggcacugacgcagcu

SEQ ID NO: 34727 - RNA, 19 nt, Homo sapiens
ucuggucuuggcgagcucu

SEQ ID NO: 34728 - RNA, 16 nt, Homo sapiens
accaccuccugcuccu

SEQ ID NO: 34729 - RNA, 22 nt, Homo sapiens
caccauccugccaccaccuucu

SEQ ID NO: 34730 - RNA, 16 nt, Homo sapiens
cuuccucuagagcucg

SEQ ID NO: 34731 - RNA, 19 nt, Homo sapiens
gcaagugcuucccagccca

SEQ ID NO: 34732 - RNA, 25 nt, Homo sapiens
ugugggagggugguuacugugggug

SEQ ID NO: 34733 - RNA, 19 nt, Homo sapiens
aagcaauucucccaccuca

SEQ ID NO: 34734 - RNA, 18 nt, Homo sapiens
cugggagaaccagaugau

SEQ ID NO: 34735 - RNA, 17 nt, Homo sapiens
uagccuugaauuccugg

SEQ ID NO: 34736 - RNA, 19 nt, Homo sapiens
gacaacacgaguuugugug

SEQ ID NO: 34737 - RNA, 23 nt, Homo sapiens
ugggguuguugggcagccugcca

SEQ ID NO: 34738 - RNA, 23 nt, Homo sapiens
agccuucuuccaaaagagccaga

SEQ ID NO: 34739 - RNA, 23 nt, Homo sapiens
cucccacuaaaaagcuaacucca

SEQ ID NO: 34740 - RNA, 21 nt, Homo sapiens
ucuugguggagagguugcgga

SEQ ID NO: 34741 - RNA, 18 nt, Homo sapiens
aauuuggauuuuguucca

SEQ ID NO: 34742 - RNA, 21 nt, Homo sapiens
gaauuuuuggugcuguccgga

SEQ ID NO: 34743 - RNA, 23 nt, Homo sapiens
guccagaguguuagcuuagagcu

SEQ ID NO: 34744 - RNA, 19 nt, Homo sapiens
guuucaacauucaaucuaa

SEQ ID NO: 34745 - RNA, 19 nt, Homo sapiens
uaggucuauaaaucaccca

SEQ ID NO: 34746 - RNA, 18 nt, Homo sapiens
ugucugugaagucugaga

SEQ ID NO: 34747 - RNA, 22 nt, Homo sapiens
uucaagugauucucaucucagc

SEQ ID NO: 34748 - RNA, 23 nt, Homo sapiens
aacuuauccauguagauauagca

SEQ ID NO: 34749 - RNA, 18 nt, Homo sapiens
cagaccugugaauucaaa

SEQ ID NO: 34750 - RNA, 22 nt, Homo sapiens
caguuguaauucaguuuaauga

SEQ ID NO: 34751 - RNA, 20 nt, Homo sapiens
cuguucucuuauguguccca

SEQ ID NO: 34752 - RNA, 19 nt, Homo sapiens
gacggcucagcauggacug

SEQ ID NO: 34753 - RNA, 21 nt, Homo sapiens
guguguguaauugcuggacua

SEQ ID NO: 34754 - RNA, 24 nt, Homo sapiens
uucugggaaaaacagaccugugaa

SEQ ID NO: 34755 - RNA, 21 nt, Homo sapiens
acauuuguccacccugagaga

SEQ ID NO: 34756 - RNA, 27 nt, Homo sapiens
cccugugcucagccuggaauuguuaua

SEQ ID NO: 34757 - RNA, 21 nt, Homo sapiens
cuucuccaucugcuuuacuuu

SEQ ID NO: 34758 - RNA, 22 nt, Homo sapiens
guagaaguuguucauugccgaa

SEQ ID NO: 34759 - RNA, 19 nt, Homo sapiens
accagagaugaacccacug

SEQ ID NO: 34760 - RNA, 19 nt, Homo sapiens
cccgaauggccuugugccu

SEQ ID NO: 34761 - RNA, 17 nt, Homo sapiens
cgaauggccuugugccu

SEQ ID NO: 34762 - RNA, 19 nt, Homo sapiens
uuccagaaauacagggucc

SEQ ID NO: 34763 - RNA, 20 nt, Homo sapiens
cuuccuccuccuccuccucu

SEQ ID NO: 34764 - RNA, 22 nt, Homo sapiens
gcgccggccccuucccaugcgg

SEQ ID NO: 34765 - RNA, 20 nt, Homo sapiens
aaauguguugccagacuuaa

SEQ ID NO: 34766 - RNA, 19 nt, Homo sapiens
acguuaugaaaacuaacca

SEQ ID NO: 34767 - RNA, 21 nt, Homo sapiens
gaauuuuucucuuuuucugga

SEQ ID NO: 34768 - RNA, 19 nt, Homo sapiens
uggcucucaacuggaauug

SEQ ID NO: 34769 - RNA, 16 nt, Homo sapiens
uugaguccucugguuu

SEQ ID NO: 34770 - RNA, 23 nt, Homo sapiens
aaaccaaugaagcaaucuauugu

SEQ ID NO: 34771 - RNA, 22 nt, Homo sapiens
aaugucugauuuugaagucaca

SEQ ID NO: 34772 - RNA, 21 nt, Homo sapiens
aauugcaaauaucagauccuu

SEQ ID NO: 34773 - RNA, 17 nt, Homo sapiens
acaccgucagcaaucca

SEQ ID NO: 34774 - RNA, 22 nt, Homo sapiens
agagucacggaaucuguacuga

SEQ ID NO: 34775 - RNA, 20 nt, Homo sapiens
cagaccucccuugcauugaa

SEQ ID NO: 34776 - RNA, 25 nt, Homo sapiens
ccuaaguaacugccaaguuuuuuuu

SEQ ID NO: 34777 - RNA, 22 nt, Homo sapiens
gaaaaugucacagaccaugaua

SEQ ID NO: 34778 - RNA, 20 nt, Homo sapiens
uggguaacagagugagacug

SEQ ID NO: 34779 - RNA, 21 nt, Homo sapiens
aaccaggccacacagcagggg

SEQ ID NO: 34780 - RNA, 21 nt, Homo sapiens
aaucuggaaaaaaauuaccug

SEQ ID NO: 34781 - RNA, 19 nt, Homo sapiens
acuacuuauagauuuuacc

SEQ ID NO: 34782 - RNA, 18 nt, Homo sapiens
caguaccaguccguggca

SEQ ID NO: 34783 - RNA, 16 nt, Homo sapiens
gcaccuacugugugcu

SEQ ID NO: 34784 - RNA, 18 nt, Homo sapiens
uccgccuccuggguucaa

SEQ ID NO: 34785 - RNA, 20 nt, Homo sapiens
uccugagcuccacgccuuca

SEQ ID NO: 34786 - RNA, 22 nt, Homo sapiens
aauuuagaaauuauaucccuaa

SEQ ID NO: 34787 - RNA, 21 nt, Homo sapiens
agcagugucugucacuuucca

SEQ ID NO: 34788 - RNA, 19 nt, Homo sapiens
cuuugugugcugguuuaua

SEQ ID NO: 34789 - RNA, 25 nt, Homo sapiens
ggagagucagggcggcggcugcggc

SEQ ID NO: 34790 - RNA, 20 nt, Homo sapiens
ucccggaacagccuaucuca

SEQ ID NO: 34791 - RNA, 21 nt, Homo sapiens
uguaucaaacagcacaagcag

SEQ ID NO: 34792 - RNA, 24 nt, Homo sapiens
aggaugcucacuuguuccuacuga

SEQ ID NO: 34793 - RNA, 17 nt, Homo sapiens
agucuguuuaauugccu

SEQ ID NO: 34794 - RNA, 16 nt, Homo sapiens
ucaccaccggcacaca

SEQ ID NO: 34795 - RNA, 21 nt, Homo sapiens
aaacccugccccaaugcaccu

SEQ ID NO: 34796 - RNA, 22 nt, Homo sapiens
cagagggugggggaccuggcgg

SEQ ID NO: 34797 - RNA, 17 nt, Homo sapiens
ccagccuugccucauca

SEQ ID NO: 34798 - RNA, 20 nt, Homo sapiens
uggcagggagcacuaccccu

SEQ ID NO: 34799 - RNA, 22 nt, Homo sapiens
aacuugauuuuacauuuauuua

SEQ ID NO: 34800 - RNA, 18 nt, Homo sapiens
cccgcaaccuccgccucc

SEQ ID NO: 34801 - RNA, 19 nt, Homo sapiens
cgcuacaaccuccaccucc

SEQ ID NO: 34802 - RNA, 21 nt, Homo sapiens
cugccugauucuccugccuca

SEQ ID NO: 34803 - RNA, 18 nt, Homo sapiens
cugccuggccaccacccc

SEQ ID NO: 34804 - RNA, 24 nt, Homo sapiens
ggcaugagccaccgcacccggcca

SEQ ID NO: 34805 - RNA, 18 nt, Homo sapiens
uccgccucccggguucaa

SEQ ID NO: 34806 - RNA, 18 nt, Homo sapiens
ugcccggccgccauccca

SEQ ID NO: 34807 - RNA, 24 nt, Homo sapiens
acaugauguuuucacacacauuuu

SEQ ID NO: 34808 - RNA, 17 nt, Homo sapiens
cccagcuccccgcagcu

SEQ ID NO: 34809 - RNA, 23 nt, Homo sapiens
ccccggggccccggcugggguug

SEQ ID NO: 34810 - RNA, 21 nt, Homo sapiens
cccuuccccacuguucacucc

SEQ ID NO: 34811 - RNA, 17 nt, Homo sapiens
ccucugggaggcaggag

SEQ ID NO: 34812 - RNA, 18 nt, Homo sapiens
cugucuuucucugagccu

SEQ ID NO: 34813 - RNA, 18 nt, Homo sapiens
guggcggcgcgcgggcca

SEQ ID NO: 34814 - RNA, 24 nt, Homo sapiens
ucugccaccauggccauugugcag

SEQ ID NO: 34815 - RNA, 20 nt, Homo sapiens
uggaaacugguaugagccug

SEQ ID NO: 34816 - RNA, 22 nt, Homo sapiens
gaugaaaggaacagucugugca

SEQ ID NO: 34817 - RNA, 21 nt, Homo sapiens
guaugugugaguauaaguuga

SEQ ID NO: 34818 - RNA, 21 nt, Homo sapiens
caggauagcuggguccauuca

SEQ ID NO: 34819 - RNA, 19 nt, Homo sapiens
cuaacccucauccagggcu

SEQ ID NO: 34820 - RNA, 17 nt, Homo sapiens
ggcccuggcauaagcug

SEQ ID NO: 34821 - RNA, 23 nt, Homo sapiens
gugugugugggugggugugagug

SEQ ID NO: 34822 - RNA, 24 nt, Homo sapiens
ucuugcuuguccccaaaucaccua

SEQ ID NO: 34823 - RNA, 18 nt, Homo sapiens
uggcauguguuucuugga

SEQ ID NO: 34824 - RNA, 20 nt, Homo sapiens
uguaugggugugugugggug

SEQ ID NO: 34825 - RNA, 16 nt, Homo sapiens
cuccugcacccuuuuu

SEQ ID NO: 34826 - RNA, 19 nt, Homo sapiens
cuuccacucaguuccccca

SEQ ID NO: 34827 - RNA, 18 nt, Homo sapiens
cacguagacaggcuguaa

SEQ ID NO: 34828 - RNA, 20 nt, Homo sapiens
cccaaugaccccccuucagc

SEQ ID NO: 34829 - RNA, 18 nt, Homo sapiens
cuucagccccgggugcca

SEQ ID NO: 34830 - RNA, 19 nt, Homo sapiens
cuucucauugucuuaauuu

SEQ ID NO: 34831 - RNA, 23 nt, Homo sapiens
gcuccucauuccuccccugcccu

SEQ ID NO: 34832 - RNA, 23 nt, Homo sapiens
ggaggaggggagaaggggagaca

SEQ ID NO: 34833 - RNA, 18 nt, Homo sapiens
uuaauuucgcuuugugca

SEQ ID NO: 34834 - RNA, 27 nt, Homo sapiens
ccuccaggauccuuacuaauaaugggc

SEQ ID NO: 34835 - RNA, 17 nt, Homo sapiens
cucuuugcucugccucu

SEQ ID NO: 34836 - RNA, 22 nt, Homo sapiens
acuccagacacugaacuguccu

SEQ ID NO: 34837 - RNA, 21 nt, Homo sapiens
gccugggugaguguugggcuc

SEQ ID NO: 34838 - RNA, 18 nt, Homo sapiens
augcccauuuuuauaugc

SEQ ID NO: 34839 - RNA, 17 nt, Homo sapiens
cauggaaacagcaagca

SEQ ID NO: 34840 - RNA, 22 nt, Homo sapiens
cucucucccucuuucuccucuc

SEQ ID NO: 34841 - RNA, 21 nt, Homo sapiens
cucucucucucuuccucucuc

SEQ ID NO: 34842 - RNA, 20 nt, Homo sapiens
gcgccgcagccgcccccucc

SEQ ID NO: 34843 - RNA, 22 nt, Homo sapiens
uggucuguuuugacagaaacug

SEQ ID NO: 34844 - RNA, 17 nt, Homo sapiens
aaguugcagagauguga

SEQ ID NO: 34845 - RNA, 18 nt, Homo sapiens
gguccacgcgccgucucc

SEQ ID NO: 34846 - RNA, 19 nt, Homo sapiens
auucaguuaauucacuuga

SEQ ID NO: 34847 - RNA, 22 nt, Homo sapiens
cauuugugccccacugaccuga

SEQ ID NO: 34848 - RNA, 19 nt, Homo sapiens
cguggcgcccauccucuga

SEQ ID NO: 34849 - RNA, 20 nt, Homo sapiens
cuauucuucucagacccuca

SEQ ID NO: 34850 - RNA, 16 nt, Homo sapiens
auccugggcccagauc

SEQ ID NO: 34851 - RNA, 20 nt, Homo sapiens
ccugccuucccacauucuga

SEQ ID NO: 34852 - RNA, 18 nt, Homo sapiens
guguuugucuggugucag

SEQ ID NO: 34853 - RNA, 19 nt, Homo sapiens
uucaaaauagcauucccca

SEQ ID NO: 34854 - RNA, 20 nt, Homo sapiens
uucuacagucgucgauuuuu

SEQ ID NO: 34855 - RNA, 22 nt, Homo sapiens
cagagucccagcuccucaguca

SEQ ID NO: 34856 - RNA, 17 nt, Homo sapiens
ccagaaaauugcuucca

SEQ ID NO: 34857 - RNA, 23 nt, Homo sapiens
ccaguccugcuggccugcucuua

SEQ ID NO: 34858 - RNA, 20 nt, Homo sapiens
cuuuuccuagagacuacgcc

SEQ ID NO: 34859 - RNA, 23 nt, Homo sapiens
ucacuuuccucagccaaaggucc

SEQ ID NO: 34860 - RNA, 19 nt, Homo sapiens
cucuuuccccuuugccccu

SEQ ID NO: 34861 - RNA, 22 nt, Homo sapiens
ucccucuguugccaucagcuug

SEQ ID NO: 34862 - RNA, 20 nt, Homo sapiens
ugguggcaaguuucucugga

SEQ ID NO: 34863 - RNA, 16 nt, Homo sapiens
aggaucaugggaccag

SEQ ID NO: 34864 - RNA, 17 nt, Homo sapiens
ucaauguacaaaucagc

SEQ ID NO: 34865 - RNA, 19 nt, Homo sapiens
aacacgagacaaaacaauc

SEQ ID NO: 34866 - RNA, 16 nt, Homo sapiens
cauguuugggggucug

SEQ ID NO: 34867 - RNA, 24 nt, Homo sapiens
ccaaacauggacguccuccccucc

SEQ ID NO: 34868 - RNA, 23 nt, Homo sapiens
ccaggcagcgccccaggaagcca

SEQ ID NO: 34869 - RNA, 18 nt, Homo sapiens
cugcaaagcugugcaggg

SEQ ID NO: 34870 - RNA, 20 nt, Homo sapiens
ugggcaaagcagccacccca

SEQ ID NO: 34871 - RNA, 18 nt, Homo sapiens
uguguaagaauguguuuu

SEQ ID NO: 34872 - RNA, 19 nt, Homo sapiens
aacucuuaacagaugcagu

SEQ ID NO: 34873 - RNA, 19 nt, Homo sapiens
agcaacccuucucaccuua

SEQ ID NO: 34874 - RNA, 22 nt, Homo sapiens
caggaaccccauccuugcuuca

SEQ ID NO: 34875 - RNA, 22 nt, Homo sapiens
cccaccccgucuguguccccca

SEQ ID NO: 34876 - RNA, 19 nt, Homo sapiens
ccucagacacaccauuuca

SEQ ID NO: 34877 - RNA, 22 nt, Homo sapiens
cugugcccccacccccgccucc

SEQ ID NO: 34878 - RNA, 17 nt, Homo sapiens
guacgcagccaccuccu

SEQ ID NO: 34879 - RNA, 19 nt, Homo sapiens
guuuucaucacuagacuca

SEQ ID NO: 34880 - RNA, 18 nt, Homo sapiens
uauuaaaaugucuggcaa

SEQ ID NO: 34881 - RNA, 24 nt, Homo sapiens
uccaaguacauuaugacccccuca

SEQ ID NO: 34882 - RNA, 24 nt, Homo sapiens
uguccagcaacgguaccguuuaca

SEQ ID NO: 34883 - RNA, 19 nt, Homo sapiens
uucagguauuauuuacuuu

SEQ ID NO: 34884 - RNA, 22 nt, Homo sapiens
auccacagccuuacacuaggca

SEQ ID NO: 34885 - RNA, 17 nt, Homo sapiens
caugguuuuuugaccuu

SEQ ID NO: 34886 - RNA, 19 nt, Homo sapiens
caaagccaugccugcuccu

SEQ ID NO: 34887 - RNA, 17 nt, Homo sapiens
cuucaagucucauuuua

SEQ ID NO: 34888 - RNA, 19 nt, Homo sapiens
uccuuuugacguacuuuug

SEQ ID NO: 34889 - RNA, 21 nt, Homo sapiens
ucuugaugaaacaucuucgaa

SEQ ID NO: 34890 - RNA, 18 nt, Homo sapiens
ugcuugcugccauaugug

SEQ ID NO: 34891 - RNA, 18 nt, Homo sapiens
uugacacugaucuggucc

SEQ ID NO: 34892 - RNA, 24 nt, Homo sapiens
aagagaggugucugucuagcccug

SEQ ID NO: 34893 - RNA, 21 nt, Homo sapiens
cgacgagcaggcacuggaaga

SEQ ID NO: 34894 - RNA, 19 nt, Homo sapiens
gugggagggcucaacuuua

SEQ ID NO: 34895 - RNA, 21 nt, Homo sapiens
uaaacauaaaaaaauuagccu

SEQ ID NO: 34896 - RNA, 19 nt, Homo sapiens
caucaaucaucccugucca

SEQ ID NO: 34897 - RNA, 22 nt, Homo sapiens
ccaaggaauaugaagugagaca

SEQ ID NO: 34898 - RNA, 22 nt, Homo sapiens
ggcuccagcagaugaugagaua

SEQ ID NO: 34899 - RNA, 22 nt, Homo sapiens
caaacuguaagaaugcuguugu

SEQ ID NO: 34900 - RNA, 21 nt, Homo sapiens
gcucucuacuaugccuugaug

SEQ ID NO: 34901 - RNA, 18 nt, Homo sapiens
uuaaugaaaguguugcac

SEQ ID NO: 34902 - RNA, 19 nt, Homo sapiens
caauuuauuuuccgcagca

SEQ ID NO: 34903 - RNA, 19 nt, Homo sapiens
ccuauggaaaaugcagcug

SEQ ID NO: 34904 - RNA, 19 nt, Homo sapiens
uuuggcaccacucucugaa

SEQ ID NO: 34905 - RNA, 19 nt, Homo sapiens
cauuguuaguguaaucuca

SEQ ID NO: 34906 - RNA, 16 nt, Homo sapiens
cucuuccuccuccccu

SEQ ID NO: 34907 - RNA, 20 nt, Homo sapiens
ucccucagcccagacucagu

SEQ ID NO: 34908 - RNA, 18 nt, Homo sapiens
uuauuccccuggacuccg

SEQ ID NO: 34909 - RNA, 19 nt, Homo sapiens
uggagcugcagcugggcca

SEQ ID NO: 34910 - RNA, 18 nt, Homo sapiens
aguaagguguuacuccca

SEQ ID NO: 34911 - RNA, 18 nt, Homo sapiens
aucucucagaccagcuca

SEQ ID NO: 34912 - RNA, 20 nt, Homo sapiens
caugguccagccccauuuga

SEQ ID NO: 34913 - RNA, 23 nt, Homo sapiens
ccacgaacaccagcccaaacuga

SEQ ID NO: 34914 - RNA, 17 nt, Homo sapiens
cccacgcccaguuccag

SEQ ID NO: 34915 - RNA, 20 nt, Homo sapiens
cuccaaccugggacauccca

SEQ ID NO: 34916 - RNA, 19 nt, Homo sapiens
gccccggccgggcccagcc

SEQ ID NO: 34917 - RNA, 19 nt, Homo sapiens
gcugauaccaccuaccuca

SEQ ID NO: 34918 - RNA, 19 nt, Homo sapiens
uggguggaucaccugagau

SEQ ID NO: 34919 - RNA, 18 nt, Homo sapiens
uuccagaaaggccuccag

SEQ ID NO: 34920 - RNA, 20 nt, Homo sapiens
cauagaaaauguacacuuca

SEQ ID NO: 34921 - RNA, 18 nt, Homo sapiens
gaauuaacauauaugaug

SEQ ID NO: 34922 - RNA, 18 nt, Homo sapiens
guaaccggaagugcuguc

SEQ ID NO: 34923 - RNA, 17 nt, Homo sapiens
ugcccagagagcugccc

SEQ ID NO: 34924 - RNA, 21 nt, Homo sapiens
acccagagccacacacgcccg

SEQ ID NO: 34925 - RNA, 17 nt, Homo sapiens
gagucagacucuaagaa

SEQ ID NO: 34926 - RNA, 16 nt, Homo sapiens
gugacuccaccaguua

SEQ ID NO: 34927 - RNA, 19 nt, Homo sapiens
agcuaaaaagaucaugaua

SEQ ID NO: 34928 - RNA, 20 nt, Homo sapiens
auguaauguugugauauucc

SEQ ID NO: 34929 - RNA, 18 nt, Homo sapiens
cucauuuugcgaggcuua

SEQ ID NO: 34930 - RNA, 19 nt, Homo sapiens
gcuguuaguuggcuuuuga

SEQ ID NO: 34931 - RNA, 20 nt, Homo sapiens
ggcgauuggcaucgaucucu

SEQ ID NO: 34932 - RNA, 18 nt, Homo sapiens
cugggagaagaccaccug

SEQ ID NO: 34933 - RNA, 23 nt, Homo sapiens
gcaaagagaacuaccucauaugc

SEQ ID NO: 34934 - RNA, 19 nt, Homo sapiens
uuccuuuugauggcugcau

SEQ ID NO: 34935 - RNA, 21 nt, Homo sapiens
agaaaagaaagcaagaacaga

SEQ ID NO: 34936 - RNA, 25 nt, Homo sapiens
agcucccaucacaagcuuggcauug

SEQ ID NO: 34937 - RNA, 22 nt, Homo sapiens
aguucccccucuuucuggguca

SEQ ID NO: 34938 - RNA, 23 nt, Homo sapiens
auagauauauagagauauagaua

SEQ ID NO: 34939 - RNA, 16 nt, Homo sapiens
caccaggguuugggga

SEQ ID NO: 34940 - RNA, 18 nt, Homo sapiens
ccuggugcaggccggugg

SEQ ID NO: 34941 - RNA, 18 nt, Homo sapiens
gccaccaggguuugggga

SEQ ID NO: 34942 - RNA, 20 nt, Homo sapiens
ggaaccugaggagccaccug

SEQ ID NO: 34943 - RNA, 18 nt, Homo sapiens
ucaguuccauuuuaccuc

SEQ ID NO: 34944 - RNA, 21 nt, Homo sapiens
ucccgccuccccucacccuca

SEQ ID NO: 34945 - RNA, 16 nt, Homo sapiens
ugcaaaaccuaccuuc

SEQ ID NO: 34946 - RNA, 18 nt, Homo sapiens
ugcccagaaauuacccca

SEQ ID NO: 34947 - RNA, 21 nt, Homo sapiens
gggcuucgagggauggcggcg

SEQ ID NO: 34948 - RNA, 23 nt, Homo sapiens
ucccagaggaacugacuaaggcu

SEQ ID NO: 34949 - RNA, 24 nt, Homo sapiens
ugaccccagucauccugcagguga

SEQ ID NO: 34950 - RNA, 15 nt, Homo sapiens
uggaaagcuacauca

SEQ ID NO: 34951 - RNA, 18 nt, Homo sapiens
uuuugcccgcguaucuca

SEQ ID NO: 34952 - RNA, 18 nt, Homo sapiens
ggcggcaggagcugggcc

SEQ ID NO: 34953 - RNA, 19 nt, Homo sapiens
gaaaaaauaagugauucaa

SEQ ID NO: 34954 - RNA, 17 nt, Homo sapiens
uauuaaaggauaugcaa

SEQ ID NO: 34955 - RNA, 19 nt, Homo sapiens
accauaugauauuccacuu

SEQ ID NO: 34956 - RNA, 17 nt, Homo sapiens
cugagccugagucauuu

SEQ ID NO: 34957 - RNA, 21 nt, Homo sapiens
uaaauggauuacacuggggcu

SEQ ID NO: 34958 - RNA, 20 nt, Homo sapiens
uuuuguuaugugcaguuuau

SEQ ID NO: 34959 - RNA, 19 nt, Homo sapiens
cuguuuugguccaacccca

SEQ ID NO: 34960 - RNA, 19 nt, Homo sapiens
gcuauggugcagacauucc

SEQ ID NO: 34961 - RNA, 21 nt, Homo sapiens
uucugaugagucucugcuugc

SEQ ID NO: 34962 - RNA, 16 nt, Homo sapiens
ccugcggacagucagg

SEQ ID NO: 34963 - RNA, 20 nt, Homo sapiens
cgcagucaggaauucugaga

SEQ ID NO: 34964 - RNA, 19 nt, Homo sapiens
ggcgcacuucaaaacccuc

SEQ ID NO: 34965 - RNA, 21 nt, Homo sapiens
acuugauagugcuuuuggucc

SEQ ID NO: 34966 - RNA, 20 nt, Homo sapiens
ggcagccagcaaacuugaua

SEQ ID NO: 34967 - RNA, 18 nt, Homo sapiens
ugguccuagaugauuuuu

SEQ ID NO: 34968 - RNA, 22 nt, Homo sapiens
uuauguaaugaaaaacaaauag

SEQ ID NO: 34969 - RNA, 21 nt, Homo sapiens
aguaguugaauuuugcaaagc

SEQ ID NO: 34970 - RNA, 21 nt, Homo sapiens
ccuuggugcgaugucugugag

SEQ ID NO: 34971 - RNA, 21 nt, Homo sapiens
ccuuggugcgaugucugugag

SEQ ID NO: 34972 - RNA, 18 nt, Homo sapiens
cugcagcauccuugugug

SEQ ID NO: 34973 - RNA, 23 nt, Homo sapiens
acaaaaugauggacccaaugcac

SEQ ID NO: 34974 - RNA, 19 nt, Homo sapiens
agcuuccaguccaaucuca

SEQ ID NO: 34975 - RNA, 20 nt, Homo sapiens
caacccuuuugucugccucu

SEQ ID NO: 34976 - RNA, 21 nt, Homo sapiens
caauuuacuugccauuacuca

SEQ ID NO: 34977 - RNA, 19 nt, Homo sapiens
cagggccugagccaagcua

SEQ ID NO: 34978 - RNA, 19 nt, Homo sapiens
gcugugcccaaguuguggu

SEQ ID NO: 34979 - RNA, 17 nt, Homo sapiens
ucaaaugcuuggcuucu

SEQ ID NO: 34980 - RNA, 17 nt, Homo sapiens
ucagacuaguuuaguua

SEQ ID NO: 34981 - RNA, 18 nt, Homo sapiens
uccaaucuaaccacauca

SEQ ID NO: 34982 - RNA, 17 nt, Homo sapiens
ugagcacucccaagucu

SEQ ID NO: 34983 - RNA, 18 nt, Homo sapiens
uugaagucagauguggua

SEQ ID NO: 34984 - RNA, 19 nt, Homo sapiens
agcaccuucucguccacca

SEQ ID NO: 34985 - RNA, 19 nt, Homo sapiens
gccucugucccccaggugu

SEQ ID NO: 34986 - RNA, 20 nt, Homo sapiens
ggagcuucccaccaucuaca

SEQ ID NO: 34987 - RNA, 17 nt, Homo sapiens
aauuccaacaacuccaa

SEQ ID NO: 34988 - RNA, 18 nt, Homo sapiens
caggaggccugggcccag

SEQ ID NO: 34989 - RNA, 22 nt, Homo sapiens
cccugaugacccucccugcgag

SEQ ID NO: 34990 - RNA, 17 nt, Homo sapiens
cugccaggugcuggcca

SEQ ID NO: 34991 - RNA, 18 nt, Homo sapiens
gagcuguguugaaaucca

SEQ ID NO: 34992 - RNA, 17 nt, Homo sapiens
gccuagcauagauuugc

SEQ ID NO: 34993 - RNA, 20 nt, Homo sapiens
ucugcuuuacucucaugugg

SEQ ID NO: 34994 - RNA, 24 nt, Homo sapiens
uuauagcuauuagaauaaaaucuc

SEQ ID NO: 34995 - RNA, 23 nt, Homo sapiens
agcauuuaugaccucuucuauga

SEQ ID NO: 34996 - RNA, 22 nt, Homo sapiens
cccagcuuggccucccgcaaug

SEQ ID NO: 34997 - RNA, 17 nt, Homo sapiens
ucaagugauucuccugc

SEQ ID NO: 34998 - RNA, 20 nt, Homo sapiens
uucaagaccagccugaccaa

SEQ ID NO: 34999 - RNA, 23 nt, Homo sapiens
agcauuuaugaccucuucuauga

SEQ ID NO: 35000 - RNA, 17 nt, Homo sapiens
ucaagugauucuccugc

SEQ ID NO: 35001 - RNA, 18 nt, Homo sapiens
cggagaggaccuccaacc

SEQ ID NO: 35002 - RNA, 23 nt, Homo sapiens
accuggacuuaagcaucuggcuc

SEQ ID NO: 35003 - RNA, 18 nt, Homo sapiens
cagcccuucugaccaccg

SEQ ID NO: 35004 - RNA, 17 nt, Homo sapiens
aggacaccccccacccc

SEQ ID NO: 35005 - RNA, 16 nt, Homo sapiens
auccucuccccucagg

SEQ ID NO: 35006 - RNA, 23 nt, Homo sapiens
ccagaugauuaaacguuguauua

SEQ ID NO: 35007 - RNA, 22 nt, Homo sapiens
cccugcauugaggccuugugga

SEQ ID NO: 35008 - RNA, 16 nt, Homo sapiens
gaacggccacucgaga

SEQ ID NO: 35009 - RNA, 21 nt, Homo sapiens
gaccccgggcuucauccacau

SEQ ID NO: 35010 - RNA, 18 nt, Homo sapiens
acauuugugcuuaaauug

SEQ ID NO: 35011 - RNA, 17 nt, Homo sapiens
agaaacaaacaaacaaa

SEQ ID NO: 35012 - RNA, 21 nt, Homo sapiens
cccaccuccacagccaggaug

SEQ ID NO: 35013 - RNA, 19 nt, Homo sapiens
ccuagaugucaacuccaca

SEQ ID NO: 35014 - RNA, 22 nt, Homo sapiens
agcgaccuuggccucaguucac

SEQ ID NO: 35015 - RNA, 23 nt, Homo sapiens
agggaggcugcuggacccacccc

SEQ ID NO: 35016 - RNA, 20 nt, Homo sapiens
ccaaugcccacuuccccucc

SEQ ID NO: 35017 - RNA, 23 nt, Homo sapiens
cccaaacacugguuugcauccca

SEQ ID NO: 35018 - RNA, 18 nt, Homo sapiens
cugcccacugcacucuuu

SEQ ID NO: 35019 - RNA, 20 nt, Homo sapiens
guuuucuccauggcaggaca

SEQ ID NO: 35020 - RNA, 18 nt, Homo sapiens
aaagugacaaaaacgugu

SEQ ID NO: 35021 - RNA, 19 nt, Homo sapiens
aguagcuacgacugcaagc

SEQ ID NO: 35022 - RNA, 18 nt, Homo sapiens
ccaccuccaccucccaaa

SEQ ID NO: 35023 - RNA, 18 nt, Homo sapiens
ccccacuuagagacaaug

SEQ ID NO: 35024 - RNA, 18 nt, Homo sapiens
ccucccaccuccaccucc

SEQ ID NO: 35025 - RNA, 18 nt, Homo sapiens
cauggugauuuuugcaau

SEQ ID NO: 35026 - RNA, 18 nt, Homo sapiens
cuuuacuuuuaauacagg

SEQ ID NO: 35027 - RNA, 19 nt, Homo sapiens
uugcaaagaguagcuuuuu

SEQ ID NO: 35028 - RNA, 19 nt, Homo sapiens
uuuuguuuugaagaguuga

SEQ ID NO: 35029 - RNA, 21 nt, Homo sapiens
gaagaccagacagauucagag

SEQ ID NO: 35030 - RNA, 19 nt, Homo sapiens
acgagaauguuaccaugca

SEQ ID NO: 35031 - RNA, 20 nt, Homo sapiens
caugucguggcuggcuacaa

SEQ ID NO: 35032 - RNA, 22 nt, Homo sapiens
gauuaagacuuuucacaaaaua

SEQ ID NO: 35033 - RNA, 20 nt, Homo sapiens
uaaauggacuuuggggagac

SEQ ID NO: 35034 - RNA, 22 nt, Homo sapiens
uaggugcccuguucuccuacca

SEQ ID NO: 35035 - RNA, 21 nt, Homo sapiens
ugcucaaaggaaagucagugg

SEQ ID NO: 35036 - RNA, 21 nt, Homo sapiens
ugugcagcuagcuuuguuuua

SEQ ID NO: 35037 - RNA, 16 nt, Homo sapiens
ccaguggccaugugaa

SEQ ID NO: 35038 - RNA, 18 nt, Homo sapiens
gaaagguacuguaggcag

SEQ ID NO: 35039 - RNA, 18 nt, Homo sapiens
ggugauccaccuaccucg

SEQ ID NO: 35040 - RNA, 17 nt, Homo sapiens
caacaacaacugcuaca

SEQ ID NO: 35041 - RNA, 17 nt, Homo sapiens
ccaauaucaauugugug

SEQ ID NO: 35042 - RNA, 21 nt, Homo sapiens
ccccacccacagugcugcacu

SEQ ID NO: 35043 - RNA, 19 nt, Homo sapiens
cccccugcccaccucucca

SEQ ID NO: 35044 - RNA, 25 nt, Homo sapiens
cgcccacccccugcccaccucucca

SEQ ID NO: 35045 - RNA, 17 nt, Homo sapiens
cugugagcccuaccuua

SEQ ID NO: 35046 - RNA, 17 nt, Homo sapiens
cuuaccccucugccccu

SEQ ID NO: 35047 - RNA, 18 nt, Homo sapiens
gcuguugcugcuuggucu

SEQ ID NO: 35048 - RNA, 22 nt, Homo sapiens
gcuuggagugcugcugccuggc

SEQ ID NO: 35049 - RNA, 21 nt, Homo sapiens
ucugggcugcuaaccuggccu

SEQ ID NO: 35050 - RNA, 20 nt, Homo sapiens
ugaggguggugggccugcgg

SEQ ID NO: 35051 - RNA, 20 nt, Homo sapiens
uagguggaaaacauggaauu

SEQ ID NO: 35052 - RNA, 18 nt, Homo sapiens
uugugguuuuugccauug

SEQ ID NO: 35053 - RNA, 18 nt, Homo sapiens
gcuguggccagggcccca

SEQ ID NO: 35054 - RNA, 22 nt, Homo sapiens
uagaugcccugguguagggcug

SEQ ID NO: 35055 - RNA, 17 nt, Homo sapiens
aucuuggcuucuggccc

SEQ ID NO: 35056 - RNA, 18 nt, Homo sapiens
auggaaauagcauaucua

SEQ ID NO: 35057 - RNA, 20 nt, Homo sapiens
cuggguaaaaugacuauuga

SEQ ID NO: 35058 - RNA, 19 nt, Homo sapiens
gauugcuuuguaaauguuu

SEQ ID NO: 35059 - RNA, 21 nt, Homo sapiens
aaguaucuuguaucgacuaca

SEQ ID NO: 35060 - RNA, 21 nt, Homo sapiens
caaaauacacaacuuuuagca

SEQ ID NO: 35061 - RNA, 22 nt, Homo sapiens
ccuugguggcggaauggcguug

SEQ ID NO: 35062 - RNA, 20 nt, Homo sapiens
cuccccuaaaccccacccca

SEQ ID NO: 35063 - RNA, 21 nt, Homo sapiens
cucuagcaaacauguaguuua

SEQ ID NO: 35064 - RNA, 18 nt, Homo sapiens
cucucugaguauuuagcu

SEQ ID NO: 35065 - RNA, 17 nt, Homo sapiens
cugggucccucccacaa

SEQ ID NO: 35066 - RNA, 24 nt, Homo sapiens
cuuaggugauaaggaaucauuuuu

SEQ ID NO: 35067 - RNA, 20 nt, Homo sapiens
guccuuuaaaaaauggagga

SEQ ID NO: 35068 - RNA, 23 nt, Homo sapiens
ucugaguaguuguccaucacuuu

SEQ ID NO: 35069 - RNA, 21 nt, Homo sapiens
uugugguggaaggugaaaggc

SEQ ID NO: 35070 - RNA, 19 nt, Homo sapiens
acauuuaauaaaaugaggg

SEQ ID NO: 35071 - RNA, 20 nt, Homo sapiens
accaaggauccaucugggcu

SEQ ID NO: 35072 - RNA, 24 nt, Homo sapiens
agcacacuauaauauagugaacug

SEQ ID NO: 35073 - RNA, 24 nt, Homo sapiens
caaggaaagaaaauuuuuucuaca

SEQ ID NO: 35074 - RNA, 19 nt, Homo sapiens
ccucaccaccuucccucca

SEQ ID NO: 35075 - RNA, 23 nt, Homo sapiens
gcuuuuugccugaugccauuuua

SEQ ID NO: 35076 - RNA, 18 nt, Homo sapiens
ucaugguuguaaaccaaa

SEQ ID NO: 35077 - RNA, 17 nt, Homo sapiens
cucuccgccucugccuc

SEQ ID NO: 35078 - RNA, 17 nt, Homo sapiens
cucuccgccucugccuc

SEQ ID NO: 35079 - RNA, 20 nt, Homo sapiens
acagacacucaaacucccaa

SEQ ID NO: 35080 - RNA, 17 nt, Homo sapiens
cccgcccugccccagcu

SEQ ID NO: 35081 - RNA, 20 nt, Homo sapiens
ucacccaugcucaggccauu

SEQ ID NO: 35082 - RNA, 17 nt, Homo sapiens
ugcucaggccauuccag

SEQ ID NO: 35083 - RNA, 21 nt, Homo sapiens
ccauuuuccagcagcgcucga

SEQ ID NO: 35084 - RNA, 20 nt, Homo sapiens
gguuacaaggauuugcaaua

SEQ ID NO: 35085 - RNA, 21 nt, Homo sapiens
guauucuuguucacuugauua

SEQ ID NO: 35086 - RNA, 20 nt, Homo sapiens
ccaccuccgccuccaccucc

SEQ ID NO: 35087 - RNA, 20 nt, Homo sapiens
ccgauuccaccuccgccucc

SEQ ID NO: 35088 - RNA, 17 nt, Homo sapiens
ccugccccgcccacuuu

SEQ ID NO: 35089 - RNA, 18 nt, Homo sapiens
ggccagacaaccucaggg

SEQ ID NO: 35090 - RNA, 21 nt, Homo sapiens
uaccagcgucuccuucgggua

SEQ ID NO: 35091 - RNA, 27 nt, Homo sapiens
ucccagagcgccccgagggggcagcga

SEQ ID NO: 35092 - RNA, 19 nt, Homo sapiens
ugcccaaggccaaccuccu

SEQ ID NO: 35093 - RNA, 21 nt, Homo sapiens
aaaaugcacagaaaccauugg

SEQ ID NO: 35094 - RNA, 19 nt, Homo sapiens
uggcugcccaacguggagc

SEQ ID NO: 35095 - RNA, 20 nt, Homo sapiens
aaaaacgaauaagcaaagaa

SEQ ID NO: 35096 - RNA, 19 nt, Homo sapiens
gcaaauacaggugcauuua

SEQ ID NO: 35097 - RNA, 16 nt, Homo sapiens
uaugaauuguucaucg

SEQ ID NO: 35098 - RNA, 17 nt, Homo sapiens
ugacagucaccacgagg

SEQ ID NO: 35099 - RNA, 19 nt, Homo sapiens
gauuacuuuucacaaaaua

SEQ ID NO: 35100 - RNA, 19 nt, Homo sapiens
aaugagauucuaacuagga

SEQ ID NO: 35101 - RNA, 18 nt, Homo sapiens
caacaacuuuacuugccu

SEQ ID NO: 35102 - RNA, 21 nt, Homo sapiens
ccauauuuguuuaauuguauu

SEQ ID NO: 35103 - RNA, 20 nt, Homo sapiens
gaggcagaagaaucacuuca

SEQ ID NO: 35104 - RNA, 25 nt, Homo sapiens
aaaauaccacuguacuuguuuuaca

SEQ ID NO: 35105 - RNA, 22 nt, Homo sapiens
ucagcacauguugaguuuucua

SEQ ID NO: 35106 - RNA, 25 nt, Homo sapiens
cccaucacagccacaccacauccca

SEQ ID NO: 35107 - RNA, 25 nt, Homo sapiens
cccaucacagccacaccacauccca

SEQ ID NO: 35108 - RNA, 18 nt, Homo sapiens
ggacgggcugggcccagu

SEQ ID NO: 35109 - RNA, 20 nt, Homo sapiens
aggcccacuccagccugaga

SEQ ID NO: 35110 - RNA, 21 nt, Homo sapiens
auguucacacaugcacacuca

SEQ ID NO: 35111 - RNA, 21 nt, Homo sapiens
ccugcugacaucuaccugcca

SEQ ID NO: 35112 - RNA, 21 nt, Homo sapiens
gagguuggcaucccccauccc

SEQ ID NO: 35113 - RNA, 22 nt, Homo sapiens
ggaggaggaagccagcagcaca

SEQ ID NO: 35114 - RNA, 20 nt, Homo sapiens
gggcccuuggugugcucaca

SEQ ID NO: 35115 - RNA, 19 nt, Homo sapiens
ggggacaggucggcugugg

SEQ ID NO: 35116 - RNA, 17 nt, Homo sapiens
gugcagcucuggucugc

SEQ ID NO: 35117 - RNA, 18 nt, Homo sapiens
uccgccucccggguucaa

SEQ ID NO: 35118 - RNA, 24 nt, Homo sapiens
aucagauagcaauagaccucuaga

SEQ ID NO: 35119 - RNA, 18 nt, Homo sapiens
caccaugauuguaaguuc

SEQ ID NO: 35120 - RNA, 24 nt, Homo sapiens
cauguacuauuaaugaaaauguua

SEQ ID NO: 35121 - RNA, 22 nt, Homo sapiens
agauggaguuauaacugucaua

SEQ ID NO: 35122 - RNA, 20 nt, Homo sapiens
agucucacucugucgcccag

SEQ ID NO: 35123 - RNA, 21 nt, Homo sapiens
auuaauuuacagacauuugaa

SEQ ID NO: 35124 - RNA, 18 nt, Homo sapiens
cagaaugcgggaagccgc

SEQ ID NO: 35125 - RNA, 19 nt, Homo sapiens
cccagaaauauacccugac

SEQ ID NO: 35126 - RNA, 18 nt, Homo sapiens
ccugcaaccuccaccucc

SEQ ID NO: 35127 - RNA, 19 nt, Homo sapiens
cugcaaccuccaccuccca

SEQ ID NO: 35128 - RNA, 18 nt, Homo sapiens
uccaccucccagguucaa

SEQ ID NO: 35129 - RNA, 18 nt, Homo sapiens
uucaagcgauucucaugc

SEQ ID NO: 35130 - RNA, 17 nt, Homo sapiens
auguuggguuuccugau

SEQ ID NO: 35131 - RNA, 21 nt, Homo sapiens
caugauuucuuuuggucaauc

SEQ ID NO: 35132 - RNA, 22 nt, Homo sapiens
cccccaaacuuaucagaauccu

SEQ ID NO: 35133 - RNA, 20 nt, Homo sapiens
aacugcuaaaauaccucugu

SEQ ID NO: 35134 - RNA, 19 nt, Homo sapiens
acuguaauguuacaugcac

SEQ ID NO: 35135 - RNA, 18 nt, Homo sapiens
cugaguuauuuguacaga

SEQ ID NO: 35136 - RNA, 22 nt, Homo sapiens
gucauggaauacaaccuuuaga

SEQ ID NO: 35137 - RNA, 19 nt, Homo sapiens
gugagagcuguuuuguuuu

SEQ ID NO: 35138 - RNA, 19 nt, Homo sapiens
uaaguaaaauuuauuucac

SEQ ID NO: 35139 - RNA, 15 nt, Homo sapiens
uauuaagaaaacucc

SEQ ID NO: 35140 - RNA, 17 nt, Homo sapiens
ucuuugcaaacaguguu

SEQ ID NO: 35141 - RNA, 22 nt, Homo sapiens
acaauaauuaauaauuguucaa

SEQ ID NO: 35142 - RNA, 21 nt, Homo sapiens
uaugugcauguuugauauuuu

SEQ ID NO: 35143 - RNA, 19 nt, Homo sapiens
uauuaucuuccugugcugu

SEQ ID NO: 35144 - RNA, 19 nt, Homo sapiens
ugaaaacaaaaucaguuuu

SEQ ID NO: 35145 - RNA, 19 nt, Homo sapiens
caagucccuagcucccuca

SEQ ID NO: 35146 - RNA, 18 nt, Homo sapiens
ccucuaauaagacaucgg

SEQ ID NO: 35147 - RNA, 19 nt, Homo sapiens
gccucuggcccaggaguua

SEQ ID NO: 35148 - RNA, 22 nt, Homo sapiens
ggcccgcggguaaccaccuccu

SEQ ID NO: 35149 - RNA, 21 nt, Homo sapiens
ugaagagcagagcuuaccuca

SEQ ID NO: 35150 - RNA, 22 nt, Homo sapiens
agaccauccuggaugcccagga

SEQ ID NO: 35151 - RNA, 18 nt, Homo sapiens
cggcagcagcagcagcac

SEQ ID NO: 35152 - RNA, 22 nt, Homo sapiens
uuaccagcaugaaguucaccua

SEQ ID NO: 35153 - RNA, 20 nt, Homo sapiens
ggccagugcgacggcaaauc

SEQ ID NO: 35154 - RNA, 16 nt, Homo sapiens
cccagcccuguuccag

SEQ ID NO: 35155 - RNA, 20 nt, Homo sapiens
cucuccuuccuucuuauuga

SEQ ID NO: 35156 - RNA, 17 nt, Homo sapiens
cccaaaucgucauggaa

SEQ ID NO: 35157 - RNA, 20 nt, Homo sapiens
cucuucuacccucccccucu

SEQ ID NO: 35158 - RNA, 22 nt, Homo sapiens
gaguacaccguucacuauugua

SEQ ID NO: 35159 - RNA, 19 nt, Homo sapiens
ggacagccagcuccgcccu

SEQ ID NO: 35160 - RNA, 22 nt, Homo sapiens
acggcaccacagaagccuggca

SEQ ID NO: 35161 - RNA, 28 nt, Homo sapiens
agaggaccaguauuuucauuuccauaaa

SEQ ID NO: 35162 - RNA, 18 nt, Homo sapiens
aucugcuccuuaucucca

SEQ ID NO: 35163 - RNA, 21 nt, Homo sapiens
ccaaggggagacauugcucca

SEQ ID NO: 35164 - RNA, 17 nt, Homo sapiens
ccaggccacccccacca

SEQ ID NO: 35165 - RNA, 21 nt, Homo sapiens
cuccuuaaauuuaucuucaca

SEQ ID NO: 35166 - RNA, 22 nt, Homo sapiens
gagaaguaagacagagaagccg

SEQ ID NO: 35167 - RNA, 22 nt, Homo sapiens
uccagaagggguucaccuuaaa

SEQ ID NO: 35168 - RNA, 19 nt, Homo sapiens
acuguccgaccccugcaca

SEQ ID NO: 35169 - RNA, 19 nt, Homo sapiens
cuuaacaucuguccugaug

SEQ ID NO: 35170 - RNA, 18 nt, Homo sapiens
gcggugaagaucugugga

SEQ ID NO: 35171 - RNA, 20 nt, Homo sapiens
gugagcaugaucgcgacacu

SEQ ID NO: 35172 - RNA, 16 nt, Homo sapiens
guuuuaggucuuguca

SEQ ID NO: 35173 - RNA, 19 nt, Homo sapiens
uccuuccacagccgcaucu

SEQ ID NO: 35174 - RNA, 18 nt, Homo sapiens
ugcucaaggcaauuucca

SEQ ID NO: 35175 - RNA, 18 nt, Homo sapiens
gcauuaaucuugcaguuu

SEQ ID NO: 35176 - RNA, 22 nt, Homo sapiens
gcugcuucuguuuuuucauuaa

SEQ ID NO: 35177 - RNA, 26 nt, Homo sapiens
auggaacagugucucagcuggaacug

SEQ ID NO: 35178 - RNA, 19 nt, Homo sapiens
caucugucuggcucaugag

SEQ ID NO: 35179 - RNA, 20 nt, Homo sapiens
cuuuuggggaccacugccca

SEQ ID NO: 35180 - RNA, 18 nt, Homo sapiens
aaaaaagcaaacgaagaa

SEQ ID NO: 35181 - RNA, 21 nt, Homo sapiens
aacuagaaccagcacacgaaa

SEQ ID NO: 35182 - RNA, 16 nt, Homo sapiens
aagaacgcugaaccca

SEQ ID NO: 35183 - RNA, 18 nt, Homo sapiens
acaccgcaacagaaugau

SEQ ID NO: 35184 - RNA, 18 nt, Homo sapiens
ccagaaaaugccauguua

SEQ ID NO: 35185 - RNA, 20 nt, Homo sapiens
ggaggugucagugauugcca

SEQ ID NO: 35186 - RNA, 21 nt, Homo sapiens
guugaaucggggccuuuguuc

SEQ ID NO: 35187 - RNA, 19 nt, Homo sapiens
uaugauugugccacugcac

SEQ ID NO: 35188 - RNA, 16 nt, Homo sapiens
ugaucguaacacauuc

SEQ ID NO: 35189 - RNA, 22 nt, Homo sapiens
uuuaggcuucacaaauuauuuu

SEQ ID NO: 35190 - RNA, 17 nt, Homo sapiens
cucagcgccgccgacac

SEQ ID NO: 35191 - RNA, 20 nt, Homo sapiens
acagugacauccucucccuc

SEQ ID NO: 35192 - RNA, 23 nt, Homo sapiens
aucugggcucagguguauggccc

SEQ ID NO: 35193 - RNA, 19 nt, Homo sapiens
ccauuaugaaaaacacagc

SEQ ID NO: 35194 - RNA, 20 nt, Homo sapiens
ccugccccaacccccgucca

SEQ ID NO: 35195 - RNA, 20 nt, Homo sapiens
cgucccccaggauugaucca

SEQ ID NO: 35196 - RNA, 18 nt, Homo sapiens
cucuuucagccauccuga

SEQ ID NO: 35197 - RNA, 19 nt, Homo sapiens
cuuuuugguugagaaagga

SEQ ID NO: 35198 - RNA, 17 nt, Homo sapiens
gcagucagcugcuguua

SEQ ID NO: 35199 - RNA, 18 nt, Homo sapiens
ucaccauuccccucacaa

SEQ ID NO: 35200 - RNA, 20 nt, Homo sapiens
uccuggagauccuaaugggc

SEQ ID NO: 35201 - RNA, 23 nt, Homo sapiens
uccuuccuaaguacucaucaaau

SEQ ID NO: 35202 - RNA, 20 nt, Homo sapiens
ugaaaucaccauuccccuca

SEQ ID NO: 35203 - RNA, 18 nt, Homo sapiens
ugagcccagccuucccca

SEQ ID NO: 35204 - RNA, 18 nt, Homo sapiens
ugagccuucuuggcccca

SEQ ID NO: 35205 - RNA, 19 nt, Homo sapiens
uugagcaagggccccuaga

SEQ ID NO: 35206 - RNA, 20 nt, Homo sapiens
auccaccacuguaauaucau

SEQ ID NO: 35207 - RNA, 20 nt, Homo sapiens
caccucagccuccugaacag

SEQ ID NO: 35208 - RNA, 22 nt, Homo sapiens
caucgagacauuaaaucucaga

SEQ ID NO: 35209 - RNA, 21 nt, Homo sapiens
ccugugcuccaccucccucca

SEQ ID NO: 35210 - RNA, 23 nt, Homo sapiens
guuuguacagauauguuuggccc

SEQ ID NO: 35211 - RNA, 19 nt, Homo sapiens
uauuucuuuucuuccauug

SEQ ID NO: 35212 - RNA, 23 nt, Homo sapiens
uggucuugaacuccuggguucaa

SEQ ID NO: 35213 - RNA, 22 nt, Homo sapiens
agcccccaaacugcauauaaua

SEQ ID NO: 35214 - RNA, 18 nt, Homo sapiens
aguaagauguuacuuuca

SEQ ID NO: 35215 - RNA, 18 nt, Homo sapiens
augcuaccuuuuuuguua

SEQ ID NO: 35216 - RNA, 18 nt, Homo sapiens
ccaacaagagacuuggca

SEQ ID NO: 35217 - RNA, 19 nt, Homo sapiens
uuaaaacauagggugagua

SEQ ID NO: 35218 - RNA, 22 nt, Homo sapiens
uuuuuucauggucccuugcuuu

SEQ ID NO: 35219 - RNA, 24 nt, Homo sapiens
uuuuuuguuaacaagacacugacu

SEQ ID NO: 35220 - RNA, 20 nt, Homo sapiens
cucugaaccagaagucauca

SEQ ID NO: 35221 - RNA, 17 nt, Homo sapiens
gcccaguggcuuuaaac

SEQ ID NO: 35222 - RNA, 19 nt, Homo sapiens
ugcaaggugcugccuaacu

SEQ ID NO: 35223 - RNA, 18 nt, Homo sapiens
ggugcccgagugaucuga

SEQ ID NO: 35224 - RNA, 24 nt, Homo sapiens
uccucaucuuggaggguuugggga

SEQ ID NO: 35225 - RNA, 19 nt, Homo sapiens
ucuuccuugcacuccuuga

SEQ ID NO: 35226 - RNA, 21 nt, Homo sapiens
uuaaacccccaccacuccccg

SEQ ID NO: 35227 - RNA, 25 nt, Homo sapiens
uuucuuccuugcacuccuugaucuu

SEQ ID NO: 35228 - RNA, 19 nt, Homo sapiens
aacagaaaaaagguauuga

SEQ ID NO: 35229 - RNA, 23 nt, Homo sapiens
caaauuuccuuaggauuauagua

SEQ ID NO: 35230 - RNA, 26 nt, Homo sapiens
gaaaguguauuuuugguaugaagcug

SEQ ID NO: 35231 - RNA, 16 nt, Homo sapiens
uggacacauuaucuua

SEQ ID NO: 35232 - RNA, 22 nt, Homo sapiens
aauacagacuguuuguuuacca

SEQ ID NO: 35233 - RNA, 22 nt, Homo sapiens
gcagcuuugagggggaacaguu

SEQ ID NO: 35234 - RNA, 21 nt, Homo sapiens
ucuguaucauacauugcuuuu

SEQ ID NO: 35235 - RNA, 23 nt, Homo sapiens
ggugggccaggcagcgcaccgca

SEQ ID NO: 35236 - RNA, 25 nt, Homo sapiens
guuugggucuuuugugccguggcuc

SEQ ID NO: 35237 - RNA, 21 nt, Homo sapiens
aaauagcuuauggcccugugc

SEQ ID NO: 35238 - RNA, 18 nt, Homo sapiens
gcaucugccccggugaag

SEQ ID NO: 35239 - RNA, 17 nt, Homo sapiens
ucagcgggagucaccua

SEQ ID NO: 35240 - RNA, 21 nt, Homo sapiens
aaaagguagaacuuggaugau

SEQ ID NO: 35241 - RNA, 20 nt, Homo sapiens
cauagacaacuagagcagcu

SEQ ID NO: 35242 - RNA, 20 nt, Homo sapiens
ccacagccauagacaacuag

SEQ ID NO: 35243 - RNA, 20 nt, Homo sapiens
acaaaauugcaccuuguguc

SEQ ID NO: 35244 - RNA, 18 nt, Homo sapiens
cauguacuguugaugagg

SEQ ID NO: 35245 - RNA, 19 nt, Homo sapiens
ccuuagucuccuuacucuu

SEQ ID NO: 35246 - RNA, 17 nt, Homo sapiens
cucauuuugucugucau

SEQ ID NO: 35247 - RNA, 22 nt, Homo sapiens
cucuaauuucuauuacauguaa

SEQ ID NO: 35248 - RNA, 23 nt, Homo sapiens
ucuuuuuguggcaaaagaaacuu

SEQ ID NO: 35249 - RNA, 19 nt, Homo sapiens
ugagcaugugucccacagc

SEQ ID NO: 35250 - RNA, 21 nt, Homo sapiens
uuucagucacauugcauugua

SEQ ID NO: 35251 - RNA, 21 nt, Homo sapiens
uuucucaauauuguuuuggcu

SEQ ID NO: 35252 - RNA, 23 nt, Homo sapiens
accugggaaauuugauuugguuu

SEQ ID NO: 35253 - RNA, 22 nt, Homo sapiens
caaugcuugaugucaucaagca

SEQ ID NO: 35254 - RNA, 19 nt, Homo sapiens
cccgccgccagcuacccgg

SEQ ID NO: 35255 - RNA, 24 nt, Homo sapiens
cccuggcgaagcuggugcugugag

SEQ ID NO: 35256 - RNA, 18 nt, Homo sapiens
cugccuugucugccccca

SEQ ID NO: 35257 - RNA, 23 nt, Homo sapiens
gccuggaaccagacuguuugcuu

SEQ ID NO: 35258 - RNA, 22 nt, Homo sapiens
gcuauugcuguaccuuguguua

SEQ ID NO: 35259 - RNA, 16 nt, Homo sapiens
guggauugauuugauu

SEQ ID NO: 35260 - RNA, 20 nt, Homo sapiens
gugucucggccaaggcgagc

SEQ ID NO: 35261 - RNA, 18 nt, Homo sapiens
ugagugauguuucccaua

SEQ ID NO: 35262 - RNA, 19 nt, Homo sapiens
uguguuuuaacaggggcug

SEQ ID NO: 35263 - RNA, 20 nt, Homo sapiens
uuucccauacaacucaggga

SEQ ID NO: 35264 - RNA, 21 nt, Homo sapiens
acccacauuccccaaucaaua

SEQ ID NO: 35265 - RNA, 23 nt, Homo sapiens
ccagaacaaguucugugugccuc

SEQ ID NO: 35266 - RNA, 17 nt, Homo sapiens
cuucaccuacugacaug

SEQ ID NO: 35267 - RNA, 19 nt, Homo sapiens
gaccagaacacgagccccu

SEQ ID NO: 35268 - RNA, 25 nt, Homo sapiens
gccauuaaggaaugaacucuuucaa

SEQ ID NO: 35269 - RNA, 23 nt, Homo sapiens
gccugacugccaagccaccugca

SEQ ID NO: 35270 - RNA, 22 nt, Homo sapiens
ucccaaucucccauuuuuacca

SEQ ID NO: 35271 - RNA, 18 nt, Homo sapiens
caauuuuucugagagaag

SEQ ID NO: 35272 - RNA, 22 nt, Homo sapiens
aaaauagcuacagguaacccuu

SEQ ID NO: 35273 - RNA, 19 nt, Homo sapiens
aguguguaaaaaucaauca

SEQ ID NO: 35274 - RNA, 25 nt, Homo sapiens
ccugggggugcgcccaagucacuuu

SEQ ID NO: 35275 - RNA, 22 nt, Homo sapiens
gcacgggccgccucugcucucc

SEQ ID NO: 35276 - RNA, 17 nt, Homo sapiens
ggcgaucugcccaccuc

SEQ ID NO: 35277 - RNA, 19 nt, Homo sapiens
gucuuggcuggguuuguca

SEQ ID NO: 35278 - RNA, 21 nt, Homo sapiens
ugugggaguaaauugaaggug

SEQ ID NO: 35279 - RNA, 19 nt, Homo sapiens
uuccagaaauaaccaccag

SEQ ID NO: 35280 - RNA, 22 nt, Homo sapiens
uuuugauccaaaggaucugugg

SEQ ID NO: 35281 - RNA, 27 nt, Homo sapiens
agaauaggagcaagccagcacuaguca

SEQ ID NO: 35282 - RNA, 21 nt, Homo sapiens
ucagcuaacuaagugacucaa

SEQ ID NO: 35283 - RNA, 23 nt, Homo sapiens
agaaaaaagaaaggaaucugaca

SEQ ID NO: 35284 - RNA, 21 nt, Homo sapiens
aacaaguuuuguguuugcugu

SEQ ID NO: 35285 - RNA, 23 nt, Homo sapiens
agcgcauuuaagggguuuuuguu

SEQ ID NO: 35286 - RNA, 20 nt, Homo sapiens
uccuuuucacuccgaaucgc

SEQ ID NO: 35287 - RNA, 21 nt, Homo sapiens
aucugcaucugcugaccucaa

SEQ ID NO: 35288 - RNA, 22 nt, Homo sapiens
cucucuccuuccccaguguaca

SEQ ID NO: 35289 - RNA, 24 nt, Homo sapiens
cuuggguaauccacuagggcuuuu

SEQ ID NO: 35290 - RNA, 23 nt, Homo sapiens
cuuuuguuacuguccuuaauuuu

SEQ ID NO: 35291 - RNA, 19 nt, Homo sapiens
uccccuuggacucaacuua

SEQ ID NO: 35292 - RNA, 19 nt, Homo sapiens
ucuggccacagagcugcag

SEQ ID NO: 35293 - RNA, 20 nt, Homo sapiens
ugagauuuuguugaaguuca

SEQ ID NO: 35294 - RNA, 22 nt, Homo sapiens
uucacagaacuuugcagcaguu

SEQ ID NO: 35295 - RNA, 27 nt, Homo sapiens
augucacuucagaaacuuccugcccua

SEQ ID NO: 35296 - RNA, 18 nt, Homo sapiens
ugcagcugcaccuaagca

SEQ ID NO: 35297 - RNA, 23 nt, Homo sapiens
gcaccacguguuuagacacagca

SEQ ID NO: 35298 - RNA, 21 nt, Homo sapiens
ggcgacggcgacggcgacggc

SEQ ID NO: 35299 - RNA, 20 nt, Homo sapiens
ucucuccgccuuccucugcc

SEQ ID NO: 35300 - RNA, 19 nt, Homo sapiens
acacagcggccccaccuca

SEQ ID NO: 35301 - RNA, 26 nt, Homo sapiens
augggguuucccuggauguggggcug

SEQ ID NO: 35302 - RNA, 17 nt, Homo sapiens
gccuucuugcggacggu

SEQ ID NO: 35303 - RNA, 25 nt, Homo sapiens
gcuugggagcccaucguccuggcuc

SEQ ID NO: 35304 - RNA, 23 nt, Homo sapiens
cgcgugugguccuugcgccgcug

SEQ ID NO: 35305 - RNA, 18 nt, Homo sapiens
agaggaacaggccuuggg

SEQ ID NO: 35306 - RNA, 22 nt, Homo sapiens
agcuggggggcagugcugucca

SEQ ID NO: 35307 - RNA, 17 nt, Homo sapiens
cagcugguaguccauca

SEQ ID NO: 35308 - RNA, 20 nt, Homo sapiens
cccagaccccugaccacccc

SEQ ID NO: 35309 - RNA, 21 nt, Homo sapiens
gaauaacacuguugcuuccug

SEQ ID NO: 35310 - RNA, 22 nt, Homo sapiens
gcaccugccccaccugcccaca

SEQ ID NO: 35311 - RNA, 19 nt, Homo sapiens
ggcccccagccugagacug

SEQ ID NO: 35312 - RNA, 20 nt, Homo sapiens
gugucugguuugcuuggcug

SEQ ID NO: 35313 - RNA, 26 nt, Homo sapiens
ucgcccuuauuuccacccucaccucc

SEQ ID NO: 35314 - RNA, 19 nt, Homo sapiens
ugaugggaagaugagauua

SEQ ID NO: 35315 - RNA, 22 nt, Homo sapiens
uugacaaugaauaaagggcacg

SEQ ID NO: 35316 - RNA, 19 nt, Homo sapiens
uuuugggaucaggugccug

SEQ ID NO: 35317 - RNA, 18 nt, Homo sapiens
cucuccuuccccgcucug

SEQ ID NO: 35318 - RNA, 18 nt, Homo sapiens
gaauaugaaauauuugca

SEQ ID NO: 35319 - RNA, 20 nt, Homo sapiens
agugaguaaaccacacuucc

SEQ ID NO: 35320 - RNA, 18 nt, Homo sapiens
augugaauacuauauucc

SEQ ID NO: 35321 - RNA, 19 nt, Homo sapiens
ccggccccgggcccagcuu

SEQ ID NO: 35322 - RNA, 22 nt, Homo sapiens
uacuuuuuuaugaguuaugaua

SEQ ID NO: 35323 - RNA, 21 nt, Homo sapiens
ccaucuagacuccaucucaaa

SEQ ID NO: 35324 - RNA, 22 nt, Homo sapiens
cccgugggcuccggcgugaggc

SEQ ID NO: 35325 - RNA, 19 nt, Homo sapiens
gcagcugucgggacgugac

SEQ ID NO: 35326 - RNA, 20 nt, Homo sapiens
uccugaacuucucccauuaa

SEQ ID NO: 35327 - RNA, 23 nt, Homo sapiens
uguaggaaauaaaagugaugaua

SEQ ID NO: 35328 - RNA, 19 nt, Homo sapiens
aguugauaaaaauuguuga

SEQ ID NO: 35329 - RNA, 27 nt, Homo sapiens
aucauauacguaaguauaguuccucaa

SEQ ID NO: 35330 - RNA, 23 nt, Homo sapiens
gacacucucugaugccugagaga

SEQ ID NO: 35331 - RNA, 17 nt, Homo sapiens
ggguaauuuuuguaaga

SEQ ID NO: 35332 - RNA, 18 nt, Homo sapiens
gugaaauagaaaauguca

SEQ ID NO: 35333 - RNA, 17 nt, Homo sapiens
uaucccaacaugccugg

SEQ ID NO: 35334 - RNA, 16 nt, Homo sapiens
ucuccugggaugcuca

SEQ ID NO: 35335 - RNA, 17 nt, Homo sapiens
aacaccagaaggugugg

SEQ ID NO: 35336 - RNA, 17 nt, Homo sapiens
aauuuucuaucaaaugg

SEQ ID NO: 35337 - RNA, 25 nt, Homo sapiens
gaagaaauugacucuugcaguuuuu

SEQ ID NO: 35338 - RNA, 17 nt, Homo sapiens
acaggaagggcauuaca

SEQ ID NO: 35339 - RNA, 21 nt, Homo sapiens
agccagggaggugguagccca

SEQ ID NO: 35340 - RNA, 19 nt, Homo sapiens
guuugcaacugauagcuca

SEQ ID NO: 35341 - RNA, 20 nt, Homo sapiens
uaguucuacaaaaaucagcu

SEQ ID NO: 35342 - RNA, 17 nt, Homo sapiens
gaaccugcuaaggccau

SEQ ID NO: 35343 - RNA, 18 nt, Homo sapiens
acugaaauguacuagcug

SEQ ID NO: 35344 - RNA, 20 nt, Homo sapiens
gugguacccacacaucagca

SEQ ID NO: 35345 - RNA, 18 nt, Homo sapiens
cauccacagcguguccuc

SEQ ID NO: 35346 - RNA, 16 nt, Homo sapiens
cagguguauuagacca

SEQ ID NO: 35347 - RNA, 18 nt, Homo sapiens
ccucacacugccuggccc

SEQ ID NO: 35348 - RNA, 20 nt, Homo sapiens
cuccaguaucccucauucca

SEQ ID NO: 35349 - RNA, 23 nt, Homo sapiens
gugcuuuggcuaagauagauacu

SEQ ID NO: 35350 - RNA, 18 nt, Homo sapiens
ucugauuugaaaggagua

SEQ ID NO: 35351 - RNA, 21 nt, Homo sapiens
ugauaacaugaccuggggcuu

SEQ ID NO: 35352 - RNA, 19 nt, Homo sapiens
ccuuacugaaaguaccucu

SEQ ID NO: 35353 - RNA, 20 nt, Homo sapiens
uucucggaacaauuaccuua

SEQ ID NO: 35354 - RNA, 23 nt, Homo sapiens
aucucaccggggaaauuauuuua

SEQ ID NO: 35355 - RNA, 21 nt, Homo sapiens
gcaagccugcucacugucaug

SEQ ID NO: 35356 - RNA, 19 nt, Homo sapiens
uacaaaauagcaccacagu

SEQ ID NO: 35357 - RNA, 23 nt, Homo sapiens
aacagcacaugcaaaggcccuga

SEQ ID NO: 35358 - RNA, 17 nt, Homo sapiens
accaccauaucuggcua

SEQ ID NO: 35359 - RNA, 21 nt, Homo sapiens
acuuacugaaauucccaguca

SEQ ID NO: 35360 - RNA, 21 nt, Homo sapiens
ccccacccgcaccugcagucc

SEQ ID NO: 35361 - RNA, 19 nt, Homo sapiens
cugcaaccuccgccuccca

SEQ ID NO: 35362 - RNA, 21 nt, Homo sapiens
ucaccccaacaccucaccucc

SEQ ID NO: 35363 - RNA, 18 nt, Homo sapiens
uccgccucccagguucaa

SEQ ID NO: 35364 - RNA, 24 nt, Homo sapiens
ugcaaccucugccuccuggauuca

SEQ ID NO: 35365 - RNA, 17 nt, Homo sapiens
aaaagucugucuugcca

SEQ ID NO: 35366 - RNA, 20 nt, Homo sapiens
aaagaacaaaaacacuuccc

SEQ ID NO: 35367 - RNA, 19 nt, Homo sapiens
acugaaacagcuucaccua

SEQ ID NO: 35368 - RNA, 18 nt, Homo sapiens
agucagacucauuguuga

SEQ ID NO: 35369 - RNA, 22 nt, Homo sapiens
cagucuacaaaaagaaaaaaua

SEQ ID NO: 35370 - RNA, 22 nt, Homo sapiens
ugauaaaaagucugucuugcca

SEQ ID NO: 35371 - RNA, 19 nt, Homo sapiens
uuaccaccaccacccuuuu

SEQ ID NO: 35372 - RNA, 18 nt, Homo sapiens
aagacccuaaaacugccc

SEQ ID NO: 35373 - RNA, 22 nt, Homo sapiens
agccuuucugcaggagauucaa

SEQ ID NO: 35374 - RNA, 21 nt, Homo sapiens
cccugugcuggggggccuugg

SEQ ID NO: 35375 - RNA, 21 nt, Homo sapiens
acaauugauguuuaguacuau

SEQ ID NO: 35376 - RNA, 19 nt, Homo sapiens
acagagaugccguauacua

SEQ ID NO: 35377 - RNA, 16 nt, Homo sapiens
accaugacuaugucau

SEQ ID NO: 35378 - RNA, 22 nt, Homo sapiens
acuaccuuuuacaaauguuaca

SEQ ID NO: 35379 - RNA, 18 nt, Homo sapiens
auccuaauacugaccaca

SEQ ID NO: 35380 - RNA, 19 nt, Homo sapiens
auucuacccaccuaugguc

SEQ ID NO: 35381 - RNA, 18 nt, Homo sapiens
caaauaguucguauuuaa

SEQ ID NO: 35382 - RNA, 20 nt, Homo sapiens
caguaggaaaacuucaaaua

SEQ ID NO: 35383 - RNA, 20 nt, Homo sapiens
ccuuccugccaacuguucca

SEQ ID NO: 35384 - RNA, 19 nt, Homo sapiens
gacuuugaaaaauuccuua

SEQ ID NO: 35385 - RNA, 23 nt, Homo sapiens
uaguuuuaggagaguuuuucuua

SEQ ID NO: 35386 - RNA, 23 nt, Homo sapiens
ucaaaacccauuugccguauacu

SEQ ID NO: 35387 - RNA, 18 nt, Homo sapiens
ucugugggguuuuuuugg

SEQ ID NO: 35388 - RNA, 18 nt, Homo sapiens
ugaaaacugaccaaauga

SEQ ID NO: 35389 - RNA, 23 nt, Homo sapiens
accuuuuuccccccucucccucu

SEQ ID NO: 35390 - RNA, 20 nt, Homo sapiens
agagauauuagauauuucuu

SEQ ID NO: 35391 - RNA, 19 nt, Homo sapiens
agcucuagaaugcuuacca

SEQ ID NO: 35392 - RNA, 24 nt, Homo sapiens
cacuucauacaaggaaaacuucga

SEQ ID NO: 35393 - RNA, 21 nt, Homo sapiens
gauacaaucaaaggaacuuca

SEQ ID NO: 35394 - RNA, 19 nt, Homo sapiens
gcaaugauauuaccucuga

SEQ ID NO: 35395 - RNA, 19 nt, Homo sapiens
ucaaaagauuaugaauagc

SEQ ID NO: 35396 - RNA, 22 nt, Homo sapiens
uugauauaugaguauuuaaacu

SEQ ID NO: 35397 - RNA, 19 nt, Homo sapiens
acugguggcaggcuguggc

SEQ ID NO: 35398 - RNA, 17 nt, Homo sapiens
accagagacacacuggg

SEQ ID NO: 35399 - RNA, 19 nt, Homo sapiens
gacggagccucccggcucg

SEQ ID NO: 35400 - RNA, 22 nt, Homo sapiens
gccagggaccgccugcugccaa

SEQ ID NO: 35401 - RNA, 16 nt, Homo sapiens
acuaugaagacauucu

SEQ ID NO: 35402 - RNA, 19 nt, Homo sapiens
ucagguuauuuccuaaugu

SEQ ID NO: 35403 - RNA, 22 nt, Homo sapiens
cacgacaccaucaucgaugcca

SEQ ID NO: 35404 - RNA, 21 nt, Homo sapiens
cugcacccccaguccugggga

SEQ ID NO: 35405 - RNA, 19 nt, Homo sapiens
ugucuguguggcacagaga

SEQ ID NO: 35406 - RNA, 22 nt, Homo sapiens
agcuuccacuuugggaacaugu

SEQ ID NO: 35407 - RNA, 19 nt, Homo sapiens
auagaagagaagacauaug

SEQ ID NO: 35408 - RNA, 19 nt, Homo sapiens
ugucgaugcuuacaucuua

SEQ ID NO: 35409 - RNA, 22 nt, Homo sapiens
gagccaagaucgugccacugca

SEQ ID NO: 35410 - RNA, 18 nt, Homo sapiens
uccgccucccggguucaa

SEQ ID NO: 35411 - RNA, 21 nt, Homo sapiens
ugcagugagccaagaucgugc

SEQ ID NO: 35412 - RNA, 22 nt, Homo sapiens
caggcaauuacuagcccuaguu

SEQ ID NO: 35413 - RNA, 18 nt, Homo sapiens
cccccagcccacccacca

SEQ ID NO: 35414 - RNA, 21 nt, Homo sapiens
cucugccaugagggcuuugga

SEQ ID NO: 35415 - RNA, 19 nt, Homo sapiens
cugauaauaaaugggcucu

SEQ ID NO: 35416 - RNA, 19 nt, Homo sapiens
ggcgucaucucucuucugu

SEQ ID NO: 35417 - RNA, 21 nt, Homo sapiens
uaaaugggcucucucagaggc

SEQ ID NO: 35418 - RNA, 21 nt, Homo sapiens
uccaagauaccagcauuccuc

SEQ ID NO: 35419 - RNA, 20 nt, Homo sapiens
accacagcugccucuuccuc

SEQ ID NO: 35420 - RNA, 21 nt, Homo sapiens
accuaggggaaaccaucucuc

SEQ ID NO: 35421 - RNA, 18 nt, Homo sapiens
acggcugcagacccauga

SEQ ID NO: 35422 - RNA, 19 nt, Homo sapiens
ccccaucuuugacucaguu

SEQ ID NO: 35423 - RNA, 21 nt, Homo sapiens
ccucccccaacucuuccucca

SEQ ID NO: 35424 - RNA, 18 nt, Homo sapiens
cgccucagcccugccucc

SEQ ID NO: 35425 - RNA, 24 nt, Homo sapiens
cgccuuguucugaagcuuucucua

SEQ ID NO: 35426 - RNA, 16 nt, Homo sapiens
cucucccccugcuucu

SEQ ID NO: 35427 - RNA, 19 nt, Homo sapiens
cucuuccuccuccuccucu

SEQ ID NO: 35428 - RNA, 21 nt, Homo sapiens
cuucauuccuccucugucucu

SEQ ID NO: 35429 - RNA, 21 nt, Homo sapiens
gaugccacccucccugaaccc

SEQ ID NO: 35430 - RNA, 21 nt, Homo sapiens
gccccuggagcucagggguca

SEQ ID NO: 35431 - RNA, 19 nt, Homo sapiens
ggccucccugcucugugau

SEQ ID NO: 35432 - RNA, 21 nt, Homo sapiens
ugaugguuucucccagacuag

SEQ ID NO: 35433 - RNA, 19 nt, Homo sapiens
ugcuuccuagcacauucca

SEQ ID NO: 35434 - RNA, 24 nt, Homo sapiens
uggccuccaugaggggcagggcca

SEQ ID NO: 35435 - RNA, 20 nt, Homo sapiens
uucagaauaggucaaaauuc

SEQ ID NO: 35436 - RNA, 17 nt, Homo sapiens
uuccagaaugugguggu

SEQ ID NO: 35437 - RNA, 17 nt, Homo sapiens
uugggagaccuuuguca

SEQ ID NO: 35438 - RNA, 21 nt, Homo sapiens
uuuuggggccaagauggcugc

SEQ ID NO: 35439 - RNA, 22 nt, Homo sapiens
gagccaagaucacgccacugca

SEQ ID NO: 35440 - RNA, 18 nt, Homo sapiens
ugcccucuccccgucucu

SEQ ID NO: 35441 - RNA, 20 nt, Homo sapiens
caaggucaccagguacaguu

SEQ ID NO: 35442 - RNA, 24 nt, Homo sapiens
cccacccacauacauuucugccag

SEQ ID NO: 35443 - RNA, 25 nt, Homo sapiens
cgcgcgccgccgccccgcgcugcug

SEQ ID NO: 35444 - RNA, 19 nt, Homo sapiens
gaaaaguccacaauuuccc

SEQ ID NO: 35445 - RNA, 20 nt, Homo sapiens
gacagggagggcccaucacc

SEQ ID NO: 35446 - RNA, 21 nt, Homo sapiens
gccugagcugucgcaccuggc

SEQ ID NO: 35447 - RNA, 23 nt, Homo sapiens
cuuugcgagcugcauuuggccuu

SEQ ID NO: 35448 - RNA, 16 nt, Homo sapiens
gugaugacagaaucag

SEQ ID NO: 35449 - RNA, 18 nt, Homo sapiens
ugaacgaggcugacugug

SEQ ID NO: 35450 - RNA, 21 nt, Homo sapiens
aaggauucuagaaaauuauga

SEQ ID NO: 35451 - RNA, 26 nt, Homo sapiens
cccugaugguugcaaaggcuugggaa

SEQ ID NO: 35452 - RNA, 19 nt, Homo sapiens
cccuuuuccuuagaccccg

SEQ ID NO: 35453 - RNA, 19 nt, Homo sapiens
ccuguaccuuggcuacuuc

SEQ ID NO: 35454 - RNA, 20 nt, Homo sapiens
ccuucgccuccuggguucaa

SEQ ID NO: 35455 - RNA, 19 nt, Homo sapiens
cucagugacccaucucuga

SEQ ID NO: 35456 - RNA, 19 nt, Homo sapiens
uaggaaacauuuuguugua

SEQ ID NO: 35457 - RNA, 17 nt, Homo sapiens
ucccugagugcaccuca

SEQ ID NO: 35458 - RNA, 16 nt, Homo sapiens
agcggaugcccaauga

SEQ ID NO: 35459 - RNA, 16 nt, Homo sapiens
cacacacacucacuca

SEQ ID NO: 35460 - RNA, 17 nt, Homo sapiens
cagacgcaucccauuuc

SEQ ID NO: 35461 - RNA, 22 nt, Homo sapiens
cagggcgcacacucucgcgcac

SEQ ID NO: 35462 - RNA, 18 nt, Homo sapiens
gcagagugagagccuucg

SEQ ID NO: 35463 - RNA, 21 nt, Homo sapiens
accacgcagucccuccacuuu

SEQ ID NO: 35464 - RNA, 21 nt, Homo sapiens
guuugcuugcagugcuuucuu

SEQ ID NO: 35465 - RNA, 19 nt, Homo sapiens
aaaccucucauuuuuguuu

SEQ ID NO: 35466 - RNA, 19 nt, Homo sapiens
agacguuacauuucauucg

SEQ ID NO: 35467 - RNA, 16 nt, Homo sapiens
cacucucaucugcuca

SEQ ID NO: 35468 - RNA, 20 nt, Homo sapiens
caucuuauguuuguaugaga

SEQ ID NO: 35469 - RNA, 21 nt, Homo sapiens
cuuaaaauaacuaucaugaaa

SEQ ID NO: 35470 - RNA, 21 nt, Homo sapiens
gcccuacaucuugccuuggua

SEQ ID NO: 35471 - RNA, 19 nt, Homo sapiens
gugugugugaguguaugcg

SEQ ID NO: 35472 - RNA, 19 nt, Homo sapiens
uccuaucugaaucucugaa

SEQ ID NO: 35473 - RNA, 24 nt, Homo sapiens
ugguggguucucaaagcaguacca

SEQ ID NO: 35474 - RNA, 19 nt, Homo sapiens
ugugggaguauuuguggug

SEQ ID NO: 35475 - RNA, 18 nt, Homo sapiens
accagccaccccuguccu

SEQ ID NO: 35476 - RNA, 26 nt, Homo sapiens
auggauucaguccuggugugugauug

SEQ ID NO: 35477 - RNA, 19 nt, Homo sapiens
caacaacuuuuguauuacu

SEQ ID NO: 35478 - RNA, 23 nt, Homo sapiens
cccugaugauguaacaccugcga

SEQ ID NO: 35479 - RNA, 23 nt, Homo sapiens
cuaauguuuuugguuuguauggu

SEQ ID NO: 35480 - RNA, 17 nt, Homo sapiens
gagaccauccugcuguc

SEQ ID NO: 35481 - RNA, 23 nt, Homo sapiens
gagccuuugacucagacauuuuu

SEQ ID NO: 35482 - RNA, 16 nt, Homo sapiens
gcuuccauagucuuug

SEQ ID NO: 35483 - RNA, 18 nt, Homo sapiens
ggaaggacucccaccuca

SEQ ID NO: 35484 - RNA, 20 nt, Homo sapiens
uacaguuugcaguggaucua

SEQ ID NO: 35485 - RNA, 20 nt, Homo sapiens
uccaacucucuaagcacuaa

SEQ ID NO: 35486 - RNA, 20 nt, Homo sapiens
ucccugccugauucucugag

SEQ ID NO: 35487 - RNA, 23 nt, Homo sapiens
ugagucccuuccaagugagauug

SEQ ID NO: 35488 - RNA, 17 nt, Homo sapiens
ccuaaaggcugacagug

SEQ ID NO: 35489 - RNA, 17 nt, Homo sapiens
gaucuuugacacuauug

SEQ ID NO: 35490 - RNA, 20 nt, Homo sapiens
aaaauuagcugggugcgaug

SEQ ID NO: 35491 - RNA, 19 nt, Homo sapiens
aauccgagagucccaauuc

SEQ ID NO: 35492 - RNA, 19 nt, Homo sapiens
acaucaacagucuacguca

SEQ ID NO: 35493 - RNA, 19 nt, Homo sapiens
acucaaacuggggauucca

SEQ ID NO: 35494 - RNA, 20 nt, Homo sapiens
gcugcagcauugcacggcac

SEQ ID NO: 35495 - RNA, 21 nt, Homo sapiens
ggccacagucagggcaacuuu

SEQ ID NO: 35496 - RNA, 18 nt, Homo sapiens
uggggcgcguggugugug

SEQ ID NO: 35497 - RNA, 19 nt, Homo sapiens
ccuccguccuccuccuguc

SEQ ID NO: 35498 - RNA, 16 nt, Homo sapiens
ggugcguguuugugua

SEQ ID NO: 35499 - RNA, 22 nt, Homo sapiens
acacagaacuugcugcuguguu

SEQ ID NO: 35500 - RNA, 23 nt, Homo sapiens
ucuuuugaagauagauucuuuca

SEQ ID NO: 35501 - RNA, 20 nt, Homo sapiens
uggagaauucaugccuuuca

SEQ ID NO: 35502 - RNA, 19 nt, Homo sapiens
uuguaguaaugacuguguu

SEQ ID NO: 35503 - RNA, 17 nt, Homo sapiens
acgugagucagcagcaa

SEQ ID NO: 35504 - RNA, 19 nt, Homo sapiens
agagagaaacacacaccuu

SEQ ID NO: 35505 - RNA, 19 nt, Homo sapiens
caacggcugagccagccca

SEQ ID NO: 35506 - RNA, 20 nt, Homo sapiens
cagccggucucaggcugcug

SEQ ID NO: 35507 - RNA, 18 nt, Homo sapiens
ccgaagugccccucugaa

SEQ ID NO: 35508 - RNA, 20 nt, Homo sapiens
ccguggaguaacacagccag

SEQ ID NO: 35509 - RNA, 24 nt, Homo sapiens
cucugaaugaagaggaaccugcgg

SEQ ID NO: 35510 - RNA, 22 nt, Homo sapiens
gaaccguggacacacacugcac

SEQ ID NO: 35511 - RNA, 16 nt, Homo sapiens
gggugaggugucugcu

SEQ ID NO: 35512 - RNA, 23 nt, Homo sapiens
uacccgccugugucgcuuuugca

SEQ ID NO: 35513 - RNA, 20 nt, Homo sapiens
uccuggucacgaucugguga

SEQ ID NO: 35514 - RNA, 18 nt, Homo sapiens
aaacacugacucaaucuu

SEQ ID NO: 35515 - RNA, 18 nt, Homo sapiens
aagaggcacuaaugacau

SEQ ID NO: 35516 - RNA, 18 nt, Homo sapiens
agugaguaaaguagaaua

SEQ ID NO: 35517 - RNA, 21 nt, Homo sapiens
uaugauggaccagguuggcca

SEQ ID NO: 35518 - RNA, 21 nt, Homo sapiens
uccaucagaaauaauacuuua

SEQ ID NO: 35519 - RNA, 21 nt, Homo sapiens
uuacuucaccauuuauugugc

SEQ ID NO: 35520 - RNA, 21 nt, Homo sapiens
acagagccagaucagaaccca

SEQ ID NO: 35521 - RNA, 17 nt, Homo sapiens
acccaucucccccuucc

SEQ ID NO: 35522 - RNA, 15 nt, Homo sapiens
aggagccagucuucc

SEQ ID NO: 35523 - RNA, 19 nt, Homo sapiens
aggcugauuuguuccuagu

SEQ ID NO: 35524 - RNA, 19 nt, Homo sapiens
auggucugaauguaaacug

SEQ ID NO: 35525 - RNA, 19 nt, Homo sapiens
ccagaaaaagugccaguga

SEQ ID NO: 35526 - RNA, 21 nt, Homo sapiens
ccagcugaccaggcaagaccu

SEQ ID NO: 35527 - RNA, 18 nt, Homo sapiens
ccuaccagaggcaaccaa

SEQ ID NO: 35528 - RNA, 19 nt, Homo sapiens
ccugcacccgcuucuuccc

SEQ ID NO: 35529 - RNA, 19 nt, Homo sapiens
cggguuacaggagauccga

SEQ ID NO: 35530 - RNA, 18 nt, Homo sapiens
cugagcggcguuugguuc

SEQ ID NO: 35531 - RNA, 20 nt, Homo sapiens
gagagucgcaaaacugccaa

SEQ ID NO: 35532 - RNA, 17 nt, Homo sapiens
gagugucgcuucccaca

SEQ ID NO: 35533 - RNA, 17 nt, Homo sapiens
gcacccgcuucuucccc

SEQ ID NO: 35534 - RNA, 17 nt, Homo sapiens
gucuaccuaccugccuu

SEQ ID NO: 35535 - RNA, 19 nt, Homo sapiens
uaaguaaaacacuaccacu

SEQ ID NO: 35536 - RNA, 19 nt, Homo sapiens
uacugaauaucaacuguga

SEQ ID NO: 35537 - RNA, 20 nt, Homo sapiens
uggaagacucuuggguccaa

SEQ ID NO: 35538 - RNA, 21 nt, Homo sapiens
uucccucagcuccaacucuuc

SEQ ID NO: 35539 - RNA, 20 nt, Homo sapiens
uucucaagugguuuguugua

SEQ ID NO: 35540 - RNA, 22 nt, Homo sapiens
gagccaagaucgcgccacugca

SEQ ID NO: 35541 - RNA, 17 nt, Homo sapiens
uggaugccuacugugga

SEQ ID NO: 35542 - RNA, 22 nt, Homo sapiens
acagagaacuggaaucucacuu

SEQ ID NO: 35543 - RNA, 18 nt, Homo sapiens
agaaaaaucacugugcug

SEQ ID NO: 35544 - RNA, 18 nt, Homo sapiens
cccagagauucuacccag

SEQ ID NO: 35545 - RNA, 17 nt, Homo sapiens
cgcaaaagauguaccug

SEQ ID NO: 35546 - RNA, 21 nt, Homo sapiens
cuuuaugguucaauaaauaua

SEQ ID NO: 35547 - RNA, 21 nt, Homo sapiens
aagaaucccgcuggcauccug

SEQ ID NO: 35548 - RNA, 18 nt, Homo sapiens
acacucauaguuuugcca

SEQ ID NO: 35549 - RNA, 21 nt, Homo sapiens
gcgccggccgagaaggcgccg

SEQ ID NO: 35550 - RNA, 21 nt, Homo sapiens
accuggcuuguugcuuggcuu

SEQ ID NO: 35551 - RNA, 19 nt, Homo sapiens
caguuucuugcuuucuuca

SEQ ID NO: 35552 - RNA, 22 nt, Homo sapiens
cauauuuguguccucgccagcu

SEQ ID NO: 35553 - RNA, 17 nt, Homo sapiens
gaggcaguggaagaagg

SEQ ID NO: 35554 - RNA, 20 nt, Homo sapiens
uccacacgguuagccgugca

SEQ ID NO: 35555 - RNA, 18 nt, Homo sapiens
accccccagaauuucuca

SEQ ID NO: 35556 - RNA, 19 nt, Homo sapiens
caucaccacccacccuguc

SEQ ID NO: 35557 - RNA, 20 nt, Homo sapiens
cucccagagcaacccugggc

SEQ ID NO: 35558 - RNA, 17 nt, Homo sapiens
cugcuuccagggggucc

SEQ ID NO: 35559 - RNA, 16 nt, Homo sapiens
gggcuuggaaaucuga

SEQ ID NO: 35560 - RNA, 19 nt, Homo sapiens
guccagcugagcuccaccu

SEQ ID NO: 35561 - RNA, 17 nt, Homo sapiens
uccugaaccuggaacaa

SEQ ID NO: 35562 - RNA, 20 nt, Homo sapiens
uccugcuuccccggcacccu

SEQ ID NO: 35563 - RNA, 23 nt, Homo sapiens
ucugggguggacccugugugauu

SEQ ID NO: 35564 - RNA, 23 nt, Homo sapiens
ggcacacgccaccucgcccggcc

SEQ ID NO: 35565 - RNA, 18 nt, Homo sapiens
uccgccucccggguucaa

SEQ ID NO: 35566 - RNA, 21 nt, Homo sapiens
agaaaauccagcagcugucag

SEQ ID NO: 35567 - RNA, 22 nt, Homo sapiens
caacccugugcucucuggcccc

SEQ ID NO: 35568 - RNA, 17 nt, Homo sapiens
ccagcagcuccugcccc

SEQ ID NO: 35569 - RNA, 19 nt, Homo sapiens
ccccagggccccccugagc

SEQ ID NO: 35570 - RNA, 23 nt, Homo sapiens
cuuccauuccauuuagccuuugg

SEQ ID NO: 35571 - RNA, 16 nt, Homo sapiens
guggccaaguggagca

SEQ ID NO: 35572 - RNA, 17 nt, Homo sapiens
ugcaggcucaggcuucu

SEQ ID NO: 35573 - RNA, 18 nt, Homo sapiens
aagcaaagaccuuucucu

SEQ ID NO: 35574 - RNA, 19 nt, Homo sapiens
aguggaggaaagaaugcau

SEQ ID NO: 35575 - RNA, 22 nt, Homo sapiens
ccuggaagaguccacugccaaa

SEQ ID NO: 35576 - RNA, 18 nt, Homo sapiens
cucuauucucugcacuaa

SEQ ID NO: 35577 - RNA, 19 nt, Homo sapiens
cuuuugacuccaucaacuu

SEQ ID NO: 35578 - RNA, 22 nt, Homo sapiens
gagccaagaucacaccacugca

SEQ ID NO: 35579 - RNA, 23 nt, Homo sapiens
gggcugcaaagugacaacugcac

SEQ ID NO: 35580 - RNA, 18 nt, Homo sapiens
ggggaauuggugauuaca

SEQ ID NO: 35581 - RNA, 21 nt, Homo sapiens
uaauccaagauacucaggagg

SEQ ID NO: 35582 - RNA, 17 nt, Homo sapiens
ucaagugauucuucugc

SEQ ID NO: 35583 - RNA, 21 nt, Homo sapiens
ucuggaguacaauggcaugau

SEQ ID NO: 35584 - RNA, 20 nt, Homo sapiens
uggccaggcuggucuugaac

SEQ ID NO: 35585 - RNA, 16 nt, Homo sapiens
acaaacacugaucucc

SEQ ID NO: 35586 - RNA, 18 nt, Homo sapiens
aggaaucaagucuucccc

SEQ ID NO: 35587 - RNA, 16 nt, Homo sapiens
gaagggcaucuuguac

SEQ ID NO: 35588 - RNA, 19 nt, Homo sapiens
ucuuggggguucugcagga

SEQ ID NO: 35589 - RNA, 19 nt, Homo sapiens
aguugaccacugcagcagu

SEQ ID NO: 35590 - RNA, 20 nt, Homo sapiens
ggucuccaaccacagggcca

SEQ ID NO: 35591 - RNA, 25 nt, Homo sapiens
cccaguuacuuaaggaacuaaguga

SEQ ID NO: 35592 - RNA, 21 nt, Homo sapiens
gaccucucagaaaaacuugcc

SEQ ID NO: 35593 - RNA, 19 nt, Homo sapiens
ucauuucugagugaucuca

SEQ ID NO: 35594 - RNA, 23 nt, Homo sapiens
ucugagugaucucacagauuuuu

SEQ ID NO: 35595 - RNA, 19 nt, Homo sapiens
ccccagccgccggcacggc

SEQ ID NO: 35596 - RNA, 17 nt, Homo sapiens
cucucugcccugcuucu

SEQ ID NO: 35597 - RNA, 22 nt, Homo sapiens
gagggcagcuaacaagggcuga

SEQ ID NO: 35598 - RNA, 20 nt, Homo sapiens
ggaggcggcuggugccgcca

SEQ ID NO: 35599 - RNA, 23 nt, Homo sapiens
uacagcuuuuauuugugaauuaa

SEQ ID NO: 35600 - RNA, 23 nt, Homo sapiens
uugcuacagcuuuuauuugugaa

SEQ ID NO: 35601 - RNA, 21 nt, Homo sapiens
aguagccccccugaaguuaga

SEQ ID NO: 35602 - RNA, 19 nt, Homo sapiens
auaaacaacuguggugcua

SEQ ID NO: 35603 - RNA, 22 nt, Homo sapiens
uaggaucaugguauugaccagu

SEQ ID NO: 35604 - RNA, 19 nt, Homo sapiens
uuuuguuugcggcaccuac

SEQ ID NO: 35605 - RNA, 18 nt, Homo sapiens
aucaugcugcaauaugau

SEQ ID NO: 35606 - RNA, 17 nt, Homo sapiens
ccaccccuugccugagg

SEQ ID NO: 35607 - RNA, 16 nt, Homo sapiens
ccagcucccugccucc

SEQ ID NO: 35608 - RNA, 20 nt, Homo sapiens
cugauuuccuccaugcacac

SEQ ID NO: 35609 - RNA, 22 nt, Homo sapiens
gacggcaccccuggcuuccuca

SEQ ID NO: 35610 - RNA, 25 nt, Homo sapiens
uccuugugucuguuucucuguuccu

SEQ ID NO: 35611 - RNA, 22 nt, Homo sapiens
ucuaugcaacuugauccucuag

SEQ ID NO: 35612 - RNA, 18 nt, Homo sapiens
uucaagacuucaagaaca

SEQ ID NO: 35613 - RNA, 22 nt, Homo sapiens
agaaaaauauauauaucugguu

SEQ ID NO: 35614 - RNA, 19 nt, Homo sapiens
ugguuuuaaagccuugaac

SEQ ID NO: 35615 - RNA, 20 nt, Homo sapiens
caccacaagaccuauuaaca

SEQ ID NO: 35616 - RNA, 21 nt, Homo sapiens
acagcaccccugagcugggca

SEQ ID NO: 35617 - RNA, 20 nt, Homo sapiens
caaccuucccccuaccuccu

SEQ ID NO: 35618 - RNA, 24 nt, Homo sapiens
ccugguaagcggagggccugagga

SEQ ID NO: 35619 - RNA, 20 nt, Homo sapiens
cuuacuaguuguuugaccuu

SEQ ID NO: 35620 - RNA, 17 nt, Homo sapiens
gagaggaacagagguga

SEQ ID NO: 35621 - RNA, 21 nt, Homo sapiens
agggccaccaugagcccaaga

SEQ ID NO: 35622 - RNA, 24 nt, Homo sapiens
ccccaccuacaacugaagacaaug

SEQ ID NO: 35623 - RNA, 21 nt, Homo sapiens
ccucuuugcuuccucgguuuu

SEQ ID NO: 35624 - RNA, 21 nt, Homo sapiens
gcauauccagcuccucacuca

SEQ ID NO: 35625 - RNA, 21 nt, Homo sapiens
ggugggugggacccugcuugu

SEQ ID NO: 35626 - RNA, 20 nt, Homo sapiens
agccuaaaacgacacaccca

SEQ ID NO: 35627 - RNA, 18 nt, Homo sapiens
aaguagaagcuuaaacuu

SEQ ID NO: 35628 - RNA, 18 nt, Homo sapiens
cuaggcgguaauugcuuu

SEQ ID NO: 35629 - RNA, 18 nt, Homo sapiens
ugggacacacguguguga

SEQ ID NO: 35630 - RNA, 24 nt, Homo sapiens
acuuguauagaugauuuuuggcuu

SEQ ID NO: 35631 - RNA, 18 nt, Homo sapiens
acuuuuuacuuguauaga

SEQ ID NO: 35632 - RNA, 22 nt, Homo sapiens
gauugcacuugccugccaugau

SEQ ID NO: 35633 - RNA, 17 nt, Homo sapiens
acacaggagccccccac

SEQ ID NO: 35634 - RNA, 26 nt, Homo sapiens
agugacuuccccgguauccacucuca

SEQ ID NO: 35635 - RNA, 18 nt, Homo sapiens
ccauaggagguuugugag

SEQ ID NO: 35636 - RNA, 19 nt, Homo sapiens
cgcgccugcuuuagagaca

SEQ ID NO: 35637 - RNA, 20 nt, Homo sapiens
gccaugguccccucacuuga

SEQ ID NO: 35638 - RNA, 20 nt, Homo sapiens
accacacucuccuucccaca

SEQ ID NO: 35639 - RNA, 20 nt, Homo sapiens
cagcccucuacccuggaugu

SEQ ID NO: 35640 - RNA, 22 nt, Homo sapiens
ucaaguacucaucacccaccca

SEQ ID NO: 35641 - RNA, 20 nt, Homo sapiens
aaacgaaagcacaccaccca

SEQ ID NO: 35642 - RNA, 15 nt, Homo sapiens
aaguaaaagagcuua

SEQ ID NO: 35643 - RNA, 18 nt, Homo sapiens
cagucaacaagcaccuuc

SEQ ID NO: 35644 - RNA, 21 nt, Homo sapiens
cucaaagaacacaguagcacc

SEQ ID NO: 35645 - RNA, 19 nt, Homo sapiens
cugucuccccauccuucca

SEQ ID NO: 35646 - RNA, 19 nt, Homo sapiens
ucuauaacaguaaacccca

SEQ ID NO: 35647 - RNA, 19 nt, Homo sapiens
ugcaguagccuguccccaa

SEQ ID NO: 35648 - RNA, 20 nt, Homo sapiens
uugcucccaagggcccucac

SEQ ID NO: 35649 - RNA, 24 nt, Homo sapiens
accagacaaugaaugaacuaugaa

SEQ ID NO: 35650 - RNA, 23 nt, Homo sapiens
cuauuaucaccaaacaauauguu

SEQ ID NO: 35651 - RNA, 24 nt, Homo sapiens
uaccaucucucucucccccuaccu

SEQ ID NO: 35652 - RNA, 24 nt, Homo sapiens
ugaauuaaacccauugugagguug

SEQ ID NO: 35653 - RNA, 17 nt, Homo sapiens
ugcuagucauaacugua

SEQ ID NO: 35654 - RNA, 17 nt, Homo sapiens
uguacuaguuacuauga

SEQ ID NO: 35655 - RNA, 18 nt, Homo sapiens
ccucuaauaagacaucgg

SEQ ID NO: 35656 - RNA, 19 nt, Homo sapiens
gccucuggcccaggaguua

SEQ ID NO: 35657 - RNA, 17 nt, Homo sapiens
aggccacgagaagcugc

SEQ ID NO: 35658 - RNA, 22 nt, Homo sapiens
auccugcaacagcuggacucaa

SEQ ID NO: 35659 - RNA, 17 nt, Homo sapiens
ccuaggcguauguguau

SEQ ID NO: 35660 - RNA, 18 nt, Homo sapiens
gauggcuccugccccaua

SEQ ID NO: 35661 - RNA, 18 nt, Homo sapiens
ugacaaggaaggaguuga

SEQ ID NO: 35662 - RNA, 16 nt, Homo sapiens
caaaucugaggccugu

SEQ ID NO: 35663 - RNA, 22 nt, Homo sapiens
gcggaggaggggccccucuuuc

SEQ ID NO: 35664 - RNA, 20 nt, Homo sapiens
aucaacaccauaacaucaca

SEQ ID NO: 35665 - RNA, 24 nt, Homo sapiens
caacgcucggaaaccgccagacac

SEQ ID NO: 35666 - RNA, 23 nt, Homo sapiens
cccaggaggcggggcgccugugg

SEQ ID NO: 35667 - RNA, 17 nt, Homo sapiens
gaaccugcuaaggccau

SEQ ID NO: 35668 - RNA, 21 nt, Homo sapiens
acuggaugucuuucuucuuca

SEQ ID NO: 35669 - RNA, 21 nt, Homo sapiens
augagagcuccagccauucca

SEQ ID NO: 35670 - RNA, 18 nt, Homo sapiens
cacccagccuugcugccu

SEQ ID NO: 35671 - RNA, 21 nt, Homo sapiens
agccauguccuccaagccucc

SEQ ID NO: 35672 - RNA, 21 nt, Homo sapiens
ucugaguaaacaguaauuacu

SEQ ID NO: 35673 - RNA, 19 nt, Homo sapiens
agaaggaaaaaacauuuaa

SEQ ID NO: 35674 - RNA, 20 nt, Homo sapiens
cuuagguaaucccaaaaacu

SEQ ID NO: 35675 - RNA, 20 nt, Homo sapiens
gaguccauucaccugagaaa

SEQ ID NO: 35676 - RNA, 19 nt, Homo sapiens
acucuuuucaucuucugca

SEQ ID NO: 35677 - RNA, 22 nt, Homo sapiens
cacacgugcucacccacccgca

SEQ ID NO: 35678 - RNA, 23 nt, Homo sapiens
ccucccucuuggugggucugugg

SEQ ID NO: 35679 - RNA, 18 nt, Homo sapiens
cuugaugggggcugugag

SEQ ID NO: 35680 - RNA, 23 nt, Homo sapiens
gaaaccaggacaggccaucugca

SEQ ID NO: 35681 - RNA, 19 nt, Homo sapiens
ggacaggccaucugcagug

SEQ ID NO: 35682 - RNA, 18 nt, Homo sapiens
gugaaagcagccagcuca

SEQ ID NO: 35683 - RNA, 17 nt, Homo sapiens
agauuuccauucccaca

SEQ ID NO: 35684 - RNA, 20 nt, Homo sapiens
aguuguuaaacaacaugcua

SEQ ID NO: 35685 - RNA, 16 nt, Homo sapiens
caaagcccgcgcgcug

SEQ ID NO: 35686 - RNA, 21 nt, Homo sapiens
ccauuaauaggcaaucauuua

SEQ ID NO: 35687 - RNA, 19 nt, Homo sapiens
ccugcuccuccaaagccag

SEQ ID NO: 35688 - RNA, 23 nt, Homo sapiens
ggacuuuccagugaugccacuga

SEQ ID NO: 35689 - RNA, 23 nt, Homo sapiens
ucagcauagacuuaauccccuua

SEQ ID NO: 35690 - RNA, 19 nt, Homo sapiens
ugaaacuggaaagccauag

SEQ ID NO: 35691 - RNA, 22 nt, Homo sapiens
uuucuggagcuccuuuaaucuu

SEQ ID NO: 35692 - RNA, 19 nt, Homo sapiens
aggguggacuuagaaagca

SEQ ID NO: 35693 - RNA, 21 nt, Homo sapiens
cgccccugucucaggcaccuc

SEQ ID NO: 35694 - RNA, 24 nt, Homo sapiens
gcgagugcaugugcuacugcugcu

SEQ ID NO: 35695 - RNA, 17 nt, Homo sapiens
aacuauccauguaguca

SEQ ID NO: 35696 - RNA, 18 nt, Homo sapiens
gauggcaguggcuguagg

SEQ ID NO: 35697 - RNA, 22 nt, Homo sapiens
aaaaacuaagaagaacaaugaa

SEQ ID NO: 35698 - RNA, 17 nt, Homo sapiens
accugaagauuguaaua

SEQ ID NO: 35699 - RNA, 17 nt, Homo sapiens
agagaugaaaugugcau

SEQ ID NO: 35700 - RNA, 21 nt, Homo sapiens
cugcucauucuugacauagcu

SEQ ID NO: 35701 - RNA, 22 nt, Homo sapiens
gcaaauuggaaagccaucuuau

SEQ ID NO: 35702 - RNA, 21 nt, Homo sapiens
guagaguuuauuguucagaga

SEQ ID NO: 35703 - RNA, 19 nt, Homo sapiens
ugaucauuuuacuaacaua

SEQ ID NO: 35704 - RNA, 20 nt, Homo sapiens
ugucugugaagcuuuuaaac

SEQ ID NO: 35705 - RNA, 19 nt, Homo sapiens
acaucuauuuccauugauc

SEQ ID NO: 35706 - RNA, 20 nt, Homo sapiens
aggagagccccaguacugcc

SEQ ID NO: 35707 - RNA, 21 nt, Homo sapiens
aguggauggggagucugugug

SEQ ID NO: 35708 - RNA, 23 nt, Homo sapiens
augcccagaaggccaccccccag

SEQ ID NO: 35709 - RNA, 16 nt, Homo sapiens
cacccuacccaguacc

SEQ ID NO: 35710 - RNA, 18 nt, Homo sapiens
caugcccagaaggccacc

SEQ ID NO: 35711 - RNA, 21 nt, Homo sapiens
ccagcccuacaacccccaggc

SEQ ID NO: 35712 - RNA, 23 nt, Homo sapiens
cccagaaggccaccccccagugg

SEQ ID NO: 35713 - RNA, 22 nt, Homo sapiens
gccaggaaacccaccgugugug

SEQ ID NO: 35714 - RNA, 16 nt, Homo sapiens
gcccggcugcuggcca

SEQ ID NO: 35715 - RNA, 21 nt, Homo sapiens
gccuaccaaggugacugugca

SEQ ID NO: 35716 - RNA, 17 nt, Homo sapiens
gcggcuguccagccgau

SEQ ID NO: 35717 - RNA, 19 nt, Homo sapiens
gcggcuguccauuccugac

SEQ ID NO: 35718 - RNA, 24 nt, Homo sapiens
gggcugcguaaggggguccagcac

SEQ ID NO: 35719 - RNA, 16 nt, Homo sapiens
uccagagguaccccag

SEQ ID NO: 35720 - RNA, 21 nt, Homo sapiens
uccagcacgacuguguccucu

SEQ ID NO: 35721 - RNA, 19 nt, Homo sapiens
ucugcggcgccuuggccuu

SEQ ID NO: 35722 - RNA, 22 nt, Homo sapiens
ugcccagaaggccaccccccag

SEQ ID NO: 35723 - RNA, 20 nt, Homo sapiens
ugcccaggagcugacuccag

SEQ ID NO: 35724 - RNA, 19 nt, Homo sapiens
aguuguguaaccgugacca

SEQ ID NO: 35725 - RNA, 23 nt, Homo sapiens
cuugagcagucaccucucauuuu

SEQ ID NO: 35726 - RNA, 19 nt, Homo sapiens
guuguguaaccgugaccac

SEQ ID NO: 35727 - RNA, 21 nt, Homo sapiens
uaauuuagaaaugaauuaaaa

SEQ ID NO: 35728 - RNA, 20 nt, Homo sapiens
ugcccaccccauccccgagc

SEQ ID NO: 35729 - RNA, 20 nt, Homo sapiens
uuggguuuuuauuguuguuu

SEQ ID NO: 35730 - RNA, 24 nt, Homo sapiens
agguuggcaggaccaccuccgccu

SEQ ID NO: 35731 - RNA, 18 nt, Homo sapiens
aucccagcugucauuguu

SEQ ID NO: 35732 - RNA, 18 nt, Homo sapiens
gccagggaaaccauucua

SEQ ID NO: 35733 - RNA, 18 nt, Homo sapiens
acagaaaacugcuggcug

SEQ ID NO: 35734 - RNA, 17 nt, Homo sapiens
cagcaggaaauggugag

SEQ ID NO: 35735 - RNA, 21 nt, Homo sapiens
aaaauagcuuugaagauacuu

SEQ ID NO: 35736 - RNA, 19 nt, Homo sapiens
aaaaauguccuuugucaua

SEQ ID NO: 35737 - RNA, 18 nt, Homo sapiens
acaucuuucuuguuucuu

SEQ ID NO: 35738 - RNA, 18 nt, Homo sapiens
agaaaagugcucuugagu

SEQ ID NO: 35739 - RNA, 22 nt, Homo sapiens
aucuuggcucacugcaaccucu

SEQ ID NO: 35740 - RNA, 21 nt, Homo sapiens
cuuuucacuugcuuucauuuu

SEQ ID NO: 35741 - RNA, 18 nt, Homo sapiens
gcagugaacuugcuguca

SEQ ID NO: 35742 - RNA, 24 nt, Homo sapiens
uaaaugccagucuuagugugaagc

SEQ ID NO: 35743 - RNA, 24 nt, Homo sapiens
uaccaugaguuuuaagccucacau

SEQ ID NO: 35744 - RNA, 21 nt, Homo sapiens
uccuuaaauuuguauguauca

SEQ ID NO: 35745 - RNA, 19 nt, Homo sapiens
ucgaugccaggagauucaa

SEQ ID NO: 35746 - RNA, 19 nt, Homo sapiens
uucacuugcuuucauuuuu

SEQ ID NO: 35747 - RNA, 26 nt, Homo sapiens
uuuuuuauauuggcugucuggauuuu

SEQ ID NO: 35748 - RNA, 19 nt, Homo sapiens
agugauccaaucuaagaaa

SEQ ID NO: 35749 - RNA, 21 nt, Homo sapiens
ccugcacaccauagcccaccu

SEQ ID NO: 35750 - RNA, 23 nt, Homo sapiens
gcagaggacucuucagccuguca

SEQ ID NO: 35751 - RNA, 21 nt, Homo sapiens
gcaugacagagggucuuuguu

SEQ ID NO: 35752 - RNA, 21 nt, Homo sapiens
gccagugucagcagucagaga

SEQ ID NO: 35753 - RNA, 19 nt, Homo sapiens
ggcggcggccaccgcggca

SEQ ID NO: 35754 - RNA, 22 nt, Homo sapiens
guucucagcuuuccuuaagcga

SEQ ID NO: 35755 - RNA, 21 nt, Homo sapiens
ugugaccacccuccucuuacu

SEQ ID NO: 35756 - RNA, 20 nt, Homo sapiens
ccuguguucuccucugugga

SEQ ID NO: 35757 - RNA, 19 nt, Homo sapiens
gccaaauggcaaaugugua

SEQ ID NO: 35758 - RNA, 19 nt, Homo sapiens
gguuuaauguagcccagcu

SEQ ID NO: 35759 - RNA, 18 nt, Homo sapiens
uauuacauucuuuccuga

SEQ ID NO: 35760 - RNA, 22 nt, Homo sapiens
ucucuuuugacuaaaucaccua

SEQ ID NO: 35761 - RNA, 21 nt, Homo sapiens
aaaagauaugcaugugcugua

SEQ ID NO: 35762 - RNA, 24 nt, Homo sapiens
agcugcugaagaacauguugcuca

SEQ ID NO: 35763 - RNA, 18 nt, Homo sapiens
aguuguggcucuguuuuu

SEQ ID NO: 35764 - RNA, 16 nt, Homo sapiens
cucaguaagaauguga

SEQ ID NO: 35765 - RNA, 22 nt, Homo sapiens
gaauuauauguacaucucugga

SEQ ID NO: 35766 - RNA, 25 nt, Homo sapiens
ugaaauugauuacaaauacauuuga

SEQ ID NO: 35767 - RNA, 26 nt, Homo sapiens
acaauaggccuuuucuuuaucauuca

SEQ ID NO: 35768 - RNA, 19 nt, Homo sapiens
acuaaaagccacuuuguga

SEQ ID NO: 35769 - RNA, 18 nt, Homo sapiens
caccucauccucaaacuc

SEQ ID NO: 35770 - RNA, 19 nt, Homo sapiens
caugauauucuucaucuca

SEQ ID NO: 35771 - RNA, 21 nt, Homo sapiens
gaccagcaugcuaaucagugu

SEQ ID NO: 35772 - RNA, 19 nt, Homo sapiens
uccucuguucuuccaguuc

SEQ ID NO: 35773 - RNA, 19 nt, Homo sapiens
ucugaaaacugaggagugu

SEQ ID NO: 35774 - RNA, 23 nt, Homo sapiens
ugggguuuguuaacauggaacua

SEQ ID NO: 35775 - RNA, 23 nt, Homo sapiens
uuugccaguuccagaucucuuuu

SEQ ID NO: 35776 - RNA, 24 nt, Homo sapiens
aagaaauacuuuuauguuaucccu

SEQ ID NO: 35777 - RNA, 17 nt, Homo sapiens
gcuuuuacccaaucuca

SEQ ID NO: 35778 - RNA, 21 nt, Homo sapiens
gugccaggguguaucugggua

SEQ ID NO: 35779 - RNA, 20 nt, Homo sapiens
guugaaaacuuaguauauga

SEQ ID NO: 35780 - RNA, 20 nt, Homo sapiens
uucuuugaugcaugcaguuu

SEQ ID NO: 35781 - RNA, 17 nt, Homo sapiens
aagcagccagggucuca

SEQ ID NO: 35782 - RNA, 19 nt, Homo sapiens
agucucacucugucaccag

SEQ ID NO: 35783 - RNA, 20 nt, Homo sapiens
ccucugccucccagguucaa

SEQ ID NO: 35784 - RNA, 19 nt, Homo sapiens
cugcaaccucugccuccca

SEQ ID NO: 35785 - RNA, 16 nt, Homo sapiens
ugugugugacuauuga

SEQ ID NO: 35786 - RNA, 23 nt, Homo sapiens
aacauucucaaaacaucacauca

SEQ ID NO: 35787 - RNA, 18 nt, Homo sapiens
guaacaugauuacauaau

SEQ ID NO: 35788 - RNA, 20 nt, Homo sapiens
gugaacagguucccauacca

SEQ ID NO: 35789 - RNA, 18 nt, Homo sapiens
uucagaguccagauggca

SEQ ID NO: 35790 - RNA, 19 nt, Homo sapiens
agggucccggggcccgguu

SEQ ID NO: 35791 - RNA, 18 nt, Homo sapiens
ccaccgacucccaccucc

SEQ ID NO: 35792 - RNA, 19 nt, Homo sapiens
aaguacuugaauugcuuuu

SEQ ID NO: 35793 - RNA, 20 nt, Homo sapiens
cacauuuaaccuacugucaa

SEQ ID NO: 35794 - RNA, 24 nt, Homo sapiens
ccucaggccccgucccggcgccgc

SEQ ID NO: 35795 - RNA, 19 nt, Homo sapiens
gacugagcaaaauaucuca

SEQ ID NO: 35796 - RNA, 23 nt, Homo sapiens
ucuuuucaauggguuuuaauuuu

SEQ ID NO: 35797 - RNA, 21 nt, Homo sapiens
ugcucuauaaauaguauucca

SEQ ID NO: 35798 - RNA, 18 nt, Homo sapiens
aaagaagucugucuaaga

SEQ ID NO: 35799 - RNA, 22 nt, Homo sapiens
aacugacugauaaagcuguaca

SEQ ID NO: 35800 - RNA, 20 nt, Homo sapiens
aaguuuuaaugaucugccau

SEQ ID NO: 35801 - RNA, 26 nt, Homo sapiens
ccguugaguaaugccaaguuguuuuu

SEQ ID NO: 35802 - RNA, 21 nt, Homo sapiens
cgaauuauuccagguagaucc

SEQ ID NO: 35803 - RNA, 19 nt, Homo sapiens
uagaauuuucccaccaacg

SEQ ID NO: 35804 - RNA, 18 nt, Homo sapiens
ugugccuaacaagcaaca

SEQ ID NO: 35805 - RNA, 22 nt, Homo sapiens
cgccagcuccacucccaccuuc

SEQ ID NO: 35806 - RNA, 16 nt, Homo sapiens
uccccccaccacccca

SEQ ID NO: 35807 - RNA, 20 nt, Homo sapiens
ccuggcggcggcagccgcac

SEQ ID NO: 35808 - RNA, 18 nt, Homo sapiens
ggaccuggcggcggcagc

SEQ ID NO: 35809 - RNA, 24 nt, Homo sapiens
uacuuacugugaugacugcugucu

SEQ ID NO: 35810 - RNA, 19 nt, Homo sapiens
ggaaacacaguccacauca

SEQ ID NO: 35811 - RNA, 19 nt, Homo sapiens
ucugguucuaggccuuuga

SEQ ID NO: 35812 - RNA, 25 nt, Homo sapiens
aaauccuauuucaacacugaaauug

SEQ ID NO: 35813 - RNA, 24 nt, Homo sapiens
auuuaguagaauuuuuuaguuuua

SEQ ID NO: 35814 - RNA, 20 nt, Homo sapiens
cacggaaaugaaagccuuuu

SEQ ID NO: 35815 - RNA, 20 nt, Homo sapiens
ccauuacaguggccuggaua

SEQ ID NO: 35816 - RNA, 21 nt, Homo sapiens
gccauuacaguggccuggaua

SEQ ID NO: 35817 - RNA, 19 nt, Homo sapiens
ggcuuugguacugaaacug

SEQ ID NO: 35818 - RNA, 26 nt, Homo sapiens
ggggacggcgacagcgcggcucugug

SEQ ID NO: 35819 - RNA, 19 nt, Homo sapiens
gucuguuguuacccacgua

SEQ ID NO: 35820 - RNA, 17 nt, Homo sapiens
guggccauccgccgcgg

SEQ ID NO: 35821 - RNA, 18 nt, Homo sapiens
cccgcuccacauuucccu

SEQ ID NO: 35822 - RNA, 20 nt, Homo sapiens
cuagagcccgcugguaugau

SEQ ID NO: 35823 - RNA, 15 nt, Homo sapiens
cucauucuggaucca

SEQ ID NO: 35824 - RNA, 18 nt, Homo sapiens
gcagcacuacaacgugca

SEQ ID NO: 35825 - RNA, 19 nt, Homo sapiens
ggacagccaaguggagcua

SEQ ID NO: 35826 - RNA, 22 nt, Homo sapiens
uaugcaauuuauaugccagaua

SEQ ID NO: 35827 - RNA, 17 nt, Homo sapiens
ucuguggguucuuucaa

SEQ ID NO: 35828 - RNA, 23 nt, Homo sapiens
ugaaugggucucuagacugggac

SEQ ID NO: 35829 - RNA, 18 nt, Homo sapiens
cagccgagaaguuccugg

SEQ ID NO: 35830 - RNA, 21 nt, Homo sapiens
gaccccgagcggcgcugccgg

SEQ ID NO: 35831 - RNA, 23 nt, Homo sapiens
gccaccccccuccauccuggggg

SEQ ID NO: 35832 - RNA, 19 nt, Homo sapiens
augauccuaaacuuuuugg

SEQ ID NO: 35833 - RNA, 22 nt, Homo sapiens
ccuuccacauguuaacaguaga

SEQ ID NO: 35834 - RNA, 22 nt, Homo sapiens
gcugcaaucguauggcuuucuc

SEQ ID NO: 35835 - RNA, 23 nt, Homo sapiens
ggcgcaggacgcggccgaucucc

SEQ ID NO: 35836 - RNA, 20 nt, Homo sapiens
gggagcgguggggagagcau

SEQ ID NO: 35837 - RNA, 19 nt, Homo sapiens
uggagccacagaaccagcu

SEQ ID NO: 35838 - RNA, 20 nt, Homo sapiens
uuccacauguuaacaguaga

SEQ ID NO: 35839 - RNA, 18 nt, Homo sapiens
acugggauaaaaauguca

SEQ ID NO: 35840 - RNA, 18 nt, Homo sapiens
cggaagaacccaucaaag

SEQ ID NO: 35841 - RNA, 20 nt, Homo sapiens
ggaagaacccaucaaagccc

SEQ ID NO: 35842 - RNA, 16 nt, Homo sapiens
acuauuugaaacauuc

SEQ ID NO: 35843 - RNA, 25 nt, Homo sapiens
agcccaucuccugucuugcaguuca

SEQ ID NO: 35844 - RNA, 23 nt, Homo sapiens
cccuggcuguuagggucugggag

SEQ ID NO: 35845 - RNA, 18 nt, Homo sapiens
ccuccagcugucuggccu

SEQ ID NO: 35846 - RNA, 20 nt, Homo sapiens
gcccuucacgccuuaacacu

SEQ ID NO: 35847 - RNA, 24 nt, Homo sapiens
cugcaaaucugcacacacaacgaa

SEQ ID NO: 35848 - RNA, 19 nt, Homo sapiens
cuuuguaaugcaguuugug

SEQ ID NO: 35849 - RNA, 16 nt, Homo sapiens
ugggacggguuuacuu

SEQ ID NO: 35850 - RNA, 25 nt, Homo sapiens
cacacacaccacuaauuucccugaa

SEQ ID NO: 35851 - RNA, 19 nt, Homo sapiens
auggacacacuaacagcac

SEQ ID NO: 35852 - RNA, 22 nt, Homo sapiens
caugguuaaggaaagaaugcaa

SEQ ID NO: 35853 - RNA, 17 nt, Homo sapiens
cugacaaucauugcagc

SEQ ID NO: 35854 - RNA, 19 nt, Homo sapiens
ucuguaaauccaccuuuga

SEQ ID NO: 35855 - RNA, 22 nt, Homo sapiens
aaaacaaaauuaaaacccaaau

SEQ ID NO: 35856 - RNA, 17 nt, Homo sapiens
aaguucucucaaguguc

SEQ ID NO: 35857 - RNA, 20 nt, Homo sapiens
ggguagcaaucuuguugcca

SEQ ID NO: 35858 - RNA, 21 nt, Homo sapiens
uuguugccacaugugcagcaa

SEQ ID NO: 35859 - RNA, 22 nt, Homo sapiens
augggcaucuuccaugccacca

SEQ ID NO: 35860 - RNA, 23 nt, Homo sapiens
ucuaaucaagagaauuuugcucc

SEQ ID NO: 35861 - RNA, 21 nt, Homo sapiens
ugaagaucacaaggugguauc

SEQ ID NO: 35862 - RNA, 20 nt, Homo sapiens
gacuguauaaaugcauuuua

SEQ ID NO: 35863 - RNA, 20 nt, Homo sapiens
gcauaaucacugucugccua

SEQ ID NO: 35864 - RNA, 22 nt, Homo sapiens
uugaaauuuaucauuuuaucau

SEQ ID NO: 35865 - RNA, 22 nt, Homo sapiens
agccacauuuggccaggccucc

SEQ ID NO: 35866 - RNA, 18 nt, Homo sapiens
gauuuauucccuugacuu

SEQ ID NO: 35867 - RNA, 18 nt, Homo sapiens
ucuauuguaugucacuua

SEQ ID NO: 35868 - RNA, 24 nt, Homo sapiens
aacuagcauaauuaacuuaguucu

SEQ ID NO: 35869 - RNA, 23 nt, Homo sapiens
gcaagucuuccagcccugcugcu

SEQ ID NO: 35870 - RNA, 23 nt, Homo sapiens
gcacggccccgucuucugccucc

SEQ ID NO: 35871 - RNA, 21 nt, Homo sapiens
ggaaacagaacacagcaguga

SEQ ID NO: 35872 - RNA, 23 nt, Homo sapiens
uauuucagacuucagaaaccauu

SEQ ID NO: 35873 - RNA, 19 nt, Homo sapiens
uccugcuaaauaaccugca

SEQ ID NO: 35874 - RNA, 23 nt, Homo sapiens
uggaaaccuccucuuccagcuua

SEQ ID NO: 35875 - RNA, 18 nt, Homo sapiens
aaaaggugcuaaaaugau

SEQ ID NO: 35876 - RNA, 19 nt, Homo sapiens
acugaggaugaacuguguu

SEQ ID NO: 35877 - RNA, 21 nt, Homo sapiens
cccacuuuccagaccauucca

SEQ ID NO: 35878 - RNA, 25 nt, Homo sapiens
cuguguuuugcagcauuuuguuuua

SEQ ID NO: 35879 - RNA, 19 nt, Homo sapiens
gcucuuugacacauggaca

SEQ ID NO: 35880 - RNA, 17 nt, Homo sapiens
aaaaacaagcaaacaaa

SEQ ID NO: 35881 - RNA, 24 nt, Homo sapiens
cccacuucucaccaccaccgccau

SEQ ID NO: 35882 - RNA, 17 nt, Homo sapiens
gacaccccgcagcuucu

SEQ ID NO: 35883 - RNA, 19 nt, Homo sapiens
agauauggaaguuaugaca

SEQ ID NO: 35884 - RNA, 18 nt, Homo sapiens
agcagaagauagaugcca

SEQ ID NO: 35885 - RNA, 19 nt, Homo sapiens
ucucauaauggauaucuca

SEQ ID NO: 35886 - RNA, 20 nt, Homo sapiens
cgcuguuaccaagaaugacu

SEQ ID NO: 35887 - RNA, 20 nt, Homo sapiens
gcaaggacucucauuggguu

SEQ ID NO: 35888 - RNA, 18 nt, Homo sapiens
gcgcgcugcuggaucuaa

SEQ ID NO: 35889 - RNA, 21 nt, Homo sapiens
caauagaucuauccuugccag

SEQ ID NO: 35890 - RNA, 18 nt, Homo sapiens
caguggaagcugcuguua

SEQ ID NO: 35891 - RNA, 15 nt, Homo sapiens
ccaggaggcccaccu

SEQ ID NO: 35892 - RNA, 23 nt, Homo sapiens
ccuaaguaguuuugaauuucuuu

SEQ ID NO: 35893 - RNA, 22 nt, Homo sapiens
gagccaagaucaggccacugca

SEQ ID NO: 35894 - RNA, 20 nt, Homo sapiens
uggcuagaaguggcagaggg

SEQ ID NO: 35895 - RNA, 18 nt, Homo sapiens
uggguggaucaguugagg

SEQ ID NO: 35896 - RNA, 17 nt, Homo sapiens
ugucccaguggaagcug

SEQ ID NO: 35897 - RNA, 17 nt, Homo sapiens
caaacaucuuucagcug

SEQ ID NO: 35898 - RNA, 21 nt, Homo sapiens
cacgucucucuggcccacuca

SEQ ID NO: 35899 - RNA, 20 nt, Homo sapiens
cagagugcccaggcacuccu

SEQ ID NO: 35900 - RNA, 20 nt, Homo sapiens
ucuuggcagcagaccagugg

SEQ ID NO: 35901 - RNA, 20 nt, Homo sapiens
uggagaaaucacagagaggu

SEQ ID NO: 35902 - RNA, 20 nt, Homo sapiens
gaacagaagaguccucuguu

SEQ ID NO: 35903 - RNA, 17 nt, Homo sapiens
gagcugaugaaaucuca

SEQ ID NO: 35904 - RNA, 22 nt, Homo sapiens
gguaauggaauaaaggaugcau

SEQ ID NO: 35905 - RNA, 21 nt, Homo sapiens
ucuguuucucaaccuuaucca

SEQ ID NO: 35906 - RNA, 17 nt, Homo sapiens
ugcagcucucuuucugc

SEQ ID NO: 35907 - RNA, 17 nt, Homo sapiens
ugcagcucucuuucugc

SEQ ID NO: 35908 - RNA, 17 nt, Homo sapiens
ugcagcucucuuucugc

SEQ ID NO: 35909 - RNA, 22 nt, Homo sapiens
ugucugguugguuuaacaaaga

SEQ ID NO: 35910 - RNA, 19 nt, Homo sapiens
cccuccccacuugcuuccc

SEQ ID NO: 35911 - RNA, 22 nt, Homo sapiens
uaaaugcuuaucagcaugaaau

SEQ ID NO: 35912 - RNA, 16 nt, Homo sapiens
ccauuagagcuuaaga

SEQ ID NO: 35913 - RNA, 19 nt, Homo sapiens
gauucccgcccgcuuccuc

SEQ ID NO: 35914 - RNA, 22 nt, Homo sapiens
gguauuuucuccaaauguucac

SEQ ID NO: 35915 - RNA, 22 nt, Homo sapiens
accuuagaggcagggaacagca

SEQ ID NO: 35916 - RNA, 22 nt, Homo sapiens
cagcaaugccaaauuucccucu

SEQ ID NO: 35917 - RNA, 21 nt, Homo sapiens
gccccucaauuccaggaguca

SEQ ID NO: 35918 - RNA, 23 nt, Homo sapiens
cacuaugguuaaauaaggucuua

SEQ ID NO: 35919 - RNA, 18 nt, Homo sapiens
cagccauuuagcauuuaa

SEQ ID NO: 35920 - RNA, 18 nt, Homo sapiens
cugucacaguaacacuuu

SEQ ID NO: 35921 - RNA, 18 nt, Homo sapiens
aacuacucaaugaaaaca

SEQ ID NO: 35922 - RNA, 20 nt, Homo sapiens
auauuugugcagaaacugca

SEQ ID NO: 35923 - RNA, 18 nt, Homo sapiens
cgagcggaauuccggcgg

SEQ ID NO: 35924 - RNA, 21 nt, Homo sapiens
ggcaugcucggcagcccggga

SEQ ID NO: 35925 - RNA, 16 nt, Homo sapiens
cccagacuuccucccc

SEQ ID NO: 35926 - RNA, 23 nt, Homo sapiens
gagacgcgacuggcggcuccagc

SEQ ID NO: 35927 - RNA, 17 nt, Homo sapiens
ggcuccagcagggacua

SEQ ID NO: 35928 - RNA, 16 nt, Homo sapiens
cuuaacaaaccuuuga

SEQ ID NO: 35929 - RNA, 21 nt, Homo sapiens
gacagagcugagcucaaaaua

SEQ ID NO: 35930 - RNA, 22 nt, Homo sapiens
aaaaagaacauuuuuccagugu

SEQ ID NO: 35931 - RNA, 19 nt, Homo sapiens
aacuagaaaagucaaagua

SEQ ID NO: 35932 - RNA, 21 nt, Homo sapiens
gacucuaaaagauuugccaaa

SEQ ID NO: 35933 - RNA, 18 nt, Homo sapiens
gggucguugggcccuguc

SEQ ID NO: 35934 - RNA, 21 nt, Homo sapiens
uuuaggaaacgaaauauuucc

SEQ ID NO: 35935 - RNA, 23 nt, Homo sapiens
aaucaccuucagaaucaugucga

SEQ ID NO: 35936 - RNA, 18 nt, Homo sapiens
caccauucuccugccuca

SEQ ID NO: 35937 - RNA, 18 nt, Homo sapiens
cagguugacaccauucuc

SEQ ID NO: 35938 - RNA, 21 nt, Homo sapiens
ccuuccccucuucuucuuucc

SEQ ID NO: 35939 - RNA, 21 nt, Homo sapiens
gccccugccccucuguuggag

SEQ ID NO: 35940 - RNA, 19 nt, Homo sapiens
aaauaaauaggcagagcua

SEQ ID NO: 35941 - RNA, 22 nt, Homo sapiens
aaggcaccucaaagaugucuca

SEQ ID NO: 35942 - RNA, 20 nt, Homo sapiens
agaccagccucaucaacaua

SEQ ID NO: 35943 - RNA, 23 nt, Homo sapiens
cugaaauaugacugccauaugaa

SEQ ID NO: 35944 - RNA, 19 nt, Homo sapiens
guuuauacuugaggacuga

SEQ ID NO: 35945 - RNA, 21 nt, Homo sapiens
ugacugccauaugaaugugau

SEQ ID NO: 35946 - RNA, 24 nt, Homo sapiens
aucauuuauugcaucucauaacua

SEQ ID NO: 35947 - RNA, 18 nt, Homo sapiens
auuaaacagcuauguaaa

SEQ ID NO: 35948 - RNA, 19 nt, Homo sapiens
cucauugucuccuucccau

SEQ ID NO: 35949 - RNA, 17 nt, Homo sapiens
cucugacugcuuugauc

SEQ ID NO: 35950 - RNA, 18 nt, Homo sapiens
cuuccaagcacuucuggu

SEQ ID NO: 35951 - RNA, 16 nt, Homo sapiens
cuucucccucugacug

SEQ ID NO: 35952 - RNA, 20 nt, Homo sapiens
gaaaaacuaaaaaugaacca

SEQ ID NO: 35953 - RNA, 22 nt, Homo sapiens
uuuggguaauucugccacauuu

SEQ ID NO: 35954 - RNA, 25 nt, Homo sapiens
gaauauuugggcaggguuuuuguua

SEQ ID NO: 35955 - RNA, 20 nt, Homo sapiens
ugaacaguuaucacauuuaa

SEQ ID NO: 35956 - RNA, 19 nt, Homo sapiens
ccuccugccgccgccgcua

SEQ ID NO: 35957 - RNA, 19 nt, Homo sapiens
gccgccgccgcugcuccuc

SEQ ID NO: 35958 - RNA, 18 nt, Homo sapiens
guugcuuuuaucacugcc

SEQ ID NO: 35959 - RNA, 16 nt, Homo sapiens
uugugcauagggaagc

SEQ ID NO: 35960 - RNA, 19 nt, Homo sapiens
auucaagugagaaguaaau

SEQ ID NO: 35961 - RNA, 19 nt, Homo sapiens
cucuaaaugugacaugcaa

SEQ ID NO: 35962 - RNA, 22 nt, Homo sapiens
cucucauuuguuaaugcuuucc

SEQ ID NO: 35963 - RNA, 24 nt, Homo sapiens
auaauaaaaaaaaaagcccuuuaa

SEQ ID NO: 35964 - RNA, 23 nt, Homo sapiens
ucauuuucuuucauuuuauauuc

SEQ ID NO: 35965 - RNA, 22 nt, Homo sapiens
acaggaaaaccacccacagcug

SEQ ID NO: 35966 - RNA, 21 nt, Homo sapiens
acucugagggcaaacugcuga

SEQ ID NO: 35967 - RNA, 22 nt, Homo sapiens
auguagacaauacagcuuugga

SEQ ID NO: 35968 - RNA, 24 nt, Homo sapiens
cccuccccuuucucuuucuuucca

SEQ ID NO: 35969 - RNA, 23 nt, Homo sapiens
cccucccugccucggcagcgcgg

SEQ ID NO: 35970 - RNA, 22 nt, Homo sapiens
gcuuccacggcguguuugguuc

SEQ ID NO: 35971 - RNA, 19 nt, Homo sapiens
guuuucauacucgaucggg

SEQ ID NO: 35972 - RNA, 22 nt, Homo sapiens
uccuuacuuccugccucaguua

SEQ ID NO: 35973 - RNA, 22 nt, Homo sapiens
ugcuuuuuccuuugcuucuuga

SEQ ID NO: 35974 - RNA, 22 nt, Homo sapiens
aacaggaaaccaaucaccuggc

SEQ ID NO: 35975 - RNA, 17 nt, Homo sapiens
aaucuuuccauuuaaca

SEQ ID NO: 35976 - RNA, 21 nt, Homo sapiens
aguucaaguucaaagcuguuc

SEQ ID NO: 35977 - RNA, 18 nt, Homo sapiens
cauccucacaacagcccc

SEQ ID NO: 35978 - RNA, 19 nt, Homo sapiens
cucccccgaccaaacccca

SEQ ID NO: 35979 - RNA, 22 nt, Homo sapiens
gcaccacuuucaagaugcuuca

SEQ ID NO: 35980 - RNA, 17 nt, Homo sapiens
uguuucagcucauucca

SEQ ID NO: 35981 - RNA, 18 nt, Homo sapiens
aggaauugaaauacaaca

SEQ ID NO: 35982 - RNA, 18 nt, Homo sapiens
agccccugucuuucccac

SEQ ID NO: 35983 - RNA, 26 nt, Homo sapiens
ccacacagaugguguggaccaugcug

SEQ ID NO: 35984 - RNA, 22 nt, Homo sapiens
gaagagaccagcccuccuccca

SEQ ID NO: 35985 - RNA, 19 nt, Homo sapiens
gggugggggacaggagcug

SEQ ID NO: 35986 - RNA, 19 nt, Homo sapiens
guggauguuacaggguggc

SEQ ID NO: 35987 - RNA, 22 nt, Homo sapiens
cagcuguuccaccuggacccca

SEQ ID NO: 35988 - RNA, 23 nt, Homo sapiens
gaggccauccucuccauccgaga

SEQ ID NO: 35989 - RNA, 22 nt, Homo sapiens
gccugcuccauggaggcagaga

SEQ ID NO: 35990 - RNA, 21 nt, Homo sapiens
ggaggcgcggcggcugcaggc

SEQ ID NO: 35991 - RNA, 23 nt, Homo sapiens
guggcuuuguuuccaguuuuugu

SEQ ID NO: 35992 - RNA, 18 nt, Homo sapiens
uggccuuaaugcuaaagc

SEQ ID NO: 35993 - RNA, 23 nt, Homo sapiens
uuccacaccuugaaauaaacaga

SEQ ID NO: 35994 - RNA, 23 nt, Homo sapiens
gagagucucaacagccccuucca

SEQ ID NO: 35995 - RNA, 19 nt, Homo sapiens
gccacgguaaaagcaaaca

SEQ ID NO: 35996 - RNA, 23 nt, Homo sapiens
gcuggacgcggucggccuggucc

SEQ ID NO: 35997 - RNA, 19 nt, Homo sapiens
uggugaaaccccaucucca

SEQ ID NO: 35998 - RNA, 19 nt, Homo sapiens
uuucuggcccuuauugcug

SEQ ID NO: 35999 - RNA, 21 nt, Homo sapiens
caggugauacauagccuggua

SEQ ID NO: 36000 - RNA, 21 nt, Homo sapiens
gaaaaaggacuagaccugugu

SEQ ID NO: 36001 - RNA, 17 nt, Homo sapiens
gccugguacuuuuuugu

SEQ ID NO: 36002 - RNA, 18 nt, Homo sapiens
cugggcggcuccugguuc

SEQ ID NO: 36003 - RNA, 18 nt, Homo sapiens
aaggaugaacugacaccu

SEQ ID NO: 36004 - RNA, 19 nt, Homo sapiens
auauggauuuagauuauca

SEQ ID NO: 36005 - RNA, 24 nt, Homo sapiens
gacugcuuugcauaaaacugggaa

SEQ ID NO: 36006 - RNA, 17 nt, Homo sapiens
gaggagagcuauguuuu

SEQ ID NO: 36007 - RNA, 17 nt, Homo sapiens
gaugaccucgauaugga

SEQ ID NO: 36008 - RNA, 21 nt, Homo sapiens
uccacggcgauucuucccgca

SEQ ID NO: 36009 - RNA, 19 nt, Homo sapiens
caagccagcccucuccucu

SEQ ID NO: 36010 - RNA, 22 nt, Homo sapiens
ccagacgcccaccugugccuca

SEQ ID NO: 36011 - RNA, 18 nt, Homo sapiens
gacucacagcagcaccga

SEQ ID NO: 36012 - RNA, 18 nt, Homo sapiens
gcccugccaggcuugcca

SEQ ID NO: 36013 - RNA, 16 nt, Homo sapiens
guaaaggauauuuggc

SEQ ID NO: 36014 - RNA, 21 nt, Homo sapiens
cacagcugaccccagcgcagc

SEQ ID NO: 36015 - RNA, 19 nt, Homo sapiens
ggagcuuauugugagauug

SEQ ID NO: 36016 - RNA, 24 nt, Homo sapiens
gggugaugcucagacagugugcca

SEQ ID NO: 36017 - RNA, 20 nt, Homo sapiens
uccagcccgcuacgugacug

SEQ ID NO: 36018 - RNA, 21 nt, Homo sapiens
aagggccucgugcaguguguu

SEQ ID NO: 36019 - RNA, 26 nt, Homo sapiens
aaguuugauuccuaacacuggaguug

SEQ ID NO: 36020 - RNA, 17 nt, Homo sapiens
acuccacuucacaugcc

SEQ ID NO: 36021 - RNA, 21 nt, Homo sapiens
ccagggucccuuaacaccucg

SEQ ID NO: 36022 - RNA, 24 nt, Homo sapiens
cccggacucugccccuacaucuca

SEQ ID NO: 36023 - RNA, 21 nt, Homo sapiens
cccuggcaucgguccugcgga

SEQ ID NO: 36024 - RNA, 20 nt, Homo sapiens
cccuucucagccacacuucc

SEQ ID NO: 36025 - RNA, 23 nt, Homo sapiens
cgaugggcaguggcucaccccca

SEQ ID NO: 36026 - RNA, 20 nt, Homo sapiens
cuugacacagucacagugua

SEQ ID NO: 36027 - RNA, 21 nt, Homo sapiens
cuuggggugcucugcacucca

SEQ ID NO: 36028 - RNA, 17 nt, Homo sapiens
gccuaccgcgugcccgg

SEQ ID NO: 36029 - RNA, 15 nt, Homo sapiens
gccugcaggugagcu

SEQ ID NO: 36030 - RNA, 20 nt, Homo sapiens
gcugcuccuccagaggucug

SEQ ID NO: 36031 - RNA, 20 nt, Homo sapiens
ggggauggcgucggagccgc

SEQ ID NO: 36032 - RNA, 18 nt, Homo sapiens
uugagggcuguuuggcuc

SEQ ID NO: 36033 - RNA, 20 nt, Homo sapiens
acagaaaagaaaguaccauc

SEQ ID NO: 36034 - RNA, 23 nt, Homo sapiens
cccagguuacauuuguucuagau

SEQ ID NO: 36035 - RNA, 19 nt, Homo sapiens
cugggcugagauuguuuuu

SEQ ID NO: 36036 - RNA, 17 nt, Homo sapiens
cuguguuuucucucuua

SEQ ID NO: 36037 - RNA, 24 nt, Homo sapiens
ggugggugggugugugugugugug

SEQ ID NO: 36038 - RNA, 18 nt, Homo sapiens
uauguauuuauuuguuuu

SEQ ID NO: 36039 - RNA, 19 nt, Homo sapiens
uggccucaaugugaaauua

SEQ ID NO: 36040 - RNA, 17 nt, Homo sapiens
uucuuaauugauaacac

SEQ ID NO: 36041 - RNA, 18 nt, Homo sapiens
cgacaggcagcgcggcug

SEQ ID NO: 36042 - RNA, 21 nt, Homo sapiens
cgcgcggcgcccgcaggaccc

SEQ ID NO: 36043 - RNA, 18 nt, Homo sapiens
cgauggaagucgacuuuu

SEQ ID NO: 36044 - RNA, 22 nt, Homo sapiens
guguuuuuaccuuggugaaucu

SEQ ID NO: 36045 - RNA, 19 nt, Homo sapiens
aaacuccugaccucaggug

SEQ ID NO: 36046 - RNA, 19 nt, Homo sapiens
agaauacaaguauacguca

SEQ ID NO: 36047 - RNA, 17 nt, Homo sapiens
auccucuccuuuccagg

SEQ ID NO: 36048 - RNA, 18 nt, Homo sapiens
ccuacaaccuccaccucc

SEQ ID NO: 36049 - RNA, 18 nt, Homo sapiens
gagcuuccacuggaggcu

SEQ ID NO: 36050 - RNA, 18 nt, Homo sapiens
uggacuuccggucccugc

SEQ ID NO: 36051 - RNA, 21 nt, Homo sapiens
uuuugagacgggagucucgcu

SEQ ID NO: 36052 - RNA, 19 nt, Homo sapiens
gcagagggaggcacuuuca

SEQ ID NO: 36053 - RNA, 20 nt, Homo sapiens
ggccacggcgcaccacgagu

SEQ ID NO: 36054 - RNA, 18 nt, Homo sapiens
aaacaaacucaaaacaua

SEQ ID NO: 36055 - RNA, 24 nt, Homo sapiens
guguuuuggccacuuggaggaccu

SEQ ID NO: 36056 - RNA, 26 nt, Homo sapiens
uuuuggccacuuggaggaccugggag

SEQ ID NO: 36057 - RNA, 22 nt, Homo sapiens
cuauuuuuuuuaaagcucguca

SEQ ID NO: 36058 - RNA, 28 nt, Homo sapiens
ggaauucugcaagacaacucuucuucca

SEQ ID NO: 36059 - RNA, 20 nt, Homo sapiens
ugcuauuuuuuuuaaagcuc

SEQ ID NO: 36060 - RNA, 23 nt, Homo sapiens
agugacccuccugccucagccuc

SEQ ID NO: 36061 - RNA, 21 nt, Homo sapiens
cuuaagcaaucuuccugcuuu

SEQ ID NO: 36062 - RNA, 20 nt, Homo sapiens
ucuguggagaagggaagaga

SEQ ID NO: 36063 - RNA, 16 nt, Homo sapiens
aaacacugaauccauc

SEQ ID NO: 36064 - RNA, 22 nt, Homo sapiens
aacuuaaacaucuguggaacca

SEQ ID NO: 36065 - RNA, 20 nt, Homo sapiens
cacuuucacacuugccucau

SEQ ID NO: 36066 - RNA, 24 nt, Homo sapiens
ggggacggcggcggcggcggcggc

SEQ ID NO: 36067 - RNA, 22 nt, Homo sapiens
auccaaccaacuacacauuuua

SEQ ID NO: 36068 - RNA, 19 nt, Homo sapiens
acugugaaauugacugugu

SEQ ID NO: 36069 - RNA, 18 nt, Homo sapiens
auggaacuauacauagaa

SEQ ID NO: 36070 - RNA, 21 nt, Homo sapiens
ccucuuuguggcaacagaucu

SEQ ID NO: 36071 - RNA, 21 nt, Homo sapiens
gaguccaucacugugaaauug

SEQ ID NO: 36072 - RNA, 25 nt, Homo sapiens
ucugacuccuuucauucauuccucc

SEQ ID NO: 36073 - RNA, 19 nt, Homo sapiens
ugacuguguccaugugaug

SEQ ID NO: 36074 - RNA, 19 nt, Homo sapiens
uggcuuuuuaaacuccuuu

SEQ ID NO: 36075 - RNA, 19 nt, Homo sapiens
agccuccagccugacccca

SEQ ID NO: 36076 - RNA, 21 nt, Homo sapiens
auccucacgucucccacuuuu

SEQ ID NO: 36077 - RNA, 19 nt, Homo sapiens
ccagacccuguguccccca

SEQ ID NO: 36078 - RNA, 20 nt, Homo sapiens
cccagacccuguguccccca

SEQ ID NO: 36079 - RNA, 20 nt, Homo sapiens
cccucugagcuggccugugg

SEQ ID NO: 36080 - RNA, 22 nt, Homo sapiens
cucucucucuccucucuuucuc

SEQ ID NO: 36081 - RNA, 21 nt, Homo sapiens
cucuuucucucucucccucuc

SEQ ID NO: 36082 - RNA, 21 nt, Homo sapiens
gcccuuccuccauguguuugu

SEQ ID NO: 36083 - RNA, 18 nt, Homo sapiens
gggcccuggugcugccac

SEQ ID NO: 36084 - RNA, 20 nt, Homo sapiens
gguccucccagcccuugcca

SEQ ID NO: 36085 - RNA, 20 nt, Homo sapiens
ucucuccugcaauaacuagg

SEQ ID NO: 36086 - RNA, 17 nt, Homo sapiens
ucucucucucuccucuc

SEQ ID NO: 36087 - RNA, 17 nt, Homo sapiens
ucucucucucucuccuc

SEQ ID NO: 36088 - RNA, 23 nt, Homo sapiens
acccuaaaaagucauuucuugga

SEQ ID NO: 36089 - RNA, 19 nt, Homo sapiens
uccaacauggcgccuggca

SEQ ID NO: 36090 - RNA, 18 nt, Homo sapiens
cuaagagccuggccucca

SEQ ID NO: 36091 - RNA, 17 nt, Homo sapiens
gccugcacaccaccaca

SEQ ID NO: 36092 - RNA, 17 nt, Homo sapiens
ggggcaaccacuggcca

SEQ ID NO: 36093 - RNA, 22 nt, Homo sapiens
ugaguggcaggcgcaugagauu

SEQ ID NO: 36094 - RNA, 23 nt, Homo sapiens
cuucaaaggacccuaucugcaga

SEQ ID NO: 36095 - RNA, 20 nt, Homo sapiens
gaauaauugcagaaaaucuu

SEQ ID NO: 36096 - RNA, 20 nt, Homo sapiens
ggcugccggcgcuccucgga

SEQ ID NO: 36097 - RNA, 21 nt, Homo sapiens
ucauuugaccuugccagcuga

SEQ ID NO: 36098 - RNA, 18 nt, Homo sapiens
uuuggguuggcuugguuu

SEQ ID NO: 36099 - RNA, 18 nt, Homo sapiens
aucuaacaggacauauca

SEQ ID NO: 36100 - RNA, 22 nt, Homo sapiens
gaaagccaaaccaaacaacgaa

SEQ ID NO: 36101 - RNA, 18 nt, Homo sapiens
guguacugguccacuucc

SEQ ID NO: 36102 - RNA, 21 nt, Homo sapiens
ucccuaccaggaggcagucca

SEQ ID NO: 36103 - RNA, 20 nt, Homo sapiens
uugcagggccagaacuucuu

SEQ ID NO: 36104 - RNA, 23 nt, Homo sapiens
caccaggggcaaugcucauucca

SEQ ID NO: 36105 - RNA, 17 nt, Homo sapiens
gcugcugcuguguuugc

SEQ ID NO: 36106 - RNA, 22 nt, Homo sapiens
ggaaggaggcugggacugugcc

SEQ ID NO: 36107 - RNA, 22 nt, Homo sapiens
ucagcgcugccauuuuauuuca

SEQ ID NO: 36108 - RNA, 18 nt, Homo sapiens
ucccucugaccuaccagu

SEQ ID NO: 36109 - RNA, 19 nt, Homo sapiens
ugccaccaccgccgagcca

SEQ ID NO: 36110 - RNA, 19 nt, Homo sapiens
aaacuugucaggacuggcu

SEQ ID NO: 36111 - RNA, 21 nt, Homo sapiens
gggccauaugggaagcugcac

SEQ ID NO: 36112 - RNA, 16 nt, Homo sapiens
aaacaugaaggacucc

SEQ ID NO: 36113 - RNA, 22 nt, Homo sapiens
agcuacagaaguucagccauga

SEQ ID NO: 36114 - RNA, 20 nt, Homo sapiens
agguugggauuaccacacca

SEQ ID NO: 36115 - RNA, 17 nt, Homo sapiens
agugagaaauaagaccu

SEQ ID NO: 36116 - RNA, 23 nt, Homo sapiens
caaaacauuuuauaauauauauc

SEQ ID NO: 36117 - RNA, 17 nt, Homo sapiens
cuuuuucauacauugca

SEQ ID NO: 36118 - RNA, 19 nt, Homo sapiens
uauuucuggaaacauauca

SEQ ID NO: 36119 - RNA, 20 nt, Homo sapiens
ucuggccucuguuuccccca

SEQ ID NO: 36120 - RNA, 24 nt, Homo sapiens
ugugguuucugccuaaaauuggca

SEQ ID NO: 36121 - RNA, 22 nt, Homo sapiens
uguucuucuacuggcugugaug

SEQ ID NO: 36122 - RNA, 21 nt, Homo sapiens
uucagguacauuaagcuuuag

SEQ ID NO: 36123 - RNA, 17 nt, Homo sapiens
aucuuuuuccccucuga

SEQ ID NO: 36124 - RNA, 23 nt, Homo sapiens
cgggcgcaccgcggcccccagga

SEQ ID NO: 36125 - RNA, 16 nt, Homo sapiens
ggcaggugguaccgua

SEQ ID NO: 36126 - RNA, 20 nt, Homo sapiens
ggcccccacccuccacuccu

SEQ ID NO: 36127 - RNA, 17 nt, Homo sapiens
ugcauaccaaccccucc

SEQ ID NO: 36128 - RNA, 23 nt, Homo sapiens
gaguugucauucucaucuaucca

SEQ ID NO: 36129 - RNA, 19 nt, Homo sapiens
gacucuauaacacacgugg

SEQ ID NO: 36130 - RNA, 22 nt, Homo sapiens
gcgcggagcuaagcggcucgga

SEQ ID NO: 36131 - RNA, 17 nt, Homo sapiens
gcgaaguccucgagcca

SEQ ID NO: 36132 - RNA, 16 nt, Homo sapiens
aacucucccuucuccu

SEQ ID NO: 36133 - RNA, 19 nt, Homo sapiens
auggagcagaucugugaca

SEQ ID NO: 36134 - RNA, 21 nt, Homo sapiens
caccacacccggccccccuuc

SEQ ID NO: 36135 - RNA, 20 nt, Homo sapiens
ccucugccucccagguucaa

SEQ ID NO: 36136 - RNA, 19 nt, Homo sapiens
cugcaaccucugccuccca

SEQ ID NO: 36137 - RNA, 21 nt, Homo sapiens
cuggugacauggagcagaucu

SEQ ID NO: 36138 - RNA, 19 nt, Homo sapiens
ggaacuuaacuuggggcua

SEQ ID NO: 36139 - RNA, 17 nt, Homo sapiens
uaccccacccuacccca

SEQ ID NO: 36140 - RNA, 16 nt, Homo sapiens
uuucucaagcuccuca

SEQ ID NO: 36141 - RNA, 22 nt, Homo sapiens
cgcgcgccgccaccgccgccgc

SEQ ID NO: 36142 - RNA, 20 nt, Homo sapiens
accuggagaaaguuaucugu

SEQ ID NO: 36143 - RNA, 19 nt, Homo sapiens
agcuucuagcaucagauca

SEQ ID NO: 36144 - RNA, 24 nt, Homo sapiens
ccaucagcaaccucagaccaaccc

SEQ ID NO: 36145 - RNA, 20 nt, Homo sapiens
uaguuaccuugaauuccugg

SEQ ID NO: 36146 - RNA, 21 nt, Homo sapiens
uauuugaagauuggcuuuucc

SEQ ID NO: 36147 - RNA, 23 nt, Homo sapiens
uccccugcuuguuuuuuuuuuuu

SEQ ID NO: 36148 - RNA, 20 nt, Homo sapiens
uguccauauuugagcuuuau

SEQ ID NO: 36149 - RNA, 21 nt, Homo sapiens
accuaggcuauaugguauagu

SEQ ID NO: 36150 - RNA, 22 nt, Homo sapiens
acuaucaaagggcccuucagga

SEQ ID NO: 36151 - RNA, 20 nt, Homo sapiens
cucaaaauaugaguuuugua

SEQ ID NO: 36152 - RNA, 18 nt, Homo sapiens
cuugaagucuuacaguca

SEQ ID NO: 36153 - RNA, 21 nt, Homo sapiens
gacuuguauaaacacugcaca

SEQ ID NO: 36154 - RNA, 18 nt, Homo sapiens
ggugccaacaugaagcua

SEQ ID NO: 36155 - RNA, 19 nt, Homo sapiens
uggaugguagcaugagcug

SEQ ID NO: 36156 - RNA, 16 nt, Homo sapiens
uggccaggcguagugg

SEQ ID NO: 36157 - RNA, 19 nt, Homo sapiens
uuuaaaaauacugucccag

SEQ ID NO: 36158 - RNA, 19 nt, Homo sapiens
aaaaagggcagaaaucacc

SEQ ID NO: 36159 - RNA, 22 nt, Homo sapiens
agcgguuucucuguucugugau

SEQ ID NO: 36160 - RNA, 21 nt, Homo sapiens
auucuugaaaucaauaaauca

SEQ ID NO: 36161 - RNA, 23 nt, Homo sapiens
ccauaauuccagaaagcaaaagg

SEQ ID NO: 36162 - RNA, 21 nt, Homo sapiens
ccuuugaucuguuuuaaccuu

SEQ ID NO: 36163 - RNA, 19 nt, Homo sapiens
gccuccugucaccucucag

SEQ ID NO: 36164 - RNA, 19 nt, Homo sapiens
gcuucugugccucauuuug

SEQ ID NO: 36165 - RNA, 21 nt, Homo sapiens
guaauuguuauuauugucauu

SEQ ID NO: 36166 - RNA, 19 nt, Homo sapiens
uggguggaucacuugaggc

SEQ ID NO: 36167 - RNA, 17 nt, Homo sapiens
uuuugagacaggguguc

SEQ ID NO: 36168 - RNA, 17 nt, Homo sapiens
aggcagaaggaucacuu

SEQ ID NO: 36169 - RNA, 21 nt, Homo sapiens
cucucucucucuuucauccuc

SEQ ID NO: 36170 - RNA, 17 nt, Homo sapiens
cuuucucucucucucuc

SEQ ID NO: 36171 - RNA, 19 nt, Homo sapiens
gaaauggacagcauuauca

SEQ ID NO: 36172 - RNA, 23 nt, Homo sapiens
ccaucccaccaccucuaccugcu

(The sequence listing continues in the following parts.)

The invention claimed is:

1. An isolated nucleic acid, wherein the sequence of the nucleic acid consists of:
 (a) the sequence of SEQ ID NO: 4642;
 (b) an RNA equivalent of (a); or
 (c) the complement of (a) or (b), wherein the complement is identical in length to the nucleic acid of (a) or (b).

2. A vector comprising the nucleic acid according to claim 1.

3. A probe comprising the nucleic acid according to claim 1.

4. An isolated nucleic acid, wherein the sequence of the nucleic acid consists of:
 (a) the sequence of SEQ ID NO: 1917;
 (b) an RNA equivalent of (a); or
 (c) the complement of (a) or (b), wherein the complement is identical in length to the nucleic acid of (a) or (b).

5. A vector comprising the nucleic acid according to claim 4.

6. A probe comprising the nucleic acid according to claim 4.

* * * * *